United States Patent 9,328,346 (POLYCOMB-ASSOCIATED NON-CODING RNAS) - sequence listing, part 159

SEQ ID NO: 192937 - RNA, 107230 nt, Homo sapiens
gggggcuuugugcgcggcggcggcgggagaggcggcggcggcggccagcacggaggcggaggccgagggggcugugcacaggucgccgcggagaggcgugcgaauuccgagccgagcgccgaggaccgugcuacccaggccgggcugccagccgcaggcuccucucuggcagcagcggcggcgcggcgacccccgucccucggccuccccuucccaucccaccucccgagccuuccucuucccgcagcacgcccggcccggcccggccguggcccuccucagugccggccgccauggcagaggcguccggcgcggggaaaaucuagcccggggauuucaugcggccuagcucgguuccgccuccuccucgcgcggccccagcggcugcccgcaccccagccccacuccgggccuccgugucucuccugugaucgcacugacacggccgggggguuagaauggaacaaacugaagguaaagugcgugugcguguguguaugugugugugugugugugugugugugugcgcgcgcgcgcguguguagugcuaggaagggcugaggagggaacgacggggagggggcgaccuagggauggagcgccagaccccaggaggaauggaaggggaagcggguggccugaaagggcucgaggggaguccugacggaggagcagauggcaaggugggggguguggagggaauuggggggugggccaggggagguggggagugggaugggagucggaguggcgcugagcugggaauugggaaagugggaugggggcggggauaaggauggaucggggaggggcagggaaaggggagaagaguugcauggagauuacagaccuggguggacugauaaauagggagauuuggggauggaguguaggaaccagaagagucugggagaaggggauaaauuugcuggagaaauggggcauuuuaugggaaugaagggagaaaugaggaauggaagugaaggaaaagguggauuaggaaaggggaugaggcaggcugcaauaggagaaugggaaauagacgcaggaaacuggaagacaggauugggcuagggaaggaaauuaacugaaugaugacagggaugagaacgaucgacuuagcgucagagugggaggaagagaaggggauggaggucguuaaaguguuaggaagggaggccuuuuguuccuguauuuguguguauucugugucuuucuuucaaggcuagagaauagagaagcuggugguuaugggauugugauuguugugaaauggggagguguggguuuuacuguuuugagggagaaggcgauguguuuguguuauggaagggaggcagggagagacauggccauaauuugaugguuuuggggagggagugaagauuauuucgauuuaaagggggcaggggcagccauguuugcugccaaggcacugcaguguaaauaaauuccuuuuccucuccgacaucaguaugaaucuggaaggggccaauucagacuguuagcccccuuucuuucuauucaugaacucuuuuccccuuacgucuugggucauuuuaaauuauucauaaccgccaaaggagguagugauguuuuccaucacuaccuuuuugaugcuuuucucccucucuuuacccucuuccuucugguugcaaacaagguaugcuaaugagcugcaguguaaauuuaacccauuuaaucaauuuaaaacuagauuuuuacuagcugaaggaaucauuacuacgcuuacauaucaaacaugaucgugaagucuuuuacguauugaaaauucguuuguuucggaagccucagaagcagucaacauguuuucugcaauucuuuaaguaaacaaggaaauugcaucgguuauuuuacuugggccugugcucuuggcaaagcgcuguguccgggugaaagggguaggaagcucugcuugugguagauuaucggcuugcuguauuuugaauguugaaaaauuagaaauguauguauuuuuaaauaguauuucugauagcucuugcuuauaggugaugagcguguuaagugaugaguguguuaagaauaguauuuucuuuuuuaaauaaacucucuuuuccccaucucuucucuuugccuucauguagcuggcucaauacaaucuccagaugccaguucagcacagugcaaugaucugugaaguaggcaugcaguucuuagagucucauugagaugccaggguuuuuuuguuguuguuuuguuuguucguuuuuugauugaaacuucaguugacucucaggaaacuacaguaacuaauauauucaacuguaacuacuuguacaauuugaaauaauuacuauucuaagguuuaaauccugacaaauuuacagaacauacauugguguuaaguagagccuauuuuauuucauauuggauuaaaugugugugugaccuuuuguuuuuauuauagcaguuggaguaauccaaacuuuaaccuaucacauugauauugaaacuguucucuaauaccaagaaggccuguuaacauuguaauaugguggacucaaaccaguugaacuacauuuaaccuaccuaaauggcaacauccucucaguuguuauacagaagcuuaggauauauucuugguuuguuagaaaaaugaaauugaauguuguuaaagugguacuuuguaaaucuggcuuuuacacuaaaagcacccucucagcuuguaguauuuuaauuugauaauauucagccugaauuuguuugaaauucugugaggaacaguugcauuaaaaaaaaaauucagcaugcuuuuucuggaauuuauuuuuauggcaauuuaaguuuuauaucuccuacuugauugacauguuauuuguaauuagcugguaaauugugugcaugagcuaucagugcugcaaauuuuuaggaaaauaagcaaucauuaaauagaaaaauuuguguuggaagcuuucauugcuuaaaaaaaaaaaaaagaaaaaguuuauuuuuauguaugcagcauccuuuaaagaucaggguuccugcccagcugucauaaguauccugguuccuuggacagguauucauauacgaagaagccuacucuuguuaaauaacacuuauaaccaauuaauauguccaucagcccaccuguuaccuguguuggcuuuuuuuuuucuuuuuuucccuaacccuuaaauuaacaaaugccgucucuuacacugaucagauugaaugaguuuuggauaaaggaaacugucuuugagauuggugauuguugagugaacugucaaaucugauucuaaugacagcguuucuggaauuuauaauaauauucauaauccacuaauagcugcucacaguuguccucacacugugcuaugcugagugucucacaugcaugauuuccuuuuauccuccuaacaguuuuaugaaguuaguacuuuuuuuuuuuuuuuuuuugagagauggagucucacuccuguugucuaggcuggagugcaauggugcgaucucgguucaauacaaccuccaccucccagguucaagugauucucgugccuuagccucccgaguagcugggauuacaggcacacgccaccaugcccuucuaauuuuuguguuuuuuuguuuuuguuuuuguuuugagacggagucucgcucugucacccaggcuggagugcaguggcaugaucuuggcucacugcaagcuccgccucucggguucacaccauucuccugccucagccucuggagcagcugggacuacaggcgcccgccaccacgcccugcuaauuuuuuguauuuuuuaguagagacaggguuucacgguguuagccaggauggucucgaucuccugaccucgugauccacccgccucggccucccaaaguccugggauuacaggcgugagccaccgugcccggccaauuuuuguauuuuuuuuaguagagacaggguuucacuauguuggccaggcuggucucaaacuccugaccucgugaucugcccaccuuggccucccaaagugcuggaauuacaggcaugagccaacacgcccggccaagauggaguuuguuuguuuguucguuuguuuguuuugacacggaguuucacucuuguugcccagguuggagugucucaaaaaaaaaaaaaguuauucacauauucacauauuacagaaggcuaagaaguuaaaaaaauaaaguuagcauucuucuccacugauaaccacuugaaguuucuuguaugucccucuggaaaacuucuaugcauguauguguauauuucucuuaaaauauuuucaaauggaucauacuaucugcauuuugcuuuuuuguuuuuuuguuuguuuuuugagauaguuuugcuguuguugcccaggcuggagugcaguggcgcgaucguggcucacugcagacuucaccucccgguucaagcgguucuucugccucagucucccgaguagcugggauuacaggcaugcaccaccgugccggcuaauuuuuguauuuuuaguagagacgagguuucccaaagugcugggauuacaagcgugagccaccgcaccuggccacuuuuucauuuuaacagccuaucugggacaucuuuuuaaauuaguaccuaugaauccacggcugggcgcaguggcucacgccuguaaucccagcgcuuugggagggaggcugaggcgggcggauugcuugaggucaggcguuugagaccagucuggccaacaugacgaaacacccaucucuacuaaaaauacaaaaauuagccaggugugguggcggcgccuguaaucgcagcuacucggaaggcugagaugggagaacugccugaaccccgagggggaaagccgcaguaagcugagauugcgccaccgcacucuagccugaaugacagagcgagauuccgucucaaaaacaaaacaaggccaggcaugguggcucacgucuguaauucccgcacuuugggaggcugaggcaggaggaucacuugaggucaggaguuugagaccagucuggccagcauggugaaacucccgucucuacuaaaaauacaaaaauuagccgggcaugguggugcgugccuguaaucccggcuacuccggaggcugagacaggccaaucgcuugaacccaggaggcggagguugcacugagcugagauuguaccacugcgcuccagucugguaggcaaagcgagacuccgucucaaaaacaaaacaaaacaaagaacaaaaacaauaaaaauuaguacauauggauccacagcuuuuuuuuuuaaagagucuuguaaguauuucauuguuuaaaacaucgauuaacauuuaguuuguuagcagguuuugcuauuauaaguaaauaauaguugguccugaauuaaguuccuaauagccuguuaaauggaagagagauaguacaacuacuuuauuuuagaagagagaaaacugaggccuauggaagugaagucuggggcuuuuuugacaaacccguuacuugguucuuuacagcacaaccuauuacuuccuuaaaguauuggagcugccuggccgggcgcaguggcucacgccuguaaccccagcacuuugcggggccaaggcggguggaucaccugaggucaggaguucaagaccaaccuggccaacauggugaaaccccgucucuacuaaaaauacaaaaaauuagccgggcccgguggugugcgccuguaaucccagcuacucuugaggcugaagcaggagaaucgcuugaacccaggaggcagagguugcagugagcugaggucgcgccauugcacuccagccugggcaauaaaagcaaaacuuugucucaaaaaaaaaaaaagaaagaaagaauuagagcugccuaugaaaacucaaggugagggggcaaacuuaagguuaaguauauuuaguagaaagaguuaaaggggaguaagcugcagugaggcaagagaucuuguauuuuuucauauuuuauucaccauguugugaacauauaugcauaaaauauuuuuacaugcaaaaaugaauuguguccaaguuaucuugagguguguguuuuuguaugaaguggauuuuaguggacuuuuucuuguuugaauaaaauuaucaauaaaauaagauagcgaugaaacgaaaaaaauuagagguccaucauggucuuagaaaaggaccuggaaaaaaaauagagacauugguaaaaauuuuaaagugagcuaaaaaucccuauuugaaaacaaguuaaaaaucuuagcauggacuguugcuuacuuuauuuaauuuuuuuuuucuaucaagaagaaaauggguuacuuauucauugggaucuuuuaaaacaaaaagauagucuugucuguuguagauacuucagaaauuaaaauuguuaaaacuuuaaaaaugcuuagaacuuggcaucuguccauaaaaucuguuuuucaaugcaauucuguuuuuaguuuuacuuuuuuuuuaaaagcagucuauuauuuuuugaaaaagcaacuaagaugauucauuuauuuguuaauaaacauguccagcauuugaguuuuuaaaugaauggugaacuuuauuucugcaggccaaucuuuuuaugaauuauauuuauaaguuauaaauaauuauacuuauauuguuauauuaacaaggacaaauguaagaaauugcuuauacuaacauuaucuaaccuuuuuuuaaaaagcuuacaguuuuguuuucauuuuuacuguugcuguuaguaaauauguaauaaagacuuuaaacacuucuguaguauguuguaccugcacuguguagcaugaaaagaagguaaagguauauuuuaaauuuuguggacuuagagaauguucaguuuuuaccacauggauguguuguuacuccuaaagcacaacuuuuuugauaagauuuugaauuugaaaaagcucuuugaaaaaguauucuuagcuuguuuuuuuagauguggaucuuuaucgucauuaacugaucuacagugauaacuuuucccccuucuaauauuuaauuacuagguucuuuuuuccaucuacauuuagggcuacuuagagcaagugacuaggaaaaugaaaauuguuaauauucauacuguuucaguuuuagccauguguagcauggaaagauaaaacaugaauaauaccuuacauuuauguggcaucuucugagguguuugguagaauucccacagaauaacuuggcuuuuuaaaaaugugaaguuagaaagcacaagaauuauuauuuauuuauuuauuuuuaaauuuuuuuuucgagacagagucucccucuguugcccaggcuggagugcaggggcgcgaucucggcucacugcaagcuccgccucccguguucgcgccauucuccugccucagccucccgaguagcugggacuacaggcgccccccagcacgcccggcuaauuuuuuguauuuuuaguagagauggguuuucaccguguuagcuaggauggucucgaucuccugaccucgugauccauccaccucggccucccaaaguccugggauuacaggcgugagccacugcgcccaggcaagaauuauuuaacucagucuuaagaugggaaaauuaagauuucagagaccccuucaggccaaauagacugucauguuacggagaauaaaauuuucagauuuccguauaauuaaucuuuucucuuuuuuugugagacagggucuggcucuguugccucugcuggacugaaacucuugggcucaagcagucuucaugucucagcuucucuaguagcugggacuacaggcaggugccacugcgccgggcucuguaugauuacuuaaaacaaauuaagacuguguguguccugauuuuucuucauagcuuauauuacccacauucuaauagauaauuaaauauuaaguaacaaguauuuuucuacauaggugugcuuuuucuuauuuugguguaaguuauauacauauuuccuaagauauauagauuuauuuauuuuuuuuauuuuuagagacagggucuugcucucuugcccaggcuggaguguaguggcaugauccuagaucauugcagucuugaacuccuuggaucaagcaguucuccuagccucauccucuggaguagcuaugacuacacacaugugccacccugcccaacuaauuuuuuuuuuuuugagacagggucuuccucuaccaccuaggcuggagugcaguggcacagucauggcucacugcagccucaacuucccaggcucaggugauccucccaccucagccuccugaguagcugggacuacaggcgugugccaccacacccagcuaguuuugcuuuuuuuuuuuuuuuuuuuuuuuuuguagagacagaguuuugccaaguugcccaggcuggucuugagcuccugggcucaaccaauccucccaccucguccucccaaaguguugggauuauaggcaugagccacugugcuggucccccuagcuauuuuuuaaaauuuuuuuguagagauggagucucacuuuguugccuggcuggccuugaacacuuggccucaagugauccuuauagggaggcguuuuaaauuuaagaauggguagcuuauugggauuucauagguuaaaaaaauuaguuuaucaaauugauuugagauuaagaagaucauauggagauacuccuaguggcauuugggccauagccaagacaauauugugucuauugaaucuuauguuaucuaauuucucuuagcuguggaggcuuaagaaagcuauauguaaaaaacaaacaaaaacuuuaagaaauaggcauuuuaaagccuuuuacguuaugaaaugugaaauauaaaaaaaagcauauaaaacuugaauguacaguauaaacaaauaauuaggaagugaaaauacaaaaauuaggcgugguggcacacgccuguaaucccagcuacucgggaggcugaggcaggagaaugacuugaacaagggaggcguagguuguagagagccaagauugcgccacugcacuccagccugagcgacaaagcaagacucuccaucucaaaaaaaaaaagaagugaacaucggguaacuaucacccagguaauaaguccuuuaagaaaagcugcagagacaaccucauugguuuagcugguauugcuuuggugguaguuggacuuuagggacaaaaauguauugauguccuugguuuuucuuuuuucuuuuuuucuuucuuucuuuuuuuuuuuuuugagaggagucucgcuguguugcccaggcuggagguccaguggcgcaaucucggcucacugcaaccuccgcgucccggguucaagcgauucgccugcgucagccuuccgaguagcucgacuacaggugcccaucaccacacccggcuaauuuuuguaguuuuaguagagacuggguuucgcuauauuggccaggcgugaaccgccgcgcccggcuggugguuuuuuuuuuuuuuuuaauaauaguaagaaccugcggccgggcgcaguggcucaugccuguaaucccagcacuuugggaggccgaggcgggcggagcaccugaggggaggaguuggagaccagccuggccaacauggcgaaacccgucucuacuaaaacuacaaaaauuagccaggcgugguggcaggcgccuguaauaccagcuacucaggaggcugagccaggagaaucgcuugaacccgggaggcggagguugcaaugagccgagauuacgucaccucacacgccagccugggcgaaagagcgaaacugugucucaaaaaaaaaaaaaaaaagaaccugaagaauucauaagcaugcgaguucaacgaauauaaaaacugaauaaccaguuuuuaauuguuauugccagaaggggucucugaacaauauuuuuaagguagcuuucuaacauuuauugucaguguuuagugauuugaaaucuuaguaccuuaccgaugaauaacaaaaaauaauacugaauccuguaagaaagugccauuuuauacaaaauguuguuuguuuagaguucaucucuguugcacuuuuugguaagauucagugauuagguuuuaaauuaacaugcaaacucuaaaaugacuuacuuagaaaaugucgauuugucuauauuguuaauuucuuagcuuaacuaucuuaauuaacaaaaaugaguuugacacuccugcuuuugcaguauuggaaccauucaaaaaguauuaaccugagaaguaaucagugaugacaaucuauguuugacccuucauccuugguacuucuugaguuuuaacuuuucuguaauuugggcaagagaaccaaauuucuuuugaagcuggagaaacugcauuaugcuuuccuggccuucaagaauauuuucuuagguauuuggaaagguuaaguguugauuuuugaggauuaggauagcagaaaaauuugaaugcuuuuuucccacugaguaccugcugaauacggucuauuugcguacaacucugccaugugaacuuugagaaaggcauuuuuauaaauuaaagccuuuauuugguuauuauaauuuugucacucuaaguggucuccuuuuguaugaucucugcaagauucaaaugcaucagaauauaguauuucauauuagauuguggugagaaacuucuugcuuuguuuuauuguauccuugaauucuuuucuguagugcaauagcauguuauucuuuuuuacucccacugaagguuaaauauauuucuugcuaauuuuuccccugcaugggcgauagcgauuuuaaaucuugaacguguauguugaguuuuccuagauguggaaguaaucauaauuugauauuuuuagaaagauaaauuagguaauguggcuuuguguaugcaguagaguuaauaugcuuuuauucaccucaugguuucuaugucauuaccaccuguugguuuuuauuuuuuaauggaaaacuugaacuucuccaaagugacuaguuuuaaaauaacauuuauguaaggauuguuuauacagagaaauugaaaaccagaagguauaaagacaauuaaaauuaucuaaaauucuacuaguuagaaguaacuacuauuaauauuuuguucuauauccuuccaauauuuuuucauauguauuuuuuuuacauaguuggaauugugcauccauauuauuuuguaauauguuuuauuauuuaauauauuaugaaauaaauguuugugauuuaaaaaaucaauauagaauuucaguguacaggugugcuauuaucuguuuaccauucuguguugaaggucuuuuaggcaguuugcaauuuugggauauuguaaguugauggacauccuuauacauuaaaaaaaauuauauggcugauuauuucauuacaauaaauuccuagaaguagaauuacuuaaaagauauaaacauuuugaaagcuuuugauacauauuuccaaacuguucucuugaaagauuuuuuaaaauaauaguuuuauugagauauaauucacauacccaaaauuuauccauuuaaaguauacaaugcaguggcuuuuaguauguugacgggguuauauaaccaucaccacaaucaauuuuagaacauuuccagaaagguuugaaccaguuuaaacccagcaauauuauaaaguuuuguuuuaaaaacagcauuuauucauaacauuuaaaguaguacaguauacaggaacacaacagcuugugugauauauacuuuauaugcauuugagagagauuuuagaaaguccuucaugagaagaugaugcuccuacgucccauuuuaagaaaaccugacauauuaagcuuaagcugauuaaacaaaauaugagguauauuuuuuugaauuauaaaauuauucuccugagccugggcgacagagcgagacucugucucaaaaaaaaaaaaaaaaaauucuccuggacagucagaaugucuuuauugagagaguauuguguaugguuuaaaauuuuuuuaaaaaauucaaauuugauuuagaaacacuuuauuuuagaaaacaucuguggaaaguauguuuuaccuauacaguuaacuguagcaaacuuaucaccuuauagaaaauaugguuuucuuuuaagagagguuugcuuuguucuaauugaccuuccccccgaaaguuguucuuuuguuauguucgcuuaagccguuuaacaaaacauuuuuuaaaaacugggugggcuggcugggcgugguggcucacaccuguaaucccagcacuuugggaggccgagguggguggaucacuugaggucaggaguuugagaccagccuggucaacauggugaaaccccaugucuacuaaaaauacaaaaauuagccaguguuguggugcacgcguguagucccagcuacucaggaggcugaggcaggagagucgcuugaacccagaaggcagagguugcagugagcugagaucgugccacugcacuccagccugggcaacagagcgagacucugucucaaaaacaaaaacaaaaacaaaaacaaaaaacaaaacugggagggcagugaaguauagggcaagagucaaggagaucugaguuccuauccccacuucacuuuaccacugaagaucaguguucuuaucucuaaaagugcaaaugaaaauuauucuuggaguuacagggauucaaauuagaaguacuagagugugcguagaacuguaccagacacauaguugauaaugaauaacuuuuuuaauagaagaaaaauaguguacacaaaaugaacuagucuuuagucacauguuuaauggaagaagaacugaacucaauuggcuaaacucacuuucauagaaguuaaaaguugaacaucaacuaauaccugaagagaaucuuugccuagguuauaugaguuuuucuuaauuguugagagaauucaugcugguucaaguuugaacaugaaguuaacuuuccaguccaauuuuacuuccacuguuuuauuacaacucaugauggcuaaagcuucacuaaagcuugguguucugauuaaacaaacaggugaugugaaauuuggauauauaguaugaaauucugaauuuucuaacuuuuauuacuuauuuugaaaacuacauguugaauacuaaaauacuacauguugaaccuaaaauacuaaagcgauaaacaaaaaaaacaaaacccaaacuggucuuuauagaaaagauaaacuuaguaaauuauuauuuagauauaauaaauugcuuagugccuuaaaaacuacauaucaucuuuggcauacauucucuuuugccuuuuuugggggaauggaggauacaagcuaaaagaaaguaaauuugaaugcuugcaaaauuuuaagaaccaaucucaaaccauuuuaccauaauuuaaaaguuuguccaggaaauagguaagaaaauauguggaugaacuuguuaguuuacuagauuucauagugaauggaacaagaugacugaugaaaguuguuuguaguaauuuucauugugagcaacuacccuugcuguaaaggauuggaaaauaauguaauuuccuucaagugguaauaccaugucuguuguugcuggguguggucagcaacaaagcgaagacaguugagguuaaacuagauagauaagggaaacaggguguuuuacuaguaagcuuuguauugguaaaaggcaguucaauaguaaugugguuuagucaggaaaaaaauaugaacuacaaagccaccuaaaauguuguauaacuuaauggaaucauagucaagugaaaacuguaugauugaauuuagugacaggauuuaugguuaaaugaaacacuuuuuuguuguuguuguuuucuuuuuuguauuuuguuaacuaaguucuacuucacgcagguuacuuccuaauucaggauauuuuaaugucuuuaaucaucauccuucucuaaacaucuuucucuaaauuuuuaguggaaaauuuaaagugaacacauuucagaaaauauuugaggugacaacgcuaaaguuaaacagauuauggaguagcacaguuauucuuuacagauaauuugcugccuggugcaguggcucacaccuguaaucccaacacuuugggaggccaaggcgaguggaucaccugaggucaggaguucgagaccggccugacuaacaugguguaacccccuuuagcugggugugauggugcaugccuguaaucccagcuacuugggaagcugaggcaggagaaucacuugaacccuggaggcagagguugcagugagccgagauugugccagggcacuccaaccugggcaacaagagcaaaucucugucucaaaaaaaaaagauauuuugcuuuauuaauaguuuaaacucagaaaaguuuaaaaaaaguuaagagaaaacauacaacuucucuaacacaccuugauuccuuacuaggauuuuguaaagagaaucguggccaugcugauuuuacucccuaaaauccuaucuaugucacuaacuguauugguugugaauuucauauaauuguuugauauuacaaauaauggucaucuuaaauaauguuaaggugauagaugagauuuaaaguuaguuuuuuauuuauuuauuuuuuugagacagagucucacucugucacccaggcuggagugcaguggcacaaucucagcucaccgcaaccuccaccucccggguucaagugauucuccugccucagccucccuaguagcugggaccacaggcaugcaccaccacacccaacuaauuuuuguauuuuugguagagacaagguuucaccauguuggccaggcuugucuugaacugcugaccucaagugaucugccugccucggccucccaaagugcugggauuauaggcaugagccaccacaccuggccaaaaguuaguauuuuaaccacauauauauauauauucuuuucagaaugaaaacucaagcccuacacuuauguauugauaauaggaggaaucacagcucauuuucccauuuuucguggucauuuuauauauguggaucaccugauccaaccuuucuuaugauguuaaaugaaaacccaaagauacugucuguccucggaauuuaugcagcuaaguuagggguagaagcagaacuaaaauucaagucuuaugacucuaagaccaauguuagaguacauccuucuacucuguggacauuuugcuugucccuagguauaugaguuugucuuacucuggcauagagaucuauuugcugaacuuccucuuaugugacuucuuucuagcaucacaguaauauuaacagauuucuuuaaaaauuuauaauucuuauuuaauauaagcuuuuaaaggauguuuuuguuaagguaaaauuugaaaaauaauguagaucagcacugucuaauagaauuuucuaugaugacagaaauauucuguaucugcacugaccaauaugguaaccuuagccacauguugauguugaaugcuugaaauauggccauuguaacugaggaacuaaauuuuuaauguaauuuaauuuuaacuuguuuaaauuuaaauagcuacgugugguuagcccagaauuagcuauucuuagugaagggaaagaauuaaguagauauaggcugggcacguuggcucacaccuguaaucccagcacuuugggaggccgaggugggcagaucaugaggucaagagaucaagaccauccuggccaacauggugaaaccccgucucuacuaaaaauucaaaaauuagccaggugugguggcgggcgccuguagucccagcuacucacgaggcugaggcagagaauugcuugaacccaggaggcaaagguugcagugagcugagaucauaccauugcacuccagccuggcgacgacagagacucuaucucaaaaaaaaaaaaaaaagaauuaaguagaugugaacauaauuguacauucuuugccuugugauuacuauauuuguguguuuuugugggcuagauguuuaaaaucucauuuuuccaguguguuugcuacguuagaugguaaauaaauucuucauggcaaagaaagauaacuauaacuuaucaguaauaguuguuugaaagcuggaauauuuuaaaagucuuuuaaucagugcaauuacuagcagacuauagauugccgaccaacaaaaugauuuaaauacagaaugcauugccuucauuucagcuuuuuuuuuuuuuuuuuuuuuugagacagagucucacacuaucacccagacuggcgugcagaggugcgaucuuggcccacugcaaccuucgccucccagguucaaaugauucucaugccucagccucccgagaguuccauuucaguauauuuuggaucaguuauguuuacauaacauuuaagauuuaaacuuuauacuacauggaauacuugaguaaaccguaauuuaaaucuuuuuacuauagccauaacucagaagccucugaaacagagugaacgucaaaggaaauaaaaguaccugaugaucaucuuuuuccuugucuuuuuccagccucucuauaugacugauuccugguuuugguuucauuaguuuuuuaauaagaaucuaagccgggugcgguggcucacaccuguaaugccagcacuugaggucaggaguucgagaccagccuggccaacaugcggaaaccccgucucuacuaaaaauacaaaaauuagccaggcaugauggcgggcaccuguaauugcagcuacucugguggcugaggcaggagaaucgcuugaaccugggaggcagagguugcagugagcugagaucgugcuaguguacuccagcuugggugacagagcgagacuccgucuucaaagaaaagaauccagccccccgucccuguauuguauuacccuguuuuauaguagcauaucacuaucugaaauuuccauguuuauuuuagcuccaugagacuagaaucuuauuucuuuggauuucccaagaucuagaacagggucugguacauaguuaguguucaguagugaaccacaucacagacaaaaacaaaaauaagacucuacaaggagaaagauauauaacauggcacuuggagucugggaauaggcaaggugagacucagcuuuugcuuaucuuggcaguguuggugugggugauucaagcugguuaguuuaauuuuguauagaaauguuucucugcgaacucaauuaaaaacaaaacuuuuguccagacauacaauauauacuaaauaaauucuaucugccucauggagcuggaaaagggaaacaaacaugagaaaauauuuccguggucaguuuuugacuagucagucucauuuauuugggaaaacagagguuaugggauuuacucaaaugccuguucuugaguaguguuuuaaaaugugaaugaaagucuguuuauuuaggaaacuugcacauuauuuaucuuuacaaaauaaauuuccaccuagugauuacucuuuagaaaaauuguuggauuaauauaauucuuugugauggcuaugaggggcuuuucuuaaaacugugacuauuauauguuuaaauuaacaagacuuuaaaaaaugauucuuacuauagugcugucuuuauuacuacaaguuuucuuucucccuauauauuuuuaugaaaaucagccacaaaauucaauguggcccagagauuuugguugucagaaauggaaaaucuuaaauagguguuuuaguaguaaaaggacccauagcauuuuauuaugucaugcauaguaguggcuugacugccauuuuguuauuuguaucaggucuaccccuagaaugagaguaaacuccagaguauagaaagcugcggcagcugugccaaugaaaugggagaaauucuuuccauuucuucugcuuaugugagagaugacaguaacacccuaccagcaauuaaaaucuaauggcuuuuccugguuguccagggacaaauuguaggucacaucaucaugccuguaucuauagauaaaacuauuuauguuguaauggggcaagacuucuguuguuguuguuguuguuguuguuguuguuguuguuugagacggagucuugcucugucacccaggcuggagugcaguggcacgaucuuggcucacugcaaccuccaccucccagguucaagcgaucgucccaccucagcccccugaguagcugggacuacagacgcgcaucaccaugccuggcuaauuuuuuuuuguauuuuuaguagacacgggguuucaccagguuggccaggcugaccucgaacuccugaccucaaagugauccacccaccuuggacucgcaaagugcugggauuacaggcaugagccaccgcgccuagccuaagacuucuuuuuuaagugauauuucuauuuuggguacaccaaaucuuagguuaaugaaucuaaggauuccccuccuucuguuuauagggaugcuccugaaacugaagacaaccaagugaguggaaaggcuuucagaaaaacccuuguugcugcuguaacaaauuacaacaaacuuaauggcuuaaaacgacacagauuuauucuuuuacauuucuugaugucugacaugggacuaaaaucaaggugucagcggcagaggugcguuccuucuggaggcucuaggagagaaacuguuaccuugauuuaucuagcuguuuccuucccuuuuuuuuuuuuuuuuuuuuuuuugagacggagucucacucuguuacccaggcuagagugcaggugcaaucucagcucauggcaaccucugccucucagguucaagugauucuccugccucagccuccagaguagcugggacuacaggcacgcaccaccaugcccagcuaguuuuuguauuuuuagcagacaagagucucaccauguuggccaggcugcucucgaaguccugaccucaagugagcccccgccucugccucccaaagugcugggauuacaggcauaagccaccaugcccggcccucuuccuccauuuucaaagucagcagucuucaaaucucucucugacucugauccuucccaccaaaaggaugauaaggauccuugugauuauguuggguccaccugaauaguauaggauaaucucuccauugcagcauuguguuugcugccauuccuauguucauuuagcagcuuucuucccucacauacuaggggauggggauacagcagugagcaagauguagaaguacgcaguaccuucguuaacacggaaguaguuuuguuuuguuuuucuuuccaugacugaaggcacuaccacacuuuacuuuggaaacuaaagauaaaucugaacuucaguuaucagcgcacauuuggcaauucucugagcacugaaguuacucaaagacaccuaaauaucucgugacauuccaaaauaaauugauuuuauguugagcacagguuuuguauuagucuauaaaugauacaaaaaaggaagucuuuuuuuagaguuucagauucucaucauguguuauguucuacagugaugauguugugacaguuucucuuacgcuguucauagugaauguagguuuuguauacugauacaaaagacagagcuucgugucauaauaucccacuguuuaggaaaauaugaaucacaauauguugucaauuguuuauauaugcuuguagaauuauuauuagauucaugguagagcauauuuaaugugguuauguaaauguuuaaaguuucuuggaaaaaaauucuugacaagucgugacucuuuuggaugauguacuuacacucguauuuugagcacuuaauaaaauaucuaauuuuaauuuuccaaugaaaagauuacuugcuaaaauuaaaaaauuacauacuaaacuuuuuaaaaaguuuaaaaauaauuggggcaaauuuuuuuucuguuuuccucugagugacguuacauuuaugaggucuuucuuaggaaggaagaagcaaaucuguacucucaguucaaaauccaugccauuaaaaaacagccugugauauuucaauaauacugcuuaaugguauuagcacauauuaagcuuuuuaaauuguuaauccaaucuugugcccccccccccccccccgccuuacuguaauacucuauucuguuuuggauugauuuguuuauugauaaugugccaggcacuauaguuggcucugggaauucaaggaugaacuaguuucauguccuguaacuuucagucuguccauauucucuggcaucuaaguuguuuuuauuuccuggaauuuuauagugugcuuucauuaaauacuuauaauuugguuuugcaacauaugaagaaaagcccuucuaaaaaucuagaucauuugaaaccugugauauuaagaagccaagaagguucucaauggaagucuuuagguacugguuuauaauaggucuuuggaaaggagcuccucucucuuccacuacagguuagaacuuguuuccuaagccaaaaaugccugagguccccugcauccucucuccccgucgucacacccccagcuucucaacccuggauauuuuccuuugucauccaggacacuugucccuuucugucuuuuuuuuuuuuuuuuuuuuuuuuugagacggagucucgcucuguagcccaggcuggagcgcaguggcgcgaucuuggcucacugcaagcuccgccucccagguucacuccauucuccugccucagccuccugaauagcugggacuacaggcgcacgccaccacgccuggcuaacuuuuuguauuuuuaguagagacgggguuucaccguguuagccaggauggucucgaucuccugaccucgugauccgcccgccucggccucccaaagugcugggauuacaggugugagccaccgcgcccggccccuuucugucuuuuguuuuuauuguucaaguaucaaacauaauuuauuucuggccgggagcagugccuauaagccuagcacuuugggaggccaaggcaggcggcuugcuugaggccaggaguuggagaccagucuggccaacacggugaaacccugucugugcuaaaaauagcaaaauuaggcugggcgugguggcucacaacuguaaucccagcacuuugggaggccaagguggguggaucacuugaagucaggaguuugagaccagccuggccaacauggugaaaccccgucucuacuaauaauacaaaaauuagcugggcuugguggcgcgugccuguaaucccagcuacucgggaggcggagguugcagugagccaagauugugccgcugcacugcagccugggugacagagugagacucugucucaaaaaaaaaauuauuucuccuucauuuauugaaaagagugguccuucuuaugcuuuugcuucguuauuuaauaacuaaaugucauauaacaaguccuguucuggaaggguaacuucuguugauacaucuugaguuuauuauauauagauggagcuagacuacuuuguuuuggaugcauguuguuaguaauuauacaaaaauggcauaauuugcuucacgucuuggaggaaagugaguaaaauuacaugaaaauauaaagggaauguauuuuucccaaauuuuuuuuuuaagcaagcagauuuuccaguuuaacccagaaauuagucagcagcuuagaguucuuucuaaaaggcuaccauggaaaguaccuuuaagucaagauauacagauaagguuuacuaauauagaacauuuguuuuacauacuaaaaugcuguaagcccuuuuugucauuuggagaauugauguuuuauuaguauaacugcugaaaaguaguacaggaaaauguuuuccccuaaaucauagccuuaaacuuugaaagagucagccucaaccagaaugguaguaaaccucuuuaaaugauucagaguuugaccagcagucuuuucaaaccucauaauuuugacauccucaaguuuucauuaaaaaagcuauaggagaacuaaaaauguguuaagugcuuauacaauuaauauauaauggccuuugaaucugagaaguccaaguauaugcauuaccaugggaauuuaagaaauuauuuggacuggcacaguggcucauggcuguaaucccagccaaagugggaggauugcuugaguccaagaguucaagaccagccugggcaacauggcaaaacccugucucuacaacaaauuuuaaaaauuagccaggcaugguggugcacgcccauagucccagcuacuugggaggcugaggugggagaaucaccugagcccaggaaguugaggcugccaugagcugugauugcaccacugcacuccagccucagugauauagugagaccgucucaaaaaaaaaaaaaaaauuguuugagaggaaaugcccacauuuuagugagaaauaauuugcauuuguacuaucgugguucaaacuuuuuggauaacuguaacugccaacuguauaacacuuggaugccacuaaaagcacuguauuuuguuuguggaugaaauagugagaucuauuuuauagaugguguuuguucccucaaaggauaaaauaaucuaaagacaaauagaacaaucacuugcauuuguaauuucauuuuuauuuccuugacaaaacauuuucaagcaggauccguuuuguuugaaaguuaacauugaguuguauagucacuguaccaaauuugguuauugcuuuugucuguagugagggcuagauuagauccuaucgauucuagcugcuuucagugaauaaaagacaaacauuuuuguucauuuccuuuuugguaccauaggggcguggucaaguucuuagaaccaggugguugguuuuuacuuuuuguuuccuccagaaguccacacccacaucucugcuuuuucuuguguauguguggggugagggugaaguuaaaaugugauuagaaaggacucauggcuuucaaaggaagaauauugauuuuuaguguaauuugugcccuguccuuaggguagaaauugacuuuugcuucuguucauacuucauagcaguuugguuuugcugauuucuaaagguauguguuuggguccuuuaaaaauauguauguacuacuucaaaaagggaugaggggcuugcaguuucacaauaaauagcauuaaaaacuuaccuccauuauuuuuaaacaauacacauuuguuacuguauuacuaaaaauuuuuuaauuaugaaaaccuaaaugggcaauaccagaauuuauaacuuauagucaaaggguuacucugaucauauauuuagauuaaaauauuaguagaacacagaaccagaaagaauggagucuuuuuuaaaaacugacauuagaggauuuuagcaucuucuauaguuacgcauuuuuucuuuguagaguuucugguuucacccuaccaaacccauauacugaaaauaauggagcauauuaaaaaaaaaauuaacuguuccuuuccccccauuuacuucuuggugucaauuuggggaaaaauuguaaaacgagaaucucccuugaugcugucacccggagaucuuuauauucugugaucaaaugugagucacauucagaagauguuuuuaggggggcuuugcguguauguacauauuaaauugauuucaaagacaggauccaaauacaggaucacugaaacauuaagugaucauucaguuagaaauuaguauaugaauauauuugauagcuuucucuuuauacuucacagaaucuaugcuuaagcuugucuuuauguacugcguuuaaaacaaaaugacccucuaguuuuuuaacauuauguaucuuaaaaaaaauuuuuuuaaauaauguuuuugcugcauaaauugccaaacaugcuagguuuucaagaaccagcauagcugguucauuacuguagacugucugcauguacuccauuccuguuacuauggaaacacauugaguguggauuuaucauaaaccuugagaaauauuccuugcaacaguucauauaaagaaacaucuggaucccuuguuuauccuggggugaaggaagaccaccgucuuccucuguguugugaaaaucauauuauauuccaccauuuuuuucuagcuguaaaaauucucauguacaucuaucaaguauacuuuguuuuauaguaugauugauuauguuuacuagaacaacuuuggaaaauagauugauuuucaugcugauucaguuaacuacaacuaugacaauuguauuuugagagcuucuacauucugaauuucagaccuacauuaauaagguuuuaaauauauauauacauaugaguuucuuuuuuuaauauauuuuggucuuugguuggguuaacacucccucuggaaguuuauuugacuucauuccagucucuuggaacuuuaaaccuucaugaaaguuaagucuagaacuaaagagaaucucagugacaucuaagugagcuaaguuguuagucucauuuuaccaaggauauuaccugaggagacuguaacugcuuuuauauucuguuacuaccuccaugcaaagacccacagcagcucugugaagcauuucauuuauauaaaauaacuucuuuaaguuuauguaguuuaguuuaaaagauucauugaagccccuccucugagccuuugaguuagguuccaagagcauauaugggaauaacauuacuuccugcucuuaagaaaacucacauaaacagaucauuuuaugguuaauucugagaggcacgcauagaauaucuuagaacacagaggaaaguuacucagacuaacuuagagcuuaagugacuacuucuuggaaaugacauucugagcucaaaagaugguuaagagucaagcaaaaaaaauaaaaaaggaaaaggguauauuauggauaggauauaauauuaguaaaggcacagaggagugaaaucauggugugcagagaaauuuccagugauuuuauauuacuagaguacaaaaaugacuugagguugaagagguagguuagcgaccuugcuuggagggccuuauaugaucugucagucuaagugcuuggccuuuuucugggcaaugggaaaccauugaaggauuuuaaucaauagaguguugugguuugauuuacagauuaaccuaggaauguauuuguagaguagcugugucugaaaacagaaauagacaauuuauaugacaucuuaaaaccacuucuaauuccaaaaugcuuaaauaaugauaucaauguaaggauuuuuuuuuuuuuuuuuuuuuuuuuuuugagauggugucuugcuuugucacccaggcuggagugcaguggugugaucuuggcucacugcaaccuccgccucccagauucaagcaauucuccugccucaccuucccaaguagcugggauuaccggcguguaccaccaugccuggcuaauuuuuguauuuuuaguagagacgggguuucgccauauuagccaggcuggucucaaacuccugaucucaguugaucuacccaccucacccucccaaagugcugggauuacaagcauaagccacugcucccagccuaaggaauuuuuaaguauaauuaaauauaaaguuucuauuauugagaagagacuggcauuuuaaacauagaaaaaaagaauauauacagcacaacauguaauucuauagaguagaaucuagcaauacauuccacagaaauaauuguuuaugaauuuguuauagugacuuaaacuauaaauuuagcacauuaugaauacuuaauugauauuuauaggcucaaguuguucaucugaaacacguaacaugauuucuuucuuucucccucuugcucuuuuuuuuauuuuagagaaagaguuuuacugugucacccaggcuggucuugaaugccuggccucaaacaggcccucuacuucagccuccuaaggagcugggauugcaggcaugagccaccaugccuggcuugauuucuuuuccuguuuuuguuuuuuucaacucuguaucugugauuuggcuuaaggauucuauaaacuuuucuauuaucagcccaccaucccccaccaccaugaauaaguugguaaauaauaagagcacuaaagcuuugauugauaauuuucaacuuuuuuuugcuuauuuaaaacuguauaguuucagcaaaauuagaaguauucauugauugauuuaucuuuuuuaaaaaauuagccuagaaacauuguucagaggaugaauuuaucagaaauguuuuuguguggugauuucauuuacuugaaaguacauauuagaauggauagauuaguacaauuauuuagucucccaccaaauuguuaguuaacucuggggagugggaguggagaagggugaagugagguucuguuguuguuuacauauuuagggauugugggaaguaagcuuacuuguuaagagccaaugcuguggaacagaguguguguuugaacccuccauuuacuugaucucagacuauggcaaguuauuugaucauacuggccuugauuuuucauuuguaaaaugggauaguaauaguauuuccucaaagggguguucugugaaguaaaauaauauaacaaauguaaaauguuuagaauaguauugacacuaagcucucaaauguuagccauuaaaauuauugcuuuaaaaauaaauugaacacauuaucuuuaucagggauuuauuuaggacaaagguuuaagaauuucugauggccuguaccaaguaauuugaaaagcaaugugugaagaacaccuuacuuccacauccuacuuguuucucauggccuaaaugccuccuugcccagcauuuuucuucuccuuagaugucuguuauaauuguaguaguaacacaauucaauucuuagucaucuucuguuucacauuguuugcuacuauuuuaugugucuuacucacaaaaucuuacauuaucuugcuaaagagauugaaaguaccuuuaggucagugauuuuuuuuuuuuuuuaacuuuuuagcaguucuguaugcccagcauugcaaugaaugauaauaauagccaacaaguggccaggcucuaacuguaugccaggcacugucuuaagugcuguucauggauuaacucuuaauucuuacggcagcccuguacaagguacacaauugcagguauccacaauuucuggcuaaggaaacugaggauuagagaugcugaauaaguugccugaagucacacagccagcaggacuugaaguaugcuuuugaacuuaguuugauucugaaccugcacucucaagcacagugcucaguagagcccccuaaucuaguaaggucuuaaccauuuuaucaguuggugugucugcugcgugaaggcuggccgccagacuccgcugcccauaaaaaucacuauguaaagaaauuuacauguagucccaaaauaucuguuuuuaugaacuaccaaaacugcuuucuugauugcauuguuguauuauuuggaggcauaauaugaagaaguauggcccucuuaaugcuuacgguuucuagaaaauauaacaauguggccccuuuagcuuguuugcuuagaacauggcaccagaauuuaauggaggcuuauaccacuuuagguaccuguagcuuuuuauuuuuaguacuucuuccaaacacuagccaaaucauuuguuuuuuuuuuccccgaacuuuucaguuuaaaaauuuucaaaccuuuagaaaaguuaaaagaauauuacauucaacaccuagauucgccaguuguuaaaauuuugucucauuugcuuuacucuagguauauauaccuuuuuuaaaauccucaaccauuugaaaguuguagauaccaugacacuuuaucacauauuucagcauagcucuccuaagaaugagaacauucucguauauaaacagaauagcauuaucagaaccuugaaauuaauagcuccauuguuuaaagccaguucauauuuuaaaauucuuuaguugucuccacaauaucuguuuaaucuuuguguuuguguguauuuaaauccaggauuuaaucaaaguucaugcauuguauuagguugauaaaucuugucucuuuuaaucuagaauagucuuuccaccuuucauuuguuuuagacauuagccucuuugaagagcccaggccaguugucugggagaauaucccccauuuuggauuugucugauuauuuccucacuuuagauucggucuaagcacugggaagaauacuucaaaggaagaaaaugcgagauuugcuaaaugacugguuuuauggcuuaacaaagagggaagaaucaaucaccugugagccugagauuucuagucugggaagcuagaaaagugguggaagcaaugacagacugggguagucugaaagggacauugcacuaggaaaaggacagugcauucaguuuuggacuaaugaccuuuagcguuuaguguaguuguccuuaaguaguugguuauucucuggcgguaggauguugugaaaaagagcacaggauuagaaaucaggagacugauuauuuuucaagcuuuaucacuaauuagcuuuguggucuuggaaagucaguauuugaaguguucuaugugguuaccuaaaaaaugaaguuaaugcacaccuugcccugucagucugacagaguuguuuugaggaucaaauacaaauguauaugaaaacacucugugauacaaauguauauguguucacuccauggacuccuguguaauuauaagaagguaauguuauuuucuuaguucagacuaaaaugaaauauuuggaguuagggcuagagaagacaggaaaaggggaaaauauaaaacuuuuuguguuugaaacucaaucaaaagcaucagaaaucucagucucugaauacauaugccugaaaaacccugaagacuauaauuugggaggcgaaucuggaagcugaucuuguauacaacaguuacaagaaccaaaaacacagguugcaucuuguuagaugucauuauuugacuugccuucaaguuggaaguauaaaugagaacuuuugaauucugccuguguaguugguccaugcuuguuaacagaauuuuuaaacauuuccuucuuaugucuguugcugugagcuauacauuuuugccaaaaguuaaauuaagguaauguuucaguuguuaaacauugucaguaaauaugguaugcuaaucaagagcacagacccuggaacugcgguuuuuuugcagugagccaagaucgugccacugcacuccagccugggugaaucuuggguugaaucuuagccaugugcacuugagcaagucauuuaacuucucugugccucuauuucccuauguauaauaggagauaauagcuacaugaauguuguugggaggauuaaacguaguacuuaugucaagcacuuagaauggugccuggcauaugcaaagugcuauguaaguguuaauggugguuauuagaauauuugugauuuugguagugacgaaggaauaaaguaccugaacaaaagaauucuuuucccagaacugauagcugagggaaacagaagugauacaguaguaaaaaucauggacaucaggagcucgagaucagccugggcaacauagugaaacuccaucucuauaaaaaauacaaaaaauuagccagguguggcgcaugccuguagucccagcuacuugggagccugaggugagagaaucaucugaacccaggaagucaaggcugcggugagcugugauuguguguuucugcacuccagccugggcaacagagugagacccuaucucaaaacaaacaaacaaacaaacaaacaaaaacaacauggacuucagagucagacaugccuagauccaaauucaaguucucccacuuugugguuuaagcaggccaccuagccccucugaagcucacuuucuuuuaccuaugaaccagaaaucacaaucccuaucuugcagaguugugauuauuaaaugagcugauguguaaagugccugacacugaggugacacuaagaaaaugagagcgcucuggaucccucccaccccccaccaauguaaagcaauacauacaguucaauuucuugugugcagucuuauucauuuguuuguaauuuuaggacuuccaaaaucauuuccauuugcuaacagcagaagaaacaguggcuguauaauuggauacaccuugaaaaguguauugucagcuuuguuucccucuuccauuugcuguuugggguuauuuguuuuauuauuacagcagauccuacuggaaccaagaugguagacacuguuaaucagucuauuauuaaucuauuaauaauaggcauuguuaaugauucuguuauuaacagagucgaacuggaauguagccucaggauccuuuuuuuuuuuuaauuauacuuuaaguuuuaggguacaugugcacaaugugcagguuuguuacguauguauacaugugccauguuggugugcugcacccauuaacucuucauuuaacauuagguauaucuccuaaugcuaucccuccccacuccccccaccccacaacaggccccggugugugauguuccccuuccuguguccauguguucucauuguucaauucccgccuaugagugagaaccugcgguguuugguuuuuuguccuugcgauaguuugcugagaaugaugguuuccagcuucguccaugucccuacaaaggacaugaacucaucauuuuuuauggcugcauaguauuuuuuuuuuuuuuuugagacggagucucacucuguugcccaggcuggaaugcaauggugcgaucucugcucacugcaaccucugccuccuggguucaaacaauucuccugccucagccucccaaguagcugggauuacaggcacuugccagcaugcccagcuaauuuuuguauuuuuagcagagacgggguuucacuguauuggccaggcuggucucaaacuccugaccucgugauccacccaccucggccucccaaagugcugggauuacagaugugagccacggcgcccggccucaggauccuucuucacaguauucuaggaagcuacaaucaguucaucagaguugauauagcugugaaaacugguuuguccuuccugcuuuagaacuuucuagaagaggccaggcaugguggcucacaccuguaaucccagcacuuuggcaggcugaggcgggcggaucacgaggucaggagaucgagaccauccuggcuaacacggugaaaccccgucucuacuaaaaaaaaaauacaaaaaaaauagcugggcaugguggcgggcaccuguagucccagcuauucgggaggcugaggcaggagaauggcgugaaccugggaggcggcgcuugcagugggcuaagauugcaccacuguacuccaaccugggcgacagagcaagacuccaucucaaaaaaaaaaaaaaaagaacuuucuagaagaaauguuuguuggauuaucaaaauauuauauggauuguccauuaaucuucuauucugugaugugcacgugucaaaccuuaugacaaggcaggguggucuuguagcauuuucuaacagauacuuaucuauauuguaacguuauuacauaauguaggcaucuucggacaccuacuggaggaggugcaauaauugaaagauuauaaugcaaugaucuaaccaagaauaugcaucaaaguuaccggggauauagucuuaaaaaacuuaugcccaggaccccaccccagauuuauucaauuagaaucuucaggaggcagacccugccacguacauuuuguaaaaguacuccagaugcuucugcuauauauaccacuuguuaaaaauaaguagauacuggcaaaaaagucaaacauauuuacaagaaaaaaacaaccccaucaaaaagugggcgaaggauaugaacagauacgucucaaaagaagacauuuaugcagccaacagacacacgaaaaaaugcucaucuucacuggccaucagacaaaugcaaaucaaaacuacaaugagauaucaucucacaccaguuagaaugacaaucauuaaaaagucaggaaacaacaggugcuggagaggguguggagaaauaggaacacuuuuacacuguuggugggacugcaaacuaguucaaccauuguggaagacaguguggcgauuccucagggaucuagaacuagaaauaccauuugacccaggcaucccauuacuggguauauacccaaaggaauauaaaugaugcugcuauaaagacacacgcacacauauguuuaucgcggcaguacucacaauagcaaagacuuggaaccaacccgaauguccaacaaugauagauuggauuaagaaaauguggcacauauacaccauggaauacuaugcagccauaaaaaaugauaaguucauguccuuuguagggacauggaugaagcuggaaaccaucauucucagcaaacuauugcaaggacaaaaaaccaaacacuguauguucucacucauaggugggaauugaacagugagaacacuuggacacaggaaggggaaugucacacacuggggccuguugugggguggggaaaggggggagggauagcauuaggagauauaccuaauguaaaugacgaguuaauaggugcagcacaccaacauggcacauguaugcauauguaacaaaccugcacauugugcacauguacccuagaacuuaaaguauaauaaauacauauauauauauauauauauauauauaaagaaagaaauuacaauaaaaaaauaaguagauacuggcaacuauagagaagcacacacuauugguaugagaguucauugacauaguauaaccuauagaacaauuuuacaguaucucaaaauuucaaaucuguccuauagaaauauauaugugcacaaaaacagaguuuagagaauguuucaggccaggcguggugacucaugccuauaaucucagcacuuugggaggcugaagcaggaggauuacuugaguccaggaguuugagaccuaccugggcaacauagcaagacccugucucuauuugaaaaaaagaguaaagaaaagaaaagaaaaauaaguaaaaaauaaacgagguuuucugcagacguauuuauuauaucaaacaauugugagaaacugaugaucaguacauaaaugguuaaauacaaauaccacguuuguuuacuaugcaaccauuuaaagaaugaauauguaugaaaauugucuauacaugcugauguagaaguauaucuaggauauauuguuaaguuaaauaagcaagucacagaauaagcccuauuuuaaaaauuuauauguaaaaauguagagaaagaugugaaaguauacccaucaaaguguuuauagugguugucuuggcauagaagagugggaauaaugaaguggggacaggaacaggccuuuucacuuugguguuuaaaauauuugcaggccagucgugguggcugacgccuauaauccuagcacuuugggaggcugaggcagguggauugcuugagcccaagaguucaagaccagcuugggcaacauagugaaacccugucuacaaaaaauacaaaaauuagcugggcgugguggugcaugccugagucccagcuacuggggaggcugagaugggaggaucaccugagccugggagguugaggcuguagugagccaugauuguaccacuacauucaagccugggugacagagugagauucugucucaaaaaaaaagaaaaaaugcaauaacauuuuauuauuuuuguaauaaaaacaaccacuggacaaaauaugaaugauuuuaaaggaagcucuuauggaagcagauugauaugugucaggacacugcuuauuuugcaaacaccaguuuuaaccugagacgaucucuaacuugggaaauaaaaaggaaugucaaaacuauuucguguguugguggugaugauaaaaucuuguugccacaguuguugugaaaguaaucaggaguuucaaacagauaagcauugaagauaaaagguauuugcccugugucagaauuauaucaguuaucuguuuuagaaauauuuaaugucuaugcauaucuggauaugaaaauugaguucaaaacauuuuaguuuaauccuuuuucaguugauuagccucuagccuaugagaauaguaacaccuucuaauccccucuuuuauaauuuuaggcccgaugagagaaagggaaaguuaaggaugcuggagcagaacaauggauuucucuuucucuuucaugcaagggaucaugggaaacacaauucagcaaccaccucaacucauugacuccgccaacauccgucaggaggaugccuuugauaacaacagugacauugcugaagaugguggccagacaccauaugaagcuacuuugcagcaaggcuuucaguacccagcuacaacagaagaucuuccuccacucacaaauggguauccaucaucaaucaguguguaugaaacucaaaccaaauaccagucauauaaucaguauccuaaugggucagccaauggcuuuggugcaguuagaaacuuuagccccacugacuauuaucauucagaaauuccaaacacaagaccacaugaaauucuggaaaaaccuuccccuccacagccaccaccuccuccuucgguaccacaaacugugauuccaaagaagacuggcucaccugaaauuaaacuaaaaauaaccaaaacuauccagaauggcagggaauuguuugagucuucccuuuguggagaccuuuuaaaugaaguacaggcaagugagcacacgaaaucaaagcaugaaagcagaaaagaaaagaggaaaaaaagcaacaagcaugacucaucaagaucugaagagcgcaagucacacaaaauccccaaauuagaaccagaggaacaaaauguaaguugaaaagucguuuugaaaaauuuuguuauauuucacauuuacuggaaguucaagagaucuuuuugguuuuuaucucuuuaaauaugaaucugucugauaacuucuuuaaucacuagcaacgugcucagaauauuauaauaggugcugaguauuuguugaauauaugaauggacaugauuaguuaagaaauauuuuuaaaacauguaaaacgaaucuuucugcuuauguuucuuuguccugaugaccucgguuauuuuuauuugcuuacaauagacuguugguuuuugaaaaucaagaggaaaggcaaagagaagauagcuaauuauauuggguuuucauuauuuuagaccaacuuuuuccaguagagcuuagauuuaacacucauugcuaauguuugcuacaaaauaaccugaaauaauagaaaucuuuuuauuaaaaucagaguuaguauuaauaaauauugauuaaaacuucaggugaguuuuuauaaaagucauccuuuauagguaacuuaagauauaugcugcugaauuuuuuaauaucugagauuucagcgugaauuugcuuagcaauaauauaauaaguauguaacauaauucuagcuuaaaugaagaguucauaauauaaauugcaaauguuuucuaaacuuugacuugggaaaacuauauuuauuuuuaugacagcuaucugcuuuuauauguguuauaccugaauaaguuaauuuauuuucuguucaaagaaauguuuacuucuuaccuauucaucuuuuccuugguagcuggcuucuauuacuucauacaacucacaugugauguuuuucuggaguaaaggucacaaugcuucuagacucucacaagucccagugugacauuucaacauguuuucucacuuuuuauaguuuucuuauuuauucauuaacaaauguuggugaaaugcuccuccuacugugugcuaggcaaugaucuaagacuuaaagguaugacaaugaaugaaaaguagagaugccugcucucaggaugcuuauauucuagugaggggagccagaaaauacacacacauauacauauauauauacacauauauacauauauacaauauauauuuauauauacauauauauacauauauacauauacuauauauacuauauacauguguauauacauauauacauauacauauacuauauauacuauauacuauauauguauauauacauagucuucauagcaucuaaagcuaacuuauguacacacauauacauaugcauauauacauaauacauagguauguauauacauauauguauauauacauauauacauacauaugcauacauauauguauauguguguacauaaguucucauagcuuuagaugcuaugaagacaauaaaacuggguaaugagauaaagaguaaucagugauguuucuaguagucauuuugcaaugagauucuaaaaccaguucugucucuguuagaugucugcuauaccuaguucuuuauaucaccuaaaccuucaguuaacuauuauagcucaggauuagaauguuuagauuuuauuuuauuuuauuguuuuugagacggaguuucacucuuauuguccaugcuggagugcaguggugcaaucuuggcucaccgcaaccuccgccuccaggguucaagcaauucuccugccucagccucccgaguagcuggggacuacaggcauaccaccacgccuggcuaauuuuuuuuuuuuuuucaaguagagacagggucauguuagucaggcuggucucaaacucccgaccucaggugauccaccugccuuggccucucaaagugccgggauuacaggcgugagccacugcgccuggcccagauguuuagauuuuaauuuaaggguuuuaauucauuuucccuuuuauugaaucaugaugagcaaaauuuacuauuugauuguuuaggaucuuacaauagcuugggauaaaggaauaucaacuugaccaaaaguauagcuggagaaaguggcauugacugccuggaauauuacuaggagcauugccugaaagucgagucuuggggggaaauccagguuuuuuucuuguucguucucucucucucucccucucucccugucuccuucucccccucuuccucucccucccucucccugcuccccucucugccccauuccucccccuuuccauccuacccccucgucccuucccccuuccauuccuuccuucuucucucccuucuucucugccucucuccucucucucucucccucucccucucaccccuucuuucuucccuuccuucaaagaaguaaagagguaaguucuuguuaauugaauuuugauuaauuggaacuguaucacacacgggggcaguuguagaaguuguaguccauucugaccacagaccuucaaagccagagcucccacagcucuugccuaucguuaaugucaugcuuuugcuaagcuagagauguguauaaauuaauguuucacaacugcauauauuuuuaaauuagauuuccuuaacuugaacaacaucuacagugcuuccuucaggacaguuguuuuaaguguuuuaauagucaauacccuaugccuacugguuguccauaggggucccagcccuugguguuuagcauuguagagaacugagaagugaaaaggaagcccaaagaagcauccacugacuucacuggacagcuucccucccccagaugccucagggaaacauaaugaaaaauguauuccuggagaaaaaagucugauuuaaaucuccuggagcuggauuugcuuuuauauagauuuuuucuuuuacuuuacuuuguuguuguuguuccuuaaaagcucacucauagguucauagguucuuuuuugagcaaacaaaaucucauauaguugaguuccauguuuaaguccgggcaugguggcucaaucuguaauaccagcccuuugggaggcugagguggguggaucacuuaaggucaggaguucaagaccagccuggccaacauggugaaaccccaucucuacuaaaaauauuuaaaaauuagccgggcguggugguggguaccuguaaucccaacuauucgggaggccgaggcacaggaauugcuugaaccugggagguggagauugcagugagccaagaucaugccacugcacuccagccugggugacagaaugagacucugucugaaaaacaaacaaauaaaaaaacacaacaccuuaagauuucaccugcuacuuuuuuucuuaguacuugauguguaaguauuucccccuaauucuaagcuguuuggccuucugaagaguggcuguuauuuggaacaaccuaaguauaucuucucagcaaugaaaauguguccaaacaucuaggcagcaggagaccugagaucacuacugaaauuguauauuuuaaaaaucugcaugagcuguuuuuccucccaccaaaucagaaauauguggcuguguuucugcaugucuuccuccuuggcagguggaaugccucaggcaugugagcguaggcccuauuauucaaacagucacuggucuccuaucagcacuucagugggcuaauccacuaaggcagagucucauuaacccuuaguuugccauauccccuuauaaaaagcagaguggcuggaucagucccgugaacacuaagguagcagguuugguucucuagccucagaguauuaggccuuaaaauucuuagaaacucuuuauaugcaaaauguucuuuauuguacacauuuuuuauuugauuuuauguguuuauuuuugagacagaaucucacucuguugcccaggguggagugcaguggugcagucucggcucacugcaaccucugccuccaggauucaagcgauuauccugccucagccuccucaguagcugggauuacaggggugugccaccacgccuggcuaguuuuuguauuuuuaguagagaugggguuucauuauguuggccaggcuggucgcgaaccccugaccuuagggugauccacccaccuuggccucccaaacugcuuggauuacaggugugagccacugcacuuggcccacauuuuuuauuuuuaagguuacaaacuuaagucauucagaaaguaaaauaaaaaugcacaauuuauuaccuuuaaaauuuucuuuccaacuuuaauguugacaucaguuuuuuguucuuuuagggacuaugauuuuacucuauguuuuugaaauuuauauaaguaauauuauuaaggcuuugaaauucugacagauuugauguguauuacuaaucuuuuuuuuuugaggcagagucucugucacccaggcuggaguacaguggcacgaucucggcucacugcaaccucuugccucccggguucaagcgauuccuaugccucagccccccagguagcuggaauuacaggugugcgucaccacacucagcuaauuuuuuuguguauuuuuaguagagacgggguuucgccauguuggccaggcugaucuugaacuccugaccucaagugauccacccaccuuggccucccaaaguucugggauuacaggcgugagccacggcaccuggccuguaguauacucaucuuaaugaaugucuuggguuuuaauaaaaguaauaggcugaaggccgugguggcucacggcuguaaucccagcacuuugggaggccgaggcgggcggaucacaaggucaagagaucgagaccuccuggccaacauggugaaaccccaucucuacuaaaaauacaaccaggcgugguggcgcgugccuguaauaccagcuacuugggaggcugaggcaggagaaucgcuugaaccugggaggcagagguuguagugagccgagaucaugccacuguacuccagccuggcaacagagcaagacucugucucaaaaaaaaaaaguacuaggcuaaaauuuguaaaggaauauuuaggauaauguaauuuauuuuagcuacucuuaacauaauuuuuagguguucuuauguggagucaauuaaaaauguaaaaaagugguauauacccacaaaaucauaauuuuaaaauuaagaugaauugaacauuaaggagagcuaacucacugucaucuuuuucucugauguuuucucuuucugacaaagcaguggaauuaguacccaaagaggguaucucugucccuacuuaauuuuaaugucuuaaacuugucucugucucugaaugccuaccagguauaucuguuuugcucacguacauuuuauaauagauacucccucucuauuauugcagcauccuuacuugaauucuuuuucuucucuuacuuauauagucuugaaagcuuagaauaaauccucuugggcauccuucgcucccuagccacuuauuucuuuuaaaaugacuguguaaaaaacuuuaauucuuugaaagugauuuugaugguguuucaaaccagccugaaggaaacaccaacaaucuggaacaaaucaaaaaauuaaaaaagauaagacauuugaauuauaagauuuggaaggaaguccuuuuuuuuuuguuuuuuuggagacagggucucacucugucacccaggcuggagugcagugacgugaucauagcucacacagccucaaacuccugggcucaaacaauccucccaccuuagccucccgaguagcugggaguauauagguacacaucacuacgccuggcucuuuuuuuauagagauggggucucgccauguugcccaagcuguucuucaguuccuaggcucaagugauccaccugccccagccucucaaaguccugggauuauaggugugaaccacugugcacagcugguaccguuuuuaaccucagguaucucacacaugcuacuccuuccuccuggaauguucuuuccuccauguuuacuaagcuaauucuucguccuuugauucuuagauuguaauuuuucuuuuuuuuuuuuuuugagacggagucucgcucugucacccagguuacaguccauugguguaaucucagcucagugcaaccucugccucccagguucaagcaauucuucugccuuagccucccaaguagcugggauuauaggcacccaccacagugccuggcuaauuuuucuauuuuuaguagagacaggguuucaccaucuuggcacggcuggucucgaacuccugaccacgugauuuacccaccuuggccucccaaagugcugggauuacaggugugagcuacugugccuggcagauuguaauuuauuuucuuagagaggcuuuuccugaccuucauaucugaaaauacauauacacuuacacuauuauuuaucuuucucuuccuagcacuuacuuuuuuuguuuguuguuguuguuuuaagagacgggguuucgcuccaucacccaggcuggagugcagucauagcccauugaagccuugaacucugaggcauaagcgguucuccugccucagccccucagaguaguugggacuacaggcauuuguuguuuuuagguacugggccucacucuguugcccaggcuggucuugaacucuuggccucaagagaucauuccaccuuggccucccaaaguacugacaggugugagccacaccaugccgagccauagcacuuacuuuuuaacuggauguuuguguuucuguuuuuuaaugucagucucuccugcccagcuguaaacuccuuggggucaggaaucacaucuguuuguuucacuauuauauauagccuauauagcuucuagaacugggccuggaacguccuaggcacugugaagugaaugauacuuggguuuggggacauuagucuggcuuauagaacauaucauuuuccuaaaacuuaaaaaucuuuuuaggccaggugugguggcucacaccuguaauuccagcacuuugggaggccaaggcaaguggaucaccugagguuaagaguucaagaccagccuggccaacauggcaaaaccccgucucuacuaaaaauacaaaaauuagcugggugugguggugcgggccuguauucccaguuucucaggaggcuaaaggaggagaaccacuugaaccugguaggcagagguugcaaugagccgagauggcgccaccacacuccagccuaggcaacagcagaguaagacucugucucaaaaaaacaaaaaccuuuuuauacuuuuuuuaauuuaauaaaacuuuguuuucacaacagugucuuuaaauguuuugaaauaauagaaugagaauuuuaaguagcuuuuagaauuaaucauauucuuuuaguggagugaagaccuacuuuaauggcuauacccucuuuuuaagccaucuaaauuaaauucuguucucuaacaaguaacauauuuuaaaaaucuuuuaaauuguagaaguaauuugguuuuuuuuuuacagaaaagacgaauaauaaaaagguauagaauaucuuccuucaccauuucccucaugucauucccaaaagauaauuacugguaucaauuuuguuuacauuguaccaaauauuuucaaggcauguauaaauuacauauuuuuaaauaaaaaauuggaagauauugguagacaugcagauuacugacaugaaauaauacuguaguuaccauuccucugcuuagauuuucuuguuuuggauauuucuauagaauaaauuucuacaaugugauugcuagauggaagaguguacauaucuugaauuuugauagcuacuuccaaauugccucccuaaaggguuuuagaaacuucuuucuuuccuuuuuuuuuuuuuugagauggagucuugcucugucaccaggcuggagugcaguggcaugaucucggcucacugcaacccccaccucccagguucaagcaauccuccugccccagccuccugaguagcuuggacuacaggcgcacaccaccacacccagcuaauuuuuaguguuuuuaguagagacgggguuucaccauguuggccaggauggucucaauuucuugaucucgugauccaccugccucagccucccaaagugcuaggauuacaggcgugagccgccaugcccagcccaucuagauuauguuuaauacuuagcucuuguaaguagcaaugguaugcauaucuucauacuuauccauauuuuuuacaucucucagugcuuuucaaauauacauucuuagaaguagauuugcaaggucagagucugaaaauuuaauguuuuucauauauacaaccaaauugcucucagaaaaguuucaaguuacaucuuacuaguaaucuuagagugcccauuuuuucuagaaucugagcauuaaaaagaaaauuaccaguuuauuuagaaauuaaguggguuuuuuuuuuguuuuuuuuuuuugagacagagucucacucugucacccaggcuggagugcaguggcacaaucucggcucacugcaaccuccgccuccuggguucaagugauucuccugccucagccucccaaguagcugggacuacaggcaugcgccaccaugcccggcuauuuuuuuaauuuuuaguagagacgggguuucaccaugcuggccaagcuggucuugaacuccugaccuugugaucugccugccuuagccucccaaaaugcugggauuacaggcaugagcuacugcacccggccuagaaauuaaguuuuaaaaguaacaaaauaagaaaaaggagauaaagcuaugauaugggguggaaaaugaauguugagacagcauuagguauugaguaaguuguauucuuacuccuuacauuguucaguuaauaaaugcccuuuauucucuuuauuuaguuuucuuugauucuuuuuauguaugucacuguuuuuuguuuguuuguuuauuuaaugccauuuuauucuacuuaccuauaccuuuucaccuagagaccaaaugagaggguugacacuguaucagaaaaaccaagggaagaaccaguacuaaaagaggaagccccaguaaguuguuuuacugaauacugucuaaccaaauaugguggaagaaggugaaacacagugauugaauugcaacacaauuguauugguacuacgcuucuuaauuucagaaauuauauugaaauaagucuuggagcugguuugauagguggauauuuucagugaaucauuuuccuuuucaaaacuaugaccuguuuuuuuuucaauugaucauguguauuuuuuuuuuuuuucuuuuugagacggagucucacucuguugcccaggcuggagugcaguggcgcaaucucgacucacugcaaccucugccuccuggguucaagcgauuguccugccucagcuugccgaauagcugggaugacaggcacgugccaccauacccagcuaauuuuuguauuuuuaguagagacgggguuucacuguguuggccaggcuggucucgaucuccugaccuugugaucugcccuccucacccucccaaagugcugggauuacaggcgugagccaccgcgccuggccgaucauguguauucuuaacaugccuuguuaauaauuuggcaacagaaaccaucaauccuaucuucaguauuugggguggggcuuauuaauauuuuuccuccuucccuuuugcuaguuuuagauaggaggcaucagagaaaaguauaauugaagauaaauuuacauuguuagcacuuuuaauguacuuuauacauaguuucuuuuuuugaauuucugauguuuuuugacccuuuccuguaucaaaguauaauugaagauaaaauuacauuguuagcauuuuuaauguacuuuauaucuaguuucuuuuuuugaauuucugauguuuuuugacccuuuccuguaucaaaguauaauugaagauaaaauuacauuguuagcauuuuuaauguacuuuauaccuaguuucuuuuuuugaauuucugauguuuuuugacacuuuccuguaucaaaguauaacugaagauaaaauuacauuguuagcauuuuuaauguacuuuauacauaguuucuuuuuuugaauuucugaugaaguuuuuugacccuuuccuguagguucagccaauacuaucuucuguuccaacaacggaaguguccacugguguuaaguuucagguuggcgaucuugugugguccaaggugggaaccuauccuugguggccuuguaugguuucaagugauccccagcuugagguucauacuaaaauuaacacaagagguaagaaaaggcauaaacagauacuaaguaaaagguuggaaauaaaagugacuuuuaaauguuguaugugaauauaagaauacacacguaauauauaaucugauacaaaaaugugcauauccguaucaguuuuguggauuuuuuuuuuuucuuuuuuuuuuugagacggaguuuuugcucuguugcccaggcuggagugcaauggcgcaaucucagcucacugcaaccuccgccuccuggguucaagugauucuccugccugggccucuggaguagcugggauuacaggcacccgccacaauuccugguuaguuuuuguauuuuuaauacagaugagguuucaccauguuacccaggauggucuugaacucucgaacucaagggaugcaccugccucggccucccaaagugguaggauuacaggcgugagccacugcgcccggccucuguaucaguuuuuaaaaccagugaaauacugauagucauuuuaaauugcagagugcuucuauggcuaaugcaguccuuguuucccuuaugauacccuacauuugcuuauaauuugcuuacacuugcuuuuuuuaaagaccuuaaucugacugaaaauaugaccucauauuuccuaaagaaagcauauggacaagcgaucagauguuuuauaugaacuuaauaagcauuugcgccaagccuucuuugaacauuuuuauuucaucguugacugcuauggauaguaauuuuuuacccagacaaguacuuuucauccuggcaaauuuugcaggaugcuuuuuuuuccucuacacuccauucuugaaucgguaaauuuacuggggcauccuuguaaauuugauaugacauguagccugaagguugcuauauaauauagaauccuaccuuaggaauguuaauaaaaauuaagaaagacaauucuaacuuuucucuacuccuuuucugggauuugaccaaagaaugauguggaguagauugcugagauucuagcauuugaaaugaacuugcuuaguagccaaagaaagguuugagcuuggaacuuacuucuggguguuaacuuugugaauugacucuugucauguguagaguuccucauugucugugacaaguuuguaccuguuucuuuuucuuuuacuuuaaaccaucugucuugguccuuguucacucuucugaagggaaaaaguaucucuuuaugucuggcaaggcacauuugugauaggaucagccauaucugugauucuugugcugcauaaccaagaaucucucccaguauagaaggccaucuggcucaaccauuuuucgucuugucaaugugaccugcugauuaaagguuaggagacgggaugugucagcgaggcagaagugaaaaaccagcauuguugggugucugcuuuagugcaagguccuguguucaguaguucucuuauauauuuucuuauccaauccucauagcagcaacacagugaaguagguacuuuuauuaucccauauuuuaaauagguaaacagaaucucaaagaaaucuuaauuucauaaccucuccuccuaaacacugccuuauauuacagggaaagcaguuaaauucaccuagucaucauuuacagagguuggaggaggcagucuuauuauaguuccuucauuuauauaagaaggguauuggacuagucaucucugaaguacccuaccccucuaauaaucuaugguuauaugagugggaaaagaaaagacaaggauuuuccaagaagaccaugcuuucuuaaauaaaacaauucauguccacaucuaggccuccagaacucucuaagaaguuacaucaugucagaacucuggaucuucacuucuguccccugaggaaagcauacuguugagauuauauaaagaguuucauauucaauuacuuuaugaaaaccugcagauuucagcuuuuuucaagauacaaaugaaagcacaauuuaugucucaucuguauuucaaaggaaguauuuacauuuaguuuuauuaauuaaccuaaucucagcugggcaaggugccucaugccuguaaucccagcacuuugggaggccaagguggguggaucaccugagguuaggaguucaagaccagccuggccaauauggugaaaccccauaucuacugaaaauacaaaaauuagccaggcguuuuggcgcaugccucuaaggucucacucaggugacugagacaagagaaucacuugaacccaggagguggagguugcgguugcagugagccgagauccaccacuucacuccagucugggugacagagugagacuuggucucaaaaaaaaaaaaaaaaaaaaauucuagccugguacccccaggcaguuuccuacuuuagugcuggaaaaaccgauuuuguuuauauuacuaccagaagucugaaauuuuagguuaagaaaugcauauauuuuaaccuauauauuuuaauaaaaauuuaaauuauuuuucuauaguaguuuuaaaaacuuuauugaaauauaauucucauaucauaaaauucaccuguuuuuuuuguuuguuuguuuguuuuugagauggauuguugcccaggcuguagugcaguagcacgaucucagcucacugcaaccuccgccuuccagguucaagcgauucuccugcuucagccucccaaguagcugagauuacaggcacccaccaccacaccggcuaauuuuuuuuuuuuuguauuuuuaguagagacgggguuucacuguguuggccaggcuggucucaaacuccugaccuugugaucugccugccucggccucccaaagugcugggauuaaaggcguaagccacugcuccuggccaauucacccuuuuaaaauguacaguucauugauuuaaaaaucuguacauucacagaguugugcaaccaucaccacaaucuauuuuagaacauguucaucaacccccaaaaauccuguauccauuagcagucacccucauuucuacccgcuaagcagccaguaacuacuuucugucucuguagacuuaccuauucaucuggcuucauucacuuaccauaauguuuuugagguucauccauguuuuaacaugguaucagugcuuuauuccuuuuuauugccaaauaauauuccauuuauggcuauauaguauaguuuuaaaugcaguaguuuucugacaguuuuucugaaaaccaaaaaaacacagccuaaaaauucuguuaauuauguuccacgcaugaugccuauuaagcauuuuaugcugaucauuacuuuuuuaauagcacauauacugcauguauacaugggagauacccagagaaaugagugaaucuccuguguugcuuucuaucuaagcaacuuuguaaaauuuaucuuaaucauauauaguaaucacugguuuccauauuguuauuagucaguauuuuuuuuuucuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccauuagucaguauuuuuauuagauucuuagcacuggaaaauguacuuaacaguuuuucacacauaaagauguaauaauuauuuguaagagcauguugaaagauguuuggaucacaauucuauuuuaaguuguauuuuauuauuuaggacucauuaaaaauuuagcucuucagucagagacagaugugcuuguuucuugacuuuucaggucuguagcuucuuauuucagucuuauuucauaguuuuccaggugucaggaaacaaagugcuaacaaauaggcaaaauguuugucuuguuuccucucuaguaaaugauuuaaugggggaagaaguugaaaauacagauuaaaaugaaauuguguuaucuauaaauuucggcuuuuauguuaaguccuuugggauuaucuguucauaucugaagaaauaacucugauguuuggaaacauuauguacuauguuuuuuuaaucugaauaccuguacccacuacccuguccuugaaauucacuuauuaguuuagguuauauuucuauuuuuccccccaaaaacccuuuggauuucagauaaaucuucuuugacuaauuauaauuagauuugugcuugggucuuuauucucagaugagaugauaugaaaaucugaguccacuguugccuuuuucuuccuaauuacuuuggguucucugaaaagaucaguuccugcauuucuccauugaucuaauacuuuuucucuagaacaguauuuuucagacuauuuuucgcaaaagaucaguuuuuuuuuacuuuuuucaaaugucuagucuacuauguacuaauaccucuguaaaauacaaccaaacuuaauuauuuaaaaaaaaaagaaugcccuuccccugaaaaaacaccuagugcaagauucuugaucaugugucuagauaucauaacaaugucaaauugcugucagagcuucucaaugcuuacucaacuucuguacuuacuuuugucccagacuggcuuguuugucaaaccaauuucagaguagcauugcccuuaaucagcaguucucagauguuguggucccaggaccccuuuuacuccuaaaacuugaggacucaaaaaggcuuuuguuuacguggguuauaucuaauguuauuuaaauuuagaaauuaaagcugagaugcaggcgcaguggcucacaccuguaauucuaacacuuugggaggcugaggcaagaggauugcuugagcccaggaguucaagaccagccugggcaacauagcaagaccccaucucaguuuaaagaaaaaaagaaauuaaagcugagaaaauuucaaaauauuuauugauuuauuuaaaaauaagaaccuaucauaggcuggggccaguggcucaugccuguaaucucagcacuuugggaggcugaggcaggaggaucacuucaggccaagcguuugagaccagccugagcaacauaguaagacucccaucucuacaaaaaaaagcaacaaaaaaauuuauuaauuaacugagcauguggcauaugucuguagucuuaccugcucaagaggcuaaggcacaggauugccugagcccaggaguuugaggcugcagugagcuaggaucaugccacugcaguccggccugggccauagagugagaccaugucucuaacaacaagaacuccuuacaugcuaucauuaauuauauuuuuaugaaaaaugacuauuuuguuaaaaaguuaaugagaagaauguuauuuuguuuuguuuuguuuuguuuuguuuugagacaagagucuugcucugucacccaggcuggagugcaguggugcaaucaauuauuuguggugauuuuuacaguagcuauuaguucuauaacugguggguauuggaacauaucuuuggacaauccaaacauacaaguuuuagugggaguaauacugaggaaccuggguuagauucccauuuuuggcaaaguagaugugaaugcuuauguucugaaaugguuaauaagaauuuuuacuuacaggugcccgagaauaucauguccaguuuuuuagcaaccagccagagagggcguggguucaugaaaaacggguacgagaguauaaaggucauaaacaguaugaagaauuacuggcugaggcaaccaaacaagccagcaaucacucugagaaacaaaagguaacuaacauguuaauauuauuuaccuaguaugguuuuuaaagaacuuaauaauuuagaagaauuuuucauacuugaauucagauaauuauuagaauccuuuuuuuaaaccccuuucagcuguuuuaaucguaaugguaaaugacuaguaaguuuguaaguacaccaaugaguuuuauaugucauauaaacgacguauaguacuauuaaaaacuuuagcuaccugcuuaauauugaauucuauugugaguuucauuaaugugcauaaguguaccagaugcuagugaaauguggauuuuugccagggauuuuuacucuuuuuucuauuucagcauguuuccauaauuucuuuucauucuuguuuaacaaaauuguuuuaugaaaguaaacuuuuaaaaauauuuaaugagugccuauugugaaacagguaugcuuuuaagcauuuuacauauauuaacucacuuauuauucauaacaaccuguaugagguagauacuauuauuccccuuuuuacagaugaagaaauugaggcacagaaagcuuauguaacugguucaaccgagaucacacaagugauggaaucaggaaauauauuugauguggugguggauauuuuagaauuuugacaugaacucuugguaaucugguuaagaguuuaaacucaacuaaauuagugugggucucuuaugauucagaaauuugucauuuuuuacacuugaaaaacuaaauuuuaucacagaauuuugauuaauuuuaugagacuuacauuuuacagauuuauauaugaauauuugacauaugcuaucucauaguuuuauuaacuaauuucuggcuacaucagucuagccaccuggauaauuccuaauugcucuggccaucucacacaucuuuauucaaaguauuuuuaccccucuugccaauccaaagucuucugauugacucuggaccuagagaccuauggaaacuauaauucaggucuaccuuuuuucucauccaugccuguucuccuuugucuuguuaauuuucauuuguuccuugaggcucuguccuuucacuucauucugucccugcaugcauugugguucaaacucugccaguagcuuuguugugaucucuguagcaccccugacuugcccucugcccgagauaugggagagaauugggaguuucaggguaucauuuuuaauguuaguguuuuauuagccacugaaaauaaccauuucuguaaucauuguucucuuuucccucauuaucacuagcuuuuuauguauaugagaggagaaggaugucucccucuuggggaccuuguccagcagagugaucagcaaaggaaggauauaaaagagaguagauccucauguuaucgaauaucuuuuuaucagaauuauggagauagaacauuccacuuguuugaccaaagaaccugaagauauuuauguagaccugaaaagauaacaggaucacaugggaaauacauaucaauuuuaauguaccuauuagaguaaagcaugucugauaaucucuaucuuuuuuaaagauucggaaaccccgaccucagagagaacgugcucagugggauauuggcauugcccaugcagagaaagcauugaaaaugacucgagaagaaagaauagaacaguauacuuuuauuuacauugauaaacagccugaagaggcuuuaucccaagcaaaaaagaguguugccuccaaaaccgaaguuaaaaaaacccgacgaccaagaucugugcugaauacucagccagaacagaccaaugcaggggagguggccuccucacucucaaguacugaaauucggagacauagccagaggcggcacacaagugcggaagaggaagagccaccgccuguuaaaauagccuggaaaacugcggcagcaaggaaauccuuaccagcuuccauuacgaugcacaaagggagccuggauuugcagaaguguaacaugucuccaguugugaaaauugaacaaguguuugcucuucagaaugcuacaggggaugggaaauuuaucgaucaauuuguuuauucaacaaagguaccuccuuuuuucguggaguuuuuugggggaugguauuuuaaaaguggucaaccuuggcauuuaaaacaaugaccuuggcauaauuuaaauacccuuucuacccacugaauuugaaacauacagucauuguacucugugggcaaaaaagacaggcaaaaaggcuauguuuuucuucuuuuuuauccccuucuuuugugauuuucccaucuguaguagauuagucuugagcugugcagccaaaauugagcuuagcucccuaaagucauggaaaaaaacugggcacuuugccuguuucuaguuugcguaguuagcuuuucuuaguugcaaaguguacuucuuauuaaaaucauuuuugucaauuauaugaauuaaccauuguuauaaaaaccacuguaauaauuguaccugcugaccuguuugguuccaccagcaauuuuguuagauucuuaugggcuugcgauaucuaacugccuuucagagaaucccagaacuguguuuguucuguaacaauuagcuguggcaauaacuuggguaaugggguaaaaacagccucuacaaacugugugccuucaucaguuuguccugggccuccauuuagggcacuuauacuuuagcuugaagacuuuaaaacucuuccauaauauugguagguauuuauuccguguaccucuucacuaccaucccaucccaucccacuguguugaguuugugauucugauuuaguugcauuucauucauguguauuaaagaauucuaugcuuauuuuuuccuaauauagucauaugcagauuaauuaguuaaacaggggaaugcuuaauuaguaauacaucuuccuagagaaaugucaagggugcucuuuuaaccuggucugcccauagguucagcugacuucaguuaaggccaagcuaccugcaaaaacuugaauugcaguccccacuugguucucuugauagcaaaugaauauuuuucaucuuucaaauagcaaaugaguauguugcaucuuuuuugaguacaaauuggcuuuauucuuggagcuaguuuuacugcuucugaugcacaagucaaacuuugucacuaccaccccaaagaaugcuauuuaaaggaaauucaagauaaaacugaucuuuucaaaaugaagacucuaaaaauauaugcauguauauauuuauauuuauuuuuuuccuuuuuaagagaugaggucucacucuguggcccaggcuggagugcaguggucaauaauagcucacugcagccccaagggaucuucugccuuggccuuccaaagcacugagauuacagucaugagccacugugccagaccuuuuaaaaauuuuuuguagagacagggucucacuauggugcccaggcuggucuugaacuccuggccucuagcuguucuccugccucagucucccaaaguguugagauuacaggcaggagccacggugccuggccaaaaaaauacauauauguuuauaaaucacuucuuuacuucuauuccauugcauuaaaaauaccuaaaaggagaccuaaguuaauuauaccugccuucuuucugcuucggauuacuuauugggucacauuuuggucaccaugagugacauauuucuguaucuagggguauucuugucucuuaagacauauuggcauuuuuuucuguguaauagagcacuuuaccaaaugcaaaugacuagaguucucuuacugugauauguauaaagaccagaaaauauuuuguuuuuauagaaaauugagugauacagguauauuuuuuagugacauuuaucaccuagacuuagacaaauacucuaccucacgugaucuuacugugcauuuuaaaauguaucuuggaauuagcugggcaugguagcacaugccuguagucccagcuacucgggaggcugaggcagaauuacuugaaccugggacgaggcagagguugcagugagccaagaucacaccacugcacugcagcccaggugacagagccagauuccaucuuaaaaaaaaauuuuuuuuggccgggugcgguggcuaacgccuguaaucccagcacuuugggaggccaaggugagcagaucaccugaggucaagaguucgagaccagccuggccaacauggugaaaccucaucucuacuaaaaauacaaaaaaaaaaauuagcagggcgugguggcacgcaucuguauucccagguacuuggggaggcugaggcaggagaaucacuugaacccaggugguagagguugcaaugagccaagaucacaccaugcacuccagccugggcgacagagggagacuucuucucaaaaaaaaaaaaaauuguuuuuaauuuuuaaaaaaaguaucuugaucacuuaaucaaauuucugauaaaggcuaagauaacuuaauugcaaucaaagaccauauaaaauuuaagcaaauuaugaucauuuuaagccaucuuuauaagcccaugaugccacuugccugguaaucaccuguuuuguuguuuuuucuuuugccuuauuuuaaagggaauugguaacaaaacagaaauaagugucagggggcaagacaggcuuauaauuucuacaccaaaccagagaaaugaaaagccaacgcagaguguaucaucuccugaagcaacaucugguucuacagguugguaugaaugaaaaguauauauagguccauuuugagaaauccuuguucuguucugcuauaaugugguagcuguguuucuaagaaacucuuaguuaucaaaaguaaauuauauuuaaaaaucaaaauauaaaagcaguuacuuuaauaggaaaguggguuaggggcuagagaacuuuauucauagcaaguuauuuuuuguacaagaauuaaaauaauaggguucuauaauuaaaaguguauagcuauaaaacucuauauguaucugaguaaauacaccaucgacuaucucucuuugcauaauaacagcuuuacuuuucccacucuauuagcacacacauaccauuuccuccuuuaccccuguuggaaacaaauggcugaugccaaagcucuugucauuauuccuaguugugcuagauacuaguagcugaggggccuagagccuaauuguccuaauguaaccuguuuucugauuagcagacaccaugaauugaaaaucaagccauguuauucuugcuuaaaggagaagugacuguauucaguaagauugugccuuuggaauguuuaacuuuuuuuuuuuuugagacagagucucacucugccacucaggcuggagugcaguggcucaaucucgguucgcugcaaccuccaccucccagguucaagcgauucuccugccucagccuccugaguagcugggauuacaggggcaugccaacacacccagcuacuuuuuguauuuuuaguagagacaaaguuucaccauguuggccaggcuagucuccaacuccugaccuugugaucuaccugccucggccucccaaagugcuggaauuacaggcaugaaccaccacgucuggccuuuuuuuuuuugagacggggucucacucugucaugcagaguggaguacaaugguacgaucauggcucacugcagccucgaccucccaggcucaggugauccucucaccucagccuccuagguagcugggaccacaggcaugcaccaugauaccuggcuaaguuuuuguacuuuuugccauguugcccaggcuggucucgaaccccuggauucaagcgaucuaccugccucggccucccagugugcugggauuauaggcgugagccauugcacccagccaacauaauuuuuuugagacuaacuuacuaaggauuuuagaguuucaauugaaugucugguggguuugguuuauguaacaguauuauauuaguaguauuucuguaauacugcuugcuucauauagccaucaagaaaagaguuaaguauuaacuagcguguucauuuggaaucuuaguuuagaagaaaggaguuuguuucauuuuguucuuuaaaaauuuguuuugaaucuaagaagcgacuauaguagaaaaaaaaguuaaacuauuuucugaacguacuuauagacccauauauggguuucuuuguuuucccacacugaccagcuggguguccuaugauucaauuugauucucacacuaucucccugguguuagaguccaaucccucagguuaagcgcucaauccuaugagacugcccccacuucagaugucaguugcaagucuggggcuucagagcuucugacugaccagcuauaaauuggagguucucgugacccccuccuuggguuuagucauuugcuagagcagcucacagaacucagacaagcccuuucuuuacauuuacugguucaugauaaagcauauggcaaaagauacagaugaacagccagauggaagagaugcacagggcaagguauauggaaagggcuguagagcuuccaugcccucucuggccaugccacccuacaggcaccuucguguguucagcaaccuggaauuucuccaaacccuguagcucagggauuuuuauggaggcuuuaucauguaggcaugaucaauuauuaacucagucuucagccccacuccccuucucggaggauggggggguggagcuuaaagcaucuaaucauagcuugguuuuucuagugacuagcccccaacuaggaacccaccaagaguugccucuuuagagcaaaaaacacuuauauuaugcaggaaauuccaaguaggagcucugugccaggaaccaggggcagagaucaaauauauguuucuuaucauaucacaauaucacagugaccaaguaauuuucuggauggaucaaagucuuaagaccugaagugguaaucuugaaucaguaguaacucaggcaaaccugugacugaguggcauaaaguguaaauauuuuuguaagggaaauuuaaauaagauucuaauuauuauaauagcaaaguaaaaaaaaaucacuguucacaaaaguacuugggcuagcuuucuuaaaaagaaaauaaugggagcugcaggacagggagagguaaugccaguggagaugcagcacauguuggauggggcauuuuaaacagccuuuuucaauauggaauugggaaggaaaguugaguuaaagaaaggagggagugaauagcaaaguccaguacuacauuugcaacuuguaucauuucaaaauacuuuauaaaaagaugaacuuacaaugucaaaggaaugaguagauggacuuagaagauuucauauuagccauaauugagaauguucccuucuuugaauauuaaaagaaucuuuuggccuccacuuuccaaauuagguaugucaguuuuguuaccucuuuacacuaaaugauuaguaauuugucugaauuuaaaugggauaccuaggaggaucuuuauuugaaaucagcaguuuccuaaggagaaaguaaauucuuccuauauuagacugaucuuaacucaaauauuaugcuuuuauuuuggauggagcuuguuuuucuuucuccucugaaaguuacugaauuuuuuuuuuuuuuuuuuuuuuugagacagggucuugcacccaaguugaagugcaguggugugaucuuaguucacuguaaccuuaaacuccuggacuccagagauccuccuaccucagccuccuggaguagcugagacuacccagugccugccaccaugcuuggcuaauuuauuuuauuuuuauuuuuuguagagaugagugucucaccuuguuccccaggcuggucucgaacuccugggcucaaacgauccuccugucuugcccucuugaaguguugggauuacagacaugagucgcugugcccagccugaacauuuucuuuuuauauaguauuuucauuguaagauuuaaucucugcuaugaauauuuccuuuuuuucuuaaguggaagguuauacuucuuuauaucuggaaaaaggcaguguuguuuuuugcuuaagcaggaacguagaauuuagguuguaaauuaagauugaaaacuuaauuuagggccagguaugguggcucacaccuguaaucccagcaguuugggaggcugaggcaggcggaucacaaggucaggaguuugagaucaccuggccaacauggugaaacccugucucuacaaagguacaaaaaaaaaauuagcugggcaugguggcgcacgccuguaaucccagcuacucaggaggcugaggcaggagaaucgcuugaacccuggaggcggagguugcagugagccaagaucgcgccauugcacuccagccugggugacagggagagacuccgucucaaaaaagaaaagaaaagaaaagaaaaaaaacuuaauuuagggacuggugcucuaaagcuuugagcuuguuugaaguuugguuaacagcugugguugauaagcauaccuugucuuuuuaagugaccauuuugcuuuuugugaaaauaacuucaguaguugaaaagucaaaauagaaacuuguucacccuucagaaaccaauugcaucaucucagcugauguuaacugcuuaaggaaauuauugagccuuuucuuaguaaauuucagggauauauaaaauguuuggcacugucacauuuuugucguuugaagaacuguacuuguauucacacuagauuucaaaguuauuuuccaaacccagaaaugcucaccuccucuuucuuagaacaugaacauaauacucuucaaugguuuuaaauguauauguucuuuggguaacuuucagaauaauuuuaagaaaucauguugcuuuauccucuauaagacaguaaaucaaaucucaucugcucuucauggugugauuauauuacccucaacacaaguaaauauuuuuuuguucguuuuuaagcaauuccauuuucauuuuugcccuuccuaguaguaguugaauauugacacuuuaauacuaaaguauggaucucggauccucagguuggucugggaggguagcauaucugcugucuuaguaaacauuuucgucaguguaaggagaagagugagaguaaagaaaggagccaauaccuuuauuugugauuacuauaaaucgauuaaccacagcucuaaaacaauauauuguuaucaaacuacccgcuccuucccaaaaacaaaacaaaguagugggauccuucauuuuggcuuugaacuaaagugagggaagucauuuauacauagccaagagcaaugaaaccagaaaauauaaagguuauaugaaaggcuuuauagauagagcuucuaucugauuuuauaggucuuaguggcuucuuccuauggcaagccagaggugauuaugauuuaggaaggaauacguaggugguccaggcacugaaaacauggagaacagcugcacugcagguaucauuccuccucaggcucacagaaugaaaucauuccugacaauguucuuucaaguuguguucuucaauuucaguuuuauccuuuccaaaaaugggguccaugugaguuuucuucaauucgcuuuuaaagaauuguacucuuuaaaaaucuuaauaguuuguuuuaccauuuaacaugaaaaagcuugauaauuuguuucaacuaguuuuccacgacuaauuauuuccagaguauaacagaucccuugauagucaaauuaaugauuagguuuuggucacauuuuuugccuucccugcuuuuccugcuuuuguuauuaauaacaacagcaaaacuuacauaagugcaacaagcacuguuaaccauuuuauguauagaauuaauuaaacucauuuguuaaaaugcagaauguguggcacugauugaauuuugaaccaauaauuucuaacaucagguggauaauaaaguuuauuuuuaugcauccuucagucccuucauucccuaauuauauuuaccuaaagauguuuaugugccuuuaaaacuaaugugucugcuguuuuaguuugacuuuucaauuuuuaaaaaaccaaucccccuuuauuuguauaauuuaggacccuuugugaaucccagucucagcuuaucagccuuuacaauuugaucuguuaaauaauuuauaugcuccugaauguuuagcauuuuuuaaugauuuuaauuaaaauuccaaaaguaauggguaagaaaagcaaggaauguggucauaucuuaauuacauagaugucaagguauccuuaagugaguuuuuguuuguguguuuaaaucauuucuuaggcucaguagaaaagaagcaacagagaagaucaauuagaacucguucugaaucagagaaauccacugagguugugccaaagaagaagaucaaaaaggagcagguuggcuuccuacauguagagaguuaaaacauuguauuuguaaauguuguggcuuacauuccugucuuaaaagaaagagaaacuuucccccacacugaguuuccuuucuggacuaucuuaacgcuucuguccugguggguuccagugcucaguuuuaauacagccaucccugugauucugcuucaagcauuuucacagaaaacagguuucaggagaugggaagccaguggugcaagacuuaaaaaauccuucacauuuauuuagaaguuucuguuaucagcagaaugauuucauguuuuuaugauuuuuauuuggaaccaucauugaguuccuuuuuuuuuuuuuaaguuugauuuuugguuuaagcugcugguauauauuguuuuuuauuuuuuaaacaaaucaauuuaauuuauauucuuauauuuaagaagcagauauucauagaugaucuguuuuuucuguuaauaucgcagauuuuuuggaauguuauuuucccaguggaauauucaccugauaucagguugucagauaaauaauauuuagguaaaaaaagguguguggggggguugcauuuugacugaaguguauuaaaccaguguaaucaauguaguaagauacauuuaaaucaacuuuucaaauaaaauuuuagaagccauucuucuuuaaauuaaacucacaaucagauuuuuucuuaauuuuuuuguuaaagaauauccauucuuacagccuaaacaccugcuagcaaacaaaacaaauucugaauagaauuaguuccaauaaguuuuauauuuuuuaaaccauuuauauggaagaaugugagcuuuucuauuuaaaauauuuccuucaugauuuuaaacuuccaaauuuaaaagcuaacuuugugggugcucugugguaucaccaagcaagugaaacaguuuuuccagaauauuuaacuaaaauuuaaauaguauacuaauuugucauucauuuaucauauuaacuuucauauuucauacuuaggaaauuauauuccaaaaaaucuuucuaagcucuugaaaaucuauaguuauucauuaccaaaaugaaguugugauuuugccagcugguucccaaaaucagucugugaccagucaguuuuaaacuaauaagcagaaugaguauaaaaagugggacaaauuguuaaugccacuguguuauaguuaguaguagaacaauaccagugauuguuuagaagauuuuauauuuguauuacuaauuguaucuuauaaaagcguuucuguuguauguuuuuuuaccuguuguaaaaaaaauaaaauuuuuuuuaaaaagcuuagaacaauccuuaaauauuuacaaaauguguuucaacauucauauuucaccacaucuuaaagaaacaugaaauucaauuuauagcuuaaacaggaacuccuccaaacagccuccuuucucuaauuccaaugguucaauccucaaauuaccacguguuuuacauauacauuggcagaauaacuucugaucucgcucuccuaauguaggaucaagacacuguucauaagacacucaagaaagugcuuuugcaauaucacaaacuuauuuucuuaaguuuguacuagcagcaaaaguauugagcuuccagcuguauggagcccuguagcacucucuacagagaggguccugauucccagcaacuuagcugugagugcaggcgcggaagggucuuaaaguggcgugaguuacauuaaccugaguaucauaguaaguaaaaauuuauccuaacgucuuuggggcgggagggguuuuuagcaacauuggggccgguugcagaaacaaccccucuccugccuuccagacacugaggaaaguauucuuguucucuucauauaccaagggaauggugggaaaagucuuugcuagagagcauguggcuguguguugucacuugauauucagcacaggcagcuaggauuuaaacccucccugaucuugagacagagaacuuuacccaaaagaugggacugaguucagauuucagauacauuaaucacucaucauugcuuagauugaugaaaguaucuuuucccucuguuaauaauuaaaagggaaaaaaauucuuuguuaaugcuguauuuuucuguccaaacagguugaaacaguuccucaggcuacagugaagacuggauuacagaaaggugaguuaauauuauaauguugcuuugcauuuccuugauuaaaaccaauuuuuaagaauuauuuguacuucauguauuuuugucugucucuguaaaucguuguugcucuucagugugaaauugcaguauuccccaguguucgugugugugugugacuuuuagaguugaucuuauucuguaccuccacgugaaaagucuuacuuguuuugguaaauuggagaacacaacguagacuugauacuguuuccaacuuuucuccauaagauucugggguuucacuggcuuauaaacuagggaugugacgaauccacuuuuuuugguauucgacugaauaccgaauaguagcuauucauguuugucaaacauggacuaugacaaaucagacaagacaagcugauugaaaaaaucuugccacauuuauuuuuacagugcuguaaaaucuuuuuguaaauuaaaaugauucauagcauuuauggccacuauuagaugaccuuaugcgaaucuauuugagauaugcacaaaguuuaagaaagcuuaaacuuauaucuguauuuucugugugcaauuugacuacaguacaaacuccauagcaugauucgugcguuuuuggugagaucaaacuguauuuaauaccuguaguuuacucugggcaaauugcauuauuuaaaaauaaaauaaaacaacagccucucugcauucucggggagaagucugcagcgauggucuccguggagauccucagcagaacugaacagccucucggagggaacacugcuuggcggagcuccaagaaaagacaucgcgaucgcugcgagauuaggaggccugauugcguuguguuuccaccauuccacagggucggcggaccggggagugcagggcucugucagauucagugacagcuccgucuccgcagcgauugaggaaacuguggacugagauuccuguacaauuucaucccagaaacuccagacuuguagucuccaugcaagauuucuuugucggcggcuugauaaacaguuucuuuguuuucgauuuugauuucgccaaucaucauuauuggcauuuuccugccugguuucuucuucaagacucugaacaauugcuuuaacagucaaaugauuuuuuuuuuucgguuugagcuggauggguacagcuuaaaucauggguccagccuaaaaaccaccauuuaacuuacacugaucaauuucaacauggacuguuuuugguuuuuuguuuuuaaauaaagcaucauuaaugcacaucugcagggguuugccaaacagcccaaacuguauacauuacaaucauuaaaaguucuuauuuuuuuuaauauuagugccguuaucauggagaacagcaugacagcugucuuuggcagucugucauuuuucuagcauuuucagaaacucaucggaaauggcgguaccuguguuucccuucgaaagccucucaguacagcacuccuguuccucuguuaaaacuccuuguuaauccagugaucuuuuaggccaaggaaauauuuugugaugguguucuggguccauacaccagcaaugaaggagauagauuuguguacuuguguuuuuuaaucagcauuaacaugggcaggcacccucauuuauagaugucaggaaacauucagugaaaaacuuguagaaugggaugugauaacgagguuccaguaaucugagcagucuaacgaggcccaccuccuccaccacagaacguggcuauguuccaagugcuacucucacucagccuguugcggaucuucauggccucaggagacuuguuucuccaugggcucuucuggacugcacacuuccaccauagcuugcuggguugaucuagaugucuguuuguuguauggaaauuuugggggaaaaaauccaaaacacaaacuguggguugaaauauuaaccgucuccuugguuccuugguauucaccgugccugaucugcacauuucaucguggcuguuucuguauagccuauacugcauuagcccaagagauuguugcuuuguaacuuuuugcacuauuguuuuggcuggauuuguauuacacacaguuuuaaaaaaaacaauuccacacuauucucugccuuuuuuuuccuauuuauuucuucccgcacaaauuccacauagaggccuucccauccagcucuacgugauuuggcugcacuugaacacugauuguccauuuacagcccucagcaaugugccuucuaaauggcaugacauauguagaugugcugcagcgcuuguuaauggucacaauaaaugccacuucaccaaggaagucucagaugaacaauuaugaacauccaaauuuuauuggggggcaauaaucaacugaauugcaaaauuugggggaaaauggcacuauccguguacgaaucgaauacaaaucaaagauuugucacaucccuaauaaaaacaagauggagaugucucugcaaccauauuuguaagcuacacaguguguuggguuuuaugucuucccccuccaaauugaaugguucuuugaauugcuccaaauccaucagcuauccugcaauuuucauagaauugauuuuuagguuggaacgugggcucuguugacugaaaauagcuuuagagaggagaacugaauuaaauguuuugauagagcgguuguaaauuaaaucagucacuaccaggaaggucagaaguucugaaguuuugacucauuauuucaguguuacaaagagagcuaugcuuuuuccacacuaaagaugaguuugagaaaagaaaauauucucccacacacaaaaaaauuaaaacaaaccuuaaguacuauuuuaggauuaauuucaguguguuguauuaaggugccagcgagauuucagauuccuguaaaccucuaaagaaaaggagucgcgccucaacugauguagaaaugacuaguucagcauacagagacacaucugacuccgauucuagaggacugagugaccugcagguaaauaugugcaagggucuggacaaaguguucuuucuugaacauaaugcuuuucccuuauuuauuuggggaaaucaggacauuuuaaaaauacucauagaaaaaaaucacuuuguuuauuuugagugucuuaauucuuuugcucucauguuauauaacaaaacuauaguuuguuuguaauuuuaacuacaguuuuucccaaaacagcagaccuaugauaucuguggauuuuggaaagaaaggaaggaaaaaggugguugugucaagaucuaauguuugagcaagucuuacuaggauuuucauagcaucuuaucuuggagggaauuuucauuuuguuuuucuuaaaaaugcuauguuuucuauguagguaggcuuuggaaagcaaguagauagcccuucagcuacugcagaugcagacguuucugaugugcaguccauggauucaaguuugucgagaagaggcacuggaaugaguaagaaggacacuguaugucagguaggcagguaacuggugcuauggcuugaaauaauugcuauuauauucugccaguaauagacuuaacuccuguugaagaggauaauauguuuccaaauuauuaugauauuacuuuaaagcuacagauauaaaaccucuuugugguucuuuuuuucccuuucugaguuggaauacuuacccacaugccaaucuuuagugugauauacuauaauuaauuggaaguaaauggcagaugacugauuggaaaaacuuucuuaaauucaaaauuuuaaaguaauaacuuucucaguguauuuuuaccguucuugaaaaaauacugcuuugcccugugaagaaaacuuaaauaugcagaucccaaagaaggaauccuaaaagaucaaguaugacuuuaaacuuuauaccauauuguaucuggaaauacuguaauugucuaguucucugguucucaaagugaaggccaaggacaaacaauaucagcaucuucuggauacauauuagaaaugcacauucuuggggcccccgccagaccuacugaaucacagucugugggugagggacccgguaauuuguguuuaacaagccgcccauguggucuugauguuugccaaaguuugagaaccacugcuuuuugccauauuacagauuugugaaagcucuggugacucucugauuccuugugagggagagugcugcaaacacuuucaccuggagugccugggauuggcaucacuuccugauagcaaguucaucugcauggaauguaaaacugguaagaugacuuauuucgauagucaugaaaagaugaaugggauugugccaggaaugugcacugacaaccucuccuaggacaucuuguucccaucacuuuuauuagcccuccuccucucuucccaaagguauuucaacaaauuaagauuuggcuucaagauuuaaaaaguaguuaaauuuccuccuacuggugccuucuaccauaaaaccugucaaauuaccaagaugaauuuguguuuuaucuaaagaguuauauaaaguauguuaauugaguuauuuuucagauggauuugagauuuugggggcucaauaaauugguuuaaaguucuuuaagagacuggaagaaguaucagugcauaacuacagugauuauauuucuaguggaaauuuggagcuacuggaaaucauuuuuuaaacuugggauucaccauuuauuucuuaucucacuauacauagacuaccaccuacuaaaauaauuuguagagaaauaaauaugcuaguuuauauuucuucucucuguagccauaauucugguuaauaucauggaaagcaagucguaguuguuuaaucugucacaacauggcaaauuaaaaauaacuggagaugacaugguggugcuucuaggaaacauguugauguguuuuuuguuuugcuuuguuuuagcuaugaggaacuaagccaaucagauagcaaguguacaugauaugcugaucuuaccuuugacucuuuauuauuuuucuacuccuucuuuuccuuuuauuuggauucuuacagauauuuauuuuaucuuuucuuauuugauuguaugccuccuaaaaucuuucagacaaaaaguuaguaauuuuuuuuuuuuuuuuuuugagacagagucucgcucugucgcccaggcuggagugcaguggcacaaucuaggcucaccgcaagcuccgccucccagguucacgccauucuccugccucagccucccgaguagcugggacuacaggugccugccaccacgccuggcuaauuuuuuguauuuuuaguagagacgagguuucaccauguuagccaggauggucucgauuuccugaccucgugaucagccugccuuggccucccaaguaauuuuuuuuuuuaacugaacacugacuuacuaaauguuaggugcuacaaguacuaagcauuuucuccugcuauuucauuugauccaugaugagauagguacuauuaugauuuccauuaugcagaaggagaaacaggauuagagaguuuaauagcuuccccaaagucacaaagauagcccaugaugacucugugauuuaaacccaggcagcuggacuccagauuuauuuuuucuuuaccauggucuucuacugcccuggugaauaggauggacaucacaagucauaugucauauaucccaauacacauucauucacauacauacacacacacacaaauacacacacacauguacauaaacuaagcuauggaagcuguuuagaacauauaacuuaaaauuuuccccuuauaaaauauuuuauucaucacauuuagacucugcaguaaaacuugugaacaguuugccaacuggcagccccggggucauauuaucugcacaucguuuuauuuggccuucagaaugcauuuucauuuuugaacacggauagagcauguaauccuggcuccucacauuccccauuauuccuuuuucuaaaauucagucauuccagucacuuauauaugcugccuggccccuuuaagcauucaaguauuguauuagggacuucuugcauugcuauaaagaaauaccugagacuggguaauuuauaaagaaaagacguuuaaguggcucacaauucugcaggcuguauagaaaggauagugccaguaucugcuuggcuucugaggaggccucaggaaacuuacaaucauggcagaaggcaaagugggaguaggcacuucaaauggcaaaagcaggagcaagagagagaguugagggagagggccacaauuuuuaaaugaccagauuucacaagcacccacugacugucgcaaagacagcaccaagccaugugggauccaccuccaugauccauacaccucccaccagaccucacuuccaacauuggggauuauauuucaacaggagauuuggguggggacaaauauccaaaguauaucaaguaugcaaucccugauuuaagauauugauaggaaggaccauauaucucaguauuaaaacacucuuagggcuucucuccuaacucuagaauccaggagaauucuuccaacagaggcuagguguauuuaauuugguacacaucuauuagaaaauuuaagagggaaauuugcuuuaaaaacaguuaaguaugggauguuaucaguaagcaugaaaaaaaauuuuuaauaaaaaacaguuggguagaacaaagucagaggacucacauuuccucauuugaaaguauacuacaaagcuacagaagucaaaacagugugauacuggcauaaagacagacauauagaccaauggcauagaaagcccaggaguaagcacuugcauauauggucaaaugauuuuugauaagggugugaagacuagucaguggaaaaaaagacagucuuuccaacaaaugaugcuggaagaguuggauauaugccuguaaaagaaugaaguuggacccuuacccaacagcauaaacaaaauuaauucaagaugaaucaaagacaaagauguaagagcuaaaccuauaaaacucuuggaagaaaaaauugcauagaggaaaagcuucaugacaauggauguggcagugauuucauauacaugacaccaaaggcacaggcaacaaaaggaaaaacagacaaauuguacuucaucaaaauuaaaaacuuuuguacaccaaagggucuuaucaacauaauguaaaggcaacccucagaaugggagaaaauauuugcaaauuacauaucucauaaagcauuaauacccagaauauauagagaacgccuucaacucagcaauaaaaaacuaaacaacucaagccaggugugguggcuuaugucuguaauaccggcacuuugggaggcugaguugggcggaucaccugaggucaagaguuuaagaccagccugaccaacauggagaaaccucaucucuacuaaaaauacaaaauuagcugggcaugguggcacaugccuauaauuccagcuacucgggaagcugaggcaggagaaucguugaaccucggaggcagagguugcagugagccgagaucguuccauugcacuccagccugggcaacaagagcaaaacuccaucucaaaaaaacaaaaacaaaaaacgaaacaauucaaaauugggcaaagaucuugagcagauaguucuccaaagaagauaggcagauggucaauauacauaugaaaauaugcucuauauaaugaguaaucagggggccaggugcaauggcucaugccuguaauccuagcacacuggggagccaaagcagguggagcucuuugagcucaggaguuugagaccagccugggcaauauggugaaacccugucucuauuaaaaaaaaaaaaaaaaaguaaucagggaaaugcaaaucaaagccacaaugagaugccacuugauacccauuagaaugaauaguaucaaaaaaaaaagaaaaaagaaaacaacauguuggcuuaacuauggagaaauuggaacccuugugcauuguugguggggauauaaaaugguguaguggcuguugaaaacccaaugaugguuucuuaaaaaauuaaacagaauaacaaauggucaagcaauuucacucuggguauauacccaaaagaacugaaagaaggggccaggcguagugucucacaccuguaauccaaggauuuugggaagccaagacgagcggauugcuugaguccagguguucaagaccauccugggcaacaugguaaaaccucauuucuaccaaaaaaaaaaaaaaaaguuagccuggcaugguggcgugugcccauagucccaaauacucaggaggcugaggugagagaaucaccugagcccaggaagucaagacugcggugaacuguaauggcaucacuccacuccagccugggcaaccagagugagacucucucucaaaaaaaaaaggacuccaacagauauuuguacugucauauucauauucauagcaacauuauucacaguagucaaaagguagaaacaacccaaauguccauugauggaugaauaaacaaaauguaguauguaccuacaauggaauauuauucaaccuuaaaaauaaauugugauacaugucauaacauggaugaaccuugaggacuuuaugcugagugaaauaagccagguauaaaaggccaacaaauauuguaugauugcauuuauaugaauuacuuggaauagucaaauucuuagaacaguagucaccaggguuguaggggaggugagaugaggaguucuuuaauggguaccaaguuucaguaugggaugaugaaaauguucuggaggcagacagugguaacaaugugaauguacuuaaugcuacugaaccguacacuuaaaaaugguuaaaguguuaaauuuuauguuauauauauuuuaccacaauuauuaaaaaaauuaagugcuuuuaauuaaugacaugaaaauuaguuuaguaccuauuugguacacuucuaacauauuagaagugagaacugugauucuucaaaccauuguuuaaggucauuuaggcaauuuuccuuuguuuacaaaagauaaacacuucacauguaagaaguauugcagguacauaccuaauauguucuuauacuaccacuuucuauuauuuaagucaaacgugauuucuggaaagaaagcaucuuuauuugcccuuuugaauaaaauguacaauagaauaagucuccaaaaagaguucuguaacagauaguuuuacuuauucuguuuuuccccacuucccccaugguccuugacucuggaccgauggacugacuucuuuuuuuuggucccauugcccaggcugaagugcaguggugcagucucagcucccugcagccuugaccucccaggcucaggugauccucccaccccagccuccugauuagcuguagggacuacaggcacgcagcaccaugcccagcuagcuuuuuauuuaauuaauuauuuauuuauuuauugagacagauuuuugcucugucgcccuggcuggagugcaguggcgcaaucucagcucacugcaaccuccaccucccagauucaagugauucuugugccucagccucccguguagcugggauuacaagcacacaccaccacgcccgacuaauuuuuguauuuuuaguagagccaggguuuugccauguuggccaggcuagccccgaacuccugaccucaagugauccaccugccuugcccucccagagugcugggauuacaggugugagccacugugcccagccuccagcuaguuuuuugguuuuguuuuguuuuuuuuuuuuaguagagagacagguuuaccauguugcccaggcuggucuugaacucccauacucaagcaaugcacccaccuuggccucccaaagugcugggauuacaggcaugugucacugugccuagccacugacugacuuguucuuaaugaaagccauuuccuagugaaaaggaagaguauggaaagcacucacauguuagagcucuaaccuaagucuuaaaggaguuugauaguucagcucucuguuagcauaacauuugcacuaguuuucacuauuuucauuuauauuaggcuuauuuugaucauuacauaaaugaaggcuuauuuuauauuuucuugagagagguucuugcucugucgcccaggcuggagugcaguggcaugaucauagcucacugcagccucgaccuccugggcucaauccucccaccucagccuccugagcagguggaaccacaggcacauaccaccacaccugccuaauuuuuuaauuuuuuuguagagauggggucuuacuguguugcucaggcuggucuugaacuccugugcucaagugauccucccgccucggccucccaaagggcugggauuacaggcaugagccacugugaccaucugaaguccuauuuuauuuuuacagagaguaguuuauuuauuaaaccaaucugugaagucaaacuuccuaccuuuuaaauauauuuuuuuaauuuuuaaaacuuuuaaaaguuauuuuaaaauauauaauuaccuucauaucuauauacaugguaaaauguacuuuauuggccuuaaccauguggugaaaaaauguacuuugaaauuacauauuuacaaugggaccaaaaaaaacccaccuuacuguacuuuauuucugcaaaacaauuuaaaaagugaacaucacaguuucaacuacucauuuuaaagaacuuuuauaauucagcaaauuuguaaagauuggguacuuccagaaucaaagaacaauaaugcaguucaccuaacuuucuguaaaaaagcaaaacuaucccuuauauuuuuuccuucagauuuuuagcaggcauuauaagaaaaguggacaaaagacuugaacacuuucgaaagaugauauucagaugaccaauaaacauuugacaaguuuguuauuauaauuugcaguucuuugcuuaaacauuucuuucuguaucuuuauugacucuugugaauuaucuguuuaugugucuuauccauuuauguuuugugguguuaaaaguauucuuaucauuuguuaauauuuuaaauuuauuucuaauuacacaaguaaaacauaaccacauuguuuugaaaauauuauaauuacuguucuugcugauguuacccucgaucaucagucuuaauccuaggcccuuacuuaguuccaguccugacaaccauugucaguuugacguguagcccuguaaaccuuugugugugucuguguguguguguuuuaguacaaaucugucauaccauuguucugucggagcucuucuuaugucaauacagaugcauucuauuuaauugcugcauagugcccuaguauacauauagucauaguuuauuuaacucuuccccuaucgaaggacauuugaguuacuuucacuuguuugcaauuacaaacaauguuucaggcaacauccuuuaacauuuacucucagucuuccccaguguaguuauugagaaauugaauuucuaggcagaaagugaauguacuuuuauuuuaauggauauugcccaguugccuucuaagguagcugcuuccaacuuaaacuccugccagcccccuacacccuuaucaauaauugguauuaucacuguagucccaauuacucuggauucuggggcacgagaaucacuugaacuuaggaggcaaagguugcagugagccaagaucacacaacuguacuccagucugggugacagagcgagacucugucucaaaaauaauaauugguauuaucaaacucuuuaaguuuuuuuguauuuauuuauuuauuuauuuauuuuauuuuauuuuuuuuuuuuuugagacgguaucucgcucugucacccaggcuggagugcgguggcgcgauuucggcucacugcagguuccaccucccggguugacgccauucuccugccucugccucccgaguagcugcgacuacaggcgcccgccaccacacccggcuaauuuuuuuguauuuuuaguagagacgggguuucaccuuguuaaccaggacagucuugaucuccugaccuugugauccacccgccuuggccucccaaagugcugggauuacaggcaugagccaccgcgccuggccguuuuuuucuguuuuauaacugguuucaguuagcauuuaccugauuacuagugaagaugaacacauuuuaauuuucuuuugccuauuugucuuuauguaaauugcccauuuacauccucugcccacuuuuacauuaggcugcuuugguuuuuuucuauauugauuuguaguuuguaagucuuauuccauuaucuuugcuuauauauguugugugcguuuucuccauauguaaacuguuuauacaacaaaacauaaucuuuugucauuuuuguugcauauuucccuacaucuguuugucuuuuacuuguuucuucuuuuuuuccuguuuaguuuuuucauauuuggcauuauuuuccuccuugaacauuggacauauucaccaguggagccaucugggccuaaaauuuuuuuuuguugaaagauuuccaauuauaguuucaauuucuuuuaauaguuuacagaacuauucauauguccuguuuauuuuugugccauuguucguaaguucuuuuuuucuaggaaucuguccguucaucuaaauuuucaaauuuauuagcaaaaauauagugauauccuuuuacuaucuuuuuaauguuuguaggauugguagugauguuccauuuuucauaucugauauuaauauuaggaucuuucuccuuuuuuuauuauucuuaccagagguaucaguuuuauuauucuuuuucaaagaacuagguuuuguuaauucucccuggcgaauguugauuucacuucauucuugacgaauauuuucacuggguauagaauucugguuugguaauuauuuucuuucagcccuuugaaaauaucauucuauuguuuuuuuggcuuccauuuuucucuuucagucagcucuguuugaaaguaauugucuuuuuuguggauaauuugaauauuuucuuuauccuugauuuucuauaguucgaauaagauaugucuagcuguaauuuucuuuuuuauuaggauugugaguuuucauuuuauguauauuuugcacauagaaauaaucagugauuaucuaauggaaucagacuuuccuuugguaauuuauuuauucuauguggggaaaacuuugcugcugucugcuaccagaugucaaacaaauucuguucuggcuuuucuauggaaucaguuuuggagaucuaaauuguuuuuaguauucugucuccaaauugauaaucaauuauucuagcaaaauuuaaaacauaauuuuaauuuagcauuuauuuuaaauuuuuuuugugcauuaaauucuuaaguauaguaauagagucuguuuuaggaguagcuguuugaugucuguagcugcuucuacuugaauaugcuuuagucaauuuuauuuaauuuguauuccucaccaauuuuccagggcagcacccauguuuuucguguaaagugucugguaaagaugugaagcguuguucuguuggugcuugugggaaauuuuaucaugaagccuguguccgcaaauuccccacugccaucuuugaaucaaaaggauuccgcuguccucagcacugcugcucugccugcucuauggagaaagauauccacaaagcaaguaaagguaaaacagcugaagaaggagacaaagauuuuuguuuuaagggcaguggcaaauaacauuaucaagcauauauuacaaacaacauaaggcauucuucuucuguguaucucuagcuuuaacaguucagccacaguacauacacaguacauguuaaguagagauuacauucuaaauucagaccaugagaagaaaauuccauguguucaaaauacccuugaaaguccuucagguaggugccauauuggauaccaccgucucugcagcauuggaacaaauaauuuuuucuuuggaugaucucuacgugacuauuaggcuuacauuuaggggccauauagcauaggaugacagagccagacuagggaagaaaaaaaugcuuuccaucuacuguaacuagcaucucagagggacccaaaaaagcccaacuccagaaacuuauuuuuaugucccgcugaugccuuauuagauuccuuuuugacuugucuuuaaacaggccgcaugaugagauguuuaagauguccaguugccuaucacucuggagaugcuugcauugcggccggaagcauguuaguauccuccuacauucucaucuguaguaaucauuccaaacggagcaguaauucuucugcuguaaauguaggcuuuuguuucguuugugccagaggugagugucugacuuuucucuucauuuauuuuugaggucauuggcauauuucuccauuaacauagagucucagcauugggaaagaacucaggccaucuaguagaaucuccuacccagugcagaauuccacuguaauauaucccugagagagaugaacauuuccaguaacuuuuauaaugcuagauguccaaaguguuagaauacuaauucuuccauaaguuaagcuaaaaucugcauuucuaaaaauaacagaauuauaguuaaguucuuaguuuuucuguuuggagcauuaaaagauuaaucuuuucccuucugcaaacaacucuucuauucaaaguagauccuucccauuucauaaucuuaaaccagaacuuucaacugauugagauuucacuuggaaggcaaaacuagcacauccauuuuucaguuguuuaugcuguauuuuaucauaauguuuuggucuggcauugaggagggccugaugggacacagccaaggcagcauauguggugguguuaguucagagccagccaugugggcuuucuuguugccagcuguugacguuuaaguacaccaagagauugaucaacuaaaaacaauacuguagcccuacgggggucagugaacuuggguucaugauaaauauaaaaucaaacuucuuuaguugaauguuauacagaauaucuggcuuuaucucaagccauauuauaauaaaacuuuuuugguacuuaguaagcauuauaaaaacuaacuaauaucccuaaauauugcuuugguuuguuuuuaagugcaaaguuuucugacuuucccucugaacuauucucaaggccucuaaggcccaucaugcuuguuagauucuauuuagaccauacugaacaugaaagugguuuuuguuugguugguugcuuuugcuuuaggagacaguuauuuuaauuuggugaaaguacuauaacaacuuucuaaaauagaauuuagguaguaugauagaucuuaggugguuuugcuuuugugucucucauuaugaaaacauuacuuggagguaggcaguaaaagauuaaauaaaucguaguccuuuguggaguagcuagcagggucuguaguagacacuacuuucuguuugccuguuuuauaagcacaugugacugucugccuuuggagcaggaaguacugugucuuucuuaacuacagcagugucaaauguauccugcucugaaaccuggcugguaucauggaggaguaggucugaaauguuuccugcuauaucguaacaggugggcaaauaauaaauaaaaaggugucacucauugccuuucccaucucugcauuccuaagaaaguaaugauuagaagaaaaaauuauuguauuaucaguugaauguuuagcuuuagagucuuuuaaacggaugaguggcagugauaacauaaagucucuuauugcuuugcaaacucuaugcuaccauugcugggcacugacauuuccugucaguguauaagcaugcauaauuuagcccgcauuuuaauaucaaguuuauaacuauuauguuggcuuauguuggggcacauucugaaucaaaugccaucaguagauuaauuaauauucucuuuugcucuacuucauucaauaauugggauaccuuuaaaauagguauuuucaggcugggcacaguagcucacgccuguaaucccaacacuugggaggcugaggcaggaggauugcuuaaggccaggaguucaggaccaguuugggcaacauagcaagaccccaucucuacaaaacauaaaggaauuagccaagcaugguggugugugccuguggucccagcuacucgagaggcugaggagggaggaucacuugaccccaggaguucaagacugcagugaguugugaaacaaaauauaguauuuucaauuuaggacagcuagaaaauuguacgcuuauagaaacucuagccacuuuguuaaauuuaacuuacauaacuugauuaaauucugagaauaauguaaguggagggaaaacccauguuuaacaacagaaucuguauuuacaucuuaacaauuugacgguuauccaggaauauuuacugaauuuaaaugccuguuuaagcaaaauuauuuaauucccacauauuuuaacugugaaacuuuguaugguaaacauaaccuucauuuuauuuucuagcauuugacaaagacuuacucuaaauagaucagaugcugggaaggcuuaaaucaaaagucuuucagaaguaaauaauauguguucuuuuauaaguauuuauaaaggucaccuuuuuuaaggagacauaacuguaauaaauccacacacagaaaggagcacuuuagucauuucuguuuggguauuagaaaacuuagcuuguuuugcuuguuucuugccuuauacagaauuuuucccuccacauagauuuucucuuaguucuugguuauuggguguuuaaaaucauuaagcuauuucuuaaggacuacaaugucuggaaauauuuuuugaaauguuucaggguuugacaucacuccucuuccacaugccaccuaaucguggagucacaagaagugugcggacauuuuucaguguagugcacauucuuuagcaucuccuuucaucuuagaggguuguguaaaauaaguuacuuaacauucuaugccuuucuuuguaaugguaauuuuaaauggauaauguaggcuggaguuuucuuuucauuuuaacaguaaauaauagcaauuuauuuugcauauguaagucaaacuuuacuaaacauuaucugaaugaauugccacaguuucccuaagaaguuaucucuccauaguauacaggugagaacacugaaaccuagauuaaauaauuuaccuaaugacacacaaguuguuaaauggagggacuaguauuuguacuuaauccuucuuauuucaaagcccauauuccuuuacacuacuccaucucccucuauuaaauguacaaaguucauuucaacauuauauaacuuuuuuuuuugagacagaguuuugcucuuguugcccaggcuggagugcaauggugcagucucagcucacugcaaccucugccuucuggguucaagcgauucuccugccucagccucccaaguagcugggauuacaggcaugugccaccacgccuggcuaauucuuuuguauuuuuaguagagaugggguuuuuccauguuggucaggcuagucucaaacucccgaccucagcugauccgccugucucggccucccaaagugcugggauuacaggcgugagccaccaugcccagcccauauaacuuuuauuagaagacucuggcugagcaccauggcucaugccuguaauuccagcauuuugagaugcugaggugggaggauugcuugagcccaggaauucaagaccagccugggcaacauagcaagaccucguuucuacaaaaaaaucaaaaacguagccaggcauggggacaaauggcuguaguccuagcuacucgggagguugaggugguaggaucacucgagcccaggagguugaggcugcagugagcugugaucugccacuggacuccagccugggugacagagcgagacccugucucaaaaaaacaaaacaaaaagaagauugucauauuguuaguaauuucaaguuccauucuguuauuuaggucagagauauuucuugaauucgucucaguguagaguaugaagacaaugcccacagaaaaaaguaaaugguaauuucccuccccuucaaaaugaucucuuaaauaaaacugcugccguaauuuguauuguaaauccuacaucauuauacacugauccaguaaccaagauagaggauagagaaauguccccuggucucacaguugccuagguuuaggaguggcuuauagcuacaucaugaauuaacugggggagggguaagggaaagaagagggaaccacagguagcuuuaguguuuuccuccaaguagcauagcuguaauugguagaucaaaaagauuguuuuuauuaacgcuuaaguugguaauccuuuuauauuguggcagggaaaaaaugaaaauguuugcauuaccucaguaaaguucaggaaauuauggcuccuuuaaaaucauguaccaggccuggcacaguggcucaugccuguaaucccaacauuuuggaagaccaaggugggaggauuacuuaaggcuagaaguuagagaccagccugggcacaaaagcuauuauagaccccaucucuacaaaaaaauuuaaaaauuagccuggugugguggcauguaucuguagucccagcuacucgggaggcugaggccagaggaucgcuagagcccagaaauucaaaggugcaaugagccaugaucacaccacuacccuccagucugagugacagagcaagacucugucucaaaaaauauauauauaauauaaaaugaaauaaaacauguaccauauugauagagaagaguuucauuaucuggcagagaaaguuaggauuucuuugaguaugucugaagauaugaauagaaaaaaggagagacuuccauucugcauuaaagugcuacuugauauauugaagguagaucagggucuacuuauguaaaugauucuuauuucuaucucauuacaugauauauaauaucauuuuguucuuugggcugucgucauuguacauccaaauacgaagcaguguagcuuuguuuucccuaagggguuuucuguaugaugucaaguguuuauaucuucaaauuauuugaaguuuucuucugcagaauuuagguuucuauaauauauagggauaaggaauugaguaguucagacucccuuugaaaacuguagaaaaccuuucugucagaucuuucuuuuuucuucauauucucauuuucgcccuccccaccccagcuuugaagcauacauaauagguguugguuuauuuuuuccucauggaaucauggguaguuucauugcagcucaucucuuucuguuuguuucguauagggcugauaguucaggaccauucagaccccauguucaguucauaugccuauaagucccacuaccuacugaaugaaucaaaucgugcugaguugaugaaauuaccuaugauuccuucuucgucagcuuccaaaaagaaaugugagaaagguaauaaucaaaauaguuucucuugcuuuuauuuuugcauuuccuauuuuuuucucuuucaauauaggggggaaauguaugccugucaagcaccaucuguugcuuuugguaaauucugccuuggugguugugacuguuucuucauauggcugcacaauuauuaaaaagggcuuaaaauaauuccauuguugcacauuuuuacauacucuucccuugaauaaauuuuuacacauuccauauuuauaaguuauuaaaauaggaagacuaggauuuuggucaguauaaauauagaaucauauucuaaauguucuuucucuuuuuccuggugugaaacuaucauucaaguuggaauagaaaagauaggguauaauuuguuacuaacuuucaacuaaauaacaagguagguuauuaaaagagggaaacuaagauacugauacuugaaaguuugcuuuuagaauauguucugucauugggcuucuuaaauguuugguuaagaugcuaugaaaacuaguugcccuucccuuaggagacauuggugggaagcugguuggggagaauaccccuaauacuggaugcuggaaggcagcccagcugaauugcugauggauaauuauccacacaguaccaagagcuaaauggauauuucuguucucccaguuaauuuaaccuauggaagaaaacuuuauauuguguuuaguuuuccauagccuaccuguuauaaaaaugauuuaacaaugauguauuauuuggggaguuauuaucccacugggaaaaauaaaugagcuugaaaggugagggccuuuuccuguguacauucccauuaugaucuggggccaaguucagaaucuuuaaagaaaacuucauucauaacuaauauacucuauacacacacacacacacacacacacacacaguagguguauuugaaaugggcuuuugaaaaaauucuuuguguugccuguuugauguaucuuugcucuuugucagacaucugaaguggcaacucaugacuaaaagaaagugagacuaagcaagucgauuggaacauauuagaaguauuggagagaguacuggcuuuuuugucuguuuucugcagucagauuauaucaccuuauugauaauacugccuacuuccaaaacaaaaaaaugaacauagguuugacuuacuccauaauuauucugccugagacauuuuaggaaaugcuuuauuuucuugcugguaccuauauaaaauuagauuaauucaauuguugcuuacuuuguuuucaguacucaguauuaacuuugacaugaauugaaauuauuuugagcccucuguuugcuuaacuugaaccauaucuuacuucucuuguauccuaguuuucuugcauagcaccaagguggaccauucacauuuuuuuuuauuucccuuguguauuuuaagcaucuuuaucaugaugauuuucucugaugauucuggcucuguauuuccucugaaauaagacuuaaaauuaagaacuauuccauaauguuaaaaauggccagccugacuuuucuaggucaguacuaauaaucacauguccucuaaagcuguuugcagacuuuucucccugcuggucauuccuuucugauggaaaaaaaaaaugaauaaucucauuuuacuuuaaauuuauagacaaauucccucccuaaguguagagcacuugggcaucugaucucuagguugguaaauugaaucaauuaaucuauacugagauguagucccagaaaaaaaaucuugaugauugaaguaaaagcuuuuaagcagaggaaauacagugauuuaauucaucauggguuguauauggauuuucuuuuuguuuuuauguuaaucagaaguuugaaaauuuauaggaagacaagauuuucuggaaaauugguagcaagcccucagaagguuggagcaugugauuugauaaaguugcauagagggcucuuacccuuuugcuuaugagacuuuaaaucuucguacacucauggguuauagaccugauuuuccaaugaaaagaucaauuuuuuucaauaaauauuugucuuuauuauauuucaucuucagugguuaacauucgcugucacguauugaaauacauauuagaaauaccuaauuuccucccagaauuucauauuucuuagcauuuacaacuauuuuguuugccacaccuguuuuggucucaauccagagaguauuuuguguaucuaaaaggaaagaguuuugauagggaacuuggaauuagcuccuugcauaugguacuucauucuauacugauaacuacuuaauuuuaugcuauaaagcagugguucucaauaugaagucagaagagacuuauguaaacaaaauuuuugaacuauguuuaauauuucagaaaaucuaacaauuacacauuuguacagaaucaaacugcaugaguuuuuaaaauuuggcuaugauuuuaacaauuuaaugggauaauacuaguuuuguuauugggaucagaaucucugauuggcaguuauauauuucuuugguuaauaaaaaucggagaaauuguuacuuuuaaaaugcagauuuuggccaggcaugguggcucacgccuguaaucccaacaguuugggcggcugaggcaggaggauugcuugaggccaggaguucaagaccagccugggcaagauagagcccgucucaaaauauauucucuguauauguauauauauagagagaauacacacacauacacacacacacacacacacacacacacacacacacacacagagggagagagagagagaaagagagguuuuuugguuguugauaaaauauuugaaauuauguggguucaugaggagggaaaagggaauccuuggugaugaaaaaguugcaaaccacugcuguauagccuguaaaucuucaccaaaagguaaugauaacauaaucaccaauuugagauucuguguuccuuuugcuuuuuguauucuuuauggaaagaaaaaaguacugaucaaccuauuggcuauuuuuuugcuugcuaauuauauuguaaaggaauuuaguuaaccauggcacuggauuaaaauacaacgaugacuugcuuucuuucuuaccucugaaggagaaaagaaaguugcuacuuacauguuugaaaaaccucucaaaucuacucagucaaaagauuuuaugcuucaauuuggucauauguuaagaguuuagcuucuaaacugauaccucaguagcccauaguuuaaaggaguaaagaguacauggaugcuuuugguacuacucagaagcucugaguuucuggccacugaaacccugaaaaguagcuaaauacguucacuugcuauuuuaauccaucacuguagauaugacucagucccuuuguuauuuucccccaauuugaaacaaauuuaaugugcugaaaagauaacuuucuccuuuuucuuucuuuuucucucuccucuuuucucaguuauuaagacuguuuauuuguuucaagguggaagauugcucugcugugaaucgugcccagcuuccuuccacccggaaugccuaagcauagaaaugccagaaggcugcuggaauuguaaugacuguaaagcuggcaagaaacuacauuacaagcagauuguuugggucaaauugggaaauuacaggcaaguuuuuccaagaacaaagaggaaguauucaaucauugugcagaccaguuucauacucuggauacagagugacuuggagauagauagguagacagcauggaccuacuuccuuaaaaaaaaaaaagaaaagaaccauguuuugaggcuggguucuuaagggguugggaagguuauguuccuaauucauuauugaauuucuuuuucuuuuucuuugggauugguugguugauuguuugugaggcgguuuggcucuaucaccaaggcuggagugcagugguaucgcagcucacugcacccuccaccugcuggcugaagccauccucccaccucagcccccaaaguagcugggauuacagguucacaccaccaccccuggcuaguuuuuuguauuuuuaguagagacaauguuucgccauguugcccacgcuggucucaaacucaugagucaagcaaucugcccaccucagccucccaaagugcugggauuauaagcaugagccaccaugcccaccaacuuuuguuuuuaaguccugaaaguuguuuuauacuaaugggcuauguacuacuagauuuuggaauaaaaggucuuauauggacaguggagaugauuuuuuuuuuccaaaaaaaacuuuuuuuuuuuuuuuuuuuugagacggaguguugcuuugucguccaggcuggagugcaguugcgcgaucuuggcucacugcaagcuccggcucccggguucaugccauucuccugccucagccucccgaguagcugggacuacaggcgcccgcuaccaugcccgucuaauuuuuuuguauuuuuaguagagaugggguuucacuguguuaggcaggauggucucgaucuccugaccuugugauccgccugccuuggcuucccaaagugcugggauugcaggugugagccaccacgcccggccaaaaaaaaacuuuaaaaauuuuuuuuuaauuuaaauugaauaaauauagugagauggggacucauuauauugcccaggcuggucucgaacuccugggcucaagcgauccuccugccucagccucccaaagugcuagaauuauaggaaugagccaccacacuuggccagagaugauauuuucuuugugucuuaauuagauauauguugauuucugauuucuaauaaaaucaaguuuauauucuggucaaaauagcucuuugccccugaaucucguccauuuuagcccuaaaccauguguaaagagaaaacuuuuuagaauuuaaggagagauuauuccauuaagaggcuuuagucuuaagggaaugaagcaggaaguaugugaguaccauuauuuuaauaguacuuucuccuuuaaggcuucaacgagccuuugcugaacagguauagugauacaguuuuaaaacuuggccagguacagugguucaugccuguaauccuagcacuguaggaggcuggggcagguggauugcuugagcugaggaguucaagaccagcaugggcaacgugacaaaacucugucucuacaaaauauauacaaauuagcugggcauaguggcgugccaugugugguagcaucauagcuacucgggaaacuaagucuggaggauugcuggagcccaggagguuaaggcuacagugagccaugauugugccacugcacuccaggcugggcaacagggcaagacccugucucagaaaaaaacaacaacaaaaaaacacaauuaaacuaaaaaacucuacauuuugaggcauauauuuaucauuuuacaaagaaaauagauacuauucaagauagcacaauagaguucugcuuuucaguuagaauccuagguaaaauauauuucucuuuuuuuuuuuuuuuuuuuuuuuuuuuuuuuugagacggagucucacucugucacccaggcugggauguagugauaugaucucugcucacuguaacccccaccucccagguucaagcgauucuccugcuucagccucccaaguagcugggauuacaggcaccugacaccacgccuggcuaauuuuuguaauuuuaguacagacgggguuucacuguguuggccaggcuggucucgaacuccugaccucagcugauccgcccgccucggccucccaaagugcugggauuacagaugugagccacugugcccggcucuaaaauauauuucuagaaaauuuuaaauauacuguaauuuuuuuagcaagagcuauguuuguucucccucucucuuuuuaauuuuuuuuuugagacagggucucgcucuguugccaggcuggagugcaguggugugaucuuggcccacugcagccucugccugcuggauucaagcaauuguccugccucagccccccgaguagcugggacuacaggcacgcuccaccacgccuggcuaauuuuuguauuuuuaguagagacgggguuucaccauguuggcccggauggucucaaucucuugacuuccugauccaccggccucagccucccaaagugcugggauuacaggcaugagccacugcacccagccuguucucucucuuuuacauauguuagacauguuuacccauuuaaauuuuagaacuucauuuuuagcugagaucugggguauugaaaucaaaccuccccccacuucuuuuucuuuuucuuuuuuuuuuuuuuuuugagacaaagucuugcucugucccaggcuggagugcaguggcacgaucucggcucacugcaaccucugccuccuggguucaagcgauucuguugccucagccucccaaguagcugggauuacagaugcaugccaugacgccuggcuaauguuuguauuuuuuuuugagacagagucucgcucugucgcccaggcuggagugcaguggcgcgaucuuggcucacugcaaccuccgccucccggguucaagugauucuccugccucagccucccaaguagcugggauuacagaugcaugccaugaugccuggcuaaucuuuguuuuuuuuguuuguuuguuuguuuuuuugagacagagucucacacuguugcccaggcuggaguacaguggcacgaucuuggcucacugcaagcucugccucccggguucacgccauucuccugccgcagccucccaaguagcugagacuccaggcacccgacaccacaccuggcuaauuuuuuguauuuuuuuuuuuuaguagagaugggguuucaccauguuggccaggauggucucgaucuccugaccucgugauacacccgccuuggccucccaaagugcugggauuacaggcgugagacaccgugccuggccuaaucuuuguauuuuuauuagagacgggguuucaccauguuggccaggcuggucuugaacuccugacuucaagugaucugcccgccacaaccuccccaagugcugggauuacaggccugagccaccacaccuggccaauacaguauguuuuuaauaccugggaagaaauacaucuaauguuaauagugucaaggaugagauuacaagaagaggcauuuucacuuuucuacuauacauuucugcauuguuuuaauuuuuagaagaagugcauacugcuuucauaauugaaaaauauguaucuuucuggcauggagaagggugcacaguuugaaaauuaauacauuuaagacauuucuagauaagaaauaucuaaaacaauguaagaagccuucagaucuucaaauaaacuucaauuuuuuuaaaguuauggauauaaaaaugucuuugauuuauuuuaacacuuaaauuuuaauuauauuacauuuuaaagaaacccaaaacagugcuccaauuaaauucacaguccagugagaucuuauaucuaggucagauucuucuuguauguuuuggaaagacuuccauccgugaacuaauucuuaauguauuucuuuccagucaggcccaguggggcugcaugaagcuguuuauuuucaauaacuaguuauuccaauguguugcuucuugggggaaaauaugaggaccuggaacaaacccaggcagaacaugugacucuuccuaacugacguuagugaaggcaguaacuguauacauauuuaauuaccuuaaaguuguuuagaaauaaauagagccugcuuugagaacgaaccaaguaucaaucacagaaaauauugguuuuuguuuuguuuacaauuugcgcauggauucuuacccauguuuucaauucuuagaugaacagcagaguaccuuucaggugacacuuuaucaaguucugcaauauaaaucugggagugcaaucaugucaucauuuaucuucucaauaauacaguuauguguuaaaaauuguuuuauuaagcauauguaaaauaagagauucaaaaaauuuaagucuauguauauuuacuacaaaagcccaugagguuggccucauuuucugacuguuagcuucaucauucaauucuuaacuugucugcuugcuagaaacugucagauuuccucacagaugguuucauuuagugacugcuguaguauucaauuaucauagccugaaacaguuauauuuucauucuguccacuauuccauguuuaauuaugaucuaagaugaauuagauucugaaauacaaagugauauaaaaccuaguacauuugaccaagagguguuugcccagguugacucgagacuaaaugcugauuugaaugggaguggccauucuuuaugauagcaucaguuuauucucaaaaugauuccauugacuacuagaaauaaacuguuauaccuugaaagauaaucucaguauuaaguuuggggggaaacaugacuuuucuaggauugaaauuagguuuggaauaucauuggguaguagguucaguauuauuacauuuuagaacauuuucaugauauauauuuuauaaauaugaaauauuuuuuaaaagaaaguagaucagguguuuagggccuaauuuguuuagucuguguucacuauuucauuaauuacuuuuuauaaugaugugugguauuuuauguucuuagaaucugaaugaaaauugcaaaauacaaaaacuuuuuucccuucugccaaucuuguaaauagugguuuuuuguuucguuuuugcccucuugaucuaaaauugcuuuuguuuucagaugguggccagcagagaucugcaaccccaggucugugccacugaacauccagggccuuaaacaugacuugggggacuucccuguauucuucuuugguucucaugacuacuacuggguacaccagggcagaguguucccuuauguugaaggagacaaaagcuuugcugaagggcagacuaguauuaacaagaccuucaaaaaggguaagcuggaugauguuuacagugacucaaaacuacaacuccggugucaguuucucaacaucuccucaccucccuaauauuucugguauuagagaauuuucacuagacauuaugauccuguguccauaagcuuccagucacauuagaaccagguuuaaaauacauuucaauauuguagacugugcuguguauuugaaaggaauuucuucagugucuuucuauaaacacagauuauucuaggaauagucuuuuuuuuuuuuuuagacagggucucacucuugcccaggcuagaaugcaguggcaugaucacagcucacugcagccuugaacuccagggcucaagugauccucuugccucagccucccgaguagcuggggcuacaggugcccacuaucaugcccagcuaauuuuuguacuuuuuauagagauaggguuucaccauguugcccaggcuggucuugaacuccuggguucaagcgaucugcccaccucagccuuccaaaguguugggauuauagcucugagccaccaagcccagccugagaauagucuuuuuaaucaagugaaguuccuuugcaacagaagaguaguaaagacuugccaugaaaagccuuacaacugcuuuugcaaugaguugccagcaaguuuggcuuucugguaaggguaaaaugaauuuaaaucuauuacaaggcaaaaagcugcucuuagggucacuuggagacuucugaucauugaaguagagccucuucccuguggcuacagcaugcacagagcauaguguucagugaguuauauccuauuucuuuguuaccccauccuggugguaaacaguaacuuccagaaaauaauucuaaaaagaaaaaucucaggccagaugcaaagcauugggaaggcagcguaaaacuacuaucccaucaauuuuccuuugguuuuugguauuuacauacuuuguaucaucuuauuggcagcacuggaagaagcugcaaaacguuuccaggaauugaaagcacaaagagaaaguaaagaagcccuagagauugaaaaaaacucaagaaaacccccucccuacaaacacaucaaaguaagucuuuaucucuggccugggauugccaaauaaaauaagaaacaaaguaagucuuuacuaugaaagcauuguuauuuaauagaugagacgaaaugcauuacucuuuaguaguuaaagacccucuuugacuugugcaaacuuuugcuaauuaucacagucuucuguaaaacagagcuucuguuggaagcaucaaaugggagccauaguuauugugcugugaaaauuaggucuuugauaaguccucucauaccuaguagcaacaugucuuaugugaaauccuguucuuguucuaccagguuaucccgccaccaaaugagaauauagguguuuacucccuuuauuucagagaacccacaaacaagcguauuuucucuuguuuucaguuaugaaauuuccaucuagugaaaguagaaauacccaggauaaauaagugaaaauucacaugaggcuuugauauuuuugucaacuaaaugacaaaagagaugguuauuaaucucagcuuauucaucaggaaagacaaccuuucucggaguagcaccacgaggcaguagcguggauguuuuagauguuccuguucacauugccagaugacuuaccugcugccucucucucgcuugcgauuuuguuuucuaggcuaacaaaguaauaggaaaggugcagauccagguugcugaccugucagagauuccccgcuguaacugcaagccagcugaugaaaacccuuguggcuuggaaucggagugccugaacagaauguugcaguaugaaugccacccgcaggugugcccagcuggagaucguugucagaaccagugcuuuacaaagagacuauacccugaugcagagaucaucaaaacggagcggagaggcuggggccucaggaccaaaaggagcauuaagaagguagcaugggaugguggugggggguggaagagaccagaaccuggcuuuucaggaaugcuucaguaggguauaguucuagggauaaaaucagcaggaauuugugguaaaauguuaaaacuuuccauguugagaguuugguacuucuugagcaaagaagaguaguaggaagaagauagugauaaaaugugcuuaaacuuugaguguccaguggcuagucauaaaaaggagagaggggacacugguaauuucuaugugaaaugguuuuuacuuguuuuuuuuauuguuuuauuuuuauuuucuuuuaaagacaggguccccauucuguuacccaugcuggaauacaguggcguguucauagcucacucaagccuugaacuccugggcucaagagauccucccacuucagccucccgaguagcuggauagggucucacuacauugcccaggcuggucucaaacuccuggacucaagcaauucuccugccuuggccucccacagugcugggauuauaagcaugagccacuguguccaaccuaaaauuacucuugacauuuuucuaccuuuuaaaaaaaaucagccgggcacaguggucacagccgaggucaggagauugagaccauccuggcuaacauggugaaaccccgucucuacuaaaaauacaaaaaauuagccgggcgugguagcgggcaccuguagucccagcuacucgggaggcugaggcaggagaaucacuugaacccuggagguggagguugcagugaguugagaucgugccaccgcacucuagccugggugacagagcgagacuccaucucaaaaaaaaaaaaaaaucagguuuguaauuuuaaaaugccaucuaauguaguaaagaaaagucauagaauacaaucaauacaauacaauacaaaaaagauagcagagugaaauucuuccuacaucccuucaauucuucaucuccucaucagagauaaccauuguucauaguuugauagguagccuuuuauaacguuuucuauauaguuauaaacauauauaauaauacauuuuuuaaggguuuucuaaacauaaguaucagacguuuucuucccauucacacacgauagcauaaauacauuuguggcaguacauauagauuuuacuucauucuuuuuaacagucuuauuuuagucauaguaaaauguaccauauuuaaccuauuucccaauaaguaaauaaauaaccuauuuccccaauaaauaaauaauuuaaccuauucccaauaaauaaauagauacauaaauauuuuuaaauuccauaaugaauguucuuggucauccaccuuugugcaucuauuucuguaggucagauugcucgaagugaaauucaguuauucgguacauguguauuaagcugcuuccuauguggcagguauuauucuuggcacuuggaaaacaauagugaacaagacacaugaaacccuuaccuuaguggaucugcuugaggagacagauaguaaacaugucgagugccauuaacugcugugaauaaaaauaaagcuggaaaaggggcuagcuggugacagggauugcccuuuucaagugauuggcucagggagaccugaggaggcgcuguuugccgugugugugguagaaagccaugaaggugugugcaggagaagagcacgucagacuggaggcaggcagcuguaaaggcugcagugugcuccaggaacagcagggaaguucugugccuggggaggagccacaggagaggaaagagaggagcugcggugagaaggucagccacuggcuagauaggauggugccuuacuggccauaucugccaugggauggggaacaucuggaggauuuuacuagggagugacuugaucugauuugguguauuaguuuucuauugccacacacaaauguuaccacaaaguuagcaaauuaagacauaacacacauuuuauuaucucacaguuaauaugggucaggagucuaggcaauccuuaacuggguccucuacugaggaccucaccagguagcaaucaaggugccgacuggggcuggguucuccucuguggcuugacuagggaaggaucugcuucccugcuugcacaguuguuggcagaacuccguucucuagcuauagggcugagagacuccaguuguuuuuguuuugggguguguguguguguguuuguuuguuaugugguuggccaggagcugcuuucagcuucuagaggcugcccacaguuccuugccacaugggauucccagcaugccacuugcuuccuuacagccagcaggggugagagacacuacaggaagauggacacugaagucuuaugucauaaacucacauaaucaccccgucacccaugccauauucuguugguuagaagcuaaucacagguccugcucacaugcaacaaggggaggaggcgacaaaauggcaugaacaccagcaggcaggcaucaccggggccaccuugagagucugucugccacacuuggguuucgaaaggauaacuguggcugugguauggagaacauaugauaaggaggaaagagcgauaaagggagaccauuagagucgcccaggagaaagacaauggugacguggaaucacugggguuguaguugagccaggagggaagugguuagauuucugacauuuugaagguagagccaacaggauuugcugauguauuggauauguggacugggcugcuuggucaaaggccaaccacaucuaaaaugucauuguauaaugcaaaauguuuuauauuacuuuagugccaugcauaucauauauacaaauuuuugccuaugauuucacuggaguuuauggggccauccugaaauccauccacuuuaauauuguguuaacaccuuuuaauaguaguugcacuuauucugaaauguguuguaagauaacuuauuaaacagucuugauuuuccugcucuuuagcuagcacuugaggguuugcugauguaagacaauuggucuuuuacaaaauagcuagaaauauacaaucacugaaaaguguaauaaucacagagacauuauagcaacaugaaaaagauauucgggguauuuacaggaaagaaguccaauaugaaauggaauguacacagucaguccccuucuuucuccacagaacagauuccugaaaaugugugccaaacugggaacuucuuguuaugaaguuguuucuuucucagaaaaaauuuuaagguauuaaauauugaaugacagccucuuugcuguggucuauuuuaagauauuaaauauugagugacagccuuuuugcuguggucuauuuuaagguauuaaauauugagugacagccuuuuugcuguggucuauuuuaagguauuaaauauugacugacagccucuuugcugcggucuuucaggacagaucuguagcauuuuuuaaguuaaugaauuuguuacaauuuuuuuucacaguugaauucauaguuaaugguuuuuaagucuagucagcaucucuuugaggcuaaagaucugucucaggacaucugaaauauuuccaucuuuauuuacagugguaucaaguuuaugagacuugcucucauauuugauaucagcacuuaauuuuucuguauuuacucauuuucauagacuaacaaguauaaaccauaauaaaucaugaucaagcuuuuaaagucacaaaacuauuucuucaaaugaaaucuuaccuugaaucccaaugugugaaaaaagaaguaguagagcugauuugguugaaauucuccucuaugaguuuccacuaaagaaaauuugcccuaggccgggcacaguggcucacaccuguaauccuagcacuuucggagguugaggcagguggaucauuugagauuacgaguucgagaccagccugaccaacauagugaaaccccaucucuacuaaaaauauaaaauuagcuggguguggugaugcacaccuguaaucccacuacuugggaggcugaggcaggagaaucgcuugaauccaggaggcggagguugcagugggccaagaucacgccauugcacuccagccugggcaacaagagugaaacuccgucucaaaacagaaaauuugcccuaacaucauuaaguauaguaacaguauguggcaaugcagccaagauggcaauacaaucugcuacccuuugauaucauaucacagugcaaaauguuguucaucagcugauaacaaaguccaaacuggauacaggaaaagcuauuugaggcugacaguguauauaauagaaaaaugugcagaacagucccauguccuuugugagaaaggacuggaaggaaaaagugaaggaaauuaacuguuuauggugcugcaguuacagaugaauuuugguuuguuuuuuuuuccuugaaacagucuugcccugucacccagguuggagugcagugguacagucacagcucgcugcagccuugaacucucgggcucaagugauccuccugccucagcauccugaguaguggggaccacagccaugcaccaccacaccuggcugaugcuuuuuauuuuuuguagagaugagguuucacuguguugcccaggcugaucucaaacuccuggcucaagcaguccuccugccucagccucccaaagugcuaggauuacagcaugagccaccacaccuggccuguuuuucuaacugaauuccauaucauagcuuauacaguagauaaaaacaagagagagaaaaagccaguggucaccuuugguagugacugcuccgcagcugaagcauauguagcuccgugaagcagaccggugcuucucgcugagcucacucgccacaugccaccaaaggaagaggcagggagguuagggcccuucuaguuuaaccauucauuucuuuucccuuauuauaaucuauuuuuaucaauagaaaagauuaaauguuuuaaagaccauuggcuuauguuccuaaugauuuuccacaaucagaaaacgugaugcaguacuucuuucucuucagcuagggacuaccaacaguucugugauacuaagagcuaugagaagggcuaguggaaauuugugggguggggggugggagggagaauggggagaaugggacagaaaucugauaaaauaagccaauaccuuuuuguuuuucaagacauuuauuuuccucuaaaauauauuaguaagauugguaaguccuuauagagaauauugaccuagauugaaugagcagugcuuuugaggugaaaagguuaaugauuauguaauuauaaacacaaaauguugaauguacaauauuugcucuuauuuuaaaaggagcuuaucacuguaugccuuuuagaacagcuuaaauaauaaauaguggcaauaccagaugcagacaggacguggagaaaguggaucucaugaacugcuggugggaacauaacgaugguauagcaacucuggacaauaguuuggcaguuuccuuaauaaggaaacauacacucaccauauggugcagcagacacacuccuggccauuuauccaggaaaaugaaaaucuauguccacacgaaaacuuucaccagaauguucauagcagcuuuauuuguaaagccaaaaucuggaaacaauccaaauguucuuccaugggugaauggcuaaacaaauggcagaaacacuacucagagauuuaaaaagaacaaccuguugauauacucagcaccuuggguagaucucaagagaaucugccugauuuuuuucuuuaaagccaaucucaaaagguucuguacuauaucauuccauuauaaaacauuccuuuuuuuguuuuuuugguuuuuugagacagagucuugccuugcucugucacccaggcuggagggcaguggcgcgaucucggcccucugcagccucuaccuccuggguuucggcgauucuccagccucagccuccugaguagcugggauuacaggcaugugccaccacgccugaccaauuuuuguauucuuaguagagacaguguuucaccauguuggccaggcuggucucggacgccugaccucuggugauccacccgccuuggccucccaaagugcugggauuacaggcgugagccacggcgaccagccaaaacauucuugaaaugacaaaauucuagagauggagagcaggugagugacugccagggguuaggaugagaugaguggaggaggggugugauuguaaaggagugaguaucacaaggaaucucuguggugaggcaccagcucugugucuugauugcaguggugauuacaugauccuacgccugcuaaaacugcauagaauuauauacacacacaaauguaugcauguaaaauugguaaaaucugaguaaagucuggauuauaccaaugucgguuuucugguuuugauauuguacuguaguuaugucagauguuaccacuggggaaacugagugaauguucccaagauuucccauguacuauuuuugccacuuccucugaaugucaguaauuacuugaaaagaagcuuaaaaacaaaaacagagcucacuuguuucagauucagaucucuuccaggucucaccccgaaaccugcauagccaccaacuaguaaaauucuguuauaauauagcuucaaaggcuagaguuagcuuuauccccagaucccagcaaugccccacauguugucacuuggacuauaaaaauaguauugucagcaagaaaaggcaagcagauugucaccuucugaggcacuuauaccagaaaaauaaugccaccugaaugccuaugaauaaauaaccauuucuuucuaggguugaaguuauauuuucaggguucucuuuaauuauuuuggguuauacaugugucauuaagcaaugcuuuauauaauacacugauuuuaaguuacauauugcacauuuaucuccagggugaauuuguaaaugaauacgucggugaauuaauugaugaagaagaaugcagauugcgaaucaagcgagcccacgagaacaguguaacuaauuuuuauauguuaacuguuaccaagguaaaauugcuuuuuuuuuuuguaagaaaaagggauuuguuuuuguuuuuguuucauagucuuaauuugaacucaguuucuuuuaauuugauuuuucuucaggcagagcauaaugauuugcaguagcuagugugcugccuacuauaaugugccaauuauaccagaguaaaaaaaugaaugauacugaagcuuugcacgucauguaagacagcacugugagugaaaauaaaaccaggagcaggguuagcauaucuggauuuuagucugagcucuuugucaaaaaaguccugggccucaguuucuuuauuacugaaggagagaaucaacucugugauucuaaguuauaaaccaccguuauuaaaguucuacuggagccaaaacuccaaauuguucuguauauuaaaacuuuucggcagggcaugguggcuuacaccuguaaucccaauacuuugggaggcugaggagggcagaucacaugagcccaggaguuugagaccagccugugcaacauaggaagacccugucucuacaaaaaauaaaaauaaaguuagccaggugugguggcacguuucuguggucccagcuccucaggaggccgaggcaggaggaucacuugagcccaggaggucaaggcuguagugaacugugaucacaccacugcauuccugcuugggcaauggaacaagacccugucucaaaaaaaaaaaaaaagaaaauaaugagcgcugucauaagaaaaaugacaguaaagcugcuaguuuaaucucugcaguuguaagaccuauuugauacacaguacauccauuaucucaguuaauuuuuuugucaguucucugauuuacagaggacaagaagcugauguccagccaugauaagugauuuguugacuauuuuguuacacuuuuaagaaccaagacuaguacccauauuuccuguguucuaggcuaucauaucucuauaacugagauucagaauaucauuaaaguaagaaauggagcuuaaaaguauuuuaacugauacgucauuguuugaaaguuguacaacuuucauaaacauauuucauaaacaucaguuaaaaugucguucuuuaugauugcugggaucuggcuccugcaacccuauccucccugccaguggccccuucagccaccgugacagcacuugagaggcucaguucuguggagcuuauccagauuauuagaguucaaauucaggaaaccugaauauucagcuuuucaauguauugugaacuuuaaguaaaaacagagcaaacagauaagcacuggagaauauauccuacacaguaguccuuccaucagacagcucuccaaguuuuguuucucauuuuucuuucuucuuucuggccuaagcucucauguauccccuccuauacuaguuuugcuuccugcuuggagcagaaaaggaaggcugacagcaaaacaacagagcaguuaucagaacuuugagaucucuaaucagaaaauaccauuccuaaaccucuggcccacuaaucuucuaaauagcauuauuccauggucuauuuguuucuagaagcaaacuuaaaaagcaacuaaaucccacuuuauccuaauuacuuugacuugaaggucaucaaauaaaggagagaacuuaguaaauuacccaggcagccucacauuuccugaucugucaguugucaaacaccaguugguagcaaaaugcugcugccugugauccuugacugaguuggauguuucugggagagacuuaauuuauguaaaagguacuuuucuuuucuuucugaaggaccguauaauugaugccggcccaaaaggaaauuauucucgcuucaugaaccacaguuguaaucccaacugugaaacacaaaaguggacagugaauggagauguucgagugggacuauuugcucucugugauauuccugcagguaaaaaagugacucguuccccaugcuuuccucccuaggaagaaagaauauccuauagagcuaggacaugguucuucaaggcuugaugcccaagaacuuauuuaaauaagaggaagguuauauuuagaaaacguauucaaauaaaaggagaguuauauuuagaacugaguguuagcugccagugagagguaaaaaucuauaaccucaaaagggaauuuagugagaacuuuuauguaagagcgggucugacaggauucuguguccgcaguccugcugaacgaauucuccaaguuagcugcuguccauagaguguaaccagauguuuuagcuguuguuuucuuuuuaaaacauauuaacaguaaugagcuuguguuaacagcagcugguuccuuaguugcugggaucuuuuguuguuguuuucacuuugaaagaucauucuguuucaaauuagacauaaaagccucugaagccaaagcuguuuucauuuuuccuuaccuauccagcaucugaacaauaaaacuugguuucuccuuuguuuaguuuguagaaaaauuggugagaagagaaauguuauagcuaaaacagauuuaaacuguguuucuagaacucauuguggauuguuuaagcccagcuagaagaaagcuuaggaggcccuaguuugagucccuggaucuuugguguaugcaguaaaccuucauuuuggaucuuuauuugaucauaauauaaggcaguaauuacuggaaauaguauuguuacaauuccauggucauauuguucauuuagaaacuagugugaguuagcuauagaaaagaaggcugaacuggaaccuagucuccugagcauagauugcagauucuuagacccuaucacuuugguuucaaccacugcugugaaaaggacaugacuucuuuugaggauguguaguuuugcugucauuguuccuggguggggauguuuuucuccuuuucuuuuuuuaccaucacuguuaucaaugagguagaacacuggcaagggaaacgccuucaugccaaaaugaugucucuuuuuuucauuaggggagugugccugugagagcuuuucucuuccccaugacucgaguuugaauaauuauuucuccuguguuucagggauggaguuaacauuuaauuauaaccuagauugucugggcaacggcagaacggagugccacuguggagcagauaacugcagugguuuucuaggagugcggccaaaggucagucuugcaggggagcgcccccagucaacaggcgauaaggaguagggcuguuaagaagucuguuuggccgggcgcgguggcucaugccuguaaucccagcacuuugggaggccaaggcgggcagaucacgaggucaggagaucgagaccauccuggcuaacacggugaaaccccaucucuacuaaaaauacaaaaaauuagcugggcauggugaugggugccuguagucccagcuacucgggaggcugaggcaggagaauggcgugaacccgggaugcggagcuugcagugagccaagaucgcaccacugcacuccagccugggugacagugcaagacucuaucucaaaaaaaaaaaaaaaaagaagucuguuuguguguuugugaccaucucaggaaccugcuggcaauugggcaccuggauuaguuugugggucaucagcugggcuuaucgaacauuuagacugugacuuuccaaggaagcuuguuucaguaaggucuguuagguucugagaauguauuucauuucagauugaauaugaaauuagcaaaaagcuaauuuaaaacuuuuuaaaaacccacaaaauacuaaaggccacugaauuauacacuuuaaaauggcgaauuaugugguaugugaauuauaucucaaugaaaaaaauuaacagguugucuaaaaguugcuuggauuuaccacuacccuugcaauuaaaaauaaaaagcaccuggcugggcgugguggcucacgccuguaaucccagcacuuugggaggcugaggccgguggaucacaaggucaggaguuuuaagaccagccugaccaacauggugaaaccccaucucuacuaaaaauacaaaaauuagcugggcgugguggcacgcaccuguaaucucagcuacucaggaagcugaggcagaagaaucgcuugaaacugggaggcagagguugcagugagccaaggucgcgccauugcacuucaacaugggcgacagagcgagacuccaucucaaaaaacuaaauaaauaaaaauaauaaaaagcacccuauucaaaagucagugaaggccaggcgcaguggcucaugccuguaauccuagcucuuugggaggccaaggcaggcggauugccugagcucaggaguucaagaccagccugggcaacacagugaaaccccgucucuacuaaaauacaaaacauuagccauguguggcagcacgugccuguagucccagcuacucgggaggcuaaggcaggagaauugcuugaacccaagagguggagguugcagugagaugagaucgccccacugcacuccagccuagugacagagugagacucagucuccaaaaaaagucaaugaaaggcugaggcggaggaucacuugagcccagaaguuugagaccagccugggcaauguagcaagacccugucucuacaaaaaaaauuacaaaaauuagccaggcaugaugacaugcacauguagucccagcuacuugggaggcugagacaagaggauugcuugagcccaggaggucgaggcugcagugagccaagauugcaccacugcacuucagccuggacaacagagcgagaacuccaucucaaaaauaaaauaauuuuuaagucagugaaaacaaaacuuuauuuuuguuauaguauuuguugcagcauaaggccuccugauguuuuuagguaauuguacaacagaugaauuuaaaugaaugcaagguugcaggguuuuccuguguccagcuucaugcacugucugugauguuugaaacuaugauccuuucuuuccugccagucggcaugugcgucaacaaaugaagagaaggcaaaaaaugcuaaguuaaaacagaagagacgaaagaucaaaacagaaccaaagcagaugcaugaagauuacuguuuucaauguggagaugguggagagcuggucaugugugacaaaaaagacugucccaaagcauaccaccuccuaugccuuaaccugacucagccaccauaugguaagcuggaccuucaggacccuuucccuaauuugugucuuugccaacuauguguaacucacaauauauuccaugccaugggauaggaaauguugaauagaacaaacaauagcgaaaaauuacgcuggcaaaaaucuuuccccuuacacauuugggauaccuugugguuccucaaggauugguuucuuguauacuguucccguagguggguaccuguggcguuggguuuuggccaguagcucacauccauccuaaacuguacacccagaucuauguuugguugaaauuuggaguuguauucaauugaauuccaucuccaaugagagaagaaggaaccuggguuuuucauggguaaucaagacaggcacuaacuugggcacuucuccuucuuccuccccaucuccccgaauuaggaaagugggaguguccguggcaucagugcgaugagugcagcagugcagcuguuuccuucugugaauucuguccacauucauuuuguaaagaucaugaaaagggggcccugguucccucugcacuggaaggccgccucugcugcucggaacaugaccccauggcuccugugucaccagaauacuggagcaagauaaaauguaaaugggaaucacaagaucauggagaagaaguaaaagaauaaaugugugguguccccuccuuucuauuuaagugaaaaaagcaaauagaucaugcauuuaaaaagaagagacugcuacagugcauacagccuuugccaucggaacugccuuauuaaagcaaaaaugggaaaccaguucaugcaggcagaagcaguugguggugucugguuuuuguuugauuugguugguuugggauucuuuuguggaggguuaaauucccuuggucuuuucuugccuuuuauugugcuucagugccauugcagcuugaaaaagaaauguuuuugcuguuaaaauaagaacaaagagaaaaguaaguuuuguuaaugagauaaauuuaaagucuaagauguguuccuugguuguauaaagcaaaaguagccaucauuccuuuauuuauuuucauuuuuaggaauuucaagaaguguaguucaauagucuaaucaaguguguguguguuuuaaguaggaaucugagaaagcccucuaggaaaggguaugauaagcuuuauauaccucuuuacugagcaguagguaggcucacuucucuuucccuucaaaaugcuuuucauaggcuuagagaagggcucuauggaaguauuaa

SEQ ID NO: 192938 - RNA, 107230 nt, Homo sapiens
uuaauacuuccauagagcccuucucuaagccuaugaaaagcauuuugaagggaaagagaagugagccuaccuacugcucaguaaagagguauauaaagcuuaucauacccuuuccuagagggcuuucucagauuccuacuuaaaacacacacacacuugauuagacuauugaacuacacuucuugaaauuccuaaaaaugaaaauaaauaaaggaaugauggcuacuuuugcuuuauacaaccaaggaacacaucuuagacuuuaaauuuaucucauuaacaaaacuuacuuuucucuuuguucuuauuuuaacagcaaaaacauuucuuuuucaagcugcaauggcacugaagcacaauaaaaggcaagaaaagaccaagggaauuuaacccuccacaaaagaaucccaaaccaaccaaaucaaacaaaaaccagacaccaccaacugcuucugccugcaugaacugguuucccauuuuugcuuuaauaaggcaguuccgauggcaaaggcuguaugcacuguagcagucucuucuuuuuaaaugcaugaucuauuugcuuuuuucacuuaaauagaaaggaggggacaccacacauuuauucuuuuacuucuucuccaugaucuugugauucccauuuacauuuuaucuugcuccaguauucuggugacacaggagccauggggucauguuccgagcagcagaggcggccuuccagugcagagggaaccagggcccccuuuucaugaucuuuacaaaaugaauguggacagaauucacagaaggaaacagcugcacugcugcacucaucgcacugaugccacggacacucccacuuuccuaauucggggagauggggaggaagaaggagaagugcccaaguuagugccugucuugauuacccaugaaaaacccagguuccuucuucucucauuggagauggaauucaauugaauacaacuccaaauuucaaccaaacauagaucuggguguacaguuuaggauggaugugagcuacuggccaaaacccaacgccacagguacccaccuacgggaacaguauacaagaaaccaauccuugaggaaccacaagguaucccaaauguguaaggggaaagauuuuugccagcguaauuuuucgcuauuguuuguucuauucaacauuuccuaucccauggcauggaauauauugugaguuacacauaguuggcaaagacacaaauuagggaaaggguccugaagguccagcuuaccauaugguggcugagucagguuaaggcauaggaggugguaugcuuugggacagucuuuuuugucacacaugaccagcucuccaccaucuccacauugaaaacaguaaucuucaugcaucugcuuugguucuguuuugaucuuucgucucuucuguuuuaacuuagcauuuuuugccuucucuucauuuguugacgcacaugccgacuggcaggaaagaaaggaucauaguuucaaacaucacagacagugcaugaagcuggacacaggaaaacccugcaaccuugcauucauuuaaauucaucuguuguacaauuaccuaaaaacaucaggaggccuuaugcugcaacaaauacuauaacaaaaauaaaguuuuguuuucacugacuuaaaaauuauuuuauuuuugagauggaguucucgcucuguuguccaggcugaagugcaguggugcaaucuuggcucacugcagccucgaccuccugggcucaagcaauccucuugucucagccucccaaguagcugggacuacaugugcaugucaucaugccuggcuaauuuuuguaauuuuuuuuguagagacagggucuugcuacauugcccaggcuggucucaaacuucugggcucaagugauccuccgccucagccuuucauugacuuuuuuuggagacugagucucacucugucacuaggcuggagugcaguggggcgaucucaucucacugcaaccuccaccucuuggguucaagcaauucuccugccuuagccucccgaguagcugggacuacaggcacgugcugccacacauggcuaauguuuuguauuuuaguagagacgggguuucacuguguugcccaggcuggucuugaacuccugagcucaggcaauccgccugccuuggccucccaaagagcuaggauuacaggcaugagccacugcgccuggccuucacugacuuuugaauagggugcuuuuuauuauuuuuauuuauuuaguuuuuugagauggagucucgcucugucgcccauguugaagugcaauggcgcgaccuuggcucacugcaaccucugccucccaguuucaagcgauucuucugccucagcuuccugaguagcugagauuacaggugcgugccaccacgcccagcuaauuuuuguauuuuuaguagagaugggguuucaccauguuggucaggcuggucuuaaaacuccugaccuugugauccaccggccucagccucccaaagugcugggauuacaggcgugagccaccacgcccagccaggugcuuuuuauuuuuaauugcaaggguagugguaaauccaagcaacuuuuagacaaccuguuaauuuuuuucauugagauauaauucacauaccacauaauucgccauuuuaaaguguauaauucaguggccuuuaguauuuuguggguuuuuaaaaaguuuuaaauuagcuuuuugcuaauuucauauucaaucugaaaugaaauacauucucagaaccuaacagaccuuacugaaacaagcuuccuuggaaagucacagucuaaauguucgauaagcccagcugaugacccacaaacuaauccaggugcccaauugccagcagguuccugagauggucacaaacacacaaacagacuucuuuuuuuuuuuuuuuuugagauagagucuugcacugucacccaggcuggagugcaguggugcgaucuuggcucacugcaagcuccgcaucccggguucacgccauucuccugccucagccucccgaguagcugggacuacaggcacccaucaccaugcccagcuaauuuuuuguauuuuuaguagagaugggguuucaccguguuagccaggauggucucgaucuccugaccucgugaucugcccgccuuggccucccaaagugcugggauuacaggcaugagccaccgcgcccggccaaacagacuucuuaacagcccuacuccuuaucgccuguugacugggggcgcuccccugcaagacugaccuuuggccgcacuccuagaaaaccacugcaguuaucugcuccacaguggcacuccguucugccguugcccagacaaucuagguuauaauuaaauguuaacuccaucccugaaacacaggagaaauaauuauucaaacucgagucauggggaagagaaaagcucucacaggcacacuccccuaaugaaaaaaagagacaucauuuuggcaugaaggcguuucccuugccaguguucuaccucauugauaacagugaugguaaaaaaagaaaaggagaaaaacauccccacccaggaacaaugacagcaaaacuacacauccucaaaagaagucauguccuuuucacagcagugguugaaaccaaagugauagggucuaagaaucugcaaucuaugcucaggagacuagguuccaguucagccuucuuuucuauagcuaacucacacuaguuucuaaaugaacaauaugaccauggaauuguaacaauacuauuuccaguaauuacugccuuauauuaugaucaaauaaagauccaaaaugaagguuuacugcauacaccaaagauccagggacucaaacuagggccuccuaagcuuucuucuagcugggcuuaaacaauccacaaugaguucuagaaacacaguuuaaaucuguuuuagcuauaacauuucucuucucaccaauuuuucuacaaacuaaacaaaggagaaaccaaguuuuauuguucagaugcuggauagguaaggaaaaaugaaaacagcuuuggcuucagaggcuuuuaugucuaauuugaaacagaaugaucuuucaaagugaaaacaacaacaaaagaucccagcaacuaaggaaccagcugcuguuaacacaagcucauuacuguuaauauguuuuaaaaagaaaacaacagcuaaaacaucugguuacacucuauggacagcagcuaacuuggagaauucguucagcaggacugcggacacagaauccugucagacccgcucuuacauaaaaguucucacuaaauucccuuuugagguuauagauuuuuaccucucacuggcagcuaacacucaguucuaaauauaacucuccuuuuauuugaauacguuuucuaaauauaaccuuccucuuauuuaaauaaguucuugggcaucaagccuugaagaaccauguccuagcucuauaggauauucuuucuuccuagggaggaaagcauggggaacgagucacuuuuuuaccugcaggaauaucacagagagcaaauagucccacucgaacaucuccauucacuguccacuuuuguguuucacaguugggauuacaacugugguucaugaagcgagaauaauuuccuuuugggccggcaucaauuauacgguccuucagaaagaaaagaaaaguaccuuuuacauaaauuaagucucucccagaaacauccaacucagucaaggaucacaggcagcagcauuuugcuaccaacugguguuugacaacugacagaucaggaaaugugaggcugccuggguaauuuacuaaguucucuccuuuauuugaugaccuucaagucaaaguaauuaggauaaagugggauuuaguugcuuuuuaaguuugcuucuagaaacaaauagaccauggaauaaugcuauuuagaagauuagugggccagagguuuaggaaugguauuuucugauuagagaucucaaaguucugauaacugcucuguuguuuugcugucagccuuccuuuucugcuccaagcaggaagcaaaacuaguauaggaggggauacaugagagcuuaggccagaaagaagaaagaaaaaugagaaacaaaacuuggagagcugucugauggaaggacuacuguguaggauauauucuccagugcuuaucuguuugcucuguuuuuacuuaaaguucacaauacauugaaaagcugaauauucagguuuccugaauuugaacucuaauaaucuggauaagcuccacagaacugagccucucaagugcugucacgguggcugaaggggccacuggcagggaggauaggguugcaggagccagaucccagcaaucauaaagaacgacauuuuaacugauguuuaugaaauauguuuaugaaaguuguacaacuuucaaacaaugacguaucaguuaaaauacuuuuaagcuccauuucuuacuuuaaugauauucugaaucucaguuauagagauaugauagccuagaacacaggaaauauggguacuagucuugguucuuaaaaguguaacaaaauagucaacaaaucacuuaucauggcuggacaucagcuucuuguccucuguaaaucagagaacugacaaaaaaauuaacugagauaauggauguacuguguaucaaauaggucuuacaacugcagagauuaaacuagcagcuuuacugucauuuuucuuaugacagcgcucauuauuuucuuuuuuuuuuuuuuugagacagggucuuguuccauugcccaagcaggaaugcaguggugugaucacaguucacuacagccuugaccuccugggcucaagugauccuccugccucggccuccugaggagcugggaccacagaaacgugccaccacaccuggcuaacuuuauuuuuauuuuuuguagagacagggucuuccuauguugcacaggcuggucucaaacuccugggcucaugugaucugcccuccucagccucccaaaguauugggauuacagguguaagccaccaugcccugccgaaaaguuuuaauauacagaacaauuuggaguuuuggcuccaguagaacuuuaauaacggugguuuauaacuuagaaucacagaguugauucucuccuucaguaauaaagaaacugaggcccaggacuuuuuugacaaagagcucagacuaaaauccagauaugcuaacccugcuccugguuuuauuuucacucacagugcugucuuacaugacgugcaaagcuucaguaucauucauuuuuuuacucugguauaauuggcacauuauaguaggcagcacacuagcuacugcaaaucauuaugcucugccugaagaaaaaucaaauuaaaagaaacugaguucaaauuaagacuaugaaacaaaaacaaaaacaaaucccuuuuucuuacaaaaaaaaaaagcaauuuuaccuugguaacaguuaacauauaaaaauuaguuacacuguucucgugggcucgcuugauucgcaaucugcauucuucuucaucaauuaauucaccgacguauucauuuacaaauucacccuggagauaaaugugcaauauguaacuuaaaaucaguguauuauauaaagcauugcuuaaugacacauguauaacccaaaauaauuaaagagaacccugaaaauauaacuucaacccuagaaagaaaugguuauuuauucauaggcauucagguggcauuauuuuucugguauaagugccucagaaggugacaaucugcuugccuuuucuugcugacaauacuauuuuuauaguccaagugacaacauguggggcauugcugggaucuggggauaaagcuaacucuagccuuugaagcuauauuauaacagaauuuuacuaguugguggcuaugcagguuucggggugagaccuggaagagaucugaaucugaaacaagugagcucuguuuuuguuuuuaagcuucuuuucaaguaauuacugacauucagaggaaguggcaaaaauaguacaugggaaaucuugggaacauucacucaguuuccccagugguaacaucugacauaacuacaguacaauaucaaaaccagaaaaccgacauugguauaauccagacuuuacucagauuuuaccaauuuuacaugcauacauuuguguguguauauaauucuaugcaguuuuagcaggcguaggaucauguaaucaccacugcaaucaagacacagagcuggugccucaccacagagauuccuugugauacucacuccuuuacaaucacaccccuccuccacucaucucauccuaaccccuggcagucacucaccugcucuccaucucuagaauuuugucauuucaagaauguuuuggcuggucgccguggcucacgccuguaaucccagcacuuugggaggccaaggcggguggaucaccagaggucaggcguccgagaccagccuggccaacauggugaaacacugucucuacuaagaauacaaaaauuggucaggcgugguggcacaugccuguaaucccagcuacucaggaggcugaggcuggagaaucgccgaaacccaggagguagaggcugcagagggccgagaucgcgccacugcccuccagccugggugacagagcaaggcaagacucugucucaaaaaaccaaaaaaacaaaaaaaggaauguuuuauaauggaaugauauaguacagaaccuuuugagauuggcuuuaaagaaaaaaaucaggcagauucucuugagaucuacccaaggugcugaguauaucaacagguuguucuuuuuaaaucucugaguaguguuucugccauuuguuuagccauucacccauggaagaacauuuggauuguuuccagauuuuggcuuuacaaauaaagcugcuaugaacauucuggugaaaguuuucguguggacauagauuuucauuuuccuggauaaauggccaggagugugucugcugcaccauauggugaguguauguuuccuuauuaaggaaacugccaaacuauuguccagaguugcuauaccaucguuauguucccaccagcaguucaugagauccacuuucuccacguccugucugcaucugguauugccacuauuuauuauuuaagcuguucuaaaaggcauacagugauaagcuccuuuuaaaauaagagcaaauauuguacauucaacauuuuguguuuauaauuacauaaucauuaaccuuuucaccucaaaagcacugcucauucaaucuaggucaauauucucuauaaggacuuaccaaucuuacuaauauauuuuagaggaaaauaaaugucuugaaaaacaaaaagguauuggcuuauuuuaucagauuucugucccauucuccccauucucccucccaccccccaccccacaaauuuccacuagcccuucucauagcucuuaguaucacagaacuguugguagucccuagcugaagagaaagaaguacugcaucacguuuucugauuguggaaaaucauuaggaacauaagccaauggucuuuaaaacauuuaaucuuuucuauugauaaaaauagauuauaauaagggaaaagaaaugaaugguuaaacuagaagggcccuaaccucccugccucuuccuuugguggcauguggcgagugagcucagcgagaagcaccggucugcuucacggagcuacauaugcuucagcugcggagcagucacuaccaaaggugaccacuggcuuuuucucucucuuguuuuuaucuacuguauaagcuaugauauggaauucaguuagaaaaacaggccaggugugguggcucaugcuguaauccuagcacuuugggaggcugaggcaggaggacugcuugagccaggaguuugagaucagccugggcaacacagugaaaccucaucucuacaaaaaauaaaaagcaucagccaggugugguggugcauggcugugguccccacuacucaggaugcugaggcaggaggaucacuugagcccgagaguucaaggcugcagcgagcugugacuguaccacugcacuccaaccugggugacagggcaagacuguuucaaggaaaaaaaaacaaaccaaaauucaucuguaacugcagcaccauaaacaguuaauuuccuucacuuuuuccuuccaguccuuucucacaaaggacaugggacuguucugcacauuuuucuauuauauacacugucagccucaaauagcuuuuccuguauccaguuuggacuuuguuaucagcugaugaacaacauuuugcacugugauaugauaucaaaggguagcagauuguauugccaucuuggcugcauugccacauacuguuacuauacuuaaugauguuagggcaaauuuucuguuuugagacggaguuucacucuuguugcccaggcuggagugcaauggcgugaucuuggcccacugcaaccuccgccuccuggauucaagcgauucuccugccucagccucccaaguagugggauuacaggugugcaucaccacacccagcuaauuuuauauuuuuaguagagaugggguuucacuauguuggucaggcuggucucgaacucguaaucucaaaugauccaccugccucaaccuccgaaagugcuaggauuacaggugugagccacugugcccggccuagggcaaauuuucuuuaguggaaacucauagaggagaauuucaaccaaaucagcucuacuacuucuuuuuucacacauugggauucaagguaagauuucauuugaagaaauaguuuugugacuuuaaaagcuugaucaugauuuauuaugguuuauacuuguuagucuaugaaaaugaguaaauacagaaaaauuaagugcugauaucaaauaugagagcaagucucauaaacuugauaccacuguaaauaaagauggaaauauuucagauguccugagacagaucuuuagccucaaagagaugcugacuagacuuaaaaaccauuaacuaugaauucaacugugaaaaaaaauuguaacaaauucauuaacuuaaaaaaugcuacagaucuguccugaaagaccgcagcaaagaggcugucagucaauauuuaauaccuuaaaauagaccacagcaaaaaggcugucacucaauauuuaauaccuuaaaauagaccacagcaaaaaggcugucacucaauauuuaauaucuuaaaauagaccacagcaaagaggcugucauucaauauuuaauaccuuaaaauuuuuucugagaaagaaacaacuucauaacaagaaguucccaguuuggcacacauuuucaggaaucuguucuguggagaaagaaggggacugacuguguacauuccauuucauauuggacuucuuuccuguaaauaccccgaauaucuuuuucauguugcuauaaugucucugugauuauuacacuuuucagugauuguauauuucuagcuauuuuguaaaagaccaauugucuuacaucagcaaacccucaagugcuagcuaaagagcaggaaaaucaagacuguuuaauaaguuaucuuacaacacauuucagaauaagugcaacuacuauuaaaagguguuaacacaauauuaaaguggauggauuucaggauggccccauaaacuccagugaaaucauaggcaaaaauuuguauauaugauaugcauggcacuaaaguaauauaaaacauuuugcauuauacaaugacauuuuagaugugguuggccuuugaccaagcagcccaguccacauauccaauacaucagcaaauccuguuggcucuaccuucaaaaugucagaaaucuaaccacuucccuccuggcucaacuacaaccccagugauuccacgucaccauugucuuucuccugggcgacucuaauggucucccuuuaucgcucuuuccuccuuaucauauguucuccauaccacagccacaguuauccuuucgaaacccaaguguggcagacagacucucaagguggccccggugaugccugccugcugguguucaugccauuuugucgccuccuccccuuguugcaugugagcaggaccugugauuagcuucuaaccaacagaauauggcaugggugacggggugauuaugugaguuuaugacauaagacuucaguguccaucuuccuguagugucucucaccccugcuggcuguaaggaagcaaguggcaugcugggaaucccauguggcaaggaacugugggcagccucuagaagcugaaagcagcuccuggccaaccacauaacaaacaaacacacacacacacaccccaaaacaaaaacaacuggagucucucagcccuauagcuagagaacggaguucugccaacaacugugcaagcagggaagcagauccuucccuagucaagccacagaggagaacccagccccagucggcaccuugauugcuaccuggugagguccucaguagaggacccaguuaaggauugccuagacuccugacccauauuaacugugagauaauaaaauguguguuaugucuuaauuugcuaacuuugugguaacauuuguguguggcaauagaaaacuaauacaccaaaucagaucaagucacucccuaguaaaauccuccagauguuccccaucccauggcagauauggccaguaaggcaccauccuaucuagccaguggcugaccuucucaccgcagcuccucucuuuccucuccuguggcuccuccccaggcacagaacuucccugcuguuccuggagcacacugcagccuuuacagcugccugccuccagucugacgugcucuucuccugcacacaccuucauggcuuucuaccacacacacggcaaacagcgccuccucaggucucccugagccaaucacuugaaaagggcaaucccugucaccagcuagccccuuuuccagcuuuauuuuuauucacagcaguuaauggcacucgacauguuuacuaucugucuccucaagcagauccacuaagguaaggguuucaugugucuuguucacuauuguuuuccaagugccaagaauaauaccugccacauaggaagcagcuuaauacacauguaccgaauaacugaauuucacuucgagcaaucugaccuacagaaauagaugcacaaagguggaugaccaagaacauucauuauggaauuuaaaaauauuuauguaucuauuuauuuauugggaauagguuaaauuauuuauuuauuggggaaauagguuauuuauuuacuuauugggaaauagguuaaauaugguacauuuuacuaugacuaaaauaagacuguuaaaaagaaugaaguaaaaucuauauguacugccacaaauguauuuaugcuaucgugugugaaugggaagaaaacgucugauacuuauguuuagaaaacccuuaaaaaauguauuauuauauauguuuauaacuauauagaaaacguuauaaaaggcuaccuaucaaacuaugaacaaugguuaucucugaugaggagaugaagaauugaagggauguaggaagaauuucacucugcuaucuuuuuuguauuguauuguauugauuguauucuaugacuuuucuuuacuacauuagauggcauuuuaaaauuacaaaccugauuuuuuuuuuuuuuugagauggagucucgcucugucacccaggcuagagugcgguggcacgaucucaacucacugcaaccuccaccuccaggguucaagugauucuccugccucagccucccgaguagcugggacuacaggugcccgcuaccacgcccggcuaauuuuuuguauuuuuaguagagacgggguuucaccauguuagccaggauggucucaaucuccugaccucggcugugaccacugugcccggcugauuuuuuuuaaaagguagaaaaaugucaagaguaauuuuagguuggacacaguggcucaugcuuauaaucccagcacugugggaggccaaggcaggagaauugcuugaguccaggaguuugagaccagccugggcaauguagugagacccuauccagcuacucgggaggcugaagugggaggaucucuugagcccaggaguucaaggcuugagugagcuaugaacacgccacuguauuccagcauggguaacagaauggggacccugucuuuaaaagaaaauaaaaauaaaacaauaaaaaaaacaaguaaaaaccauuucacauagaaauuaccaguguccccucucuccuuuuuaugacuagccacuggacacucaaaguuuaagcacauuuuaucacuaucuucuuccuacuacucuucuuugcucaagaaguaccaaacucucaacauggaaaguuuuaacauuuuaccacaaauuccugcugauuuuaucccuagaacuauacccuacugaagcauuccugaaaagccagguucuggucucuuccaccccccaccaccaucccaugcuaccuucuuaaugcuccuuuugguccugaggccccagccucuccgcuccguuuugaugaucucugcaucaggguauagucucuuuguaaagcacugguucugacaacgaucuccagcugggcacaccugcggguggcauucauacugcaacauucuguucaggcacuccgauuccaagccacaaggguuuucaucagcuggcuugcaguuacagcggggaaucucugacaggucagcaaccuggaucugcaccuuuccuauuacuuuguuagccuagaaaacaaaaucgcaagcgagagagaggcagcagguaagucaucuggcaaugugaacaggaacaucuaaaacauccacgcuacugccucguggugcuacuccgagaaagguugucuuuccugaugaauaagcugagauuaauaaccaucucuuuugucauuuaguugacaaaaauaucaaagccucaugugaauuuucacuuauuuauccuggguauuucuacuuucacuagauggaaauuucauaacugaaaacaagagaaaauacgcuuguuuguggguucucugaaauaaagggaguaaacaccuauauucucauuugguggcgggauaaccugguagaacaagaacaggauuucacauaagacauguugcuacuagguaugagaggacuuaucaaagaccuaauuuucacagcacaauaacuauggcucccauuugaugcuuccaacagaagcucuguuuuacagaagacugugauaauuagcaaaaguuugcacaagucaaagagggucuuuaacuacuaaagaguaaugcauuucgucucaucuauuaaauaacaaugcuuucauaguaaagacuuacuuuguuucuuauuuuauuuggcaaucccaggccagagauaaagacuuacuuugauguguuuguagggaggggguuuucuugaguuuuuuucaaucucuagggcuucuuuacuuucucuuugugcuuucaauuccuggaaacguuuugcagcuucuuccagugcugccaauaagaugauacaaaguauguaaauaccaaaaaccaaaggaaaauugaugggauaguaguuuuacgcugccuucccaaugcuuugcaucuggccugagauuuuucuuuuuagaauuauuuucuggaaguuacuguuuaccaccaggaugggguaacaaagaaauaggauauaacucacugaacacuaugcucugugcaugcuguagccacagggaagaggcucuacuucaaugaucagaagucuccaagugacccuaagagcagcuuuuugccuuguaauagauuuaaauucauuuuacccuuaccagaaagccaaacuugcuggcaacucauugcaaaagcaguuguaaggcuuuucauggcaagucuuuacuacucuucuguugcaaaggaacuucacuugauuaaaaagacuauucucaggcugggcuugguggcucagagcuauaaucccaacacuuuggaaggcugaggugggcagaucgcuugaacccaggaguucaagaccagccugggcaacauggugaaacccuaucucuauaaaaaguacaaaaauuagcugggcaugauagugggcaccuguagccccagcuacucgggaggcugaggcaagaggaucacuugagcccuggaguucaaggcugcagugagcugugaucaugccacugcauucuagccugggcaagagugagacccugucuaaaaaaaaaaaaaagacuauuccuagaauaaucuguguuuauagaaagacacugaagaaauuccuuucaaauacacagcacagucuacaauauugaaauguauuuuaaaccugguucuaaugugacuggaagcuuauggacacaggaucauaaugucuagugaaaauucucuaauaccagaaauauuagggaggugaggagauguugagaaacugacaccggaguuguaguuuugagucacuguaaacaucauccagcuuacccuuuuugaaggucuuguuaauacuagucugcccuucagcaaagcuuuugucuccuucaacauaagggaacacucugcccugguguacccaguaguagucaugagaaccaaagaagaauacagggaagucccccaagucauguuuaaggcccuggauguucaguggcacagaccugggguugcagaucucugcuggccaccaucugaaaacaaaagcaauuuuagaucaagagggcaaaaacgaaacaaaaaaccacuauuuacaagauuggcagaagggaaaaaaguuuuuguauuuugcaauuuucauucagauucuaagaacauaaaauaccacacaucauuauaaaaaguaauuaaugaaauagugaacacagacuaaacaaauuaggcccuaaacaccugaucuacuuucuuuuaaaaaauauuucauauuuauaaaauauauaucaugaaaauguucuaaaauguaauaauacugaaccuacuacccaaugauauuccaaaccuaauuucaauccuagaaaagucauguuuccccccaaacuuaauacugagauuaucuuucaagguauaacaguuuauuucuaguagucaauggaaucauuuugagaauaaacugaugcuaucauaaagaauggccacucccauucaaaucagcauuuagucucgagucaaccugggcaaacaccucuuggucaaauguacuagguuuuauaucacuuuguauuucagaaucuaauucaucuuagaucauaauuaaacauggaauaguggacagaaugaaaauauaacuguuucaggcuaugauaauugaauacuacagcagucacuaaaugaaaccaucugugaggaaaucugacaguuucuagcaagcagacaaguuaagaauugaaugaugaagcuaacagucagaaaaugaggccaaccucaugggcuuuuguaguaaauauacauagacuuaaauuuuuugaaucucuuauuuuacauaugcuuaauaaaacaauuuuuaacacauaacuguauuauugagaagauaaaugaugacaugauugcacucccagauuuauauugcagaacuugauaaagugucaccugaaagguacucugcuguucaucuaagaauugaaaacauggguaagaauccaugcgcaaauuguaaacaaaacaaaaaccaauauuuucugugauugauacuugguucguucucaaagcaggcucuauuuauuucuaaacaacuuuaagguaauuaaauauguauacaguuacugccuucacuaacgucaguuaggaagagucacauguucugccuggguuuguuccagguccucauauuuucccccaagaagcaacacauuggaauaacuaguuauugaaaauaaacagcuucaugcagccccacugggccugacuggaaagaaauacauuaagaauuaguucacggauggaagucuuuccaaaacauacaagaagaaucugaccuagauauaagaucucacuggacugugaauuuaauuggagcacuguuuuggguuucuuuaaaauguaauauaauuaaaauuuaaguguuaaaauaaaucaaagacauuuuuauauccauaacuuuaaaaaaauugaaguuuauuugaagaucugaaggcuucuuacauuguuuuagauauuucuuaucuagaaaugucuuaaauguauuaauuuucaaacugugcacccuucuccaugccagaaagauacauauuuuucaauuaugaaagcaguaugcacuucuucuaaaaauuaaaacaaugcagaaauguauaguagaaaagugaaaaugccucuucuuguaaucucauccuugacacuauuaacauuagauguauuucuucccagguauuaaaaacauacuguauuggccaggugugguggcucaggccuguaaucccagcacuuggggagguuguggcgggcagaucacuugaagucaggaguucaagaccagccuggccaacauggugaaaccccgucucuaauaaaaauacaaagauuaggccaggcacggugucucacgccuguaaucccagcacuuugggaggccaaggcggguguaucacgaggucaggagaucgagaccauccuggccaacauggugaaaccccaucucuacuaaaaaaaaaaaauacaaaaaauuagccagguguggugucgggugccuggagucucagcuacuugggaggcugcggcaggagaauggcgugaacccgggaggcagagcuugcagugagccaagaucgugccacuguacuccagccugggcaacagugugagacucugucucaaaaaaacaaacaaacaaacaaaaaaaacaaagauuagccaggcaucauggcaugcaucuguaaucccagcuacuugggaggcugaggcaggagaaucacuugaacccgggaggcggagguugcagugagccaagaucgcgccacugcacuccagccugggcgacagagcgagacucugucucaaaaaaaaauacaaacauuagccaggcgucauggcaugcaucuguaaucccagcuacuugggaggcugaggcaacagaaucgcuugaacccaggaggcagagguugcagugagccgagaucgugccacugcacuccagccugggacagagcaagacuuugucucaaaaaaaaaaaaaaaaagaaaaagaaaaagaaguggggggagguuugauuucaauaccccagaucucagcuaaaaaugaaguucuaaaauuuaaauggguaaacaugucuaacauauguaaaagagagagaacaggcugggugcaguggcucaugccuguaaucccagcacuuugggaggcugaggccgguggaucaggaagucaagagauugagaccauccgggccaacauggugaaaccccgucucuacuaaaaauacaaaaauuagccaggcgugguggagcgugccuguagucccagcuacucggggggcugaggcaggacaauugcuugaauccagcaggcagaggcugcagugggccaagaucacaccacugcacuccagccuggcaacagagcgagacccugucucaaaaaaaaaauuaaaaagagagagggagaacaaacauagcucuugcuaaaaaaauuacaguauauuuaaaauuuucuagaaauauauuuuagagccgggcacaguggcucacaucuguaaucccagcacuuugggaggccgaggcgggcggaucagcugaggucaggaguucgagaccagccuggccaacacagugaaaccccgucuguacuaaaauuacaaaaauuagccaggcguggugucaggugccuguaaucccagcuacuugggaggcugaagcaggagaaucgcuugaaccugggagguggggguuacagugagcagagaucauaucacuacaucccagccugggugacagagugagacuccgucucaaaaaaaaaaaaaaaaaaaaaaaaaaaaaaaagagaaauauauuuuaccuaggauucuaacugaaaagcagaacucuauugugcuaucuugaauaguaucuauuuucuuuguaaaaugauaaauauaugccucaaaauguagaguuuuuuaguuuaauuguguuuuuuuguuguuguuuuuuucugagacagggucuugcccuguugcccagccuggagugcaguggcacaaucauggcucacuguagccuuaaccuccugggcuccagcaauccuccagacuuaguuucccgaguagcuaugaugcuaccacacauggcacgccacuaugcccagcuaauuuguauauauuuuguagagacagaguuuugucacguugcccaugcuggucuugaacuccucagcucaagcaauccaccugccccagccuccuacagugcuaggauuacaggcaugaaccacuguaccuggccaaguuuuaaaacuguaucacuauaccuguucagcaaaggcucguugaagccuuaaaggagaaaguacuauuaaaauaaugguacucacauacuuccugcuucauucccuuaagacuaaagccucuuaauggaauaaucucuccuuaaauucuaaaaaguuuucucuuuacacaugguuuagggcuaaaauggacgagauucaggggcaaagagcuauuuugaccagaauauaaacuugauuuuauuagaaaucagaaaucaacauauaucuaauuaagacacaaagaaaauaucaucucuggccaagugugguggcucauuccuauaauucuagcacuuugggaggcugaggcaggaggaucgcuugagcccaggaguucgagaccagccugggcaauauaaugaguccccaucucacuauauuuauucaauuuaaauuaaaaaaaaauuuuuaaaguuuuuuuuuggccgggcgugguggcucacaccugcaaucccagcacuuugggaagccaaggcaggcggaucacaaggucaggagaucgagaccauccugccuaacacagugaaaccccaucucuacuaaaaauacaaaaaaauuagacgggcaugguagcgggcgccuguagucccagcuacucgggaggcugaggcaggagaauggcaugaacccgggagccggagcuugcagugagccaagaucgcgcaacugcacuccagccuggacgacaaagcaacacuccgucucaaaaaaaaaaaaaaaaaaaaguuuuuuuuggaaaaaaaaaaucaucuccacuguccauauaagaccuuuuauuccaaaaucuaguaguacauagcccauuaguauaaaacaacuuucaggacuuaaaaacaaaaguuggugggcaugguggcucaugcuuauaaucccagcacuuugggaggcugaggugggcagauugcuugacucaugaguuugagaccagcgugggcaacauggcgaaacauugucucuacuaaaaauacaaaaaacuagccaggggugguggugugaaccuguaaucccagcuacuuugggggcugaggugggaggauggcuucagccagcagguggagggugcagugagcugcgauaccacugcacuccagccuuggugauagagccaaaccgccucacaaacaaucaaccaaccaaucccaaagaaaaagaaaaagaaauucaauaaugaauuaggaacauaaccuucccaaccccuuaagaacccagccucaaaacaugguucuuuucuuuuuuuuuuuuaaggaaguagguccaugcugucuaccuaucuaucuccaagucacucuguauccagaguaugaaacuggucugcacaaugauugaauacuuccucuuuguucuuggaaaaacuugccuguaauuucccaauuugacccaaacaaucugcuuguaauguaguuucuugccagcuuuacagucauuacaauuccagcagccuucuggcauuucuaugcuuaggcauuccggguggaaggaagcugggcacgauucacagcagagcaaucuuccaccuugaaacaaauaaacagucuuaauaacugagaaaagaggagagagaaaaagaaagaaaaaggagaaaguuaucuuuucagcacauuaaauuuguuucaaauugggggaaaauaacaaagggacugagucauaucuacagugauggauuaaaauagcaagugaacguauuuagcuacuuuucaggguuucaguggccagaaacucagagcuucugaguaguaccaaaagcauccauguacucuuuacuccuuuaaacuaugggcuacugagguaucaguuuagaagcuaaacucuuaacauaugaccaaauugaagcauaaaaucuuuugacugaguagauuugagagguuuuucaaacauguaaguagcaacuuucuuuucuccuucagagguaagaaagaaagcaagucaucguuguauuuuaauccagugccaugguuaacuaaauuccuuuacaauauaauuagcaagcaaaaaaauagccaauagguugaucaguacuuuuuucuuuccauaaagaauacaaaaagcaaaaggaacacagaaucucaaauuggugauuauguuaucauuaccuuuuggugaagauuuacaggcuauacagcagugguuugcaacuuuuucaucaccaaggauucccuuuucccuccucaugaacccacauaauuucaaauauuuuaucaacaaccaaaaaaccucucuuucucucucucucucccucuguguguguguguguguguguguguguguguguguguguguauguguguguauucucucuauauauauacauauacagagaauauauuuugagacgggcucuaucuugcccaggcuggucuugaacuccuggccucaagcaauccuccugccucagccgcccaaacuguugggauuacaggcgugagccaccaugccuggccaaaaucugcauuuuaaaaguaacaauuucuccgauuuuuauuaaccaaagaaauauauaacugccaaucagagauucugaucccaauaacaaaacuaguauuaucccauuaaauuguuaaaaucauagccaaauuuuaaaaacucaugcaguuugauucuguacaaauguguaauuguuagauuuucugaaauauuaaacauaguucaaaaauuuuguuuacauaagucucuucugacuucauauugagaaccacugcuuuauagcauaaaauuaaguaguuaucaguauagaaugaaguaccauaugcaaggagcuaauuccaaguucccuaucaaaacucuuuccuuuuagauacacaaaauacucucuggauugagaccaaaacagguguggcaaacaaaauaguuguaaaugcuaagaaauaugaaauucugggaggaaauuagguauuucuaauauguauuucaauacgugacagcgaauguuaaccacugaagaugaaauauaauaaagacaaauauuuauugaaaaaaauugaucuuuucauuggaaaaucaggucuauaacccaugaguguacgaagauuuaaagucucauaagcaaaaggguaagagcccucuaugcaacuuuaucaaaucacaugcuccaaccuucugagggcuugcuaccaauuuuccagaaaaucuugucuuccuauaaauuuucaaacuucugauuaacauaaaaacaaaaagaaaauccauauacaacccaugaugaauuaaaucacuguauuuccucugcuuaaaagcuuuuacuucaaucaucaagauuuuuuuucugggacuacaucucaguauagauuaauugauucaauuuaccaaccuagagaucagaugcccaagugcucuacacuuagggagggaauuugucuauaaauuuaaaguaaaaugagauuauucauuuuuuuuuuccaucagaaaggaaugaccagcagggagaaaagucugcaaacagcuuuagaggacaugugauuauuaguacugaccuagaaaagucaggcuggccauuuuuaacauuauggaauaguucuuaauuuuaagucuuauuucagaggaaauacagagccagaaucaucagagaaaaucaucaugauaaagaugcuuaaaauacacaagggaaauaaaaaaaaaugugaaugguccaccuuggugcuaugcaagaaaacuaggauacaagagaaguaagauaugguucaaguuaagcaaacagagggcucaaaauaauuucaauucaugucaaaguuaauacugaguacugaaaacaaaguaagcaacaauugaauuaaucuaauuuuauauagguaccagcaagaaaauaaagcauuuccuaaaaugucucaggcagaauaauuauggaguaagucaaaccuauguucauuuuuuuguuuuggaaguaggcaguauuaucaauaaggugauauaaucugacugcagaaaacagacaaaaaagccaguacucucuccaauacuucuaauauguuccaaucgacuugcuuagucucacuuucuuuuagucaugaguugccacuucagaugucugacaaagagcaaagauacaucaaacaggcaacacaaagaauuuuuucaaaagcccauuucaaauacaccuacuguguguguguguguguguguguguguguauagaguauauuaguuaugaaugaaguuuucuuuaaagauucugaacuuggccccagaucauaaugggaauguacacaggaaaaggcccucaccuuucaagcucauuuauuuuucccagugggauaauaacuccccaaauaauacaucauuguuaaaucauuuuuauaacagguaggcuauggaaaacuaaacacaauauaaaguuuucuuccauagguuaaauuaacugggagaacagaaauauccauuuagcucuugguacuguguggauaauuauccaucagcaauucagcugggcugccuuccagcauccaguauuagggguauucuccccaaccagcuucccaccaaugucuccuaagggaagggcaacuaguuuucauagcaucuuaaccaaacauuuaagaagcccaaugacagaacauauucuaaaagcaaacuuucaaguaucaguaucuuaguuucccucuuuuaauaaccuaccuuguuauuuaguugaaaguuaguaacaaauuauacccuaucuuuucuauuccaacuugaaugauaguuucacaccaggaaaaagagaaagaacauuuagaauaugauucuauauuuauacugaccaaaauccuagucuuccuauuuuaauaacuuauaaauauggaauguguaaaaauuuauucaagggaagaguauguaaaaaugugcaacaauggaauuauuuuaagcccuuuuuaauaauugugcagccauaugaagaaacagucacaaccaccaaggcagaauuuaccaaaagcaacagauggugcuugacaggcauacauuuccccccuauauugaaagagaaaaaaauaggaaaugcaaaaauaaaagcaagagaaacuauuuugauuauuaccuuucucacauuucuuuuuggaagcugacgaagaaggaaucauagguaauuucaucaacucagcacgauuugauucauucaguagguagugggacuuauaggcauaugaacugaacauggggucugaaugguccugaacuaucagcccuauacgaaacaaacagaaagagaugagcugcaaugaaacuacccaugauuccaugaggaaaaaauaaaccaacaccuauuauguaugcuucaaagcugggguggggagggcgaaaaugagaauaugaagaaaaaagaaagaucugacagaaagguuuucuacaguuuucaaagggagucugaacuacucaauuccuuaucccuauauauuauagaaaccuaaauucugcagaagaaaacuucaaauaauuugaagauauaaacacuugacaucauacagaaaaccccuuagggaaaacaaagcuacacugcuucguauuuggauguacaaugacgacagcccaaagaacaaaaugauauuauauaucauguaaugagauagaaauaagaaucauuuacauaaguagacccugaucuaccuucaauauaucaaguagcacuuuaaugcagaauggaagucucuccuuuuuucuauucauaucuucagacauacucaaagaaauccuaacuuucucugccagauaaugaaacucuucucuaucaauaugguacauguuuuauuucauuuuauauuauauauauauuuuuugagacagagucuugcucugucacucagacuggaggguaguggugugaucauggcucauugcaccuuugaauuucugggcucuagcgauccucuggccucagccucccgaguagcugggacuacagauacaugccaccacaccaggcuaauuuuuaaauuuuuuuguagagauggggucuauaauagcuuuugugcccaggcuggucucuaacuucuagccuuaaguaauccucccaccuuggucuuccaaaauguugggauuacaggcaugagccacugugccaggccugguacaugauuuuaaaggagccauaauuuccugaacuuuacugagguaaugcaaacauuuucauuuuuucccugccacaauauaaaaggauuaccaacuuaagcguuaauaaaaacaaucuuuuugaucuaccaauuacagcuaugcuacuuggaggaaaacacuaaagcuaccugugguucccucuucuuucccuuaccccucccccaguuaauucaugauguagcuauaagccacuccuaaaccuaggcaacugugagaccaggggacauuucucuauccucuaucuugguuacuggaucaguguauaaugauguaggauuuacaauacaaauuacggcagcaguuuuauuuaagagaucauuuugaaggggagggaaauuaccauuuacuuuuuucugugggcauugucuucauacucuacacugagacgaauucaagaaauaucucugaccuaaauaacagaauggaacuugaaauuacuaacaauaugacaaucuucuuuuuguuuuguuuuuuugagacagggucucgcucugucacccaggcuggaguccaguggcagaucacagcucacugcagccucaaccuccugggcucgagugauccuaccaccucaaccucccgaguagcuaggacuacagccauuuguccccaugccuggcuacguuuuugauuuuuuuguagaaacgaggucuugcuauguugcccaggcuggucuugaauuccugggcucaagcaauccucccaccucagcaucucaaaaugcuggaauuacaggcaugagccauggugcucagccagagucuucuaauaaaaguuauaugggcugggcaugguggcucacgccuguaaucccagcacuuugggaggccgagacaggcggaucagcugaggucgggaguuugagacuagccugaccaacauggaaaaaccccaucucuacuaaaaauacaaaagaauuagccaggcgugguggcacaugccuguaaucccagcuacuugggaggcugaggcaggagaaucgcuugaacccagaaggcagagguugcagugagcugagacugcaccauugcacuccagccugggcaacaagagcaaaacucugucucaaaaaaaaaaguuauauaauguugaaaugaacuuuguacauuuaauagagggagauggaguaguguaaaggaauaugggcuuugaaauaagaaggauuaaguacaaauacuagucccuccauuuaacaacuugugugucauuagguaaauuauuuaaucuagguuucaguguucucaccuguauacuauggagagauaacuucuuagggaaacuguggcaauucauucagauaauguuuaguaaaguuugacuuacauaugcaaaauaaauugcuauuauuuacuguuaaaaugaaaagaaaacuccagccuacauuauccauuuaaaauuaccauuacaaagaaaggcauagaauguuaaguaacuuauuuuacacaacccucuaagaugaaaggagaugcuaaagaaugugcacuacacugaaaaauguccgcacacuucuugugacuccacgauuagguggcauguggaagaggagugaugucaaacccugaaacauuucaaaaaauauuuccagacauuguaguccuuaagaaauagcuuaaugauuuuaaacacccaauaaccaagaacuaagagaaaaucuauguggagggaaaaauucuguauaaggcaagaaacaagcaaaacaagcuaaguuuucuaauacccaaacagaaaugacuaaagugcuccuuucuguguguggauuuauuacaguuaugucuccuuaaaaaaggugaccuuuauaaauacuuauaaaagaacacauauuauuuacuucugaaagacuuuugauuuaagccuucccagcaucugaucuauuuagaguaagucuuugucaaaugcuagaaaauaaaaugaagguuauguuuaccauacaaaguuucacaguuaaaauaugugggaauuaaauaauuuugcuuaaacaggcauuuaaauucaguaaauauuccuggauaaccgucaaauuguuaagauguaaauacagauucuguuguuaaacauggguuuucccuccacuuacauuauucucagaauuuaaucaaguuauguaaguuaaauuuaacaaaguggcuagaguuucuauaagcguacaauuuucuagcuguccuaaauugaaaauacuauauuuuguuucacaacucacugcagucuugaacuccuggggucaagugauccucccuccucagccucucgaguagcugggaccacaggcacacaccaccaugcuuggcuaauuccuuuauguuuuguagagauggggucuugcuauguugcccaaacugguccugaacuccuggccuuaagcaauccuccugccucagccucccaaguguugggauuacaggcgugagcuacugugcccagccugaaaauaccuauuuuaaagguaucccaauuauugaaugaaguagagcaaaagagaauauuaauuaaucuacugauggcauuugauucagaaugugccccaacauaagccaacauaauaguuauaaacuugauauuaaaaugcgggcuaaauuaugcaugcuuauacacugacaggaaaugucagugcccagcaaugguagcauagaguuugcaaagcaauaagagacuuuauguuaucacugccacucauccguuuaaaagacucuaaagcuaaacauucaacugauaauacaauaauuuuuucuucuaaucauuacuuucuuaggaaugcagagaugggaaaggcaaugagugacaccuuuuuauuuauuauuugcccaccuguuacgauauagcaggaaacauuucagaccuacuccuccaugauaccagccagguuucagagcaggauacauuugacacugcuguaguuaagaaagacacaguacuuccugcuccaaaggcagacagucacaugugcuuauaaaacaggcaaacagaaaguagugucuacuacagacccugcuagcuacuccacaaaggacuacgauuuauuuaaucuuuuacugccuaccuccaaguaauguuuucauaaugagagacacaaaagcaaaaccaccuaagaucuaucauacuaccuaaauucuauuuuagaaaguuguuauaguacuuucaccaaauuaaaauaacugucuccuaaagcaaaagcaaccaaccaaacaaaaaccacuuucauguucaguauggucuaaauagaaucuaacaagcaugaugggccuuagaggccuugagaauaguucagagggaaagucagaaaacuuugcacuuaaaaacaaaccaaagcaauauuuagggauauuaguuaguuuuuauaaugcuuacuaaguaccaaaaaaguuuuauuauaauauggcuugagauaaagccagauauucuguauaacauucaacuaaagaaguuugauuuuauauuuaucaugaacccaaguucacugacccccguagggcuacaguauuguuuuuaguugaucaaucucuugguguacuuaaacgucaacagcuggcaacaagaaagcccacauggcuggcucugaacuaacaccaccacauaugcugccuuggcugugucccaucaggcccuccucaaugccagaccaaaacauuaugauaaaauacagcauaaacaacugaaaaauggaugugcuaguuuugccuuccaagugaaaucucaaucaguugaaaguucugguuuaagauuaugaaaugggaaggaucuacuuugaauagaagaguuguuugcagaagggaaaagauuaaucuuuuaaugcuccaaacagaaaaacuaagaacuuaacuauaauucuguuauuuuuagaaaugcagauuuuagcuuaacuuauggaagaauuaguauucuaacacuuuggacaucuagcauuauaaaaguuacuggaaauguucaucucucucagggauauauuacaguggaauucugcacuggguaggagauucuacuagauggccugaguucuuucccaaugcugagacucuauguuaauggagaaauaugccaaugaccucaaaaauaaaugaagagaaaagucagacacucaccucuggcacaaacgaaacaaaagccuacauuuacagcagaagaauuacugcuccguuuggaaugauuacuacagaugagaauguaggaggauacuaacaugcuuccggccgcaaugcaagcaucuccagagugauaggcaacuggacaucuuaaacaucucaucaugcggccuguuuaaagacaagucaaaaaggaaucuaauaaggcaucagcgggacauaaaaauaaguuucuggaguugggcuuuuuugggucccucugagaugcuaguuacaguagauggaaagcauuuuuuucuucccuagucuggcucugucauccuaugcuauauggccccuaaauguaagccuaauagucacguagagaucauccaaagaaaaaauuauuuguuccaaugcugcagagacggugguauccaauauggcaccuaccugaaggacuuucaaggguauuuugaacacauggaauuuucuucucauggucugaauuuagaauguaaucucuacuuaacauguacuguguauguacuguggcugaacuguuaaagcuagagauacacagaagaagaaugccuuauguuguuuguaauauaugcuugauaauguuauuugccacugcccuuaaaacaaaaaucuuugucuccuucuucagcuguuuuaccuuuacuugcuuuguggauaucuuucuccauagagcaggcagagcagcagugcugaggacagcggaauccuuuugauucaaagauggcaguggggaauuugcggacacaggcuucaugauaaaauuucccacaagcaccaacagaacaacgcuucacaucuuuaccagacacuuuacacgaaaaacaugggugcugcccuggaaaauuggugaggaauacaaauuaaauaaaauugacuaaagcauauucaaguagaagcagcuacagacaucaaacagcuacuccuaaaacagacucuauuacuauacuuaagaauuuaaugcacaaaaaaaauuuaaaauaaaugcuaaauuaaaauuauguuuuaaauuuugcuagaauaauugauuaucaauuuggagacagaauacuaaaaacaauuuagaucuccaaaacugauuccauagaaaagccagaacagaauuuguuugacaucugguagcagacagcagcaaaguuuuccccacauagaauaaauaaauuaccaaaggaaagucugauuccauuagauaaucacugauuauuucuaugugcaaaauauacauaaaaugaaaacucacaauccuaauaaaaaagaaaauuacagcuagacauaucuuauucgaacuauagaaaaucaaggauaaagaaaauauucaaauuauccacaaaaaagacaauuacuuucaaacagagcugacugaaagagaaaaauggaagccaaaaaaacaauagaaugauauuuucaaagggcugaaagaaaauaauuaccaaaccagaauucuauacccagugaaaauauucgucaagaaugaagugaaaucaacauucgccagggagaauuaacaaaaccuaguucuuugaaaaagaauaauaaaacugauaccucugguaagaauaauaaaaaaaggagaaagauccuaauauuaauaucagauaugaaaaauggaacaucacuaccaauccuacaaacauuaaaaagauaguaaaaggauaucacuauauuuuugcuaauaaauuugaaaauuuagaugaacggacagauuccuagaaaaaaagaacuuacgaacaauggcacaaaaauaaacaggacauaugaauaguucuguaaacuauuaaaagaaauugaaacuauaauuggaaaucuuucaacaaaaaaaaauuuuaggcccagauggcuccacuggugaauauguccaauguucaaggaggaaaauaaugccaaauaugaaaaaacuaaacaggaaaaaaagaagaaacaaguaaaagacaaacagauguagggaaauaugcaacaaaaaugacaaaagauuauguuuuguuguauaaacaguuuacauauggagaaaacgcacacaacauauauaagcaaagauaauggaauaagacuuacaaacuacaaaucaauauagaaaaaaaccaaagcagccuaauguaaaagugggcagaggauguaaaugggcaauuuacauaaagacaaauaggcaaaagaaaauuaaaauguguucaucuucacuaguaaucagguaaaugcuaacugaaaccaguuauaaaacagaaaaaaacggccaggcgcgguggcucaugccuguaaucccagcacuuugggaggccaaggcggguggaucacaaggucaggagaucaagacuguccugguuaacaaggugaaaccccgucucuacuaaaaauacaaaaaaauuagccgggugugguggcgggcgccuguagucgcagcuacucgggaggcagaggcaggagaauggcgucaacccgggagguggaaccugcagugagccgaaaucgcgccaccgcacuccagccugggugacagagcgagauaccgucucaaaaaaaaaaaaaauaaaauaaaauaaauaaauaaauaaauaaauacaaaaaaacuuaaagaguuugauaauaccaauuauuauuuuugagacagagucucgcucugucacccagacuggaguacaguugugugaucuuggcucacugcaaccuuugccuccuaaguucaagugauucucgugccccagaauccagaguaauugggacuacagugauaauaccaauuauugauaaggguguagggggcuggcaggaguuuaaguuggaagcagcuaccuuagaaggcaacugggcaauauccauuaaaauaaaaguacauucacuuucugccuagaaauucaauuucucaauaacuacacuggggaagacugagaguaaauguuaaaggauguugccugaaacauuguuuguaauugcaaacaagugaaaguaacucaaauguccuucgauaggggaagaguuaaauaaacuaugacuauauguauacuagggcacuaugcagcaauuaaauagaaugcaucuguauugacauaagaagagcuccgacagaacaaugguaugacagauuuguacuaaaacacacacacacagacacacacaaagguuuacagggcuacacgucaaacugacaaugguugucaggacuggaacuaaguaagggccuaggauuaagacugaugaucgaggguaacaucagcaagaacaguaauuauaauauuuucaaaacaaugugguuauguuuuacuuguguaauuagaaauaaauuuaaaauauuaacaaaugauaagaauacuuuuaacaccacaaaacauaaauggauaagacacauaaacagauaauucacaagagucaauaaagauacagaaagaaauguuuaagcaaagaacugcaaauuauaauaacaaacuugucaaauguuuauuggucaucugaauaucaucuuucgaaaguguucaagucuuuuguccacuuuucuuauaaugccugcuaaaaaucugaaggaaaaaauauaagggauaguuuugcuuuuuuacagaaaguuaggugaacugcauuauuguucuuugauucuggaaguacccaaucuuuacaaauuugcugaauuauaaaaguucuuuaaaaugaguaguugaaacugugauguucacuuuuuaaauuguuuugcagaaauaaaguacaguaagguggguuuuuuuuggucccauuguaaauauguaauuucaaaguacauuuuuucaccacaugguuaaggccaauaaaguacauuuuaccauguauauagauaugaagguaauuauauauuuuaaaauaacuuuuaaaaguuuuaaaaauuaaaaaaauauauuuaaaagguaggaaguuugacuucacagauugguuuaauaaauaaacuacucucuguaaaaauaaaauaggacuucagauggucacaguggcucaugccuguaaucccagcccuuugggaggccgaggcgggaggaucacuugagcacaggaguucaagaccagccugagcaacacaguaagaccccaucucuacaaaaaaauuaaaaaauuaggcagguguggugguaugugccugugguuccaccugcucaggaggcugaggugggaggauugagcccaggaggucgaggcugcagugagcuaugaucaugccacugcacuccagccugggcgacagagcaagaaccucucucaagaaaauauaaaauaagccuucauuuauguaaugaucaaaauaagccuaauauaaaugaaaauagugaaaacuagugcaaauguuaugcuaacagagagcugaacuaucaaacuccuuuaagacuuagguuagagcucuaacaugugagugcuuuccauacucuuccuuuucacuaggaaauggcuuucauuaagaacaagucagucaguggcuaggcacagugacacaugccuguaaucccagcacuuugggaggccaaggugggugcauugcuugaguaugggaguucaagaccagccugggcaacaugguaaaccugucucucuacuaaaaaaaaaaaacaaaacaaaaccaaaaaacuagcuggaggcugggcacaguggcucacaccuguaaucccagcacucugggagggcaaggcagguggaucacuugaggucaggaguucggggcuagccuggccaacauggcaaaacccuggcucuacuaaaaauacaaaaauuagucgggcgugguggugugugcuuguaaucccagcuacacgggaggcugaggcacaagaaucacuugaaucugggagguggagguugcagugagcugagauugcgccacugcacuccagccagggcgacagagcaaaaaucugucucaauaaauaaauaaauaauuaauuaaauaaaaagcuagcugggcauggugcugcgugccuguagucccuacagcuaaucaggaggcuggggugggaggaucaccugagccugggaggucaaggcugcagggagcugagacugcaccacugcacuucagccugggcaaugggaccaaaaaaaagaagucaguccaucgguccagagucaaggaccaugggggaaguggggaaaaacagaauaaguaaaacuaucuguuacagaacucuuuuuggagacuuauucuauuguacauuuuauucaaaagggcaaauaaagaugcuuucuuuccagaaaucacguuugacuuaaauaauagaaagugguaguauaagaacauauuagguauguaccugcaauacuucuuacaugugaaguguuuaucuuuuguaaacaaaggaaaauugccuaaaugaccuuaaacaaugguuugaagaaucacaguucucacuucuaauauguuagaaguguaccaaauagguacuaaacuaauuuucaugucauuaauuaaaagcacuuaauuuuuuuaauaauugugguaaaauauauauaacauaaaauuuaacacuuuaaccauuuuuaaguguacgguucaguagcauuaaguacauucacauuguuaccacugucugccuccagaacauuuucaucaucccauacugaaacuugguacccauuaaagaacuccucaucucaccuccccuacaacccuggugacuacuguucuaagaauuugacuauuccaaguaauucauauaaaugcaaucauacaauauuuguuggccuuuuauaccuggcuuauuucacucagcauaaaguccucaagguucauccauguuaugacauguaucacaauuuauuuuuaagguugaauaauauuccauuguagguacauacuacauuuuguuuauucauccaucaauggacauuuggguuguuucuaccuuuugacuacugugaauaauguugcuaugaauaugaauaugacaguacaaauaucuguuggaguccuuuuuuuuuugagagagagucucacucugguugcccaggcuggaguggagugaugccauuacaguucaccgcagucuugacuuccugggcucaggugauucucucaccucagccuccugaguauuugggacuaugggcacacgccaccaugccaggcuaacuuuuuuuuuuuuuuuugguagaaaugagguuuuaccauguugcccaggauggucuugaacaccuggacucaagcaauccgcucgucuuggcuucccaaaauccuuggauuacaggugugagacacuacgccuggccccuucuuucaguucuuuuggguauauacccagagugaaauugcuugaccauuuguuauucuguuuaauuuuuuaagaaaccaucauuggguuuucaacagccacuacaccauuuuauauccccaccaacaaugcacaaggguuccaauuucuccauaguuaagccaacauguuguuuucuuuuuucuuuuuuuuuugauacuauucauucuaauggguaucaaguggcaucucauuguggcuuugauuugcauuucccugauuacuuuuuuuuuuuuuuuuuaauagagacaggguuucaccauauugcccaggcuggucucaaacuccugagcucaaagagcuccaccugcuuuggcuccccagugugcuaggauuacaggcaugagccauugcaccuggcccccugauuacucauuauauagagcauauuuucauauguauauugaccaucugccuaucuucuuuggagaacuaucugcucaagaucuuugcccaauuuugaauuguuucguuuuuuguuuuuguuuuuuugagauggaguuuugcucuuguugcccaggcuggagugcaauggaacgaucucggcucacugcaaccucugccuccgagguucaacgauucuccugccucagcuucccgaguagcuggaauuauaggcaugugccaccaugcccagcuaauuuuguauuuuuaguagagaugagguuucuccauguuggucaggcuggucuuaaacucuugaccucaggugauccgcccaacucagccucccaaagugccgguauuacagacauaagccaccacaccuggcuugaguuguuuaguuuuuuauugcugaguugaaggcguucucuauauauucuggguauuaaugcuuuaugagauauguaauuugcaaauauuuucucccauucugaggguugccuuuacauuauguugauaagacccuuugguguacaaaaguuuuuaauuuugaugaaguacaauuugucuguuuuuccuuuuguugccugugccuuuggugucauguauaugaaaucacugccacauccauugucaugaagcuuuuccucuaugcaauuuuuucuuccaagaguuuuauagguuuagcucuuacaucuuugucuuugauucaucuugaauuaauuuuguuuaugcuguuggguaaggguccaacuucauucuuuuacaggcauauauccaacucuuccagcaucauuuguuggaaagacugucuuuuuuuccacugacuagucuucacacccuuaucaaaaaucauuugaccauauaugcaagugcuuacuccugggcuuucuaugccauuggucuauaugucugucuuuaugccaguaucacacuguuuugacuucuguagcuuuguaguauacuuucaaaugaggaaaugugaguccucugacuuuguucuacccaacuguuuuuuauuaaaaauuuuuuuucaugcuuacugauaacaucccauacuuaacuguuuuuaaagcaaauuucccucuuaaauuuucuaauagauguguaccaaauuaaauacaccuagccucuguuggaagaauucuccuggauucuagaguuaggagagaagcccuaagaguguuuuaauacugagauauaugguccuuccuaucaauaucuuaaaucagggauugcauacuugauauacuuuggauauuuguccccacccaaaucuccuguugaaauauaauccccaauguuggaagugaggucuggugggagguguauggaucauggagguggaucccacauggcuuggugcugucuuugcgacagucagugggugcuugugaaaucuggucauuuaaaaauuguggcccucucccucaacucucucucuugcuccugcuuuugccauuugaagugccuacucccacuuugccuucugccaugauuguaaguuuccugaggccuccucagaagccaagcagauacuggcacuauccuuucuauacagccugcagaauugugagccacuuaaacgucuuuucuuuauaaauuacccagucucagguauuucuuuauagcaaugcaagaagucccuaauacaauacuugaaugcuuaaaggggccaggcagcauauauaagugacuggaaugacugaauuuuagaaaaaggaauaauggggaaugugaggagccaggauuacaugcucuauccguguucaaaaaugaaaaugcauucugaaggccaaauaaaacgaugugcagauaauaugaccccggggcugccaguuggcaaacuguucacaaguuuuacugcagagucuaaaugugaugaauaaaauauuuuauaaggggaaaauuuuaaguuauauguucuaaacagcuuccauagcuuaguuuauguacauguguguguguauuuguguguguguguauguaugugaaugaauguguauugggauauaugacauaugacuugugauguccauccuauucaccagggcaguagaagaccaugguaaagaaaaaauaaaucuggaguccagcugccuggguuuaaaucacagagucaucaugggcuaucuuugugacuuuggggaagcuauuaaacucucuaauccuguuucuccuucugcauaauggaaaucauaauaguaccuaucucaucauggaucaaaugaaauagcaggagaaaaugcuuaguacuuguagcaccuaacauuuaguaagucaguguucaguuaaaaaaaaaaauuacuugggaggccaaggcaggcugaucacgaggucaggaaaucgagaccauccuggcuaacauggugaaaccucgucucuacuaaaaauacaaaaaauuagccaggcgugguggcaggcaccuguagucccagcuacucgggaggcugaggcaggagaauggcgugaaccugggaggcggagcuugcggugagccuagauugugccacugcacuccagccugggcgacagagcgagacucugucucaaaaaaaaaaaaaaaaaaauuacuaacuuuuugucugaaagauuuuaggaggcauacaaucaaauaagaaaagauaaaauaaauaucuguaagaauccaaauaaaaggaaaagaaggaguagaaaaauaauaaagagucaaagguaagaucagcauaucauguacacuugcuaucugauuggcuuaguuccucauagcuaaaacaaagcaaaacaaaaaacacaucaacauguuuccuagaagcaccaccaugucaucuccaguuauuuuuaauuugccauguugugacagauuaaacaacuacgacuugcuuuccaugauauuaaccagaauuauggcuacagagagaagaaauauaaacuagcauauuuauuucucuacaaauuauuuuaguaggugguagucuauguauagugagauaagaaauaaauggugaaucccaaguuuaaaaaaugauuuccaguagcuccaaauuuccacuagaaauauaaucacuguaguuaugcacugauacuucuuccagucucuuaaagaacuuuaaaccaauuuauugagcccccaaaaucucaaauccaucugaaaaauaacucaauuaacauacuuuauauaacucuuuagauaaaacacaaauucaucuugguaauuugacagguuuuaugguagaaggcaccaguaggaggaaauuuaacuacuuuuuaaaucuugaagccaaaucuuaauuuguugaaauaccuuugggaagagaggaggagggcuaauaaaagugaugggaacaagauguccuaggagagguugucagugcacauuccuggcacaaucccauucaucuuuucaugacuaucgaaauaagucaucuuaccaguuuuacauuccaugcagaugaacuugcuaucaggaagugaugccaaucccaggcacuccaggugaaaguguuugcagcacucucccucacaaggaaucagagagucaccagagcuuucacaaaucuguaauauggcaaaaagcagugguucucaaacuuuggcaaacaucaagaccacaugggcggcuuguuaaacacaaauuaccgggucccucacccacagacugugauucaguaggucuggcgggggccccaagaaugugcauuucuaauauguauccagaagaugcugauauuguuuguccuuggccuucacuuugagaaccagagaacuagacaauuacaguauuuccagauacaauaugguauaaaguuuaaagucauacuugaucuuuuaggauuccuucuuugggaucugcauauuuaaguuuucuucacagggcaaagcaguauuuuuucaagaacgguaaaaauacacugagaaaguuauuacuuuaaaauuuugaauuuaagaaaguuuuuccaaucagucaucugccauuuacuuccaauuaauuauaguauaucacacuaaagauuggcauguggguaaguauuccaacucagaaagggaaaaaaagaaccacaaagagguuuuauaucuguagcuuuaaaguaauaucauaauaauuuggaaacauauuauccucuucaacaggaguuaagucuauuacuggcagaauauaauagcaauuauuucaagccauagcaccaguuaccugccuaccugacauacaguguccuucuuacucauuccagugccucuucucgacaaacuugaauccauggacugcacaucagaaacgucugcaucugcaguagcugaagggcuaucuacuugcuuuccaaagccuaccuacauagaaaacauagcauuuuuaagaaaaacaaaaugaaaauucccuccaagauaagaugcuaugaaaauccuaguaagacuugcucaaacauuagaucuugacacaaccaccuuuuuccuuccuuucuuuccaaaauccacagauaucauaggucugcuguuuugggaaaaacuguaguuaaaauuacaaacaaacuauaguuuuguuauauaacaugagagcaaaagaauuaagacacucaaaauaaacaaagugauuuuuuucuaugaguauuuuuaaaauguccugauuuccccaaauaaauaagggaaaagcauuauguucaagaaagaacacuuuguccagacccuugcacauauuuaccugcaggucacucaguccucuagaaucggagucagaugugucucuguaugcugaacuagucauuucuacaucaguugaggcgcgacuccuuuucuuuagagguuuacaggaaucugaaaucucgcuggcaccuuaauacaacacacugaaauuaauccuaaaauaguacuuaagguuuguuuuaauuuuuuugugugugggagaauauuuucuuuucucaaacucaucuuuaguguggaaaaagcauagcucucuuuguaacacugaaauaaugagucaaaacuucagaacuucugaccuuccugguagugacugauuuaauuuacaaccgcucuaucaaaacauuuaauucaguucuccucucuaaagcuauuuucagucaacagagcccacguuccaaccuaaaaaucaauucuaugaaaauugcaggauagcugauggauuuggagcaauucaaagaaccauucaauuuggagggggaagacauaaaacccaacacacuguguagcuuacaaauaugguugcagagacaucuccaucuuguuuuuauuagggaugugacaaaucuuugauuuguauucgauucguacacggauagugccauuuucccccaaauuuugcaauucaguugauuauugccccccaauaaaauuuggauguucauaauuguucaucugagacuuccuuggugaaguggcauuuauugugaccauuaacaagcgcugcagcacaucuacauaugucaugccauuuagaaggcacauugcugagggcuguaaauggacaaucaguguucaagugcagccaaaucacguagagcuggaugggaaggccucuauguggaauuugugcgggaagaaauaaauaggaaaaaaaaggcagagaauaguguggaauuguuuuuuuuaaaacuguguguaauacaaauccagccaaaacaauagugcaaaaaguuacaaagcaacaaucucuugggcuaaugcaguauaggcuauacagaaacagccacgaugaaaugugcagaucaggcacggugaauaccaaggaaccaaggagacgguuaauauuucaacccacaguuuguguuuuggauuuuuucccccaaaauuuccauacaacaaacagacaucuagaucaacccagcaagcuaugguggaagugugcaguccagaagagcccauggagaaacaagucuccugaggccaugaagauccgcaacaggcugagugagaguagcacuuggaacauagccacguucugugguggaggaggugggccucguuagacugcucagauuacuggaaccucguuaucacaucccauucuacaaguuuuucacugaauguuuccugacaucuauaaaugagggugccugcccauguuaaugcugauuaaaaaacacaaguacacaaaucuaucuccuucauugcugguguauggacccagaacaccaucacaaaauauuuccuuggccuaaaagaucacuggauuaacaaggaguuuuaacagaggaacaggagugcuguacugagaggcuuucgaagggaaacacagguaccgccauuuccgaugaguuucugaaaaugcuagaaaaaugacagacugccaaagacagcugucaugcuguucuccaugauaacggcacuaauauuaaaaaaaauaagaacuuuuaaugauuguaauguauacaguuugggcuguuuggcaaaccccugcagaugugcauuaaugaugcuuuauuuaaaaacaaaaaaccaaaaacaguccauguugaaauugaucaguguaaguuaaauggugguuuuuaggcuggacccaugauuuaagcuguacccauccagcucaaaccgaaaaaaaaaaaucauuugacuguuaaagcaauuguucagagucuugaagaagaaaccaggcaggaaaaugccaauaaugaugauuggcgaaaucaaaaucgaaaacaaagaaacuguuuaucaagccgccgacaaagaaaucuugcauggagacuacaagucuggaguuucugggaugaaauuguacaggaaucucaguccacaguuuccucaaucgcugcggagacggagcugucacugaaucugacagagcccugcacuccccgguccgccgacccuguggaaugguggaaacacaacgcaaucaggccuccuaaucucgcagcgaucgcgaugucuuuucuuggagcuccgccaagcaguguucccuccgagaggcuguucaguucugcugaggaucuccacggagaccaucgcugcagacuucuccccgagaaugcagagaggcuguuguuuuauuuuauuuuuaaauaaugcaauuugcccagaguaaacuacagguauuaaauacaguuugaucucaccaaaaacgcacgaaucaugcuauggaguuuguacuguagucaaauugcacacagaaaauacagauauaaguuuaagcuuucuuaaacuuugugcauaucucaaauagauucgcauaaggucaucuaauaguggccauaaaugcuaugaaucauuuuaauuuacaaaaagauuuuacagcacuguaaaaauaaauguggcaagauuuuuucaaucagcuugucuugucugauuugucauaguccauguuugacaaacaugaauagcuacuauucgguauucagucgaauaccaaaaaaaguggauucgucacaucccuaguuuauaagccagugaaaccccagaaucuuauggagaaaaguuggaaacaguaucaagucuacguuguguucuccaauuuaccaaaacaaguaagacuuuucacguggagguacagaauaagaucaacucuaaaagucacacacacacacgaacacuggggaauacugcaauuucacacugaagagcaacaacgauuuacagagacagacaaaaauacaugaaguacaaauaauucuuaaaaauugguuuuaaucaaggaaaugcaaagcaacauuauaauauuaacucaccuuucuguaauccagucuucacuguagccugaggaacuguuucaaccuguuuggacagaaaaauacagcauuaacaaagaauuuuuuucccuuuuaauuauuaacagagggaaaagauacuuucaucaaucuaagcaaugaugagugauuaauguaucugaaaucugaacucagucccaucuuuuggguaaaguucucugucucaagaucagggaggguuuaaauccuagcugccugugcugaauaucaagugacaacacacagccacaugcucucuagcaaagacuuuucccaccauucccuugguauaugaagagaacaagaauacuuuccucagugucuggaaggcaggagagggguuguuucugcaaccggccccaauguugcuaaaaaccccucccgccccaaagacguuaggauaaauuuuuacuuacuaugauacucagguuaauguaacucacgccacuuuaagacccuuccgcgccugcacucacagcuaaguugcugggaaucaggacccucucuguagagagugcuacagggcuccauacagcuggaagcucaauacuuuugcugcuaguacaaacuuaagaaaauaaguuugugauauugcaaaagcacuuucuugagugucuuaugaacagugucuugauccuacauuaggagagcgagaucagaaguuauucugccaauguauauguaaaacacgugguaauuugaggauugaaccauuggaauuagagaaaggaggcuguuuggaggaguuccuguuuaagcuauaaauugaauuucauguuucuuuaagauguggugaaauaugaauguugaaacacauuuuguaaauauuuaaggauuguucuaagcuuuuuaaaaaaaauuuuauuuuuuuuacaacagguaaaaaaacauacaacagaaacgcuuuuauaagauacaauuaguaauacaaauauaaaaucuucuaaacaaucacugguauuguucuacuacuaacuauaacacaguggcauuaacaauuugucccacuuuuuauacucauucugcuuauuaguuuaaaacugacuggucacagacugauuuugggaaccagcuggcaaaaucacaacuucauuuugguaaugaauaacuauagauuuucaagagcuuagaaagauuuuuuggaauauaauuuccuaaguaugaaauaugaaaguuaauaugauaaaugaaugacaaauuaguauacuauuuaaauuuuaguuaaauauucuggaaaaacuguuucacuugcuuggugauaccacagagcacccacaaaguuagcuuuuaaauuuggaaguuuaaaaucaugaaggaaauauuuuaaauagaaaagcucacauucuuccauauaaaugguuuaaaaaauauaaaacuuauuggaacuaauucuauucagaauuuguuuuguuugcuagcagguguuuaggcuguaagaauggauauucuuuaacaaaaaaauuaagaaaaaaucugauugugaguuuaauuuaaagaagaauggcuucuaaaauuuuauuugaaaaguugauuuaaauguaucuuacuacauugauuacacugguuuaauacacuucagucaaaaugcaacccccccacacaccuuuuuuuaccuaaauauuauuuaucugacaaccugauaucaggugaauauuccacugggaaaauaacauuccaaaaaaucugcgauauuaacagaaaaaacagaucaucuaugaauaucugcuucuuaaauauaagaauauaaauuaaauugauuuguuuaaaaaauaaaaaacaauauauaccagcagcuuaaaccaaaaaucaaacuuaaaaaaaaaaaaaggaacucaaugaugguuccaaauaaaaaucauaaaaacaugaaaucauucugcugauaacagaaacuucuaaauaaaugugaaggauuuuuuaagucuugcaccacuggcuucccaucuccugaaaccuguuuucugugaaaaugcuugaagcagaaucacagggauggcuguauuaaaacugagcacuggaacccaccaggacagaagcguuaagauaguccagaaaggaaacucagugugggggaaaguuucucuuucuuuuaagacaggaauguaagccacaacauuuacaaauacaauguuuuaacucucuacauguaggaagccaaccugcuccuuuuugaucuucuucuuuggcacaaccucaguggauuucucugauucagaacgaguucuaauugaucuucucuguugcuucuuuucuacugagccuaagaaaugauuuaaacacacaaacaaaaacucacuuaaggauaccuugacaucuauguaauuaagauaugaccacauuccuugcuuuucuuacccauuacuuuuggaauuuuaauuaaaaucauuaaaaaaugcuaaacauucaggagcauauaaauuauuuaacagaucaaauuguaaaggcugauaagcugagacugggauucacaaaggguccuaaauuauacaaauaaagggggauugguuuuuuaaaaauugaaaagucaaacuaaaacagcagacacauuaguuuuaaaggcacauaaacaucuuuagguaaauauaauuagggaaugaagggacugaaggaugcauaaaaauaaacuuuauuauccaccugauguuagaaauuauugguucaaaauucaaucagugccacacauucugcauuuuaacaaaugaguuuaauuaauucuauacauaaaaugguuaacagugcuuguugcacuuauguaaguuuugcuguuguuauuaauaacaaaagcaggaaaagcagggaaggcaaaaaaugugaccaaaaccuaaucauuaauuugacuaucaagggaucuguuauacucuggaaauaauuagucguggaaaacuaguugaaacaaauuaucaagcuuuuucauguuaaaugguaaaacaaacuauuaagauuuuuaaagaguacaauucuuuaaaagcgaauugaagaaaacucacauggaccccauuuuuggaaaggauaaaacugaaauugaagaacacaacuugaaagaacauugucaggaaugauuucauucugugagccugaggaggaaugauaccugcagugcagcuguucuccauguuuucagugccuggaccaccuacguauuccuuccuaaaucauaaucaccucuggcuugccauaggaagaagccacuaagaccuauaaaaucagauagaagcucuaucuauaaagccuuucauauaaccuuuauauuuucugguuucauugcucuuggcuauguauaaaugacuucccucacuuuaguucaaagccaaaaugaaggaucccacuacuuuguuuuguuuuugggaaggagcggguaguuugauaacaauauauuguuuuagagcugugguuaaucgauuuauaguaaucacaaauaaagguauuggcuccuuucuuuacucucacucuucuccuuacacugacgaaaauguuuacuaagacagcagauaugcuacccucccagaccaaccugaggauccgagauccauacuuuaguauuaaagugucaauauucaacuacuacuaggaagggcaaaaaugaaaauggaauugcuuaaaaacgaacaaaaaaauauuuacuuguguugaggguaauauaaucacaccaugaagagcagaugagauuugauuuacugucuuauagaggauaaagcaacaugauuucuuaaaauuauucugaaaguuacccaaagaacauauacauuuaaaaccauugaagaguauuauguucauguucuaagaaagaggaggugagcauuucuggguuuggaaaauaacuuugaaaucuagugugaauacaaguacaguucuucaaacgacaaaaaugugacagugccaaacauuuuauauaucccugaaauuuacuaagaaaaggcucaauaauuuccuuaagcaguuaacaucagcugagaugaugcaauugguuucugaagggugaacaaguuucuauuuugacuuuucaacuacugaaguuauuuucacaaaaagcaaaauggucacuuaaaaagacaagguaugcuuaucaaccacagcuguuaaccaaacuucaaacaagcucaaagcuuuagagcaccagucccuaaauuaaguuuuuuuucuuuucuuuucuuuucuuuuuugagacggagucucucccugucacccaggcuggagugcaauggcgcgaucuuggcucacugcaaccuccgccuccaggguucaagcgauucuccugccucagccuccugaguagcugggauuacaggcgugcgccaccaugcccagcuaauuuuuuuuuuguaccuuuguagagacaggguuucaccauguuggccaggugaucucaaacuccugaccuugugauccgccugccucagccucccaaacugcugggauuacaggugugagccaccauaccuggcccuaaauuaaguuuucaaucuuaauuuacaaccuaaauucuacguuccugcuuaagcaaaaaacaacacugccuuuuuccagauauaaagaaguauaaccuuccacuuaagaaaaaaaggaaauauucauagcagagauuaaaucuuacaaugaaaauacuauauaaaaagaaaauguucaggcugggcacagcgacucaugucuguaaucccaacacuucaagagggcaagacaggaggaucguuugagcccaggaguucgagaccagccuggggaacaaggugagacacucaucucuacaaaaaauaaaaauaaaauaaauuagccaagcaugguggcaggcacuggguagucucagcuacuccaggaggcugagguaggaggaucucuggaguccaggaguuuaagguuacagugaacuaagaucacaccacugcacuucaacuugggugcaagacccugucucaaaaaaaaaaaaaaaaaaaaaaauucaguaacuuucagaggagaaagaaaaacaagcuccauccaaaauaaaagcauaauauuugaguuaagaucagucuaauauaggaagaauuuacuuucuccuuaggaaacugcugauuucaaauaaagauccuccuagguaucccauuuaaauucagacaaauuacuaaucauuuaguguaaagagguaacaaaacugacauaccuaauuuggaaaguggaggccaaaagauucuuuuaauauucaaagaagggaacauucucaauuauggcuaauaugaaaucuucuaaguccaucuacucauuccuuugacauuguaaguucaucuuuuuauaaaguauuuugaaaugauacaaguugcaaauguaguacuggacuuugcuauucacucccuccuuucuuuaacucaacuuuccuucccaauuccauauugaaaaaggcuguuuaaaaugccccauccaacaugugcugcaucuccacuggcauuaccucucccuguccugcagcucccauuauuuucuuuuuaagaaagcuagcccaaguacuuuugugaacagugauuuuuuuuuacuuugcuauuauaauaauuagaaucuuauuuaaauuucccuuacaaaaauauuuacacuuuaugccacucagucacagguuugccugaguuacuacugauucaagauuaccacuucaggucuuaagacuuugauccauccagaaaauuacuuggucacugugauauugugauaugauaagaaacauauauuugaucucugccccugguuccuggcacagagcuccuacuuggaauuuccugcauaauauaaguguuuuuugcucuaaagaggcaacucuugguggguuccuaguugggggcuagucacuagaaaaaccaagcuaugauuagaugcuuuaagcuccacccccccauccuccgagaaggggaguggggcugaagacugaguuaauaauugaucaugccuacaugauaaagccuccauaaaaaucccugagcuacaggguuuggagaaauuccagguugcugaacacacgaaggugccuguaggguggcauggccagagagggcauggaagcucuacagcccuuuccauauaccuugcccugugcaucucuuccaucuggcuguucaucuguaucuuuugccauaugcuuuaucaugaaccaguaaauguaaagaaagggcuugucugaguucugugagcugcucuagcaaaugacuaaacccaaggagggggucacgagaaccuccaauuuauagcuggucagucagaagcucugaagccccagacuugcaacugacaucugaagugggggcagucucauaggauugagcgcuuaaccugagggauuggacucuaacaccagggagauagugugagaaucaaauugaaucauaggacacccagcuggucagugugggaaaacaaagaaacccauauaugggucuauaaguacguucagaaaauaguuuaacuuuuuuuucuacuauagucgcuucuuagauucaaaacaaauuuuuaaagaacaaaaugaaacaaacuccuuucuucuaaacuaagauuccaaaugaacacgcuaguuaauacuuaacucuuuucuugauggcuauaugaagcaagcaguauuacagaaauacuacuaauauaauacuguuacauaaaccaaacccaccagacauucaauugaaacucuaaaauccuuaguaaguuagucucaaaaaaauuauguuggcugggugcaauggcucacgccuauaaucccagcacacugggaggccgaggcagguagaucgcuugaauccagggguucgagaccagccugggcaacauggcaaaaaguacaaaaacuuagccagguaucauggugcaugccuguggucccagcuaccuaggaggcugaggugagaggaucaccugagccugggaggucgaggcugcagugagccaugaucguaccauuguacuccacucugcaugacagagugagaccccgucucaaaaaaaaaaaggccagacguggugguucaugccuguaauuccagcacuuugggaggccgaggcagguagaucacaaggucaggaguuggagacuagccuggccaacauggugaaacuuugucucuacuaaaaauacaaaaaguagcuggguguguuggcaugccccuguaaucccagcuacucaggaggcugaggcaggagaaucgcuugaaccugggagguggagguugcagcgaaccgagauugagccacugcacuccagccugaguggcagagugagacucugucucaaaaaaaaaaaaaguuaaacauuccaaaggcacaaucuuacugaauacagucacuucuccuuuaagcaagaauaacauggcuugauuuucaauucauggugucugcuaaucagaaaacagguuacauuaggacaauuaggcucuaggccccucagcuacuaguaucuagcacaacuaggaauaaugacaagagcuuuggcaucagccauuuguuuccaacagggguaaaggaggaaaugguaugugugugcuaauagagugggaaaaguaaagcuguuauuaugcaaagagagauagucgaugguguauuuacucagauacauauagaguuuuauagcuauacacuuuuaauuauagaacccuauuauuuuaauucuuguacaaaaaauaacuugcuaugaauaaaguucucuagccccuaacccacuuuccuauuaaaguaacugcuuuuauauuuugauuuuuaaauauaauuuacuuuugauaacuaagaguuucuuagaaacacagcuaccacauuauagcagaacagaacaaggauuucucaaaauggaccuauauauacuuuucauucauaccaaccuguagaaccagauguugcuucaggagaugauacacucugcguuggcuuuucauuucucugguuugguguagaaauuauaagccugucuugcccccugacacuuauuucuguuuuguuaccaauucccuuuaaaauaaggcaaaagaaaaaacaacaaaacaggugauuaccaggcaaguggcaucaugggcuuauaaagauggcuuaaaaugaucauaauuugcuuaaauuuuauauggucuuugauugcaauuaaguuaucuuagccuuuaucagaaauuugauuaagugaucaagauacuuuuuuuaaaaauuaaaaacaauuuuuuuuuuuuuugagaagaagucucccucugucgcccaggcuggagugcauggugugaucuuggcucauugcaaccucuaccaccuggguucaagugauucuccugccucagccuccccaaguaccugggaauacagaugcgugccaccacgcccugcuaauuuuuuuuuuuguauuuuuaguagagaugagguuucaccauguuggccaggcuggucucgaacucuugaccucaggugaucugcucaccuuggccucccaaagugcugggauuacaggcguuagccaccgcacccggccaaaaaaaauuuuuuuuuaagauggaaucuggcucugucaccugggcugcagugcaguggugugaucuuggcucacugcaaccucugccucgucccagguucaaguaauucugccucagccucccgaguagcugggacuacaggcaugugcuaccaugcccagcuaauuccaagauacauuuuaaaaugcacaguaagaucacgugagguagaguauuugucuaagucuaggugauaaaugucacuaaaaaauauaccuguaucacucaauuuucuauaaaaacaaaauauuuucuggucuuuauacauaucacaguaagagaacucuagucauuugcauuugguaaagugcucuauuacacagaaaaaaaugccaauaugucuuaagagacaagaauaccccuagauacagaaauaugucacucauggugaccaaaaugugacccaauaaguaauccgaagcagaaagaaggcagguauaauuaacuuaggucuccuuuuagguauuuuuaaugcaauggaauagaaguaaagaagugauuuauaaacauauauguauuuuuuuggccaggcaccguggcuccugccuguaaucucaacacuuugggagacugaggcaggagaacagcuagaggccaggaguucaagaccagccugggcaccauagugagacccugucucuacaaaaaauuuuuaaaaggucuggcacaguggcucaugacuguaaucucagugcuuuggaaggccaaggcagaagaucccuuggggcugcagugagcuauuauugaccacugcacuccagccugggccacagagugagaccucaucucuuaaaaaggaaaaaaauaaauauaaauauauacaugcauauauuuuuagagucuucauuuugaaaagaucaguuuuaucuugaauuuccuuuaaauagcauucuuuggggugguagugacaaaguuugacuugugcaucagaagcaguaaaacuagcuccaagaauaaagccaauuuguacucaaaaaagaugcaacauacucauuugcuauuugaaagaugaaaaauauucauuugcuaucaagagaaccaaguggggacugcaauucaaguuuuugcagguagcuuggccuuaacugaagucagcugaaccuaugggcagaccagguuaaaagagcacccuugacauuucucuaggaagauguauuacuaauuaagcauuccccuguuuaacuaauuaaucugcauaugacuauauuaggaaaaaauaagcauagaauucuuuaauacacaugaaugaaaugcaacuaaaucagaaucacaaacucaacacagugggaugggaugggaugguagugaagagguacacggaauaaauaccuaccaauauuauggaagaguuuuaaagucuucaagcuaaaguauaagugcccuaaauggaggcccaggacaaacugaugaaggcacacaguuuguagaggcuguuuuuaccccauuacccaaguuauugccacagcuaauuguuacagaacaaacacaguucugggauucucugaaaggcaguuagauaucgcaagcccauaagaaucuaacaaaauugcugguggaaccaaacaggucagcagguacaauuauuacagugguuuuuauaacaaugguuaauucauauaauugacaaaaaugauuuuaauaagaaguacacuuugcaacuaagaaaagcuaacuacgcaaacuagaaacaggcaaagugcccaguuuuuuuccaugacuuuagggagcuaagcucaauuuuggcugcacagcucaagacuaaucuacuacagaugggaaaaucacaaaagaaggggauaaaaaagaagaaaaacauagccuuuuugccugucuuuuuugcccacagaguacaaugacuguauguuucaaauucaguggguagaaaggguauuuaaauuaugccaaggucauuguuuuaaaugccaagguugaccacuuuuaaaauaccaucccccaaaaaacuccacgaaaaaaggagguaccuuuguugaauaaacaaauugaucgauaaauuucccauccccuguagcauucugaagagcaaacacuuguucaauuuucacaacuggagacauguuacacuucugcaaauccaggcucccuuugugcaucguaauggaagcugguaaggauuuccuugcugccgcaguuuuccaggcuauuuuaacaggcgguggcucuuccucuuccgcacuugugugccgccucuggcuaugucuccgaauuucaguacuugagagugaggaggccaccuccccugcauuggucuguucuggcugaguauucagcacagaucuuggucgucggguuuuuuuaacuucgguuuuggaggcaacacucuuuuuugcuugggauaaagccucuucaggcuguuuaucaauguaaauaaaaguauacuguucuauucuuucuucucgagucauuuucaaugcuuucucugcaugggcaaugccaauaucccacugagcacguucucucugaggucgggguuuccgaaucuuuaaaaaagauagagauuaucagacaugcuuuacucuaauagguacauuaaaauugauauguauuucccaugugauccuguuaucuuuucaggucuacauaaauaucuucagguucuuuggucaaacaaguggaauguucuaucuccauaauucugauaaaaagauauucgauaacaugaggaucuacucucuuuuauauccuuccuuugcugaucacucugcuggacaagguccccaagagggagacauccuucuccucucauauacauaaaaagcuagugauaaugagggaaaagagaacaaugauuacagaaaugguuauuuucaguggcuaauaaaacacuaacauuaaaaaugauacccugaaacucccaauucucucccauaucucgggcagagggcaagucaggggugcuacagagaucacaacaaagcuacuggcagaguuugaaccacaaugcaugcagggacagaaugaagugaaaggacagagccucaaggaacaaaugaaaauuaacaagacaaaggagaacaggcauggaugagaaaaaagguagaccugaauuauaguuuccauaggucucuagguccagagucaaucagaagacuuuggauuggcaagagggguaaaaauacuuugaauaaagaugugugagauggccagagcaauuaggaauuauccagguggcuagacugauguagccagaaauuaguuaauaaaacuaugagauagcauaugucaaauauucauauauaaaucuguaaaauguaagucucauaaaauuaaucaaaauucugugauaaaauuuaguuuuucaaguguaaaaaaugacaaauuucugaaucauaagagacccacacuaauuuaguugaguuuaaacucuuaaccagauuaccaagaguucaugucaaaauucuaaaauauccaccaccacaucaaauauauuuccugauuccaucacuugugugaucucgguugaaccaguuacauaagcuuucugugccucaauuucuucaucuguaaaaaggggaauaauaguaucuaccucauacagguuguuaugaauaauaagugaguuaauauauguaaaaugcuuaaaagcauaccuguuucacaauaggcacucauuaaauauuuuuaaaaguuuacuuucauaaaacaauuuuguuaaacaagaaugaaaagaaauuauggaaacaugcugaaauagaaaaaagaguaaaaaucccuggcaaaaauccacauuucacuagcaucugguacacuuaugcacauuaaugaaacucacaauagaauucaauauuaagcagguagcuaaaguuuuuaauaguacuauacgucguuuauaugacauauaaaacucauugguguacuuacaaacuuacuagucauuuaccauuacgauuaaaacagcugaaagggguuuaaaaaaaggauucuaauaauuaucugaauucaaguaugaaaaauucuucuaaauuauuaaguucuuuaaaaaccauacuagguaaauaauauuaacauguuaguuaccuuuuguuucucagagugauugcuggcuuguuugguugccucagccaguaauucuucauacuguuuaugaccuuuauacucucguacccguuuuucaugaacccacgcccucucuggcugguugcuaaaaaacuggacaugauauucucgggcaccuguaaguaaaaauucuuauuaaccauuucagaacauaagcauucacaucuacuuugccaaaaaugggaaucuaacccagguuccucaguauuacucccacuaaaacuuguauguuuggauuguccaaagauauguuccaauacccaccaguuauagaacuaauagcuacuguaaaaaucaccacaaauaauugauugcaccacugcacuccagccugggugacagagcaagacucuugucucaaaacaaaacaaaacaaaacaaaacaaaauaacauucuucucauuaacuuuuuaacaaaauagucauuuuucauaaaaauauaauuaaugauagcauguaaggaguucuuguuguuagagacauggucucacucuauggcccaggccggacugcaguggcaugauccuagcucacugcagccucaaacuccugggcucaggcaauccugugccuuagccucuugagcagguaagacuacagacauaugccacaugcucaguuaauuaauaaauuuuuuuguugcuuuuuuuuguagagaugggagucuuacuauguugcucaggcuggucucaaacgcuuggccugaagugauccuccugccucagccucccaaagugcugagauuacaggcaugagccacuggccccagccuaugauagguucuuauuuuuaaauaaaucaauaaauauuuugaaauuuucucagcuuuaauuucuuuuuuucuuuaaacugagauggggucuugcuauguugcccaggcuggucuugaacuccugggcucaagcaauccucuugccucagccucccaaaguguuagaauuacaggugugagccacugcgccugcaucucagcuuuaauuucuaaauuuaaauaacauuagauauaacccacguaaacaaaagccuuuuugaguccucaaguuuuaggaguaaaagggguccugggaccacaacaucugagaacugcugauuaagggcaaugcuacucugaaauugguuugacaaacaagccagucugggacaaaaguaaguacagaaguugaguaagcauugagaagcucugacagcaauuugacauuguuaugauaucuagacacaugaucaagaaucuugcacuagguguuuuuucaggggaagggcauucuuuuuuuuuuaaauaauuaaguuugguuguauuuuacagagguauuaguacauaguagacuagacauuugaaaaaaguaaaaaaaaacugaucuuuugcgaaaaauagucugaaaaauacuguucuagagaaaaaguauuagaucaauggagaaaugcaggaacugaucuuuucagagaacccaaaguaauuaggaagaaaaaggcaacaguggacucagauuuucauaucaucucaucugagaauaaagacccaagcacaaaucuaauuauaauuagucaaagaagauuuaucugaaauccaaaggguuuuuggggggaaaaauagaaauauaaccuaaacuaauaagugaauuucaaggacaggguaguggguacagguauucagauuaaaaaaacauaguacauaauguuuccaaacaucagaguuauuucuucagauaugaacagauaaucccaaaggacuuaacauaaaagccgaaauuuauagauaacacaauuucauuuuaaucuguauuuucaacuucuucccccauuaaaucauuuacuagagaggaaacaagacaaacauuuugccuauuuguuagcacuuuguuuccugacaccuggaaaacuaugaaauaagacugaaauaagaagcuacagaccugaaaagucaagaaacaagcacaucugucucugacugaagagcuaaauuuuuaaugaguccuaaauaauaaaauacaacuuaaaauagaauugugauccaaacaucuuucaacaugcucuuacaaauaauuauuacaucuuuaugugugaaaaacuguuaaguacauuuuccagugcuaagaaucuaauaaaaauacugacuaauggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaagaaaaaaaaaauacugacuaauaacaauauggaaaccagugauuacuauauaugauuaagauaaauuuuacaaaguugcuuagauagaaagcaacacaggagauucacucauuucucuggguaucucccauguauacaugcaguauaugugcuauuaaaaaaguaaugaucagcauaaaaugcuuaauaggcaucaugcguggaacauaauuaacagaauuuuuaggcuguguuuuuuugguuuucagaaaaacugucagaaaacuacugcauuuaaaacuauacuauauagccauaaauggaauauuauuuggcaauaaaaaggaauaaagcacugauaccauguuaaaacauggaugaaccucaaaaacauuaugguaagugaaugaagccagaugaauagguaagucuacagagacagaaaguaguuacuggcugcuuagcggguagaaaugagggugacugcuaauggauacaggauuuuuggggguugaugaacauguucuaaaauagauuguggugaugguugcacaacucugugaauguacagauuuuuaaaucaaugaacuguacauuuuaaaagggugaauuggccaggagcaguggcuuacgccuuuaaucccagcacuuugggaggccgaggcaggcagaucacaaggucaggaguuugagaccagccuggccaacacagugaaaccccgucucuacuaaaaauacaaaaaaaaaaaaauuagccggugugguggugggugccuguaaucucagcuacuugggaggcugaagcaggagaaucgcuugaaccuggaaggcggagguugcagugagcugagaucgugcuacugcacuacagccugggcaacaauccaucucaaaaacaaacaaacaaacaaaaaaaacaggugaauuuuaugauaugagaauuauauuucaauaaaguuuuuaaaacuacuauagaaaaauaauuuaaauuuuuauuaaaauauauagguuaaaauauaugcauuucuuaaccuaaaauuucagacuucugguaguaauauaaacaaaaucgguuuuuccagcacuaaaguaggaaacugccuggggguaccaggcuagaauuuuuuuuuuuuuuuuuuuuugagaccaagucucacucugucacccagacuggagugaagugguggaucucggcucacugcaaccgcaaccuccaccuccuggguucaagugauucucuugucucagucaccugagugagaccuuagaggcaugcgccaaaacgccuggcuaauuuuuguauuuucaguagauaugggguuucaccauauuggccaggcuggucuugaacuccuaaccucaggugauccacccaccuuggccucccaaagugcugggauuacaggcaugaggcaccuugcccagcugagauuagguuaauuaauaaaacuaaauguaaauacuuccuuugaaauacagaugagacauaaauugugcuuucauuuguaucuugaaaaaagcugaaaucugcagguuuucauaaaguaauugaauaugaaacucuuuauauaaucucaacaguaugcuuuccucaggggacagaagugaagauccagaguucugacaugauguaacuucuuagagaguucuggaggccuagauguggacaugaauuguuuuauuuaagaaagcauggucuucuuggaaaauccuugucuuuucuuuucccacucauauaaccauagauuauuagagggguaggguacuucagagaugacuaguccaauacccuucuuauauaaaugaaggaacuauaauaagacugccuccuccaaccucuguaaaugaugacuaggugaauuuaacugcuuucccuguaauauaaggcaguguuuaggaggagagguuaugaaauuaagauuucuuugagauucuguuuaccuauuuaaaauaugggauaauaaaaguaccuacuucacuguguugcugcuaugaggauuggauaagaaaauauauaagagaacuacugaacacaggaccuugcacuaaagcagacacccaacaaugcugguuuuucacuucugccucgcugacacaucccgucuccuaaccuuuaaucagcaggucacauugacaagacgaaaaaugguugagccagauggccuucuauacugggagagauucuugguuaugcagcacaagaaucacagauauggcugauccuaucacaaaugugccuugccagacauaaagagauacuuuuucccuucagaagagugaacaaggaccaagacagaugguuuaaaguaaaagaaaaagaaacagguacaaacuugucacagacaaugaggaacucuacacaugacaagagucaauucacaaaguuaacacccagaaguaaguuccaagcucaaaccuuucuuuggcuacuaagcaaguucauuucaaaugcuagaaucucagcaaucuacuccacaucauucuuuggucaaaucccagaaaaggaguagagaaaaguuagaauugucuuucuuaauuuuuauuaacauuccuaagguaggauucuauauuauauagcaaccuucaggcuacaugucauaucaaauuuacaaggaugccccaguaaauuuaccgauucaagaauggaguguagaggaaaaaaaagcauccugcaaaauuugccaggaugaaaaguacuugucuggguaaaaaauuacuauccauagcagucaacgaugaaauaaaaauguucaaagaaggcuuggcgcaaaugcuuauuaaguucauauaaaacaucugaucgcuuguccauaugcuuucuuuaggaaauaugaggucauauuuucagucagauuaaggucuuuaaaaaaagcaaguguaagcaaauuauaagcaaauguaggguaucauaagggaaacaaggacugcauuagccauagaagcacucugcaauuuaaaaugacuaucaguauuucacugguuuuaaaaacugauacagaggccgggcgcaguggcucacgccuguaauccuaccacuuugggaggccgaggcaggugcaucccuugaguucgagaguucaagaccauccuggguaacauggugaaaccucaucuguauuaaaaauacaaaaacuaaccaggaauuguggcgggugccuguaaucccagcuacuccagaggcccaggcaggagaaucacuugaacccaggaggcggagguugcagugagcugagauugcgccauugcacuccagccugggcaacagagcaaaaacuccgucucaaaaaaaaaaagaaaaaaaaaaaauccacaaaacugauacggauaugcacauuuuuguaucagauuauauauuacguguguauucuuauauucacauacaacauuuaaaagucacuuuuauuuccaaccuuuuacuuaguaucuguuuaugccuuuucuuaccucuuguguuaauuuuaguaugaaccucaagcuggggaucacuugaaaccauacaaggccaccaaggauagguucccaccuuggaccacacaagaucgccaaccugaaacuuaacaccaguggacacuuccguuguuggaacagaagauaguauuggcugaaccuacaggaaagggucaaaaaacuucaucagaaauucaaaaaaagaaacuauguauaaaguacauuaaaaaugcuaacaauguaauuuuaucuucaguuauacuuugauacaggaaagugucaaaaaacaucagaaauucaaaaaaagaaacuagguauaaaguacauuaaaaaugcuaacaauguaauuuuaucuucaauuauacuuugauacaggaaagggucaaaaaacaucagaaauucaaaaaaagaaacuagauauaaaguacauuaaaaaugcuaacaauguaauuuuaucuucaauuauacuuugauacaggaaagggucaaaaaacaucagaaauucaaaaaaagaaacuauguauaaaguacauuaaaagugcuaacaauguaaauuuaucuucaauuauacuuuucucugaugccuccuaucuaaaacuagcaaaagggaaggaggaaaaauauuaauaagccccaccccaaauacugaagauaggauugaugguuucuguugccaaauuauuaacaaggcauguuaagaauacacaugaucggccaggcgcgguggcucacgccuguaaucccagcacuuugggagggugaggagggcagaucacaaggucaggagaucgagaccagccuggccaacacagugaaaccccgucucuacuaaaaauacaaaaauuagcuggguaugguggcacgugccugucaucccagcuauucggcaagcugaggcaggacaaucgcuugaacccaggaggcagagguugcagugagucgagauugcgccacugcacuccagccugggcaacagagugagacuccgucucaaaaagaaaaaaaaaaaaaauacacaugaucaauugaaaaaaaaacaggucauaguuuugaaaaggaaaaugauucacugaaaauauccaccuaucaaaccagcuccaagacuuauuucaauauaauuucugaaauuaagaagcguaguaccaauacaauuguguugcaauucaaucacuguguuucaccuucuuccaccauauuugguuagacaguauucaguaaaacaacuuacuggggcuuccucuuuuaguacugguucuucccuugguuuuucugauacagugucaacccucucauuuggucucuaggugaaaagguauagguaaguagaauaaaauggcauuaaauaaacaaacaaacaaaaaacagugacauacauaaaaagaaucaaagaaaacuaaauaaagagaauaaagggcauuuauuaacugaacaauguaaggaguaagaauacaacuuacucaauaccuaaugcugucucaacauucauuuuccaccccauaucauagcuuuaucuccuuuuucuuauuuuguuacuuuuaaaacuuaauuucuaggccgggugcaguagcucaugccuguaaucccagcauuuugggaggcuaaggcaggcagaucacaaggucaggaguucaagaccagcuuggccagcauggugaaaccccgucucuacuaaaaauuaaaaaaauagccgggcaugguggcgcaugccuguagucccagcuacuugggaggcugaggcaggagaaucacuugaacccaggaggcggagguugcagugagccgagauugugccacugcacuccagccugggugacagagugagacucugucucaaaaaaaaaaaacaaaaaaaaaacccacuuaauuucuaaauaaacugguaauuuucuuuuuaaugcucagauucuagaaaaaaugggcacucuaagauuacuaguaagauguaacuugaaacuuuucugagagcaauuugguuguauauaugaaaaacauuaaauuuucagacucugaccuugcaaaucuacuucuaagaauguauauuugaaaagcacugagagauguaaaaaauauggauaaguaugaagauaugcauaccauugcuacuuacaagagcuaaguauuaaacauaaucuagaugggcugggcauggcggcucacgccuguaauccuagcacuuugggaggcugaggcagguggaucacgagaucaagaaauugagaccauccuggccaacauggugaaaccccgucucuacuaaaaacacuaaaaauuagcugggugugguggugugcgccuguaguccaagcuacucaggaggcuggggcaggaggauugcuugaaccugggagguggggguugcagugagccgagaucaugccacugcacuccagccuggugacagagcaagacuccaucucaaaaaaaaaaaaaaggaaagaaagaaguuucuaaaacccuuuagggaggcaauuuggaaguagcuaucaaaauucaagauauguacacucuuccaucuagcaaucacauuguagaaauuuauucuauagaaauauccaaaacaagaaaaucuaagcagaggaaugguaacuacaguauuauuucaugucaguaaucugcaugucuaccaauaucuuccaauuuuuuauuuaaaaauauguaauuuauacaugccuugaaaauauuugguacaauguaaacaaaauugauaccaguaauuaucuuuugggaaugacaugagggaaauggugaaggaagauauucuauaccuuuuuauuauucgucuuuucuguaaaaaaaaaaccaaauuacuucuacaauuuaaaagauuuuuaaaauauguuacuuguuagagaacagaauuuaauuuagauggcuuaaaaagaggguauagccauuaaaguaggucuucacuccacuaaaagaauaugauuaauucuaaaagcuacuuaaaauucucauucuauuauuucaaaacauuuaaagacacuguugugaaaacaaaguuuuauuaaauuaaaaaaaguauaaaaagguuuuuguuuuuuugagacagagucuuacucugcuguugccuaggcuggagugugguggcgccaucucggcucauugcaaccucugccuaccagguucaagugguucuccuccuuuagccuccugagaaacugggaauacaggcccgcaccaccacacccagcuaauuuuuguauuuuuaguagagacgggguuuugccauguuggccaggcuggucuugaacucuuaaccucaggugauccacuugccuuggccucccaaagugcuggaauuacaggugugagccaccacaccuggccuaaaaagauuuuuaaguuuuaggaaaaugauauguucuauaagccagacuaauguccccaaacccaaguaucauucacuucacagugccuaggacguuccaggcccaguucuagaagcuauauaggcuauauauaauagugaaacaaacagaugugauuccugaccccaaggaguuuacagcugggcaggagagacugacauuaaaaaacagaaacacaaacauccaguuaaaaaguaagugcuauggcucggcaugguguggcucacaccugucaguacuuugggaggccaagguggaaugaucucuugaggccaagaguucaagaccagccugggcaacagagugaggcccaguaccuaaaaacaacaaaugccuguagucccaacuacucugaggggcugaggcaggagaaccgcuuaugccucagaguucaaggcuucaaugggcuaugacugcacuccagccugggugauggagcgaaaccccgucucuuaaaacaacaacaacaaacaaaaaaaguaagugcuaggaagagaaagauaaauaauaguguaaguguauauguauuuucagauaugaaggucaggaaaagccucucuaagaaaauaaauuacaaucugccaggcacaguagcucacaccuguaaucccagcacuuugggaggccaagguggguaaaucacguggucaggaguucgagaccagccgugccaagauggugaaacccugucucuacuaaaaauagaaaaauuagccaggcacuguggugggugccuauaaucccagcuacuugggaggcuaaggcagaagaauugcuugaaccugggaggcagagguugcacugagcugagauuacaccaauggacuguaaccugggugacagagcgagacuccgucucaaaaaaaaaaaaaaagaaaaauuacaaucuaagaaucaaaggacgaagaauuagcuuaguaaacauggaggaaagaacauuccaggaggaaggaguagcaugugugagauaccugagguuaaaaacgguaccagcugugcacagugguucacaccuauaaucccaggacuuugagaggcuggggcagguggaucacuugagccuaggaacugaagaacagcuugggcaacauggcgagaccccaucucuauaaaaaaagagccaggcguagugauguguaccuauauacucccagcuacucgggaggcuaaggugggaggauuguuugagcccaggaguuugaggcugugugagcuaugaucacgucacugcacuccagccugggugacagagugagacccugucuccaaaaaaacaaaaaaaaaaggacuuccuuccaaaucuuauaauucaaaugucuuaucuuuuuuaauuuuuugauuuguuccagauuguugguguuuccuucaggcugguuugaaacaccaucaaaaucacuuucaaagaauuaaaguuuuuuacacagucauuuuaaaagaaauaaguggcuagggagcgaaggaugcccaagaggauuuauucuaagcuuucaagacuauauaaguaagagaagaaaaagaauucaaguaaggaugcugcaauaauagagagggaguaucuauuauaaaauguacgugagcaaaacagauauaccugguaggcauucagagacagagacaaguuuaagacauuaaaauuaaguagggacagagauacccucuuuggguacuaauuccacugcuuugucagaaagagaaaacaucagagaaaaagaugacagugaguuagcucuccuuaauguucaauucaucuuaauuuuaaaauuaugauuuuguggguauauaccacuuuuuuacauuuuuaauugacuccacauaagaacaccuaaaaauuauguuaagaguagcuaaaauaaauuacauuauccuaaauauuccuuuacaaauuuuagccuaguacuuuuuuuuuuugagacagagucuugcucuguugccaggcuggaguacaguggcaugaucucggcucacuacaaccucugccucccagguucaagcgauucuccugccucagccucccaaguagcugguauuacaggcacgcgccaccacgccugguuguauuuuuaguagagaugggguuucaccauguuggccaggaggucucgaucucuugaccuugugauccgcccgccucggccucccaaagugcugggauuacagccgugagccaccacggccuucagccuauuacuuuuauuaaaacccaagacauucauuaagaugaguauacuacaggccaggugccguggcucacgccuguaaucccagaacuuugggaggccaagguggguggaucacuugaggucaggaguucaagaucagccuggccaacauggcgaaaccccgucucuacuaaaaauacacaaaaaaauuagcugaguguggugacgcacaccuguaauuccagcuaccuggggggcugaggcauaggaaucgcuugaacccgggaggcaagagguugcagugagccgagaucgugccacuguacuccagccugggugacagagacucugccucaaaaaaaaaagauuaguaauacacaucaaaucugucagaauuucaaagccuuaauaauauuacuuauauaaauuucaaaaacauagaguaaaaucauagucccuaaaagaacaaaaaacugaugucaacauuaaaguuggaaagaaaauuuuaaagguaauaaauugugcauuuuuauuuuacuuucugaaugacuuaaguuuguaaccuuaaaaauaaaaaaugugggccaagugcaguggcucacaccuguaauccaagcaguuugggaggccaagguggguggaucacccuaaggucagggguucgcgaccagccuggccaacauaaugaaaccccaucucuacuaaaaauacaaaaacuagccaggcgugguggcacaccccuguaaucccagcuacugaggaggcugaggcaggauaaucgcuugaauccuggaggcagagguugcagugagccgagacugcaccacugcacuccacccugggcaacagagugagauucugucucaaaaauaaacacauaaaaucaaauaaaaaauguguacaauaaagaacauuuugcauauaaagaguuucuaagaauuuuaaggccuaauacucugaggcuagagaaccaaaccugcuaccuuaguguucacgggacugauccagccacucugcuuuuuauaaggggauauggcaaacuaaggguuaaugagacucugccuuaguggauuagcccacugaagugcugauaggagaccagugacuguuugaauaauagggccuacgcucacaugccugaggcauuccaccugccaaggaggaagacaugcagaaacacagccacauauuucugauuuggugggaggaaaaacagcucaugcagauuuuuaaaauauacaauuucaguagugaucucaggucuccugcugccuagauguuuggacacauuuucauugcugagaagauauacuuagguuguuccaaauaacagccacucuucagaaggccaaacagcuuagaauuagggggaaauacuuacacaucaaguacuaagaaaaaaaguagcaggugaaaucuuaagguguuguguuuuuuuauuuguuuguuuuucagacagagucucauucugucacccaggcuggagugcaguggcaugaucuuggcucacugcaaucuccaccucccagguucaagcaauuccugugccucggccucccgaauaguugggauuacagguacccaccaccacgcccggcuaauuuuuaaauauuuuuaguagagaugggguuucaccauguuggccaggcuggucuugaacuccugaccuuaagugauccacccaccucagccucccaaagggcugguauuacagauugagccaccaugcccggacuuaaacauggaacucaacuauaugagauuuuguuugcucaaaaaagaaccuaugaaccuaugagugagcuuuuaaggaacaacaacaacaaaguaaaguaaaagaaaaaaucuauauaaaagcaaauccagcuccaggagauuuaaaucagacuuuuuucuccaggaauacauuuuucauuauguuucccugaggcaucugggggagggaagcuguccagugaagucaguggaugcuucuuugggcuuccuuuucacuucucaguucucuacaaugcuaaacaccaagggcugggaccccuauggacaaccaguaggcauaggguauugacuauuaaaacacuuaaaacaacuguccugaaggaagcacuguagauguuguucaaguuaaggaaaucuaauuuaaaaauauaugcaguugugaaacauuaauuuauacacaucucuagcuuagcaaaagcaugacauuaacgauaggcaagagcugugggagcucuggcuuugaaggucuguggucagaauggacuacaacuucuacaacugcccccgugugugauacaguuccaauuaaucaaaauucaauuaacaagaacuuaccucuuuacuucuuugaaggaagggaagaaagaaggggugagagggagagggagagagagagaggagagaggcagagaagaagggagagaagaaggaaggaauggaagggggaagggacgaggggguaggauggaaagggggaggaauggggcagagaggggagcagggagagggagggagaggaagagggggagaaggagacagggagagagggagagagagagagaacgaacaagaaaaaaaccuggauuuccccccaagacucgacuuucaggcaaugcuccuaguaauauuccaggcagucaaugccacuuucuccagcuauacuuuuggucaaguugauauuccuuuaucccaagcuauuguaagauccuaaacaaucaaauaguaaauuuugcucaucaugauucaauaaaagggaaaaugaauuaaaacccuuaaauuaaaaucuaaacaucugggccaggcgcaguggcucacgccuguaaucccggcacuuugagaggccaaggcagguggaucaccugaggucgggaguuugagaccagccugacuaacaugacccugucucuacuugaaaaaaaaaaaaaaauuagccaggcguggugguaugccuguaguccccagcuacucgggaggcugaggcaggagaauugcuugaacccuggaggcggagguugcggugagccaagauugcaccacugcacuccagcauggacaauaagagugaaacuccgucucaaaaacaauaaaauaaaauaaaaucuaaacauucuaauccugagcuauaauaguuaacugaagguuuaggugauauaaagaacuagguauagcagacaucuaacagagacagaacugguuuuagaaucucauugcaaaaugacuacuagaaacaucacugauuacucuuuaucucauuacccaguuuuauugucuucauagcaucuaaagcuaugagaacuuauguacacacauauacauauauguaugcauauguauguauauauguauauauacauauauguauauacauaccuauguauuauguauauaugcauauguauauguguguacauaaguuagcuuuagaugcuaugaagacuauguauauauacauauauaguauauaguauauauaguauauguauauguauauauguauauacacauguauauaguauauauaguauauguauauauguauauauauguauauauaaauauauauuguauauauguauauauguguauauauauauguauauguguguguauuuucuggcuccccucacuagaauauaagcauccugagagcaggcaucucuacuuuucauucauugucauaccuuuaagucuuagaucauugccuagcacacaguaggaggagcauuucaccaacauuuguuaaugaauaaauaagaaaacuauaaaaagugagaaaacauguugaaaugucacacugggacuugugagagucuagaagcauugugaccuuuacuccagaaaaacaucacaugugaguuguaugaaguaauagaagccagcuaccaaggaaaagaugaauagguaagaaguaaacauuucuuugaacagaaaauaaauuaacuuauucagguauaacacauauaaaagcagauagcugucauaaaaauaaauauaguuuucccaagucaaaguuuagaaaacauuugcaauuuauauuaugaacucuucauuuaagcuagaauuauguuacauacuuauuauauuauugcuaagcaaauucacgcugaaaucucagauauuaaaaaauucagcagcauauaucuuaaguuaccuauaaaggaugacuuuuauaaaaacucaccugaaguuuuaaucaauauuuauuaauacuaacucugauuuuaauaaaaagauuucuauuauuucagguuauuuuguagcaaacauuagcaaugaguguuaaaucuaagcucuacuggaaaaaguuggucuaaaauaaugaaaacccaauauaauuagcuaucuucucuuugccuuuccucuugauuuucaaaaaccaacagucuauuguaagcaaauaaaaauaaccgaggucaucaggacaaagaaacauaagcagaaagauucguuuuacauguuuuaaaaauauuucuuaacuaaucauguccauucauauauucaacaaauacucagcaccuauuauaauauucugagcacguugcuagugauuaaagaaguuaucagacagauucauauuuaaagagauaaaaaccaaaaagaucucuugaacuuccaguaaaugugaaauauaacaaaauuuuucaaaacgacuuuucaacuuacauuuuguuccucugguucuaauuuggggauuuugugugacuugcgcucuucagaucuugaugagucaugcuuguugcuuuuuuuccucuuuucuuuucugcuuucaugcuuugauuucgugugcucacuugccuguacuucauuuaaaaggucuccacaaagggaagacucaaacaauucccugccauucuggauaguuuugguuauuuuuaguuuaauuucaggugagccagucuucuuuggaaucacaguuugugguaccgaaggaggaggugguggcuguggaggggaagguuuuuccagaauuucauguggucuuguguuuggaauuucugaaugauaauagucaguggggcuaaaguuucuaacugcaccaaagccauuggcugacccauuaggauacugauuauaugacugguauuugguuugaguuucauacacacugauugaugauggauacccauuugugaguggaggaagaucuucuguuguagcuggguacugaaagccuugcugcaaaguagcuucauauggugucuggccaccaucuucagcaaugucacuguuguuaucaaaggcauccuccugacggauguuggcggagucaaugaguugaggugguugcugaauuguguuucccaugaucccuugcaugaaagagaaagagaaauccauuguucugcuccagcauccuuaacuuucccuuucucucaucgggccuaaaauuauaaaagaggggauuagaagguguuacuauucucauaggcuagaggcuaaucaacugaaaaaggauuaaacuaaaauguuuugaacucaauuuucauauccagauaugcauagacauuaaauauuucuaaaacagauaacugauauaauucugacacagggcaaauaccuuuuaucuucaaugcuuaucuguuugaaacuccugauuacuuucacaacaacuguggcaacaagauuuuaucaucaccaccaacacacgaaauaguuuugacauuccuuuuuauuucccaaguuagagaucgucucagguuaaaacugguguuugcaaaauaagcaguguccugacacauaucaaucugcuuccauaagagcuuccuuuaaaaucauucauauuuuguccagugguuguuuuuauuacaaaaauaauaaaauguuauugcauuuuuucuuuuuuuuugagacagaaucucacucugucacccaggcuugaauguagugguacaaucauggcucacuacagccucaaccucccaggcucaggugauccucccaucucagccuccccaguagcugggacucaggcaugcaccaccacgcccagcuaauuuuuguauuuuuuguagacaggguuucacuauguugcccaagcuggucuugaacucuugggcucaagcaauccaccugccucagccucccaaagugcuaggauuauaggcgucagccaccacgacuggccugcaaauauuuuaaacaccaaagugaaaaggccuguuccuguccccacuucauuauucccacucuucuaugccaagacaaccacuauaaacacuuugauggguauacuuucacaucuuucucuacauuuuuacauauaaauuuuuaaaauagggcuuauucugugacuugcuuauuuaacuuaacaauauauccuagauauacuucuacaucagcauguauagacaauuuucauacauauucauucuuuaaaugguugcauaguaaacaaacgugguauuuguauuuaaccauuuauguacugaucaucaguuucucacaauuguuugauauaauaaauacgucugcagaaaaccucguuuauuuuuuacuuauuuuucuuuucuuuucuuuacucuuuuuuucaaauagagacagggucuugcuauguugcccagguaggucucaaacuccuggacucaaguaauccuccugcuucagccucccaaagugcugagauuauaggcaugagucaccacgccuggccugaaacauucucuaaacucuguuuuugugcacauauauauuucuauaggacagauuugaaauuuugagauacuguaaaauuguucuauagguuauacuaugucaaugaacucucauaccaauagugugugcuucucuauaguugccaguaucuacuuauuuuuuuauuguaauuucuuucuuuauauauauauauauauauauauauauguauuuauuauacuuuaaguucuaggguacaugugcacaaugugcagguuuguuacauaugcauacaugugccauguuggugugcugcaccuauuaacucgucauuuacauuagguauaucuccuaaugcuaucccuccccccuuuccccaccccacaacaggccccagugugugacauuccccuuccuguguccaaguguucucacuguucaauucccaccuaugagugagaacauacaguguuugguuuuuuguccuugcaauaguuugcugagaaugaugguuuccagcuucauccaugucccuacaaaggacaugaacuuaucauuuuuuauggcugcauaguauuccaugguguauaugugccacauuuucuuaauccaaucuaucauuguuggacauucggguugguuccaagucuuugcuauugugaguacugccgcgauaaacauaugugugcgugugucuuuauagcagcaucauuuauauuccuuuggguauauacccaguaaugggaugccugggucaaaugguauuucuaguucuagaucccugaggaaucgccacacugucuuccacaaugguugaacuaguuugcagucccaccaacaguguaaaaguguuccuauuucuccacacccucuccagcaccuguuguuuccugacuuuuuaaugauugucauucuaacuggugugagaugauaucucauuguaguuuugauuugcauuugucugauggccagugaagaugagcauuuuuucgugugucuguuggcugcauaaaugucuucuuuugagacguaucuguucauauccuucgcccacuuuuugaugggguuguuuuuuucuuguaaauauguuugacuuuuuugccaguaucuacuuauuuuuaacaagugguauauauagcagaagcaucuggaguacuuuuacaaaauguacguggcagggucugccuccugaagauucuaauugaauaaaucuggggugggguccugggcauaaguuuuuuaagacuauauccccgguaacuuugaugcauauucuugguuagaucauugcauuauaaucuuucaauuauugcaccuccuccaguagguguccgaagaugccuacauuauguaauaacguuacaauauagauaaguaucuguuagaaaaugcuacaagaccacccugccuugucauaagguuugacacgugcacaucacagaauagaagauuaauggacaauccauauaauauuuugauaauccaacaaacauuucuucuagaaaguucuuuuuuuuuuuuuuuugagauggagucuugcucugucgcccagguuggaguacaguggugcaaucuuagcccacugcaagcgccgccucccagguucacgccauucuccugccucagccucccgaauagcugggacuacaggugcccgccaccaugcccagcuauuuuuuuuguauuuuuuuuuuaguagagacgggguuucaccguguuagccaggauggucucgaucuccugaccucgugauccgcccgccucagccugccaaagugcugggauuacaggugugagccaccaugccuggccucuucuagaaaguucuaaagcaggaaggacaaaccaguuuucacagcuauaucaacucugaugaacugauuguagcuuccuagaauacugugaagaaggauccugaggccgggcgccguggcucacaucuguaaucccagcacuuugggaggccgagguggguggaucacgaggucaggaguuugagaccagccuggccaauacagugaaaccccgucucugcuaaaaauacaaaaauuagcugggcaugcuggcaagugccuguaaucccagcuacuugggaggcugaggcaggagaauuguuugaacccaggaggcagagguugcagugagcagagaucgcaccauugcauuccagccugggcaacagagugagacuccgucucaaaaaaaaaaaaaaaauacuaugcagccauaaaaaaugaugaguucauguccuuuguagggacauggacgaagcuggaaaccaucauucucagcaaacuaucgcaaggacaaaaaaccaaacaccgcagguucucacucauaggcgggaauugaacaaugagaacacauggacacaggaaggggaacaucacacaccggggccuguugugggguggggggaguggggagggauagcauuaggagauauaccuaauguuaaaugaagaguuaaugggugcagcacaccaacauggcacauguauacauacguaacaaaccugcacauugugcacauguacccuaaaacuuaaaguauaauuaaaaaaaaaaaaggauccugaggcuacauuccaguucgacucuguuaauaacagaaucauuaacaaugccuauuauuaauagauuaauaauagacugauuaacagugucuaccaucuugguuccaguaggaucugcuguaauaauaaaacaaauaaccccaaacagcaaauggaagagggaaacaaagcugacaauacacuuuucaagguguauccaauuauacagccacuguuucuucugcuguuagcaaauggaaaugauuuuggaaguccuaaaauuacaaacaaaugaauaagacugcacacaagaaauugaacuguauguauugcuuuacauugguggggggugggagggauccagagcgcucucauuuucuuagugucaccucagugucaggcacuuuacacaucagcucauuuaauaaucacaacucugcaagauagggauugugauuucugguucauagguaaaagaaagugagcuucagaggggcuagguggccugcuuaaaccacaaagugggagaacuugaauuuggaucuaggcaugucugacucugaaguccauguuguuuuuguuuguuuguuuguuuguuuguuuugagauagggucucacucuguugcccaggcuggagugcagaaacacacaaucacagcucaccgcagccuugacuuccuggguucagaugauucucucaccucaggcucccaaguagcugggacuacaggcaugcgccacaccuggcuaauuuuuuguauuuuuuauagagauggaguuucacuauguugcccaggcugaucucgagcuccugauguccaugauuuuuacuacuguaucacuucuguuucccucagcuaucaguucugggaaaagaauucuuuuguucagguacuuuauuccuucgucacuaccaaaaucacaaauauucuaauaaccaccauuaacacuuacauagcacuuugcauaugccaggcaccauucuaagugcuugacauaaguacuacguuuaauccucccaacaacauucauguagcuauuaucuccuauuauacauagggaaauagaggcacagagaaguuaaaugacuugcucaagugcacauggcuaagauucaacccaagauucacccaggcuggagugcaguggcacgaucuuggcucacugcaaaaaaaccgcaguuccagggucugugcucuugauuagcauaccauauuuacugacaauguuuaacaacugaaacauuaccuuaauuuaacuuuuggcaaaaauguauagcucacagcaacagacauaagaaggaaauguuuaaaaauucuguuaacaagcauggaccaacuacacaggcagaauucaaaaguucucauuuauacuuccaacuugaaggcaagucaaauaaugacaucuaacaagaugcaaccuguguuuuugguucuuguaacuguuguauacaagaucagcuuccagauucgccucccaaauuauagucuucaggguuuuucaggcauauguauucagagacugagauuucugaugcuuuugauugaguuucaaacacaaaaaguuuuauauuuuccccuuuuccugucuucucuagcccuaacuccaaauauuucauuuuagucugaacuaagaaaauaacauuaccuucuuauaauuacacaggaguccauggagugaacacauauacauuuguaucacagaguguuuucauauacauuuguauuugauccucaaaacaacucugucagacugacagggcaaggugugcauuaacuucauuuuuuagguaaccacauagaacacuucaaauacugacuuuccaagaccacaaagcuaauuagugauaaagcuugaaaaauaaucagucuccugauuucuaauccugugcucuuuuucacaacauccuaccgccagagaauaaccaacuacuuaaggacaacuacacuaaacgcuaaaggucauuaguccaaaacugaaugcacuguccuuuuccuagugcaaugucccuuucagacuaccccagucugucauugcuuccaccacuuuucuagcuucccagacuagaaaucucaggcucacaggugauugauucuucccucuuuguuaagccauaaaaccagucauuuagcaaaucucgcauuuucuuccuuugaaguauucuucccagugcuuagaccgaaucuaaagugaggaaauaaucagacaaauccaaaaugggggauauucucccagacaacuggccugggcucuucaaagaggcuaaugucuaaaacaaaugaaagguggaaagacuauucuagauuaaaagagacaagauuuaucaaccuaauacaaugcaugaacuuugauuaaauccuggauuuaaauacacacaaacacaaagauuaaacagauauuguggagacaacuaaagaauuuuaaaauaugaacuggcuuuaaacaauggagcuauuaauuucaagguucugauaaugcuauucuguuuauauacgagaauguucucauucuuaggagagcuaugcugaaauaugugauaaagugucaugguaucuacaacuuucaaaugguugaggauuuuaaaaaagguauauauaccuagaguaaagcaaaugagacaaaauuuuaacaacuggcgaaucuagguguugaauguaauauucuuuuaacuuuucuaaagguuugaaaauuuuuaaacugaaaaguucggggaaaaaaaaaacaaaugauuuggcuaguguuuggaagaaguacuaaaaauaaaaagcuacagguaccuaaagugguauaagccuccauuaaauucuggugccauguucuaagcaaacaagcuaaaggggccacauuguuauauuuucuagaaaccguaagcauuaagagggccauacuucuucauauuaugccuccaaauaauacaacaaugcaaucaagaaagcaguuuugguaguucauaaaaacagauauuuugggacuacauguaaauuucuuuacauagugauuuuuaugggcagcggagucuggcggccagccuucacgcagcagacacaccaacugauaaaaugguuaagaccuuacuagauuagggggcucuacugagcacugugcuugagagugcagguucagaaucaaacuaaguucaaaagcauacuucaaguccugcuggcugugugacuucaggcaacuuauucagcaucucuaauccucaguuuccuuagccagaaauuguggauaccugcaauuguguaccuuguacagggcugccguaagaauuaagaguuaauccaugaacagcacuuaagacagugccuggcauacaguuagagccuggccacuuguuggcuauuauuaucauucauugcaaugcugggcauacagaacugcuaaaaaguuaaaaaaaaaaaaaaaucacugaccuaaagguacuuucaaucucuuuagcaagauaauguaagauuuugugaguaagacacauaaaauaguagcaaacaaugugaaacagaagaugacuaagaauugaauuguguuacuacuacaauuauaacagacaucuaaggagaagaaaaaugcugggcaaggaggcauuuaggccaugagaaacaaguaggauguggaaguaagguguucuucacacauugcuuuucaaauuacuugguacaggccaucagaaauucuuaaaccuuuguccuaaauaaaucccugauaaagauaauguguucaauuuauuuuuaaagcaauaauuuuaauggcuaacauuugagagcuuagugucaauacuauucuaaacauuuuacauuuguuauauuauuuuacuucacagaacaccccuuugaggaaauacuauuacuaucccauuuuacaaaugaaaaaucaaggccaguaugaucaaauaacuugccauagucugagaucaaguaaauggaggguucaaacacacacucuguuccacagcauuggcucuuaacaaguaagcuuacuucccacaaucccuaaauauguaaacaacaacagaaccucacuucacccuucuccacucccacuccccagaguuaacuaacaauuuggugggagacuaaauaauuguacuaaucuauccauucuaauauguacuuucaaguaaaugaaaucaccacacaaaaacauuucugauaaauucauccucugaacaauguuucuaggcuaauuuuuuaaaaaagauaaaucaaucaaugaauacuucuaauuuugcugaaacuauacaguuuuaaauaagcaaaaaaaaguugaaaauuaucaaucaaagcuuuagugcucuuauuauuuaccaacuuauucaugguggugggggauggugggcugauaauagaaaaguuuauagaauccuuaagccaaaucacagauacagaguugaaaaaaacaaaaacaggaaaagaaaucaagccaggcaugguggcucaugccugcaaucccagcuccuuaggaggcugaaguagagggccuguuugaggccaggcauucaagaccagccugggugacacaguaaaacucuuucucuaaaauaaaaaaaagagcaagagggagaaagaaagaaaucauguuacguguuucagaugaacaacuugagccuauaaauaucaauuaaguauucauaaugugcuaaauuuauaguuuaagucacuauaacaaauucauaaacaauuauuucuguggaauguauugcuagauucuacucuauagaauuacauguugugcuguauauauucuuuuuuucuauguuuaaaaugccagucucuucucaauaauagaaacuuuauauuuaauuauacuuaaaaauuccuuaggcugggagcaguggcuuaugcuuguaaucccagcacuuugggagggugagguggguagaucaacugagaucaggaguuugagaccagccuggcuaauauggcgaaaccccgucucuacuaaaaauacaaaaauuagccaggcauggugguacacgccgguaaucccagcuacuugggaaggugaggcaggagaauugcuugaaucugggaggcggagguugcagugagccaagaucacaccacugcacuccagccugggugacaaagcaagacaccaucucaaaaaaaaaaaaaaaaaaaaaaaaaaaauccuuacauugauaucauuauuuaagcauuuuggaauuagaagugguuuuaagaugucauauaaauugucuauuucuguuuucagacacagcuacucuacaaauacauuccuagguuaaucuguaaaucaaaccacaacacucuauugauuaaaauccuucaaugguuucccauugcccagaaaaaggccaagcacuuagacugacagaucauauaaggcccuccaagcaaggucgcuaaccuaccucuucaaccucaagucauuuuuguacucuaguaauauaaaaucacuggaaauuucucugcacaccaugauuucacuccucugugccuuuacuaauauuauauccuauccauaauauacccuuuuccuuuuuuauuuuuuuugcuugacucuuaaccaucuuuugagcucagaaugucauuuccaagaaguagucacuuaagcucuaaguuagucugaguaacuuuccucuguguucuaagauauucuaugcgugccucucagaauuaaccauaaaaugaucuguuuaugugaguuuucuuaagagcaggaaguaauguuauucccauauaugcucuuggaaccuaacucaaaggcucagaggaggggcuucaaugaaucuuuuaaacuaaacuacauaaacuuaaagaaguuauuuuauauaaaugaaaugcuucacagagcugcugugggucuuugcauggagguaguaacagaauauaaaagcaguuacagucuccucagguaauauccuugguaaaaugagacuaacaacuuagcucacuuagaugucacugagauucucuuuaguucuagacuuaacuuucaugaagguuuaaaguuccaagagacuggaaugaagucaaauaaacuuccagagggaguguuaacccaaccaaagaccaaaauauauuaaaaaaagaaacucauauguauauauauauuuaaaaccuuauuaauguaggucugaaauucagaauguagaagcucucaaaauacaauugucauaguuguaguuaacugaaucagcaugaaaaucaaucuauuuuccaaaguuguucuaguaaacauaaucaaucauacuauaaaacaaaguauacuugauagauguacaugagaauuuuuacagcuagaaaaaaaugguggaauauaauaugauuuucacaacacagaggaagacgguggucuuccuucaccccaggauaaacaagggauccagauguuucuuuauaugaacuguugcaaggaauauuucucaagguuuaugauaaauccacacucaauguguuuccauaguaacaggaauggaguacaugcagacagucuacaguaaugaaccagcuaugcugguucuugaaaaccuagcauguuuggcaauuuaugcagcaaaaacauuauuuaaaaaaauuuuuuuuaagauacauaauguuaaaaaacuagagggucauuuuguuuuaaacgcaguacauaaagacaagcuuaagcauagauucugugaaguauaaagagaaagcuaucaaauauauucauauacuaauuucuaacugaaugaucacuuaauguuucagugauccuguauuuggauccugucuuugaaaucaauuuaauauguacauacacgcaaagccccccuaaaaacaucuucugaaugugacucacauuugaucacagaauauaaagaucuccgggugacagcaucaagggagauucucguuuuacaauuuuuccccaaauugacaccaagaaguaaauggggggaaaggaacaguuaauuuuuuuuuuaauaugcuccauuauuuucaguauauggguuugguagggugaaaccagaaacucuacaaagaaaaaaugcguaacuauagaagaugcuaaaauccucuaaugucaguuuuuaaaaaagacuccauucuuucugguucuguguucuacuaauauuuuaaucuaaauauaugaucagaguaacccuuugacuauaaguuauaaauucugguauugcccauuuagguuuucauaauuaaaaaauuuuuaguaauacaguaacaaauguguauuguuuaaaaauaauggagguaaguuuuuaaugcuauuuauugugaaacugcaagccccucaucccuuuuugaaguaguacauacauauuuuuaaaggacccaaacacauaccuuuagaaaucagcaaaaccaaacugcuaugaaguaugaacagaagcaaaagucaauuucuacccuaaggacagggcacaaauuacacuaaaaaucaauauucuuccuuugaaagccaugaguccuuucuaaucacauuuuaacuucacccucaccccacacauacacaagaaaaagcagagauguggguguggacuucuggaggaaacaaaaaguaaaaaccaaccaccugguucuaagaacuugaccacgccccuaugguaccaaaaaggaaaugaacaaaaauguuugucuuuuauucacugaaagcagcuagaaucgauaggaucuaaucuagcccucacuacagacaaaagcaauaaccaaauuugguacagugacuauacaacucaauguuaacuuucaaacaaaacggauccugcuugaaaauguuuugucaaggaaauaaaaaugaaauuacaaaugcaagugauuguucuauuugucuuuagauuauuuuauccuuugagggaacaaacaccaucuauaaaauagaucucacuauuucauccacaaacaaaauacagugcuuuuaguggcauccaaguguuauacaguuggcaguuacaguuauccaaaaaguuugaaccacgauaguacaaaugcaaauuauuucucacuaaaaugugggcauuuccucucaaacaauuuuuuuuuuuuuuuugagacggucucacuauaucacugaggcuggagugcaguggugcaaucacagcucauggcagccucaacuuccugggcucaggugauucucccaccucagccucccaaguagcugggacuaugggcgugcaccaccaugccuggcuaauuuuuaaaauuuguuguagagacaggguuuugccauguugcccaggcuggucuugaacucuuggacucaagcaauccucccacuuuggcugggauuacagccaugagccacugugccaguccaaauaauuucuuaaauucccaugguaaugcauauacuuggacuucucagauucaaaggccauuauauauuaauuguauaagcacuuaacacauuuuuaguucuccuauagcuuuuuuaaugaaaacuugaggaugucaaaauuaugagguuugaaaagacugcuggucaaacucugaaucauuuaaagagguuuacuaccauucugguugaggcugacucuuucaaaguuuaaggcuaugauuuaggggaaaacauuuuccuguacuacuuuucagcaguuauacuaauaaaacaucaauucuccaaaugacaaaaagggcuuacagcauuuuaguauguaaaacaaauguucuauauuaguaaaccuuaucuguauaucuugacuuaaagguacuuuccaugguagccuuuuagaaagaacucuaagcugcugacuaauuucuggguuaaacuggaaaaucugcuugcuuaaaaaaaaaauuugggaaaaauacauucccuuuauauuuucauguaauuuuacucacuuuccuccaagacgugaagcaaauuaugccauuuuuguauaauuacuaacaacaugcauccaaaacaaaguagucuagcuccaucuauauauaauaaacucaagauguaucaacagaaguuacccuuccagaacaggacuuguuauaugacauuuaguuauuaaauaacgaagcaaaagcauaagaaggaccacucuuuucaauaaaugaaggagaaauaauuuuuuuuuugagacagagucucacucugucacccaggcugcagugcagcggcacaaucuuggcucacugcaaccuccgccucccgaguagcugggauuacaggcacgcgccaccaagcccagcuaauuuuuguauuauuaguagagacgggguuucaccauguuggccaggcuggucucaaacuccugacuucaagugauccacccaccuuggccucccaaagugcugggauuacaguugugagccaccacgcccagccuaauuuugcuauuuuuagcacagacaggguuucaccguguuggccagacuggucuccaacuccuggccucaagcaagccgccugccuuggccucccaaagugcuaggcuuauaggcacugcucccggccagaaauaaauuauguuugauacuugaacaauaaaaacaaaagacagaaaggggccgggcgcgguggcucacaccuguaaucccagcacuuugggaggccgaggcgggcggaucacgaggucaggagaucgagaccauccuggcuaacacggugaaaccccgucucuacuaaaaauacaaaaaguuagccaggcgugguggcgugcgccuguagucccagcuauucaggaggcugaggcaggagaauggagugaaccugggaggcggagcuugcagugagccaagaucgcgccacugcgcuccagccugggcuacagagcgagacuccgucucaaaaaaaaaaaaaaaaaaaaaaaaagacagaaagggacaaguguccuggaugacaaaggaaaauauccaggguugagaagcugggggugugacgacggggagagaggaugcaggggaccucaggcauuuuuggcuuaggaaacaaguucuaaccuguaguggaagagagaggagcuccuuuccaaagaccuauuauaaaccaguaccuaaagacuuccauugagaaccuucuuggcuucuuaauaucacagguuucaaaugaucuagauuuuuagaagggcuuuucuucauauguugcaaaaccaaauuauaaguauuuaaugaaagcacacuauaaaauuccaggaaauaaaaacaacuuagaugccagagaauauggacagacugaaaguuacaggacaugaaacuaguucauccuugaauucccagagccaacuauagugccuggcacauuaucaauaaacaaaucaauccaaaacagaauagaguauuacaguaaggcgggggggggggggggggcacaagauuggauuaacaauuuaaaaagcuuaauaugugcuaauaccauuaagcaguauuauugaaauaucacaggcuguuuuuuaauggcauggauuuugaacugagaguacagauuugcuucuuccuuccuaagaaagaccucauaaauguaacgucacucagaggaaaacagaaaaaaaauuugccccaauuauuuuuaaacuuuuuaaaaaguuuaguauguaauuuuuuaauuuuagcaaguaaucuuuucauuggaaaauuaaaauuagauauuuuauuaagugcucaaaauacgaguguaaguacaucauccaaaagagucacgacuugucaagaauuuuuuuccaagaaacuuuaaacauuuacauaaccacauuaaauaugcucuaccaugaaucuaauaauaauucuacaagcauauauaaacaauugacaacauauugugauucauauuuuccuaaacagugggauauuaugacacgaagcucugucuuuuguaucaguauacaaaaccuacauucacuaugaacagcguaagagaaacugucacaacaucaucacuguagaacauaacacaugaugagaaucugaaacucuaaaaaaagacuuccuuuuuuguaucauuuauagacuaauacaaaaccugugcucaacauaaaaucaauuuauuuuggaaugucacgagauauuuaggugucuuugaguaacuucagugcucagagaauugccaaaugugcgcugauaacugaaguucagauuuaucuuuaguuuccaaaguaaagugugguagugccuucagucauggaaagaaaaacaaaacaaaacuacuuccguguuaacgaagguacugcguacuucuacaucuugcucacugcuguauccccauccccuaguaugugagggaagaaagcugcuaaaugaacauaggaauggcagcaaacacaaugcugcaauggagagauuauccuauacuauucagguggacccaacauaaucacaaggauccuuaucauccuuuuggugggaaggaucagagucagagagagauuugaagacugcugacuuugaaaauggaggaagagggccgggcaugguggcuuaugccuguaaucccagcacuuugggaggcagaggcgggggcucacuugaggucaggacuucgagagcagccuggccaacauggugagacucuugucugcuaaaaauacaaaaacuagcugggcaugguggugcgugccuguagucccagcuacucuggaggcugaggcaggagaaucacuugaaccugagaggcagagguugccaugagcugagauugcaccugcacucuagccuggguaacagagugagacuccgucucaaaaaaaaaaaaaaaaaaaaaaaagggaaggaaacagcuagauaaaucaagguaacaguuucucuccuagagccuccagaaggaacgcaccucugccgcugacaccuugauuuuagucccaugucagacaucaagaaauguaaaagaauaaaucugugucguuuuaagccauuaaguuuguuguaauuuguuacagcagcaacaaggguuuuucugaaagccuuuccacucacuugguugucuucaguuucaggagcaucccuauaaacagaaggaggggaauccuuagauucauuaaccuaagauuugguguacccaaaauagaaauaucacuuaaaaaagaagucuuaggcuaggcgcgguggcucaugccuguaaucccagcacuuugcgaguccaagguggguggaucacuuugaggucaggaguucgaggucagccuggccaaccuggugaaaccccgugucuacuaaaaauacaaaaaaaaauuagccaggcauggugaugcgcgucuguagucccagcuacucagggggcugaggugggacgaucgcuugaaccugggagguggagguugcagugagccaagaucgugccacugcacuccagccugggugacagagcaagacuccgucucaaacaacaacaacaacaacaacaacaacaacaacaacagaagucuugccccauuacaacauaaauaguuuuaucuauagauacaggcaugaugaugugaccuacaauuugucccuggacaaccaggaaaagccauuagauuuuaauugcugguaggguguuacugucaucucucacauaagcagaagaaauggaaagaauuucucccauuucauuggcacagcugccgcagcuuucuauacucuggaguuuacucucauucuagggguagaccugauacaaauaacaaaauggcagucaagccacuacuaugcaugacauaauaaaaugcuauggguccuuuuacuacuaaaacaccuauuuaagauuuuccauuucugacaaccaaaaucucugggccacauugaauuuuguggcugauuuucauaaaaauauauagggagaaagaaaacuuguaguaauaaagacagcacuauaguaagaaucauuuuuuaaagucuuguuaauuuaaacauauaauagucacaguuuuaagaaaagccccucauagccaucacaaagaauuauauuaauccaacaauuuuucuaaagaguaaucacuagguggaaauuuauuuuguaaagauaaauaaugugcaaguuuccuaaauaaacagacuuucauucacauuuuaaaacacuacucaagaacaggcauuugaguaaaucccauaaccucuguuuucccaaauaaaugagacugacuagucaaaaacugaccacggaaauauuuucucauguuuguuucccuuuuccagcuccaugaggcagauagaauuuauuuaguauauauuguaugucuggacaaaaguuuuguuuuuaauugaguucgcagagaaacauuucuauacaaaauuaaacuaaccagcuugaaucacccacaccaacacugccaagauaagcaaaagcugagucucaccuugccuauucccagacuccaagugccauguuauauaucuuucuccuuguagagucuuauuuuuguuuuugucugugaugugguucacuacugaacacuaacuauguaccagacccuguucuagaucuugggaaauccaaagaaauaagauucuagucucauggagcuaaaauaaacauggaaauuucagauagugauaugcuacuauaaaacaggguaauacaauacagggacggggggcuggauucuuuucuuugaagacggagucucgcucugucacccaagcuggaguacacuagcacgaucucagcucacugcaaccucugccucccagguucaagcgauucuccugccucagccaccagaguagcugcaauuacaggugcccgccaucaugccuggcuaauuuuuguauuuuuaguagagacgggguuuccgcauguuggccaggcuggucucgaacuccugaccucaagugcuggcauuacaggugugagccaccgcacccggcuuagauucuuauuaaaaaacuaaugaaaccaaaaccaggaaucagucauauagagaggcuggaaaaagacaaggaaaaagaugaucaucagguacuuuuauuuccuuugacguucacucuguuucagaggcuucugaguuauggcuauaguaaaaagauuuaaauuacgguuuacucaaguauuccauguaguauaaaguuuaaaucuuaaauguuauguaaacauaacugauccaaaauauacugaaauggaacucucgggaggcugaggcaugagaaucauuugaaccugggaggcgaagguugcagugggccaagaucgcaccucugcacgccagucugggugauagugugagacucugucucaaaaaaaaaaaaaaaaaaaaaagcugaaaugaaggcaaugcauucuguauuuaaaucauuuuguuggucggcaaucuauagucugcuaguaauugcacugauuaaaagacuuuuaaaauauuccagcuuucaaacaacuauuacugauaaguuauaguuaucuuucuuugccaugaagaauuuauuuaccaucuaacguagcaaacacacuggaaaaaugagauuuuaaacaucuagcccacaaaaacacacaaauauaguaaucacaaggcaaagaauguacaauuauguucacaucuacuuaauucuuuuuuuuuuuuuuuugagauagagucucugucgucgccaggcuggagugcaaugguaugaucucagcucacugcaaccuuugccuccuggguucaagcaauucucugccucagccucgugaguagcugggacuacaggcgcccgccaccacaccuggcuaauuuuugaauuuuuaguagagacgggguuucaccauguuggccaggauggucuugaucucuugaccucaugaucugcccaccucggccucccaaagugcugggauuacaggugugagccaacgugcccagccuauaucuacuuaauucuuucccuucacuaagaauagcuaauucugggcuaaccacacguagcuauuuaaauuuaaacaaguuaaaauuaaauuacauuaaaaauuuaguuccucaguuacaauggccauauuucaagcauucaacaucaacauguggcuaagguuaccauauuggucagugcagauacagaauauuucugucaucauagaaaauucuauuagacagugcugaucuacauuauuuuucaaauuuuaccuuaacaaaaacauccuuuaaaagcuuauauuaaauaagaauuauaaauuuuuaaagaaaucuguuaauauuacugugaugcuagaaagaagucacauaagaggaaguucagcaaauagaucucuaugccagaguaagacaaacucauauaccuagggacaagcaaaauguccacagaguagaaggauguacucuaacauuggucuuagagucauaagacuugaauuuuaguucugcuucuaccccuaacuuagcugcauaaauuccgaggacagacaguaucuuuggguuuucauuuaacaucauaagaaagguuggaucaggugauccacauauauaaaaugaccacgaaaaaugggaaaaugagcugugauuccuccuauuaucaauacauaaguguagggcuugaguuuucauucugaaaagaauauauauauauaugugguuaaaauacuaacuuuuggccaggugugguggcucaugccuauaaucccagcacuuugggaggccgaggcaggcagaucacuugaggucagcaguucaagacaagccuggccaacauggugaaaccuugucucuaccaaaaauacaaaaauuaguugggugugguggugcaugccuguggucccagcuacuagggaggcugaggcaggagaaucacuugaacccgggagguggagguugcggugagcugagauugugccacugcacuccagccugggugacagagugagacucugucucaaaaaaauaaauaaauaaaaaacuaacuuuaaaucucaucuaucaccuuaacauuauuuaagaugaccauuauuuguaauaucaaacaauuauaugaaauucacaaccaauacaguuagugacauagauaggauuuuagggaguaaaaucagcauggccacgauucucuuuacaaaauccuaguaaggaaucaagguguguuagagaaguuguauguuuucucuuaacuuuuuuuaaacuuuucugaguuuaaacuauuaauaaagcaaaauaucuuuuuuuuuugagacagagauuugcucuuguugcccagguuggagugcccuggcacaaucucggcucacugcaaccucugccuccaggguucaagugauucuccugccucagcuucccaaguagcugggauuacaggcaugcaccaucacacccagcuaaaggggguuacaccauguuagucaggccggucucgaacuccugaccucaggugauccacucgccuuggccucccaaaguguugggauuacaggugugagccacugcaccaggcagcaaauuaucuguaaagaauaacugugcuacuccauaaucuguuuaacuuuagcguugucaccucaaauauuuucugaaauguguucacuuuaaauuuuccacuaaaaauuuagagaaagauguuuagagaaggaugaugauuaaagacauuaaaauauccugaauuaggaaguaaccugcgugaaguagaacuuaguuaacaaaauacaaaaaagaaaacaacaacaacaaaaaaguguuucauuuaaccauaaauccugucacuaaauucaaucauacaguuuucacuugacuaugauuccauuaaguuauacaacauuuuagguggcuuuguaguucauauuuuuuuccugacuaaaccacauuacuauugaacugccuuuuaccaauacaaagcuuacuaguaaaacacccuguuucccuuaucuaucuaguuuaaccucaacugucuucgcuuuguugcugaccacacccagcaacaacagacaugguauuaccacuugaaggaaauuacauuauuuuccaauccuuuacagcaaggguaguugcucacaaugaaaauuacuacaaacaacuuucaucagucaucuuguuccauucacuaugaaaucuaguaaacuaacaaguucauccacauauuuucuuaccuauuuccuggacaaacuuuuaaauuaugguaaaaugguuugagauugguucuuaaaauuuugcaagcauucaaauuuacuuucuuuuagcuuguauccuccauucccccaaaaaaggcaaaagagaauguaugccaaagaugauauguaguuuuuaaggcacuaagcaauuuauuauaucuaaauaauaauuuacuaaguuuaucuuuucuauaaagaccaguuuggguuuuguuuuuuuuguuuaucgcuuuaguauuuuagguucaacauguaguauuuuaguauucaacauguaguuuucaaaauaaguaauaaaaguuagaaaauucagaauuucauacuauauauccaaauuucacaucaccuguuuguuuaaucagaacaccaagcuuuagugaagcuuuagccaucaugaguuguaauaaaacaguggaaguaaaauuggacuggaaaguuaacuucauguucaaacuugaaccagcaugaauucucucaacaauuaagaaaaacucauauaaccuaggcaaagauucucuucagguauuaguugauguucaacuuuuaacuucuaugaaagugaguuuagccaauugaguucaguucuucuuccauuaaacaugugacuaaagacuaguucauuuuguguacacuauuuuucuucuauuaaaaaaguuauucauuaucaacuaugugucugguacaguucuacgcacacucuaguacuucuaauuugaaucccuguaacuccaagaauaauuuucauuugcacuuuuagagauaagaacacugaucuucagugguaaagugaaguggggauaggaacucagaucuccuugacucuugcccuauacuucacugcccucccaguuuuguuuuuuguuuuuguuuuuguuuuuguuuuugagacagagucucgcucuguugcccaggcuggagugcaguggcacgaucucagcucacugcaaccucugccuucuggguucaagcgacucuccugccucagccuccugaguagcugggacuacacgcgugcaccacaacacuggcuaauuuuuguauuuuuaguagacaugggguuucaccauguugaccaggcuggucucaaacuccugaccucaagugauccacccaccucggccucccaaagugcugggauuacaggugugagccaccacgcccagccagcccacccaguuuuuaaaaaauguuuuguuaaacggcuuaagcgaacauaacaaaagaacaacuuucggggggaaggucaauuagaacaaagcaaaccucucuuaaaagaaaaccauauuuucuauaaggugauaaguuugcuacaguuaacuguauagguaaaacauacuuuccacagauguuuucuaaaauaaaguguuucuaaaucaaauuugaauuuuuuaaaaaaauuuuaaaccauacacaauacucucucaauaaagacauucugacuguccaggagaauuuuuuuuuuuuuuuuuugagacagagucucgcucugucgcccaggcucaggagaauaauuuuauaauucaaaaaaauauaccucauauuuuguuuaaucagcuuaagcuuaauaugucagguuuucuuaaaaugggacguaggagcaucaucuucucaugaaggacuuucuaaaaucucucucaaaugcauauaaaguauauaucacacaagcuguuguguuccuguauacuguacuacuuuaaauguuaugaauaaaugcuguuuuuaaaacaaaacuuuauaauauugcuggguuuaaacugguucaaaccuuucuggaaauguucuaaaauugauuguggugaugguuauauaaccccgucaacauacuaaaagccacugcauuguauacuuuaaauggauaaauuuuggguaugugaauuauaucucaauaaaacuauuauuuuaaaaaaucuuucaagagaacaguuuggaaauauguaucaaaagcuuucaaaauguuuauaucuuuuaaguaauucuacuucuaggaauuuauuguaaugaaauaaucagccauauaauuuuuuuuaauguauaaggauguccaucaacuuacaauaucccaaaauugcaaacugccuaaaagaccuucaacacagaaugguaaacagauaauagcacaccuguacacugaaauucuauauugauuuuuuaaaucacaaacauuuauuucauaauauauuaaauaauaaaacauauuacaaaauaauauggaugcacaauuccaacuauguaaaaaaaauacauaugaaaaaauauuggaaggauauagaacaaaauauuaauaguaguuacuucuaacuaguagaauuuuagauaauuuuaauugucuuuauaccuucugguuuucaauuucucuguauaaacaauccuuacauaaauguuauuuuaaaacuagucacuuuggagaaguucaaguuuuccauuaaaaaauaaaaaccaacaggugguaaugacauagaaaccaugaggugaauaaaagcauauuaacucuacugcauacacaaagccacauuaccuaauuuaucuuucuaaaaauaucaaauuaugauuacuuccacaucuaggaaaacucaacauacacguucaagauuuaaaaucgcuaucgcccaugcaggggaaaaauuagcaagaaauauauuuaaccuucagugggaguaaaaaagaauaacaugcuauugcacuacagaaaagaauucaaggauacaauaaaacaaagcaagaaguuucucaccacaaucuaauaugaaauacuauauucugaugcauuugaaucuugcagagaucauacaaaaggagaccacuuagagugacaaaauuauaauaaccaaauaaaggcuuuaauuuauaaaaaugccuuucucaaaguucacauggcagaguuguacgcaaauagaccguauucagcagguacucagugggaaaaaagcauucaaauuuuucugcuauccuaauccucaaaaaucaacacuuaaccuuuccaaauaccuaagaaaauauucuugaaggccaggaaagcauaaugcaguuucuccagcuucaaaagaaauuugguucucuugcccaaauuacagaaaaguuaaaacucaagaaguaccaaggaugaagggucaaacauagauugucaucacugauuacuucucagguuaauacuuuuugaaugguuccaauacugcaaaagcaggagugucaaacucauuuuuguuaauuaagauaguuaagcuaagaaauuaacaauauagacaaaucgacauuuucuaaguaagucauuuuagaguuugcauguuaauuuaaaaccuaaucacugaaucuuaccaaaaagugcaacagagaugaacucuaaacaaacaacauuuuguauaaaauggcacuuucuuacaggauucaguauuauuuuuuguuauucaucgguaagguacuaagauuucaaaucacuaaacacugacaauaaauguuagaaagcuaccuuaaaaauauuguucagagaccccuucuggcaauaacaauuaaaaacugguuauucaguuuuuauauucguugaacucgcaugcuuaugaauucuucagguucuuuuuuuuuuuuuuuuugagacacaguuucgcucuuucgcccaggcuggcgugugaggugacguaaucucggcucauugcaaccuccgccucccggguucaagcgauucuccuggcucagccuccugaguagcugguauuacaggcgccugccaccacgccuggcuaauuuuuguaguuuuaguagagacggguuucgccauguuggccaggcuggucuccaacuccuccccucaggugcuccgcccgccucggccucccaaagugcugggauuacaggcaugagccacugcgcccggccgcagguucuuacuauuauuaaaaaaaaaaaaaaaaccaccagccgggcgcggcgguucacgccuggccaauauagcgaaacccagucucuacuaaaacuacaaaaauuagccggguguggugaugggcaccuguagucgagcuacucggaaggcugacgcaggcgaaucgcuugaacccgggacgcggagguugcagugagccgagauugcgccacuggaccuccagccugggcaacacagcgagacuccucucaaaaaaaaaaaaaagaaagaaagaaaaaaagaaaaaagaaaaaccaaggacaucaauacauuuuugucccuaaaguccaacuaccaccaaagcaauaccagcuaaaccaaugagguugucucugcagcuuuucuuaaaggacuuauuaccugggugauaguuacccgauguucacuucuuuuuuuuuuugagauggagagucuugcuuugucgcucaggcuggagugcaguggcgcaaucuuggcucucuacaaccuacgccucccuuguucaagucauucuccugccucagccucccgaguagcugggauuacaggcgugugccaccacgccuaauuuuuguauuuucacuuccuaauuauuuguuuauacuguacauucaaguuuuauaugcuuuuuuuuauauuucacauuucauaacguaaaaggcuuuaaaaugccuauuucuuaaaguuuuuguuuguuuuuuacauauagcuuucuuaagccuccacagcuaagagaaauuagauaacauaagauucaauagacacaauauugucuuggcuauggcccaaaugccacuaggaguaucuccauaugaucuucuuaaucucaaaucaauuugauaaacuaauuuuuuuaaccuaugaaaucccaauaagcuacccauucuuaaauuuaaaacgccucccuauaaggaucacuugaggccaaguguucaaggccagccaggcaacaaagugagacuccaucucuacaaaaaaauuuuaaaaaauagcuagggggaccagcacaguggcucaugccuauaaucccaacacuuugggaggacgaggugggaggauugguugagcccaggagcucaagaccagccugggcaacuuggcaaaacucugucucuacaaaaaaaaaaaaaaaaaaaaaaaaagcaaaacuagcugggugugguggcacacgccuguagucccagcuacucaggaggcugaggugggaggaucaccugagccugggaaguugaggcugcagugagccaugacugugccacugcacuccagccuaggugguagaggaagacccugucucaaaaaaaaaaaaauuaguugggcaggguggcacauguguguagucauagcuacuccagaggaugaggcuaggagaacugcuugauccaaggaguucaagacugcaaugaucuaggaucaugccacuacacuccagccugggcaagagagcaagacccugucucuaaaaauaaaaaaaauaaauaaaucuauauaucuuaggaaauauguauauaacuuacaccaaaauaagaaaaagcacaccuauguagaaaaauacuuguuacuuaauauuuaauuaucuauuagaauguggguaauauaagcuaugaagaaaaaucaggacacacacagucuuaauuuguuuuaaguaaucauacagagcccggcgcaguggcaccugccuguagucccagcuacuagagaagcugagacaugaagacugcuugagcccaagaguuucaguccagcagaggcaacagagccagacccugucucacaaaaaaagagaaaagauuaauuauacggaaaucugaaaauuuuauucuccguaacaugacagucuauuuggccugaaggggucucugaaaucuuaauuuucccaucuuaagacugaguuaaauaauucuugccugggcgcaguggcucacgccuguaaucccaggacuuugggaggccgagguggauggaucacgaggucaggagaucgagaccauccuagcuaacacggugaaaacccaucucuacuaaaaauacaaaaaauuagccgggcgugcuggggggcgccuguagucccagcuacucgggaggcugaggcaggagaauggcgcgaacacgggaggcggagcuugcagugagccgagaucgcgccccugcacuccagccugggcaacagagggagacucugucucgaaaaaaaaauuuaaaaauaaauaaauaaauaauaauucuugugcuuucuaacuucacauuuuuaaaaagccaaguuauucugugggaauucuaccaaacaccucagaagaugccacauaaauguaagguauuauucauguuuuaucuuuccaugcuacacauggcuaaaacugaaacaguaugaauauuaacaauuuucauuuuccuagucacuugcucuaaguagcccuaaauguagauggaaaaaagaaccuaguaauuaaauauuagaagggggaaaaguuaucacuguagaucaguuaaugacgauaaagauccacaucuaaaaaaacaagcuaagaauacuuuuucaaagagcuuuuucaaauucaaaaucuuaucaaaaaaguugugcuuuaggaguaacaacacauccaugugguaaaaacugaacauucucuaaguccacaaaauuuaaaauauaccuuuaccuucuuuucaugcuacacagugcagguacaacauacuacagaaguguuuaaagucuuuauuacauauuuacuaacagcaacaguaaaaaugaaaacaaaacuguaagcuuuuuaaaaaaagguuagauaauguuaguauaagcaauuucuuacauuuguccuuguuaauauaacaauauaaguauaauuauuuauaacuuauaaauauaauucauaaaaagauuggccugcagaaauaaaguucaccauucauuuaaaaacucaaaugcuggacauguuuauuaacaaauaaaugaaucaucuuaguugcuuuuucaaaaaauaauagacugcuuuuaaaaaaaaaguaaaacuaaaaacagaauugcauugaaaaacagauuuuauggacagaugccaaguucuaagcauuuuuaaaguuuuaacaauuuuaauuucugaaguaucuacaacagacaagacuaucuuuuuguuuuaaaagaucccaaugaauaaguaacccauuuucuucuugauagaaaaaaaaaauuaaauaaaguaagcaacaguccaugcuaagauuuuuaacuuguuuucaaauagggauuuuuagcucacuuuaaaauuuuuaccaaugucucuauuuuuuuuccagguccuuuucuaagaccaugauggaccucuaauuuuuuucguuucaucgcuaucuuauuuuauugauaauuuuauucaaacaagaaaaaguccacuaaaauccacuucauacaaaaacacacaccucaagauaacuuggacacaauucauuuuugcauguaaaaauauuuuaugcauauauguucacaacauggugaauaaaauaugaaaaaauacaagaucucuugccucacugcagcuuacuccccuuuaacucuuucuacuaaauauacuuaaccuuaaguuugcccccucaccuugaguuuucauaggcagcucuaauucuuucuuucuuuuuuuuuuuuugagacaaaguuuugcuuuuauugcccaggcuggagugcaauggcgcgaccucagcucacugcaaccucugccuccuggguucaagcgauucuccugcuucagccucaagaguagcugggauuacaggcgcacaccaccgggcccggcuaauuuuuuguauuuuuaguagagacgggguuucaccauguuggccagguuggucuugaacuccugaccucaggugauccacccgccuuggccccgcaaagugcugggguuacaggcgugagccacugcgcccggccaggcagcuccaauacuuuaaggaaguaauagguugugcuguaaagaaccaaguaacggguuugucaaaaaagccccagacuucacuuccauaggccucaguuuucucucuucuaaaauaaaguaguuguacuaucucucuuccauuuaacaggcuauuaggaacuuaauucaggaccaacuauuauuuacuuauaauagcaaaaccugcuaacaaacuaaauguuaaucgauguuuuaaacaaugaaauacuuacaagacucuuuaaaaaaaaaagcuguggauccauauguacuaauuuuuauuguuuuuguucuuuguuuuguuuuguuuuugagacggagucucgcuuugccuaccagacuggagcgcagugguacaaucucagcucagugcaaccuccgccuccuggguucaagcgauuggccugucucagccuccggaguagccgggauuacaggcacgcaccaccaugcccggcuaauuuuuguauuuuuaguagagacgggaguuucaccaugcuggccagacuggucucaaacuccugaccucaagugauccuccugccucagccucccaaagugcgggaauuacagacgugagccaccaugccuggccuuguuuuguuuuugagacggaaucucgcucugucauucaggcuagagugcgguggcgcaaucucagcuuacugcggcuuucccccucgggguucaggcaguucucccaucucagccuuccgaguagcugcgauuacaggcgccgccaccacaccuggcuaauuuuuguauuuuuaguagagauggguguuucgucauguuggccagacuggucucaaacgccugaccucaagcaauccgcccgccucagccucccucccaaagcgcugggauuacaggcgugagccacugcgcccagccguggauucauagguacuaauuuaaaaagaugucccagauaggcuguuaaaaugaaaaaguggccaggugcgguggcucacgcuuguaaucccagcacuuugggaaaccucgucucuacuaaaaauacaaaaauuagccggcacgguggugcaugccuguaaucccagcuacucgggagacugaggcagaagaaccgcuugaaccgggaggugaagucugcagugagccacgaucgcgccacugcacuccagccugggcaacaacagcaaaacuaucucaaaaaacaaacaaaaaaacaaaaaagcaaaaugcagauaguaugauccauuugaaaauauuuuaagagaaauauacacauacaugcauagaaguuuuccagagggacauacaagaaacuucaagugguuaucaguggagaagaaugcuaacuuuauuuuuuuaacuucuuagccuucuguaauaugugaauaugugaauaacuuuuuuuuuuuuugagacacuccaaccugggcaacaagagugaaacuccgugucaaaacaaacaaacgaacaaacaaacaaacuccaucuuggccgggcguguuggcucaugccuguaauuccagcacuuugggaggccaaggugggcagaucacgaggucaggaguuugagaccagccuggccaacauagugaaacccugucucuacuaaaaaaaauacaaaaauuggccgggcacgguggcucacgccuguaaucccaggacuuugggaggccgaggcggguggaucacgaggucaggagaucgagaccauccuggcuaacaccgugaaacccugucucuacuaaaaaauacaaaaaauuagcagggcgugguggcgggcgccuguagucccagcugcuccagaggcugaggcaggagaauggugugaacccgagaggcggagcuugcagugagccaagaucaugccacugcacuccagccugggugacagagcgagacuccgucucaaaacaaaaacaaaaacaaaaaaacacaaaaauuagaagggcaugguggcgugugccuguaaucccagcuacucgggaggcuaaggcacgagaaucacuugaaccugggagguggagguuguauugaaccgagaucgcaccauugcacuccagccuagacaacaggagugagacuccaucucucaaaaaaaaaaaaaaaaaaaguacuaacuucauaaaacuguuaggaggauaaaaggaaaucaugcaugugagacacucagcauagcacagugugaggacaacugugagcagcuauuaguggauuaugaauauuauuauaaauuccagaaacgcugucauuagaaucagauuugacaguucacucaacaaucaccaaucucaaagacaguuuccuuuauccaaaacucauucaaucugaucaguguaagagacggcauuuguuaauuuaaggguuagggaaaaaaagaaaaaaaaaagccaacacagguaacaggugggcugauggacauauuaauugguuauaaguguuauuuaacaagaguaggcuucuucguauaugaauaccuguccaaggaaccaggauacuuaugacagcugggcaggaacccugaucuuuaaaggaugcugcauacauaaaaauaaacuuuuucuuuuuuuuuuuuuuaagcaaugaaagcuuccaacacaaauuuuucuauuuaaugauugcuuauuuuccuaaaaauuugcagcacugauagcucaugcacacaauuuaccagcuaauuacaaauaacaugucaaucaaguaggagauauaaaacuuaaauugccauaaaaauaaauuccagaaaaagcaugcugaauuuuuuuuuuaaugcaacuguuccucacagaauuucaaacaaauucaggcugaauauuaucaaauuaaaauacuacaagcugagagggugcuuuuaguguaaaagccagauuuacaaaguaccacuuuaacaacauucaauuucauuuuucuaacaaaccaagaauauauccuaagcuucuguauaacaacugagaggauguugccauuuagguagguuaaauguaguucaacugguuugaguccaccauauuacaauguuaacaggccuucuugguauuagagaacaguuucaauaucaaugugauagguuaaaguuuggauuacuccaacugcuauaauaaaaacaaaaggucacacacacauuuaauccaauaugaaauaaaauaggcucuacuuaacaccaauguauguucuguaaauuugucaggauuuaaaccuuagaauaguaauuauuucaaauuguacaaguaguuacaguugaauauauuaguuacuguaguuuccugagagucaacugaaguuucaaucaaaaaacgaacaaacaaaacaacaacaaaaaaacccuggcaucucaaugagacucuaagaacugcaugccuacuucacagaucauugcacugugcugaacuggcaucuggagauuguauugagccagcuacaugaaggcaaagagaagagauggggaaaagagaguuuauuuaaaaaagaaaauacuauucuuaacacacucaucacuuaacacgcucaucaccuauaagcaagagcuaucagaaauacuauuuaaaaauacauacauuucuaauuuuucaacauucaaaauacagcaagccgauaaucuaccacaagcagagcuuccuaccccuuucacccggacacagcgcuuugccaagagcacaggcccaaguaaaauaaccgaugcaauuuccuuguuuacuuaaagaauugcagaaaacauguugacugcuucugaggcuuccgaaacaaacgaauuuucaauacguaaaagacuucacgaucauguuugauauguaagcguaguaaugauuccuucagcuaguaaaaaucuaguuuuaaauugauuaaauggguuaaauuuacacugcagcucauuagcauaccuuguuugcaaccagaaggaagaggguaaagagagggagaaaagcaucaaaaagguagugauggaaaacaucacuaccuccuuuggcgguuaugaauaauuuaaaaugacccaagacguaaggggaaaagaguucaugaauagaaagaaagggggcuaacagucugaauuggccccuuccagauucauacugaugucggagaggaaaaggaauuuauuuacacugcagugccuuggcagcaaacauggcugccccugcccccuuuaaaucgaaauaaucuucacucccuccccaaaaccaucaaauuauggccaugucucucccugccucccuuccauaacacaaacacaucgccuucucccucaaaacaguaaaacccacaccuccccauuucacaacaaucacaaucccauaaccaccagcuucucuauucucuagccuugaaagaaagacacagaauacacacaaauacaggaacaaaaggccucccuuccuaacacuuuaacgaccuccauccccuucucuuccucccacucugacgcuaagucgaucguucucaucccugucaucauucaguuaauuuccuucccuagcccaauccugucuuccaguuuccugcgucuauuucccauucuccuauugcagccugccucauccccuuuccuaauccaccuuuuccuucacuuccauuccucauuucucccuucauucccauaaaaugccccauuucuccagcaaauuuauccccuucucccagacucuucugguuccuacacuccauccccaaaucucccuauuuaucaguccacccaggucuguaaucuccaugcaacucuucuccccuuucccugccccuccccgauccauccuuauccccgcccccaucccacuuucccaauucccagcucagcgccacuccgacucccaucccacuccccaccuccccuggcccaccccccaauucccuccacaccccccaccuugccaucugcuccuccgucaggacuccccucgagcccuuucaggccacccgcuuccccuuccauuccuccuggggucuggcgcuccaucccuaggucgcccccuccccgucguucccuccucagcccuuccuagcacuacacacgcgcgcgcgcgcacacacacacacacacacacacacacauacacacacgcacacgcacuuuaccuucaguuuguuccauucuaaccccccggccgugucagugcgaucacaggagagacacggaggcccggaguggggcuggggugcgggcagccgcuggggccgcgcgaggaggaggcggaaccgagcuaggccgcaugaaauccccgggcuagauuuuccccgcgccggacgccucugccauggcggccggcacugaggagggccacggccgggccgggccgggcgugcugcgggaagaggaaggcucgggaggugggaugggaaggggaggccgagggacgggggucgccgcgccgccgcugcugccagagaggagccugcggcuggcagcccggccuggguagcacgguccucggcgcucggcucggaauucgcacgccucuccgcggcgaccugugcacagcccccucggccuccgccuccgugcuggccgccgccgccgccucucccgccgccgccgcgcacaaagccccc

SEQ ID NO: 192939 - RNA, 13168 nt, Homo sapiens
uugagauucauauuuuauuuacaaguaaaugaagacugucccuguaaacucuaauuugggauaugaagaacaauauaaagaaguaguugcuggugccacagugaugugugaaggagucuaugccacuguuucuuuaaacagugauuuuguuauuaaaaaaaaaacccaccuacacgauuucuucauguugcauauguaaaauaauuaaaaauaaaagugacuuuucaaaacucuacagucugugaucaaaugcgugagguggccaggaugucacuuucacucagugacagccccuacucuucaagagccaacagccucugggcaaaagauuaguacucaucaagaguaucugcucgaggaauggaaagaccucgguccuucagggccugcacuuucaacuucucugcuuccagcuuggucugcuguuccacccuuuguucuucuagaauuucuucaauggauacuugcuggaggggugugucacucuccuuuuccaaguccuacaaaagagacagguuugaaaacuucaccugaagaccaagaauagaaagcacagaucucaaggcaaauggauuccucuaucaggcucagauuauuuuucauaacugugacaggaacugaaauauccuucuccuagggaccgguaaguuuuucaaagaaaugccugacaacacuacuauaggauacauacuuacaaugagguuaauagugaucaguauauguauauauuuuucaagauggagucucucugucacccaggcugaagugcaguggcgcaaucugagcucacugcaaccucuaccuccuggguucaagcgauuauccugccucagccuccugaguagcugugauuacaggcacgugccaccacgccuggcuaauuuuuguauuuuaaguagagacaggguuucaccacguuggucaggcuggucucgaaaccugaccucaugaucugccugccuuggccucucaaagugcugggauuauaggcaguaauaaguauuuguauaacagagcuuuaugugauccaaaaucccauauuagucaggauuaauuuucuauuaguccacgauuaauuuccuuaaaaaaaaaaauuagggcugcuuauagacagcuaucucccccacugcagagaauccaagagggagguuauugaggcaauguggccuuagacuuuuuuuuuuuuuuaauuauuuuaaggacggguggaguggcucacagucguaaucccagcacuuugggaggcugaggugggaggaucacuugggccuaggaguucgagaccagccugggcaacacagugagacccuaacuaacuccaccaaaaaacaaaacaaaaaaaagcugguguggugguguucaccuacaguuccagcuacucaggaggcugagguggaaggacugcuugagccugggagguugaaguucaaggcugcagugagccaugaaugugucacugcacuccagccucugcaacagcaagaccgucucaaaaaaaguaaaaagacaaaaauaaaaagggauccucuugccuuuaccuccuacguagcuggggcuacaggugugcgccaccguaccagcucuguagucuagaucuaaacuguaacaagacucuuuuucccuuuacggcaacaagucuucuagggagaaccucggcagaccauuuagguuacuaaaccaauuuggucccaauauuuuucuccacuauuuaaaaaauugcugcuuagguugggcaugguggcucacgcuuguaaucccagcacacugggaagccgaggcgggcagaucacuugaggccaggaguucgagaccagccuggccaacauggcaaaacccccgucucuacuaaaaauacaaaaaaaauuagcugggcgugguggcaggugccuguaaucccagcuacuugggaggcugaggcaggagaagcacuugaaccugggaggcggagguugcagugagcggagaucacgccauugcacucuagccugggugacaagaguaaaacuccaucucaaaaaaaaacaaaaaauuguugccuaauaaaaaauuccuuauuuaaaaaauacacacucaucguagauaauauggaaaauagacaaacaaggaaaauuuaaaaauuauccauaauuccaguauggaggauuaacauuuugauaauaucccuacaauuuuucuacauauauacugacuuaaaaaaaauaaacaacccagccaggugugguggcucacacuuguaaucccagcuacucgggaagcugaggcacgagaaucacuugaauccaggaggcagagguugcagugagccaagaucacaccacugcacucuagccugggcgacagaguaagacucugucucaaaaggaaaaaaaaaaaaaaguaaaaaauaaaaaauuagcugggcgugguaacguguaccuauagucccagcuacucaugaggcugaggggggaggaucacuugagcccaggaguuugaggcugcagugagcugugaucacaccacugcagucagccuagauaacaaagugagacgcugccucaaaaacaaaccccucccaaaaacccacaaugcaaauacugacuuuaauucguuuuuucacuuaaauguggcauaguaugcuuaauauuuuuauuuuugaauguuuuauaaacauuuuucauuaauuauuuuuaaagauauagaagacuucaugaauuugcgugucauccuuaagcaggggccgugcuaaucuucucuguguuguuccaauuuuaguagaugugcugccaaugugagcacauuuuucauuuuuuuagagacaggaucuugcucuguugcccaggguggagugcaguggcacaaucacagcucaccaugaucugaaacucuugggcugaagugauccuccugccucagccuccuaaguagcuggaacuacaggcaugugccaccacaucuggcauuaaaucuuuuuucuuuuuguagagauggggucuugcuauguugcccaggcuggucucaaacuucuggccucaagcauccucuugccuuggccucccaaagugugagccacugugccuggcccuuauaaacauuugcuaaccaaugucauaaugcagaagaaccuugcuaaaaaaguaucucacuguccauagauucaguuuauuguccuuaaaaugaauguacagguauuauuugguguuuuuguaagauggaaagccuauacaaaguauuccuguuucuuacccuccucuaugacuuucaaugauaaaaguuugggacgguacugacacacuucuccagaugcucugcccugcauacuauuaccacaugcugccaaggucucagaacucacaggcaguggcauuaucagucagagaggacucucaccacagaaguuacaaugaaagccacacaaauuacauaagcaagcccugcucuagguccaaaguuaacagcacccagcaaaguauauauuaccaccugcccucccaacccaugaguagcagcuaaagagagcacaguguucucggccuaaugcacugccucuugggcuuuucaguaugugacuugcuaagcaauucaugcugcuguugcugcuucuucccaacagucuuauuacuuaaugcugugucaucaucaucguccuugaggcagaauucagggauuucuuaaccaauauaguguuuacagaaacugauuucuauguaugaauuccucugggguugguacauaauuucuccugauugcugauucacauaacaaugcaggcauuccuggaaccaaguuucuguagugguaccccuguaaaacuucugcagcauccaaaccauaacauauuuuuuuaaaaaagggaacuuuuccucacaaaagggauccaaggaaacaauuaaacuucaagaacaaacacguucaccucuuucucugcacaaacacacacaucuacuuagauguaacuuugugccaauguaaccaguauaaaaagcaugucugcuauguuuacuacuauaaaacagaagcauaucugugaauauuuucuugagaaagggucuugcucuguuacccagguuggagugcagugguacaaucauggcucacuguagccucgaccucccugagcucaggugaaucucccaccucagccucccaaguagcugggacuggugaugugcaccaucaccccuggcuaauuuuuguauuuuuuuguaaagacaggguuuggccauguugcccaggcuggucucuugcagcuuaagcgaucugccugccucggccucccaaaguacugggauuacagacgugagccacugcacccaccccaguauuuuaacuuaaguuuuuuccucugauacguugccucuucaaaauuaaauucagaaaaguauuuuuaaaaaucaucuauaaccccaccaugcagagaugggucagcuccccuauauacuggcaguaucaagcacaguggcauguaccuauagucccggcuacuugggaggcugagacaggaggauugccuaagccuaggaguuugaaucuagccugggcaacauagugagaccccaucucuggaagaaaaaaaauacuggcagacuacuuuacagucauguagugucuccccauggguaccaugguacuaggugcuuucagacuuuuuuuuuuuuuugagacggaaucuugcucugucgcccaggcuggagugcacuggcacgaucucgacucacugcaagcuccgccuccuggguucaugccauucuccuaccucagccucccaaguagcugggacuacaggcgcccgccaccacacccggcuaacuuuuuuguauuuuaauagggaugggguuucacuguguuagccaggauggucucgaucuccugaccuugugauccgcccgccucagccucccgaagugcugggauuacaggcgugaggcaccgcaccuggccuuguuucagccuuuaugcgacacaagaagauaacaauuucugcugcuuggcugggcgcgguggcucaugccuguaaucccagcacacugggaggccgaggcggguagaucgccugaggucaggaguucgagaccagccuggccaacauagugaaaccccgucucuacuaaaaauacaaaaauuagcugggcuugguugcgggcaccuguaaucccagcuacucgggaggcugaggcaggagaaucacuugaaccugggaggcggaaguugcagugagcugagaucaugccauugcacuccagccugggcaacaggagcaaaacucugucccaaaaaaaaaaaaaaacccaaaaaacaaaaaacaauuucugcugcuuaaacaugcaagaaaugauacacugaacuaaaaguacaaacuacaaaaauauuuuauaagaaaaauuuuuauaaguauuacuuauaaauauuuuauaaguaagaaaaagcuauuucauauauuucacagcauauauuucauauauucauauauuucauauacuucauauauuucacuugggcaguauugauagucuggauuagucauuucuagcuauuuccaauaugaggucucugaaccaacccaacccuagcagaauuaucuccuugcuuucucaaauggcuguuaaaaauggcuacaaaccaaaccacucuaaagauuucugcaaacugauuuaagacauggcuagguauuuagaaaacaguauuaaaaacuuuaaaaauuaagcaaacaccaaaguuuuugguaagaaaaaagaagacagugcuggcucaacccuuaauuucaacuacucuugaagagauuuuuauuuuccuugcaaacccaauaaucagaaauaacaagaugaaaucaaagguuuuaaauaagauacuuuaaaaaaaaaucugaguacuucuaguagggguguguguguguaugucugcacacacgaagaccuacagcaacaauaccucagaaaaucugauuuaaccuuucaccugccagcuggucuuucuggcacagauaccaaaauacccucucccuggcugugagcuaaggauccaaguaagacugaacuccauucucgggauagguaacggaaaagcuuuuccuauagcuacucuuucccuuucccccuuuacuaauauggauaucacauuguacuguacaggcaauauguacuucccugaaauacugugcauuagcuuuaugccaugaaaaaccacuuguaaccaauuguuuaaaugacugcaaaauauuccaacguauguaagacacaccuuccccagcauauauaaaucaagcuuugucaauuuucugcuauuaaacaaauauauuaaugaacacauuuguuaaggcacugaaacaaaguauucucuguagcuucccuaaauuaauuugguaguugccuaggagaagccagauaaauguggagaauauuuuuauucucuuuugaaaagacaaaaaaagaagucuaacuagcaugaauaugaagaucuacagcagcuuaauaguuuucacuuacuauuucuccuaguaggaccacauuuucuccucugaccacaaaaaucccucgaggaauaucaccguauuuuuugcccacaugaauacgcuccacagucugauguagcacuaaguuugcuguaaguguauagggaaaaaccaaagauauuuaguuuaaacuacuggguaaaggcccauaacucaauaaucaguuauuuugaaaagauuuagguaaacaugauuuccaagcuuucuaauuauuuuuauuuauuuauuuuuugagaccgagucucgcucugucacccaggcuggacugcaguggcgccaucucagcucacugcaaccucugccuacugguucaagcaauucuccugccucagauuccggaguagcugggacuacaggugccugccaccacucccggcuaauucuguauuuuuagcagagacagggaucaccacauuggccaggcuggucuugaacuccuggccuugugauccgcccaccucggccuuccaaagugcugggauuacaggcgugagccacagugccgggcccccaagcuuucuaauucuggggaaggcuaaaauuucaaauaaucuucuccuauuucauugaguaagacguaccaguuaggagaugucugggauuauguugggcuaauacaugaaugacagcagaaauaagagaaauaaauuccuuuaucaguuaauugcuaauaccaaaaaaaaccauaggaaaauauaaaugaauaaggaacuuggaaaacuugggccuaaacaaccacagagaucaaaacuuuuguuuucuggaaagaaacagcuuuucuuuuuguguggguguguaugugaugaucugcugaagauucaacuuucuuuuaguaauuaggauucauuugacccaacgcagguauccauggguuaugauacagcaaaaaccuauuuuuucaccuugacagauaacuauauuuguaaucuaaaagucaacuuaauagccacuacccuucccucaaaguacucugaugaaucugacuuaagaaucaggacuccaauuuguuaacaauaauuauuuuuccucuuucaauuaguacuacuuguccuauuugaaguaaaggagaaaucuauguucauaucuuccauaauccuuuuaaguguuuuaauuacguuucuuccucaugcucaaauccagugauuucgcagauauccaauaaauguuagcaugaacaugaaguuccuugaaacagaaggaaacauaaucuuuuaacuuaagaaaaaugcaggaugcgaaacaaagacagaggccucuuauuccaauguaucccuauauguaaaguauuaagcuuaauguugggguccuuaaaauaaaggaaaugccuucuacccaauuuucauuggcuagggagggauuaccuucacuuccggaacugcuuugaagucauuuuacccugccaauguagaaauaagcagccuugggccgggcacaauggcucgcgccuauaaucucagcacuaugggagcuaagaccagccuuccagcuguccccacugaugcaccagacaugugagugaagcuccuucaaaccagcugacucaccuucuagacaccaagggacuguccuaaaaccaugaggagcagaacaacugcccagcucagcuggguggguggaucaccuaaggucaggaguuugaaaccagccuggccaacauggcgaaaccccgucucuacuaaaaauacaaaaauuagcugggggugguggcuggagccuauaaucucagcuacuugggaggcugaggcacaagaaucacuugaacccaagaggcggagguugcagugagccaagauugugccacugcacuccagccugggugaccgagagcgcgucuaaacaaaaaacaaaacaaaacaaaacaagccucuucgguggacugaguuuauuucuaucauuuggcucccccuacuggggauucuacugaaagccaguuuuagaaacgagcuuggaaauauauauaagcuuugaaccaccuaaucugaauguauagaaaacaaugauguacucacuaaaaucaguccuacuaggucacacacgugaaaaaguugcagauaaauuucaauauuaaauaacaaaaaaugcaaugggcugcuguuauuauccagaguauaagagauguccauaaauuaauacauaccaaauugaucaaugcuucuuaaaaagccuauaaguguccuuccaucucgaagcagaaccaagugcuuuucuggggagagaggaaaaaaucuuuuaaaugaaaacugacaaguucagcgaguauuuaggauaauaauuaacaguuuaagcuguaccacuuccucggccaaugcauuuaaugugaaguucaaguucauuggaaaacugaaaaaagcagcacagcaacgcggauuuagauaacaucaguagugaaaagaaucagagcaguguggcagagugggaaaaggacagggcguggcaccaggaagccugacuagcuggcucuagacccuuauguugguuuuuuuuuuuuccuuuuuucuuuuuuuuuuuuuuugagacagagucucacucugucacccaggcugcagugcaguggcacaaucucggcuuacuacaaccucugccucccagguucaagcgauccuccugcaucggccuccuuaguagcugggacuacaggaguuugccaccaugccuggcuaauuuucauauuuuuaguagagaugguguaucaccauguuagcuaggcuggucucaaacuccugacuucagaugauccauccaccuccaccucccaaagugcugggauuacaggcgugaaccauggcgccuagccaaagacccuuauguuugacacuuaaaccaucucaugucaugucaguuuuuauaucuguaaauugacaaauuuaaucuagaugacuauuaucuuauuuguagaauuauuuuguccucaaaagaugagcuucuaucucacauuuuguuuguaaccauagaaggcuuuaaauaaaaacacaaugcuucaggcauuuaaaaugaagacuaauaauaagcuagagcagaaauucaauguuuacugagggggcaugugcuguucuggggucuagacauacaguagagaaugagacuuagaaagucaccaaccuuaugaauuuauauucauguuggaggaggacaaauaaauaagaaaauaaccuauugugauuaggacaauggaauaauaaacuagcaaggcaguaugaugaagggagagaagugguuacagaaggaaggguggcaagggaaagccucucugaagaggugacuuugagcugacacugaagaaugaaaauaagccaguuacuagcgcacccagcaaaauuucuuucauuccaugccuaaaguacuuucuagaugcagaacagaggaaaaacacagugacucugcccugaaggaauuuauacucuuccuugcgcuauaaauaaguaccacagaaagcaaaucuuaauuauaugagacuacagagagagaaacuguauuucugaaggagguaucagaguuggaccuuaaaagguagauaauuuuagggcacaagaagagugauaggaagggggcggggggggagaaggaaaucuguaaauuaaagaggaggaaaaaagggcuauacauccauguuuagcuaaaagcugagggugugaagggaaagaacaguagauaaagucagaaaaguacugggcgcaggcugcaucuggauuugacuucauagggaacaagaaaacauuaagugauggagucuguuuacugaguuuguauaaguggguaugugugagaggguggggugcugaagaugugagguaaagauguaggaguuuuaugagacaucacaaaacuauuuaccaagaguugggaauaaaagcagcaagcucagggugaagguuauuagcucuuugugauucuaaagugcuaucaggacacuuaauagaaacacacgcagauaguuggaaacaguaagacuggaaaaccaaagacaucaagauuagagaaagcaauuuuggauaaaucuacaaagaggugauauaaaaaacuaaaguacaggagaucuacuaaagauuuaaagaaguaggccacauguaauccaagugaccaucuauuuuggagaacaguaagagccagagaaguaagaaaaucaccaaguaccaguuguuagagaaaucaagagaagagaauuaaagaaucugguggggagaguaucacagugcugcaaaggggagagaacacagaagaagaccuuagacgaauaacuuugaagaaugcagcuugaguaauuucaggauaaaaauuagauugcaggaguaauguaaguagucuauugaaggugaucaagaaacagacaaaaugaaaaugacucgagguuuggggauaaagauaugaaaaaagggaugggcauaugaagagaacggagaaaauauuugagauggauagacaguaacacaugaggggaagaacgcagggguuggggagacagaggauauaaaagaaaaaggcuaacaacgaaaaaagguuccagaagcagugagaggagacaguaacaacagacagacaaaaagggaggaauccuuccuacucaaauuaaaggaugggugaaaauacagaaacacaaggaggaaacuguguguuaggguuggggagcaaagggugcauaucaaauggcuucaaaguuuucauaaaguagggggucuggaaucuacaaagagguagggguuagaggaccaaagagcaaaacugauuuuuaguaaaauggcaggauguguuagaggauauauaaggagagaugagggcaaaagagcauccucgagcaacuaaaacauccuguuacacguaacagguucauauagauguuaauauauauuuaguccaauuacacuacauuucccuuacauagcacaauaaguaauuuguguuuaaaaaaaugaucugucggccggaggcgguggcucacgccuguaaucccaguacucugggaggccgagguggguggaucaccugaggucaggaguuggagaccagacugcccagcauggcgaaaccucgucucuaccaaaaaaugcaaaaauuagcugggcgugcuggcaggcgccuguaaucccaguuacuugggaggcugaggcacaagaauuguuuaaacccgggagguggagguuccagugagucgagaucgcgccacugcacacuacagccugggcgacagagcaagacucugucucaaaaaaaaaaaaaaaaaaagaaaagaaaagaaaaaagaucugucaaccauaaaaugauuuuuuuuuuuuuuuugagacggagucuugcucugucgcucaggcuggagugcaauggugcgaucucggcucacugcaaccuucuccucccggguucaagcgauucucccgccucagccucccgaguagcugggauuacaggcaccgccauagugcccagcuaauuguaggaacgggguuucaccauguuggcuaggcuggucuugaacucccgaccucaggcgaucugcccgccucggccccccaaagugcugggauuacaggcgugagccaccgcgccaggcccguaaaaugaaauuuuaaccauagauucuaaauugcguauucacagaguaacugagacgauugcaacuuauuuaaaacuauguguaaaucaucuugaaacaaguuaaugagaaagaucacaugauuaaaacaauaaaaaauguugcuugaggaauaaugcacagacggaauuuagaaaaaaggaaagccagaacaacugcagacgguucuuuucgcuuuuguauaggacugagcuccucuuccggacaaaaaccaggaauaagggaggucuucuuaguaaaagcaaaaguaaauugucuuaaaaaaaaaaaaaagguugcaagugauuuggucuuuccagaaaagucaauaccaugucuaacaguggucucuacuacaauaaccugaaggugcuaaugacccucacaguaaaauaagcuagcaaauggccacaccguagagcgccuacauuuacugccaauuaaguccaacugccgcugucuuaauauuuucgcuuuuuaaugaauccucucucuagguauuccgauccauccaccgguaacacgcugauacuucgaaauacugcaggcaggaguggacgggggagaagcccccccccuccccgggcuucuuucguguucgggccucugcugccgcgauccacggaagcaagaaugaguuccaucgcuuggggcucaccagcuagagggcuggcggaggcugcgaggggcagaaguagcagcaggcuacugggugggcaagcgguguguaccgcagcuguggaggacaucgacgcggaacgcccggauugagcucagaacacaccggccccgcccgggacucauucuacaagcuucuucggaagaggcgcccgcccgggaggaagggucuaaccccgggcuccaccgggaggagauaaacuacucacugucaauguccucgaugaggcuggcggugccaggcauauaguucauuuugaacugaaauaaugcugcaaugcacagcggcgggaggccagcgcguccaaaaccucuucccuccuaccgcagucgccgccucggugggaccaagcccggaaucccgaccgagaccagcacuucugccccggcuuucagccgccgggggcugccggaagcuccuccauauuacccuuacccacuuc

SEQ ID NO: 192940 - RNA, 86851 nt, Homo sapiens
agccgcggcucuucgcaguuuccucuccuuguuuugcuuucgaucuggacuguucucaggcaagccggggaguaacuuuuaguuuugcuccugcgauuauucaacugacgggcuuucauuuccauuucacauacccuagcaacacuuauaccuugcggaauuguauugguagcgugaaaaaagcacacugagagguaacauuuuucaaauaauaguugugacuguguguguuucucucgagggcauguuucuggggacuguggggggccguguguguaugcguguccugaugccuugacacgauguuuugcagacggaaaaugccgggguucauaaauauuaauacugauuuuuggaggaacagucggcgcaauuauggaucaucugauuuuaggggaagcagguucugcugcuguugcugcugcuacuggggcugcugaggcugcgaggaggaggaggaggaggagguagagagggaggaggaggaggagguugguggagguuuaauuucacuuuuggauuugcagaugcggagagguggcuccauggacacagaccugcugugugugcuucugcgccccagguguugugugugggggugcaggucagcuggagucgggccucauuuaaaacaaaauuguguguaugugcguguuugugugugcgcgcgugugugugugugcagccaccgccgccaccggauccgaaggaggggagcggguccuucucggugcccgcggcggcgccucuccaggcugccuccagcguaaauaagcaggcaccgcuccccggccgggaggagcgccuccagccacggccagaggaaacuugcuggggcgccccgcggcgguccaggggcucgccugccugccgggcucggggucgggucgcgggcgucgggugccagcggccggggcgggagggcgggcucggagccgggccgggcgccgggccuggccgacgcgcccugcuuccugggggcugggccgccgccgccgccgcucagaagggacgccgcguccuccuucccgccggccagcgcccggucgggcccuggggcuuugucauugcacuugucccagcgcgccaggggcucgggcggcgcgucccaggaaggcaccgugccgaggggucagccgcccgggccgcggccuagcgccgugcgcccccggguccccgcaggcgcccccggccggccucgcgcgcugggccugacccgccucggcuacggagcgggcgaggugggggcggggagccuccggggaccgagcggcgcagugggggccggcguccccucggggucccggggcgcgggccgcggcgggguggggacgcgagugcccgccccgugcccuccgacccggcuccgggcgccgggugacauucgcccgcuggccgaacaugguuggugcaaagccgcggcggccgccacuuccuuuccgccucgccgguagggcucgcccaccgagugaagccggccgcggccaaucgcggcgcccgccugcucccaguggcacggccugggggccggcguccgccggggcuggggaagccguuccaaguuccaagggucgcggguguaacucaugccccucccagcacgcgccggcgucuccccuuggcccccggucugggugcguuugccacccucuccuccuuguucccuaagaagcgggggaggggaaggaggcgggcagccugggcagggcgccagagccguggucgggcaccaggugaaacgcccgggucagucuguguaggccggacccuuggcgcucggcugcggaugugaucccggggacuggcggccgagguagcucagaagagcgagguggcuuucgcucguuucugacccgcuacugucugaaacuuggggacauauugcccgcccccucccucuucaaccuccucccuccgguugcuccuuguccuugguuauggaaggaaaaaacucaguuguucuaaaugaggaaaaguggugcuggcauucgucuucagccaccggccuccuuauggcugugacucggucugcuuuugaugaauggccaggagguauggaggauaguuagauuuccuguuguggauuuucaggcaucaccgagacugcugucaagccugcagucauuuacuaguuuucauaucgacugcagguucucuuugagcaguucaguuuuuggugcuuaagggcaggugcacaacggggucugggguuagaccaggcgguggauagucuugaugcuaggcagaugcaguuaucccuaccaggcccagagggugacucuguuuaacuucaccacgcacgcagauucaggauucucugauuuccccaacuuuccuuuauucuucuuuuagugggagaaggggcaaaaguagaaaccuaaaaaauccugggaaaaggagccuuuucugaggaaacuucagcagaugaaauauuuaagacuugaacugggaucucuagggggaacguuggaacaucuauugauugaugugucaaaguccggaauuucacuguaauuagugaacgauuauaacuuguaacuuugucuguuauguaagaaauuacauuuuggucucuuagauccaagaguucuugucuguuacgauuuguaacugcuuguuaaaauuaaacauuuacauauuucauucucagugaguugucauuuuuuuguuagagaaaguuccaguuauuucagauuuacuuaccuguaaaaaugucagcauaaucaaaaguaaggaucuguagucaaacuggaagcaaauuauggcaaacacaugcgugccaugaaguucugacagccuuaugaacaauggucccacuuuuaucccacuuucugaaacacuuuauuaggcaaauagugcaccagagcaaaagauguuuaaacuuacuggaaaaauagacacuuuggaugcuccacauuugaugugcaucaauuuucucauguuaccaacgauguuauauuuuuauucuuaacaucaucucguacaaaacuguuguuuuuagagcauuuucacauaauauccuuuugauagugaaaaaccacuguacucuaucuaaauggaguaucuggguuauaguucccuuaucugccuuauaccaaaaagggcuuaacgcagacaagagaauuuauguacacacucaauaaauauccuuagaacaucuauuauaagccagacacagugcuagccucuguauacucaacugacagcgagaaagacagcaucuuuacacuagguuguguucuggugagugagcugaccauuaacaacaaaaaauauaguuauuaccuuuugggguuagcuguaaggaggauaauaauaauuuuuaacuauaucucguaaguguugcuuucaugaacaauugagauacuguauaugaaagaacauugcauaaauuauggcagucuacaaauguguaaggcauuaacuuucaaaauuauaucagauuauucuuaguguaaaaaggccagauaaucaugacuggauuagacacuaucuuucucauagaauuuccagcaaggagggauuuuacuucugagcauauauaaauaaugauaaaagauuaaacauggaauaacuuuuauauaaaguaucaaaaaaauuucacaguggaauccgauauugucagugaauuuuuuccugucagaaggaaaguuaggugguauccauggagaccaaaugauauggaaauaacagugauuggaccaauguauuuucccucuuuaugucagauaagaaaaucuucccaagccucucugugcuuuagucugaaucuucuucacucucgugucaacuucuucauuaucugucauugcaggugugcacugggcugauuguaguauuuugcuuuuaccaccuuuuuuuucuuuucuuuuuuuuuuuuuuugaggcagagucuugcucuguugcccagacugguguacaguggcacacuuucagcucaccgcaaccucugcuuccagguucaagcaauuccugugcuucagcuucccgaguaguugggacuacaggugugcgcaggcgugcgcuaccaugccuggcuaauuuuuguauuuuuaguagagacgggguuucagcaugcuggccaggcuugucucgaacuccugaccucaggugaucugcccaccucagccuucugaaguucugggauuacaggcaugagccacugcgccggccugcuuuaccaucuuggcucaugugcauuuauugaaugcuuacugugugcccaacacuguauaugugacaacauacaugaaaguaaauauuaacugauagcauauauuuauaacauauauuacaauacguaauauaugcaaauaaacgaaacugcggugaaaugucaguuauuauuaguaaaaauuaguucuucuuuucaucuguaugagacaugauguuccuuccugcacagggguaggaggucaggaccuucggucucugccugccccgucggcccccuguguuuggccugaguguaaucaguggucggugcacgaugccagcuucaugcacagugugcugaauugaggaguggcucugguggcgggagugacugauggaaaagugggugaggaaguuccaucaaacuuuaauuuaucaacaaagaacaaagaaugaugaauaacauauaggguccagauuugaacaugaagacaguauuuuuuauagaguaccaaggaaaacacacaagcaggaaacacagcucacagguccccuuugucccugggacuccgucugaggcucguuggauucagagcaagcagcaggccugaagucuuggcauugaccuucaaagauccccuaaaaauaauuuucccccucagaagcuccaucuuaugacaaacugucucugaaacaaauuguguuuauuuaaguagacuucauguauccuuuuucuuuuauuagagucaaagucucacucuguccaccaggcuggagugcgguggcucgaucauagcucacuacaggcucaaacuccugggcacaagugauccuccugccucagucuccugaguagcugggacaacaggcaugugccaccccaaagcccgacauacauuuuuguguagagacggggucucgcuauguugcccagacuggucucaaacccuuggccucaaaugauccucccuccucagcaucccaaagugcugggauuauaggcgugagccacugcacccggcccuagugcccauuuuuauuccucagaaacacauaugacuuccagucagaacuccugauugccuugagaaaacugguaucaucaaaucucacugaacucauuauagccaaagguagagacccgugguguguuggacaggcuggccggcuccgugugagagaaacucaccaucccguuaggcuuucugaggcacugaaacuagccgggacccuccaucaauaacuuggucugcuuggggauccagggaccccaugcaauuauuuuaaaugaauaauugauuuuguuaaauguaguaacacaugcaaugguuuucuuaaaugcacacauuguguuauuauuucauuuguuuauuaaauauuucuugacagccagcuguguacaaggcucugcgguggaaggugcaugaacucagaugccuagaguggccuuuuaguucuccaaucacuuccuccuuuggaaguuuucacuguaaaauguggcuggauaauucugucauccucaggagacagaaccuguguguguugugaaaaucaccuggggaggggacuuuuagaaauuacacgggaccuuuuagauuugagacuaucuguagcccccuuucccuuccuuccccuuccugccuugauagcgagccucuuauucaccauuggaucccugcuccccagccucccucagguguguggccagaguagaaauggaaagccacugaaucgaggaucucuucccagggccaaauaguugaucuuuuccuuggcucagaugaaaccucuuuccacauuuuaaaaagcacuucggacaggggccuguggucacucuguuggcucugcccacuugcccuugcuugccauacagaaaugggacucauguuaaguuugugauacauugaauuuuccuuuuuuuuucuuuuuugagaaagagucucgaucuugucuccugggcuggagggcaguggugugaucucggcucacugcaaccuccgccuccuggguuaaagugauucuucugccucagccucccgaguagcugggauuacaggcauaugccaccacgccgggcuaauuuuuguauuuuuaguagagaugagguuucgccauguuggccggcuggucucgaacuccugaccucaggugaucugcccgccucagccucccaaaguauucggauuacaggugugagccaccgcgcccagcccaguuuuccauuuugaagaggcaagaaggacuuuauuuuauuuuauguauuugucucuuuguccaggaaggccauggagaauuaggcguuugguuuuguuuuguuucuauuuugguuuauaacuccuuuaucaguuuaguauucccuucugauaagcaagaaagagcggaguugacaaagaauggcugcagaugagaagcaggugugugagguuccuucugaugauggauucuaaguauuuuuaucccaaaggcaagacuaauuuaguucagcaaaauaccuuaauuuaggauuuugugugauaaaagccuguccuguuuucauuaaaugacgauuuuugagaauuaacuacuugcugugugauuuucauaaauaauuucauuugggcauacuuaacacuguugcuaucugcugaaggcauuugauacucgcacaccuaaugccaucaaaggagagaugaguauacacuuuaauuuguucuuauugaguguacauuuuaauuguucuuaugaaugucagauuuugggaagauccaaagaaguacucuguagacagaauacgcuguccuggcccccuaagcuuagaauccuaccaauuuucccauuucaugagauugaccuuucagaugaggagggacugcauacaaauugcuuuauuucaaguaauaucuaccauguuauuuuugaaagaauucuuuuguccuuuuuacccuagaucuauuggaaaagaugagaaaaauuacaguggugauaagagugucuuaacaccuagauaugaugggugugucgggugaaaggauagcaaugggaggcugguggaaagugagaguugggggauggggugaugagaaggaaaauaggugacuagugacuccuggauucuugaaugggagagagugaagagacaaucaggcagggagauuuucugucuuugcauaaaugucacugaaagaguuuuagagaucggaggggugaggugaaguugguuaggcaauuagugauaacucaaggaccaguugaaagacuggaggacccuccacugcugacugugggaucagauccuuuuauccuggggaugagaaaggcugaugggaaaacugcuaggcagcugcugacauuauaccaccaggaaacaugaaguugugaguaguugucacuuggacauggcugaagucaccuuaggguacagugauguugcugcaucacaacguuuaggucaucaaugggccauacacaugacuguggccccauaagaugauaauaucauacuuuuaccuuuugcuauguuuagauacacagauacuugccauugugcuacaguggccuacgguccucaguacaguaaccugcaguacauguuugcagccuggaagccauaggccauaccauaaaccuggguguguaggagguuauaccauguagguuuguguaaguacacucugugauguucacacaaugacaaaauugcuuaauggugcauuucucagaauguauaagugugcugauguugaugcauuguuuggggauggggaaacugauacucacuaugugaggccccaaacucaaucuaaaauugccuuuggaggcaaccacggaaauacgguaauagcucucuuaggccuucuccccccguacugaucuuccuugguacuguuuuauuuuauuuuuaaacucuugaaauaauacauaauagauguauguauuuucagggcacauguaauaauuuaaugcauucauauuuguaauuuguaaugauaaaucaauguaauugugcuauugagauugugggagguaaauauggaaucagggaaauagaaugggcugauaauguguuuuccuaaagaacagaugggauuggccgugcgcgguggcucacgccuguaaucccagcacuuugggaggccgaggcgggcggauuuccugaggucaggaguucaagaucagccuggccaacauggugaaaccccgucucuacuaaaaauacaaaaauuagcugggcaugguggcgggcaccuguagucccagcuacucgggaggcugaggcaggagaaucgcuugaacccaggcggcggagguugcagugagccgagaucgcaccagcuugggugacaagcgugagacuucaucucaaaaaaaaaacaaaaaacaaaaaacaaccagaugggacaaguuaaaacugaacuaugaauuccauaaguggguagugugggucacugaguggggcacugaguacuccacagugacuguagucaggauucuacauugaaauaaacuuucuggaauuuaccuuggugcuauauacuuaaagucuuaaaaauguuaagcucucuguuccagaaauucugcuucuuggaaccuacuuacgugaaguaaccagagaugggaacaaagauguauguacacggauguuuauugaauuagcuuuuguuauguaaaaacuuggaaacaagcuaaauauccaacaauagagacacauuugaacgaauuacggcacauccagacagacuauagguagcuuauaaagcucguguuuucgagcagcguuuagugaugggaaaauauuuaugaucuaugcugauuggguggggaaaaaaggauaugaaauugugcuucuaguuuuauuuuuaaaacauauguguauauugggguauuuuuaaaaaccuggaagaaaacauaucuuuuugauggugaaauuguggguguuuggcuuuuuuuuuccuucuugaaacauuuuuguauuuuccaaauuuaaaacagcaagcacaauuaccaauuacccuuuuaaccagaaaaauauucucaagagagugcuaauaugucaucucugcccucaccucugguccacguaagguuaggaaaaacacacugggugcugccgaggaggaggcugugcauggacggggccauucucgagccuuucugccuccauguguggagcaggcucuagagccagggcuuuccuggccaggcucuuggaagccuuuguccucagacagcuguggcuacuuggagacacuuagauugguggcuuuuuggugagguugggacauaauguuuugucaguaacugugaagggcuugagauaugauuucacuucacaguuaacauucuuuauacauaugaauacugcagaaacacaaaaccccuggguaggagaaaagaguuccuuguugauauuuacaacuggggcaacagccugagugacacuauugugucaggccccuaaaccuugacccuuaggugacacugaaaacuaauggaauguacaugugggcuacacuuuguugacagggacagagcagcugucccucucccgucccaaaaggagagagagagaaaaaaaaaagaagaagaaaaaggaaaaccaaacagacaaacaccuuagcuccccugacaugggaugaaaagguuccaggggucuuauccuaaccuuucagaaugugagacacuuguaaccuggggaugucuccaaggucuguuuuucaugcuuuuugaaauacacaugccuagggagauacgucuucccagcaccuugggaaccaaggugaaauuauuugguccucuugaggagauuagagguuuuauuauccuuuuggaaaagagcauuuaauguacacaaauggcuacagaucuaauucucaugguaagugaaguauaaaauguuuguaggggaagugagagugaacauucccugucuucauguccuguauagucccuaucuucauguccuguacauucccuaucuucauaugcuauacagucgcuauuuucauauccuauauggcuccuauauucauaucccauacauucccuauccuauacauucccuaccuucaugucauauaugguccuaucuucagaccuuuuaugguccccaucuucauacccuauacauuccuuaucuucauguccugaacagucuccaucuucauauccuauacauucccuaucuucauuucuuaacaguccccaucuucauauccuauauaguccccaucuucauguccuguacauucccuaucuucauaucuuccuauccuauacauucccuaucaucauguccuaaauggucgcugucuucauaugcuguacauugucuaucuucauguccaauacauucccuaucuucauguccuauacggucccuaucuucaugucauaaacggucccuaucuucgcaucauaugcauucccuaucuucguguccuauacauuuuuucccuuuauauucuauucauuucuguguguuaggaggugaaggcauuuuauaggagucuggaaagaagccugagaaguuguauuuuccccucacaccugccuuuaccagaccccuguuggagaaugacaguagagcuuaaucagagugugaccucugacuuuucaaacugaagaccucaaaucuccaauuuuuaucugaaaaaauauuagaauaguuucacucucuuuaugaacauggagacguuuuuggauugcuacggaaguaggauugggcaugaccauuaugaguucagaggcugaaugccguaccacagcccaucaaaaaaaaaauauauauauaugcacgauauuguccaauacaaauauaaugugagccacauguauaguuuuaauuuucuaguagccacuuagaaaaguaaaaagaaguagguaaaauuaauuguaauaauauaucucauuuaacuaauuuuaucuaaaauauuucaguaugucguuaauguaaaaauacuaaugagauauuuuguauccauuuuucauacugaguauuuaaaauccaauguguccuuugcaccuauagcacgucuuaauucagcccagccacauuccaagggcaugguagacccauguggcugguggcuaccaucuugguuggugcagcauaaggaaaucaaucaaggugugaagacaauacaggggaaaguuguaguacaguccugaaaggacugaaggaaaguagaguuggagugguuauuuuggucauaacuguaugaaucucccuguggcucuccccacaaaccauaccugaucucuucagccuaaaacaaugaaaugcucugaauuucuauagaagcagcauacucuacaucccauuccuaggguaguuagcuaucugcaucuugaugagaugaauguuucauucuagacucuugaacuguuaugaaaaucuuagauuauuugaauuuuuccauuuguaucaccuaugugguaaguuauuugagagccaggauccaguccgauuuauuugcauuccucaccgguguuugacaccuuuaagaccuagauaaauauuaguuuauuugauuuucagcuguaaagcaaagguuagcuugaaaggcugaauuccagcucaggaaggguggcacagaucuaguuuguacuagaaaccuaaugguauaugaauugaacacauaaacauuaggauuugucacuuugcauuaggauuuguuacuuuguauuagggguuccacacccagaaggugaaaaauuguucgguuuuucuccuuuguauccagaccuuuaaaaaauauuaucaguuucuucuuuugauguuuaaguuccaaugaugauccuaauacuuucuuguagggauaaauaagcuauauuuggugaugaccugaagauaaacauuuggaagcugcuacuuuuuccauggguucuuuguuaacaauaacuuuguuauuaacaaacacagcccacaacaucuaggcgaugaaauucuuuugaaaucaaguauaguauuuuacaguugccuucauuuguucucuuugacuguaauuguuggguugaagcaacagacuuauccagagagccaaggcaauuuauuuuuacugaagacuaccuaagaacugcuuagguagcuuuucucugcaagauuaaaugcgaccuucauggaaucauguuagcagggccagcagcuagaaaaauaaagacuaaaccaaaccuucagcagcgaaauucccagcugcucaguggcucagagcuuuccugauugcuuucuuccaaugaaaacacuguagauuaguuuuaagugaauucuaguagguuuggggauuugcaacugacagaagaacagcaaaguguaaucucacuuuaaaauaauaguccugaagguaaaucucuauuggcucuuucuuaggaugcugggauuuuuguucauaugggaaaacuuaacucauacacacuguuuagcugaccuuugaagguaaggcccuagaaggcagacggaggcuggacaccuggggauguggggcaggacugcugcuccucuuucuucucuccauuguaggcggguggaaacuugggaagccugcgaggaaggucccuguagggaauguagcugacccauuuuuuccacuuuuggguguggucauccugacuauuggugaagucagggugaauugaaaauguuacaggagaggauuuacuuaacuuacaggugcuuuuaaugcauugcgauuuuuguuuuucuugaaaguccucgcaguuugggagauggggguuggggguuggggggcggugggggggcggguagaggagagugcucagcugaaaccguugacuauuuugaucauucauccauucagucauuuauuuagcagguguuuauucagugcuaacgauauguagagggagguauaaaacgaaagaaaauuaucuucgauuugagguagccagguagguagauggucugcauuccuuacaguuaggagccuaauucuuccagauagagaaaacacaauuaggcaaguaagaugacaguuccagaaacgauuuuacuuaucugugaaucccuuuuauaguucuuccaugggcccugugggguuguuucagauuguaggggaagccgcagugcuaaugugacagauuuuuuugccaaguguauacauuuuauuuuuuuuaaaacagacucuuaauagauuguaaaauaggcauagaacaacauauuguuuuguuguucuuucuguuuuuccacaauucucccacauuuaguuuggaacauggaacuauggucuggugucauuaaggaaaacugaugggguuaaauccugauaauuaucuccccucucuacuuacccuucccuuguggggagacacuguaaccagcagagcugcagaaucaguacuccugccccccgcgguaaagugaaggaagcugaugaaagauauccaggaacucuuggcacuauuuuugaaauuuuuauguggauuggaaauaauuucaaaauaaaaagguuuuuuuaaggcuucccauuagugcucuagaguuacuguugcuuauuuaaaauaacagccuaauagaguguauuuguaaguuccuuuguuugcuuccccacgucgaucuaaaagggauuuuauguagcucuuuuucuacguagguccuacuuuagauaucauuuaguacccucuccucacagggcuugagaagacauugccuugaaggggaaacugguccuuacuucauuuugaaaaugcuuccuuuucucucuucgcgugugugugugugcgugugcaugugugugugugcgugcaugugugugugugugcgcgugcaugugugugugugugugcgugcaugcguguguguguguuuggcuauagugaauacuuuaaguugccugaaauuaaggaauaauuaucauccauaaaagcacugaaggaaacaguggcagcaaguagggaauucauaaaugcauguugaagcauucuuuuuaaaacugugguaaaauuuacaaaacaaaauuuaccauuacaaucaucuuaaaguguauaauuuggugacguuaauuacauucacaagguugccuaagcaucaccaccauccaucuccagaacuuuuucaguaucuggaucagaaucucuauacccauuaaacaauaacugcuucccgcagccccuggcagccagcauucuacuuucugucugugaaucugaccacucgagaugucucauguaaguggaaucauacagucuuugucuuuuugugucuggcuuauuuugcuuagcagaauguuuuccagguccacccauguuguagcaugcaucagagcuucauuccucuguaagacugaguaauauuccuagauuguguucguccauucaucuguugguagauacugggauucuuauuaauuuggcuauugugaauaaggcugcugugaucauugguauaaaaguaucuguuugagucccugcuuucaguuauuucaauucuguagaauggcugggucauacgguaauccuauguuuaacauuugaagaaccaccaaauuguuuuccauagcuguaccauuuugcauccccaucagcaaugcacaccgguuccagcuucuccacaccuuuuaccaacauuuguuauuauuaucuuuuuguuuugauagggccacccuaauagguaugaagugguagcucacgaugguuuugauuugcauuucccugguaauuaaugaugcugagcaucacuucaugugcuccuagccauuuguauaucuucuuaggaggaaugucuauucaagggcuuucuucauuuuugauuuuguuguuguugagcuguagguuugagucauucauuuugugguuuugaaaaugacacacuaguaagucugaaaaacuaagcuucuccccauuacaguauauguagcauguggcaaaaaguucuguuuuagaauuuugagaugcugugaagcugaugaagcacacuuugaggaauuaacuuaggcuggagugaaguaaaucagagcgcauggguaagugagaaucagauagaaucucgcaccaugcuggaauugggaguuucuguagcaacgauugccugccccuucccuucauuuuuucagcuggagaaaucaaguaaccugcucaguguauuguagccagguuaaguacuuaguauguuuuguugaacugugcaguaaauaauuauuuuuuuucuguuguauuuugaauccagaaaugucuugugagaggagaaauagcagugcuugaauaugguaguggauuuauccucgcggcugcccuugugguagccucucugcuugggacucggauaugguagugaauuuaucauugcggcugcucugucugcuugggacucaugaaaaaagccuuagaguucuucacuucugugguauuucaggauaaagauuaguaaaaacagccucagaguaacauuuggggacuuaagaauuuaaauauaauccauucaaucaugguucaauaguauuacugaguggaugaaaaaaaaauauugccguaauaacagaucuguuaaguaaaauggauaaaagcauuuguguauuuauugugaauuguugacagcaggagaagccauucauuuguucuuacaagagccauaguagauaaagaaauucagugaaauaucacaacuguauggaagcaaauucauuguugguuuaguuuuauguccugcggaaauuuuucguuuugcugaauccuuuugaagaguugaacuuuauugaaaacuauagccuggcaaggucauguguggauuauaacugaguuguaaauaauuggaagaagaugcauaauauaugugagaaacagagaaauaauauauguguugugaagcagagugguaagaggaguugcaaaaauuuuuauucucuucaggcuuggggcaacgauuuuaaaaauccuuaaaauuaguuuuaaguacugugaaaacaaacaugauaaugaugaaauuaaauugaagacucucuucuacaaacaaauaucuuaaauaaaacccucagaggaagucauuccuucagcagacaauuuugaacagcugugugugaagcccuaugcugcgaagauguaagguugaaaauuucagauccaugcucucaaagagcuuaucauuugguuagagagacaagcagguaaauaaccauuccuggucaugaaaagaacgaaagaugggcuucauggaagcacagcaagccaaaggcuaagggagagaagaggaagaagcaguaucuucuuuuuauucuuuuuaauuuacuggagcuacccaucaugaacuaagaauuacgucuuugaccagagaaacuggggcgugccucaccacugacuucugacuggccggaaggagggaggcaaugucaucugguggccagugggugagcagggcauuuuugguugaaagaacagcaagagcaaagacaugaaggguugacaguuucuuccguuccuggugcauggaccacucuccaggguggcuggaacaaacagaugaaggagggagugucagagccaguuccugguggccacaaauaucucacucagugcauguguuccuguuucccaguaaggaaggguuuuguuccgaggauacagccagcuuuuuucuuuuuuuuuuggaagguuuuugaggauuuggaacauuuuccccugugcauuucagaaaaugauagcuaaugacuguuagcagcagggcgugucgcagcugugcaccugcagcguuggagaggagcucugaggcgugugcauuuguagucugcgguccauugcgggaaggacuggguugugccuuugauaauagccaggccugucuuugaggugcuuuuauauaaguuucuaagaggaaaugaugaauagguacaaaaauauuuuuuguacucucuuuuguuuguuuugaauugguuuguaaagagagugauuauaguaaguuuauaauccucaagugaggaggaauuaaagacaguuggcucaaauucagguaagaaacccaaguuagagaaucaaggauaauggcaagacccccagaaacaaugccuucauagggcagaaguuaggacagggcuuccuauccgcccagaguguccccaggucuuccgagugacgucacgccgggccacagaagggcugggcgaacaccucaggugcaaaccuuagccagugggacucaggaacuggagggagccccagagcugcccgugccauauugaggcuucuucccugcauugggaccacauggaugauccaggaaaauuccccucugucaaggucaacagacaaccuuuaaaucaccugccuccuuaauucccauuugucacauaacacagucuauucacaggucgcagaggcuagcgugugggauacuugggaggcauuauuccaccuguaucauguguuaaccaaaccaccucacacucuucauccgacgcagcuacagaguguuuggggagauguggccaucaggugccgaggcccucacagcuggggugaccggcugccuugauggcauugacuggauguuugccggacucuucacuucccuggggcgauaaauuggaagauguuauucaaaggccuagauauuccugugguuuauuucaguauuucaccgucuccacuguauuaucacuaacugccguguuugaaccgguuguauguuguggagggccgagccacaggacucgcguagacucgguacccucaguacguguuggcugaauucaguugcagugacugacuugguccuccaauuguuauuugcuguccagacacagaggcgccugcaggacauuggugccccugggcucaggcacccgguuucccgguagggagggcggaccgggccgcaggaaagcgcgucagccgggugugugcccuggcuggaccgagggguuuccuccgcucagucggcagggacccucgcugaggugcgaggacacauggcugacucugaacucgcagcuucagggaaaccuuccagcaguuucuccaccgcggcucucacguuccccguggcgcagcuucuucguaucaccaauggcucggacacgcgggcgccaccccucucuugcccuugucguuguucuuccuuuuguugggaauguucuuucuucccuuccaccugaggaucccuuggcuuccaggcccaguucagaugcccccucuucuaggaagccuuccagaguccucucuucuggguuuuuacauaaaauauuaaaacuuccccauaggccuuugaaaaaaauucaucuauuugaagugcagagucacauuuuugugaggcgaaugaacuaaugggggugagucugaugcagagagggaacucgaacccagugugucagacgcccgugaucagugugaucagugauggugggugugcggccgcagggcaggcacccacuccggugugcucuuccuggcaggcuucgagucucaccuccgggacaccacgucuugcuugaaagcuugcuuuaacacugacgugcccaccuucgucuuugcaggguaaguccuuugaggccagagaucaugucuucaucaucuuuguauacuccacagagcuuuagauaaugcuuggcacacagcgauuuucaugcgguuggcucgggguaagguuuuuggaaugaaaaguugaaccaacguaauucaaaaguguauuaacauccuuagccggauucacccggaaaauggcauguaaauaguaaaauuuuuuuuuagguugcaugcuuuuuguagucauuuuauuuccuuugcuuaucauuuguucauaaguuuauccaucacaacguauaguuaauaucauccgccuuauccuccucagcccuugcccucagugaguuuuccaggagggauucauccacuuucuuaucaaugagugauuacuacaugucauuaugugcaagcuacugugcucgguauuuugggaugagugagaugggacuccuccucacaggacuuuauacagagauaagcccguugccaaguaccugaagcuguaagcuuugguugcaucagaagguggaaggaggcugagugcgguggcucaugccuguaaucccagcgcuuugggaggcugagaugggaggaucacuugaggccaggagguugagaccagccugggcaacauggggagacgccuuucucuacaaaaaaaaaaaaaaaaaaaaaaagaagaagaaggaagggagggggaggggagggagagggagggaagggggaggggaggggaggaagaagaaaggaaucagugggauaagagguuagaagaagaagguggagggaaucagugggaacaagagguuagaaaggugggauggggaugaauuaugguggccaggaguccagauuuuauucaaugggcguuguggaaccauggaaggauuuucugcaaggucaggagccauuuggggagauuaaucuggccaagaaugugcaggguggagaauaugcuucuauuacagaagguggacccuggacaucgucuugcuccuuguggaacacugacuuagucacugcaguuagguggagcacgggcccuacuguuuggaauuucuuuggggaagucuuaggggagaccaaggaaaucucaccucauacuuuuccuccuaacauaaacuagccuuuaucuguuucuucucacgguagcucugcuaaguugcuauuaagaucucuguuuagugaugaggaaacuauggcuuggcgaaguugaagguugugaguggugagguuccaguucaggugugcuugacgccaaaucugagcucccacuaccauauuaugcuuuaacaaggagagggaaagaaaagaaaucauugugguccugggagggguuggcagagaggggaaauagugaccauccaauggaugccagauccgacccucccaccucuggcuaccauucggaaacuggugagaggcaguagguaucuuccaaaaauauuugaagacaguucugcagcuugcagaggagacauggauucuugcuucggagguauuccuguacuuagagugguagcaauuuuggcucuuuuuccaguuggaauucauugguaauugggaugguuuaucccaggaauagaaucaaacuagcggaaacuguagugcguaaguuuauaguuugugugcuggagcuugaccagauuugaacauaaagaguuaaauuggaugucuccauaauaauuaauaauaauaacaccaagaauagcugguaaccuuuauggagagcucccuggcagaggggacagcuuaaaggaaauccucaaaggaaaaguggcagcaagaagcagauccugagggccagccuguggauguggagugugggaggaaaucauuuacucucauccaggggaaaagauagugcccuucaaaucaaccuuucagaacagguuauuuucaggcaacugguuuuugggaaggcguugguuuucaagguagucugcuagugaugugauugaagucagaaagcagcaauuuuguugcucuaugcaaauagguuuucuuagguuccaguuccaguaugcuggcucuuugaguuucuguuauuugacuuuucacaaauacugaccacauugacaucuccucucucuuguccccuugucuuuucuguguuccugaaggggcaaaacacaccuuuugaggucuguggagcucaaaaaugaagucaaaggugacugggugacacaaacagcucagguaauucagguccugccguuucugccacgcuccuccuccucaagccagcauggcucaguuauccacucugaugucuacccuuuucccacgugccuccucuuauugaacuuguucucuauacuguuacgucuccagugucugcaucagaggacugagaggucuuuuccggcuugcauacugcaggcugacacagucuuaaaggaacuuccuacugcacucugaggaggaggagcugugccuucucgaggucauguuacuucuccuguacugcaaaggcagugcucagaggacgugcugauuaagggaaauauaggaucacuucuuuucccguuuuccauauggaaagaagcuuugaaaaugcaguaugugcucgaguccauaugcuuugaaaucugugcaugauucuugcuuugcugaauugcagaggcugaugccaucuagaugcugcgacccagggccaaacacaccuaagggucccagcaugaguuucaauuuauaaaauacuuuuaaaagucagucuacccuuuuaggucuuaauggccuugcauaaauuuuucuagaaaaugcucuuuaaaaaaaugauggaguaaaaaauacucuuagauuuucauaauuuaaauguaucuggaagguaauuuaucugcaauucacaguuuucucauguugucuguuuuuuacagaaaagaauauuacauguguaucugcaucagauuucaagaucauuguaguuuuuucuuuuuuuaauuuuaagacagcauguuucacacaugauuagauuacuugggaagcauuccuagaagugacauggcuggguccaaggguguaguuuuaaaauuuuuaauaccuuggccaagcugcuguuuggaaauuuuguaccuauuuuauacucccauagugcauguaagaugcaaaacacuauucuagauauuuuacauguuuauuugcuuuuuucuucucucucuauuucuucuuucuuucuuucccuuuuuuuuuuuuuuuuuuuuuuuuugagacaggguccugcucuguugcucaugcugggguguaguggcaugaucauagcucacugcagccucuaccuccugggcucaaaugaaccuccugcuucggccucccaaagugcugggauuacaggugugagccaccgcauugccuuauuuuacaugcuucuucauuuaauccucacaaagccugaugagaacagagaaggucaguaaccugcccaaagucacagcuaaaugauagagcugggggcgaaagcaggcagugccgcagagcuccacgguccauguuguugcugcgcccggucugcacuuccauggcagccggcaugagaacaugagcaaagagaggcugugaugagacuccuuccuucugggagccucuggauauggcuauggccucgucuuucacucugcuucuugauucaucagguaggacaggugcagaaugcuuuuccugggccgaagccuauggucuucgcauucuuugugcagcgguauaauuuggaaagaagcaauggucacuuuggagagccagccccuuugcucagcucuccugugccccugugcugcugucguugccccugucaccucugccagcaucauuucccaugacugcagugcuggggggacuugggccuggccugggucccuacaucaccugaggagggucuccaaauagaggugugaagguuuuacagagauuguguagggauuucaggcuuuaaacccuugcuugucuuugcugcugcauuuggugugagagauugcaaaaaauguguauguuuuuauuggugcaacccuagggucauacagggucaaaaggcuuccucuuuuaggaagagucccagacagcugcuaacuuaucuucuuguuccaucccuguuuaugggggauuuguauuuuuaauugccuuucacucugaacaaagacugagcaagcagaaaguguugggaagggccccagggaacauucuggcuuguguuuucuuucugaucugugggccugggggacuucaauguucacuuuccugacaggaggagacaaccauaggaacuagugugguguccagugccagcuggggaaggaaaccaguuuccuagcauuuauguuucaggaucaauggcacauguagaaaaauacuauaucccagggguucuauauuaccaagaauaccccugaagaugaagcccauuuuuggauccucaguucucaugauaauggaguuugaugaccuagagucagcuuuggcaugggcuaagccagagcacccuuuuaaaaugaggauaguaaugagaacgaccccaugggguuacugugaggguuaaaugagauaauguauagaguuuaaugcugagugcaucaugggugcccagugaauagucauugcucucacaauccccaccaccacuauuaucucccuagacaucaggagaacaauuuugugaagcaacuuuggacuuuugcauguauauauuuauaaacaauucagugccugcaaauguagaagcugauuuaaguaccuuggcccuuaugguaggaaggucucuggggccccuucaccuugacccucuuuaccuuuagaguuucuucuuucuucacacuuucaugaggaaguaugugccucuuugaacugaauuucuacccaaguaccauggaaucuaaacaguucagugcuuuucaacuucucacguugcauaauauuugccauuugauucaaaauuacgugauaaaagaaauggaggagguaaacuugccagacaauuccugugucuguuuuugcauuugugcuucuggguauuuagucuuuucgguuugcaccagggcuuccguggaggaggagggcaugugaaauggagcaguugcuuacguacuggucucaguggacgguguggaugucauucauagggcaugcacagcaacaaacaaacaaacaaacaaaugccauuuaacgugauccuuggaaagguauuuuuauaauaacuuuaguuuuuaaaucaaauauuuagaaugucauggagaaagaacaaugauauuacaaaugccaucauaaaggaaccuuagggagacuauuuuaaagaaauuuugaaucuaaauauuuaaagcuuuucuuauuuuauaaguauuuuauguauuugauugguaagguaaagcacauacguauuguuagguaaacucgacuuaaaggaaauaauacuuuuaaauggcuacuuaagauuucaaauuuuauaaaaauauuuaggaaaaguauuuuuccacuuucuaauaagcagaaauaguuugcauuacauuuuuucauuucagaacuaaacagugcuauuauucacuacauuaagccuagugugugccagauuaauguguaauauaaauacaguuuaaggaaaaugaugcugauuuuucguguagcgugauaacaauaauauauuccaaagauugaaauaacuugaaaucuacugcaagccccaaaucccuuauuugcaauccaaaaugcucugaaacugaaaguuauuaucaugacucauuuggcaggauagucugcccugaauugacaugaagcuauucauagcuuuuauuuaucccaaucagugugaauguucguguuucacugcagaaauauuaacuguguuggauuaagggguucugcccuaauuacuuuccgggguguuuuguuccuugugguauaugguauguguaccgcauuaucuugcuaacauccacacacuuuugaauucugaagacuuuaucuggccccaagauuuugaauagaagacggugagccugcgucaguauaccuagccccuacaaccagaggcuucucacauccugguguuuccaggaacagucgcucuuuauaucuguuucaggugucaguauuaaugagaccccauucacauucagaagugcuccauuuuggcuuggucaccauacuaaccacauaccauaguucuugguaacggccagcgcaguguuggugaacaucaguacauuucuagugaauucccauguauaaaauaaacaagaucuacauaaacaacauuccagauuguaucuugaaaaccuaaagucauuuaaagcauuauugguaagguauccccgacugccugucuagauggcauuucccacgcauuggugcacgcuucuuuugauggcaguucauccuucuccucacugugauugccugugucccugucuucucuuucuaggcugcaagcuccuuccgucauugcguaucacugugcugggcguauauagcaaguucauuauuuagucaacuaauauuuauugagcguuggccucugccguacucugggcccugggaauagcauggugaacaaaacagaauugacuuugguccucauggagauucuugucuacagauuugggggccuggccuggugaaauggagaagguuugcugucaagugacuuugaagccaaaucugaaaaaugaguaagaguuagcuugggagaggggaugcucuugaggcugaggggugacagacgcagagacuugggacggaccccucgcuggaggcuugugggguaaggacaggcuuuaggcaguggaaugaugagagucuguuugugcuuuuggaaggguguucuggcuguagggcagagcuggguugggguugggggccgaggagagcagucugaauggcugccugguccaggcuuuguggaaggaaggaucgguucuucaccccugguuucgguuucuguucucagugugggagcuguucuuggacagugcugugugcucuucuccggaguccgaggccaggggaguaacugcaguguucagccaaguacgagcaaguggaacugacaguuguucaggcuuccgucuugcacacgucgaggaaacguuguaaacaagaaacaaaaagcaaagcccuuacuccuagugggucuucccugagccaagugcuugaaaagcugugggagugggaacuguugucaugaucgaaaaugaaacuauucugggaaugccagauuuggggcgcugggaacccugaaguguccugcagagaacuggugguggaggggccucuggaggacaaacaucuacaauuugcaaaucuaucagugacccagcgauggcacuucuggcgguuuuucuuccaccuuaacuuugaggugaggcagagugacuuggaaaccaauucugugcuuuaaaauauaaaacauaaauaacuucuauugaauuagcacagaaguuuggcuggagguaaaucuuuggcgccuaaaucugagcgcuuuucucucaaauacgcacgagagcucuuuggccgucuuauuucuccucuucuacacaacugaacaauuuaaaugaauuauggaccaucacuccucaucucccccaggaaaugaagcuuagagccuccuuguucagcuaauuguugcuugauuaagcugccccuuauggauggauagauaaagugauugaugcaugugcuuauuaauaccauccuggugcacggaggacgaauaaaccgccagcagcuucauuuaagcaccacaaaggggguuuccuagaguuuguuguauuugcagaaaggcugucgucgucuuucccucuguacuggaaauuacuuaccuacuugguauugucuuucuggccaagucguuuucuuuugagcuaauuucagacuuccaccacaguuuaacaauaguacaaagaauuauuuuucuacaucuuuggagaguaacuugccaauacugauaucccaucacuccugaguacuugaaugugucuuugcuguaacgaagauagucuccauugagacccuggcacggccaucagaaucaggaaacuagcaccgcugugugagucgccucccacccgcagacccuguuccuguuggaaugucucagucaugucccuugcagcaggagaaucugaugcagggcuagguguugaauuucggugcccugccuccuucauuauuccuugacuuccaugaacuugacacuuuugacaaugacaaggcaauuuucuuagagaauguguauccguuugggcuuguugacguuucugguuaugcauuucuuacaagaauaucacggcggugagacuuucuucuucuugcauccuuacaggugauacaugcuuuugauuugccccuuaauucguaacguucauuugaucuuuuaauuaaggagccaucagucagccuucuccaugauaaaguuagucuuuuucccuuugucauaaaaaauauuuugugggagguauuuuugaggcuauguaaguaucccauuuuucaccagccuuuuacucacugguuagcauccauugguauuucuuggcugaguacuacuuugauagcuaccaaauguugaucuucuaaguccaucauucuuccuacauuuauuuguuugcauucuacauuaugggaaagcuuuuucauuccccuauuuauuuauucguagauuccaauuuuguucaaugacagaaauacauuucagucauguauuugggugcucagauugucuuagauguggccagugggagcuccaucagguuggguucugugacuuuuuuuugacauguugcuauuaucuuuugagcccuuccuuauuuccuuucccaggcuuaucuuuugcuuucccugccccagcucuggagucagccauuucuccaaggagcccugauuccuuuugguggaggaugguguuuggaaaccaagauuugugcacugccugugcucauugcuguuggggucuugcuguucccaggcccuuuuagugucaagguuagagaauauguguauuaguugcauauauacuuacacauaugcaugcuuuuuuuguuuuuuuugagacggagucuugcucugucgcccaggcuggagugcaauggcgcgaucuuggcucacugcaagcuccacuuccuggguucaagcaauucucccugccucagccucccgaguagcugggacuacaggugcccgucaccacgccuggcuaauuuuuuuuuuauuuuuaguagagacgggguuucaccguguuagccgggguggucucgaucuccugaccucgugauccguccgccuccuaugcaugcuuuuuuaccucuguauuuauuucuguguuuauugagauauaugaaaaagcacaaauucaaaucaaguccuccuauucuagugccacagccuggguuauuguaguuuucuuucuuucuguaucuguaacuuccuucuccaguagucaaaagccucacuuccauuacccugguauauaauauaauuuacucaguugccuguguguauguggucuuauguccccacgguugccccaccacaaugacgaugcccuccucaccucccuguucuggcucccagccccugcacagggcuguggucucccuccugugucuauccucacugcccacaugggcuuuuguauucugugugccagguggcugcugccccagccacccuaacaggugcucucuuucugccaauaccuacccuggcugcaccugccccucuaccccuagugucuacucuauuaguuuccuguggcugccauaacaaauuaccgcaaacugggaagcaugaaacaacagaaauuuauucccucacaguuuugaaggccaaaaguuggcaauuaagguaugggcaggguugguuccuauuggggacccugagcgggaaucugcaccaugccucucuccuaccuucugguggcugcuagcaauccuuggcuuucuuuggcuuauggaggagucacucuaaugccugccucugucuucauacaacauucuccuuucuucuaugugugucuguguccaaguuucccucuucuuaaaaggacaccagucauauuggauuuagggcccauucuaaucugguaugaccucguuuaacuugauuauaucugcacagacuccauaugcagaaaaggucacauucacaggcuccagguggacacgaauguuggggggccacuguucaacccaguacaucuucuuugcugcguugcaucaaaugggcuuuuggaguaaaucauucauaaaggaaggguggaggaaggaagggaagaaggaaacucaguuguuuugagaagaauguucucuauuacuguauuguucuucuucuucuucuuuuuuuuuuuuuugugauggagucucacucugucgcccagguuggagugcaguggcaugaucucaauucacuguaaccucugccuccaggguucaagcgauucuccugacucagccucuugaguagcugagauuacaggcacacaccaccaugcccagcuaauuuauauaaauuuuaguagagaugggcuuucaccauguugaccaggcugguguugaucucuugagcucacguaauccgccugccuuggccucccaaagugcugggauuacaggugugagccacugugccuggccuauuguucuuauuuucucaucuaaaauuagggcacccugcugacaucaggacagucuuggaaaacucaggacuuaagagugagcacaggauggcacuuagugugaugacacugggcuguucaggaaacacguucaccuucuguucugugccaacccgggguuggggcacacccccgccccccagaggcccaguuccaggucaaacaacugucucuuggugcauguugucagcccggcgcaugcucugaguucuguaagggugagugaacggggaacucugacugucauuggugcugugggggaagagagcagcgugucagcacguggacucagcuggggacucauggggaagccaccaugguacggcagggccuggaaguuugcgcgugguccuugauugcccugaugguuaaaaccaccugcuccccgacuuuuuucacauuaugcucugugcauuccugcacaaauuaaauauucuagacaguaguucucccuuaucugugguuuugcuuuuagugguuacaguuacccauggucaacugaggucugaaaauauuaaaugggaaauuccagaaauaaacaauucauaaguuuuaaauugugcacuguugcaaguagcaugauggaauguaacaucccaccucuuccugcccaggacauaaaucaucccuuuguugagaugagggaaucugcuguagucccaauacucuauuauuugacucuauuacauuuucuuuaaacaucuucccacugucugguauuuggguuaguuuugcuauauaaauaaugcucuuugaacaauguugaccauaaauuugugucugcagaaacuauuauuuguuaaauaucaacuauugauggaucagguacuaggcuaggcauguuacacaucuuauuuaauccuuaccgcaaaccaugcggaaguuaucccauuuuacagaggagaaaacugaggcauagggucuuggguucuguuaccuucugcguuugguuccugaagcagugcccugggaaguggcuauaguugccggauggagaccugaauggcuucuacaguuguggagauggugaccagcaccaggggauuucugaauuuuuggggcaauggcuuguugauuucucauuuaaggucucauuuuuaucacuauacuguauaugagauaagguuccucuccucaucucauauacaguauagugauaaaaaagcgucacuagccaaggcuggcuccugcccacuugucauggauaugggagccgccgaggucuucccuggucucugcccugcccuuagggggcugugcuguccuggagucauguggcugucagaccucgggugucauccugaguccugcauugcagcugccauccuacuccaugaugaauaaggguaggccuaugaagggccuaaucacuuauuaggaauuugcauguugccaaauuaauaagcuaagggucagacaugauugaucaccauuaauacccaaaccauuuccuagggcugucaucucagcaggaguuguggucauagaugagcuuacacuggcuagggaaagcuuucugggauggguggauuuaaaacugucuccuggauuucucaaagaacuaaaaauagaacugccauucaacccagcaauuccauuacuggguauauacugaaaggaaaagaaaucauucuagcaaaagauaccuguacuuuuauguuuauugcaacacuauucacaauagcaaagauauggacuuaaccuagguccucaucagcaguggaccggauaaagaaaauaugguauauauacacuauggaauacuaugcagccauaaaaacaaugaaaucauucacaauaagaagcauggagcuggaggucauuaucuuaaaugaauuaacacagaaucagaaaaccaaauacuaccacauguucucacuuauaagacggagcuaaacacugaguacacauggacaugaggaugggaacaagaaacagugaggauuccagaaggggagagagaggaaguagggcaaggguugaaaaacuaccuauuggguacuauguucacuacuuggacagcaggaucauuaggagcccaaaccccaguaucauugcaauauacccauguaacaaaccugcacagguaccccugaauuuaaaacugaaagcaaaaacaaaaacaaccuguaaucccagcacuuugagaagcugagguggguggaucagcugaggucaggaguuugagaccagccuggccaacauggugaaaccccaucucuacuaaaaaugcaaaaauucaccgggcaagguggcacgugccuguaaucccagcuacacaggaggcugaggcaggagaaucgcuugaaccugggaggcggagggugcagugagcagagaucgugccauugcacuccagccugggugacaagagugagacucugucucaaacaaaacaaaacaaccccucccaccccgcugcccccaccacccccacccccacccccacaaaguuaucuucugaagaccaagagagaaguacuugguaucaagugguaaaaaacaaacagggcugagagauuuaaguagguuggagaaaggaguuuuggggcacaggguuuuuguacuucuuggagguccugauacuaaaaaugaggucauuuuuagagugggaagcaaaacggccccauaacgaaguguuugcucuucauaugcacugaaacggcaggagguggaaauugacaaauauugaggaugcuuacuaguucacugguuuucagcaccuuaaauaaauguuaaugugaaauuaacauuaagauaguggcgcguuugucuucuaugggacuuacuugugcuucugaaauaguucuucagguuaaucgguuaugggcugggcagggcacacuuuccuccccuucugccuucaaaagacccuggaagcacccagguggcccugcuuuauggcagaagcagcaacuaaaaugaaacaacugauucaucugcauccaggugaugcaaagccaggaaaaagccccucugguucucucuuguuuccuuaaagagagcauggaggugaagggguggagagagggcgaguaucuuuauuuuggaguaugggaguguuuuccuaguccggacuacaaaaggaaagcucggguuggccaggaaacgcagcauguuuuguugaugcccacucgcugggaaaguauuaaauggggcaggaagugugacuuuggaaggggcugcauaaaggaggcugggaaacugcuuccugugcacccgggccagcucaggagcuggaacgauguuuggcaggcuguggggaucuugcugcccuggcuguguccccuuccacacaggcucccagugcagaugccaggucagacggagguguggggcccucucuaccucuugaugugaaccccaguuuggccugccugugcgagccucauauccaaaugcuaagucagggccuaagacuccaguucaaauaugaguucuaccacucaguagcucugugaccuugggaaguuacuuaaccuuacgugccucaguuucuucaucuauaaaauggggaccacaguaguacccacguucuugggaugcugugaaucaggugagcuuauccucuuaacgugcuuagaacuugccuaacacugcuaagcgcuuaauacuccuuagcuauuguuaauacccucaugguggaggauauugacaacauccugguaagugggacacucccugcuggccagcugguaucauuuucaaggguuugcaggucuagaucuggaugaggcaguuacucacagaaaagcucccuugcuuaccaacagguuguguuccaaaggugauuaaguuugcagagugugcaucaggcuuuuuaaaacuaagcuuuucccaaaacaaagcuguuucaguagcaggaacauuacaggggugucacgagcagguauuuucuuuccaccagacaccugaccacucacugugauuuggaaagauuagaaccggccgggaaacgauguuuccaucuuugaugacaaagcuuuccucauucaugguagccacauuucagguauucaggagccaccuuguugacugcccugauaaauaacaaguuaauaguugcaaaaugucuacuggauagugcuggucuacauucauuggguguuugcugggugcagaguacaaggccuauuuaggccuaaggagcguuggucucaguggauuaaagcacaucacaaugaaccagugacuuuaggacaguguaagaugcgugcuaacucacuguuagaggcagugaguuuuaugacuucaagggaagggggcauguaugugucuuguguuggccaggccaaguauuguggaaaagagacauuugaacaaucuuucaagguauggcgagacguuuccaggcuaggccuuucuccugagcuccagccucgcacagcuaguagcccagccaucaccucuuuuuggguaucccagagaucuccaacccuguaggccccaaaccacucucaguaucucuccucaaacaucccacaucuucuguugcagaguggcacucccacccaucuagucuaagaaagggaaaaaggucacacccaagugaguaugaagagggaggcgagguagacauucagaaagaagagccucgcagaucucuuuucucugugaagcuggaggcagggagggaucugaaauugcaccuguggaaaaugggaacaggaccuggggagaagaaagcaaaaaagaucugcagaggcagagacucugagagcucagaugaggcgaucagccgcccaucugcugcgagguucuccagccucucacaaauguuugcagugugagcaaacaagacggaggcaugaaggcccguuuguagugggaaaguggccaggccacugugugggaaggagaauggggccggggaggccccuggagcuggaaucccauguuaacguugcugcccacguuaauauauaagccuacguagucuuguacucucacccagcagacacgcaguaaguauaggccuccgcuguguggaauguggaaguggauugaagggaggguggccgggacagggacgcugcagcagcucggggcagagcggagagccccugaacaggcugccgcgggagcauggaaggaggccguggguaauggggauggucugacagauggagacugcaccccuugguggcugacauggcaaugggugggagggccagggaaguggcuacugagccagggaaagucaagaaaaugucagcagagaggucuagcugcuuucccauucguguucuugcacuguguuucuuacaucugccuagggaacugcccuuugagaguuuguggggaccuuucucagaaaaguacacaucugggugaacguuaacacacugcauguauuuuuaaggcuugaucucuggacgaagagcugcuguucuuguuaggcugcauugagaacuguuuucuagagugaccacugggucaucugcagaaccaagaaccagugauagacaggugacuuuugugcacacacacauaggggccccaagucaguuugcucgauuaugguucggaugcagcacacauuucagguaccagaggagucuguggucagagacaagguaaauuuuauaaagcagcuaugggaauagcuuccgaaaggauauagaaaacgugccuaauaggaaaauugugcauagaauggcaaauauguaaaacuguaaucuggaugauuuucagccuggaaaacuaguuuugugguauuugaaagcauuuuagacuuuugauuucauauacguuucuauuccauuaaugaugaaaucuauucaccacuggccuccuguuuucccaugacucaacuggagauguuuauuaaacaucuggaaucuggaaguccauuggguuaauggauacuaaauaacagugauuuucauacuuaauugcuuaucaaaauuauucuaggauaauaaaaaaaauucccgguucuuauuagaguggggccagggaccuuuuuuuuuuuuuuaaguacccccgcuccgccccgcuuuuuuuuuuuuuuuuuuaaaguuuuaagguaauagcauugcaaggcaguuuugggauaguggcaugaacagaacagaaaagaauaaagguggguuaugauguauuuggaguagcaguccugccucaucauucauccugaaaaaucuacguaguaggagaauuggugguugaauugcuugaaaccuuaugaggaagacuggcuggagacucccauucuuaaaugaaccuaugacuuucuaaaguucaacaaaacauaaaaaucaguuuugcauuggugcagauaauauguacacugagaggcaugguuuuuuccguaucuagcccuccauccaaacguuaaacgucuuucugauuucaggacuggcaauggcugacuucagccgucagggucccaugagagucuggagagugauuugaaugucgcaggcagagcaggaggaagcguggccgcauaggaaggucucaggccaugcuuccucucucauauaggggguccuguuaucuuugcuccgaacauacuauuuucaugccaugaaguucuuguacauuuuauuucuaccucuuagcagucaguacagcucuuaggguaugcuucuccuuguuucccuguuucuacaaaaauguuaaaaauauuaggccaggcgcggggcucacgccugugaucccaggacuuugggaggccaaggcaggcgaaucacauauccucuucugcauucuacuucccacagugcccccucccucucucugccguccacaugcucgcacacaccugcacacacacugucgggaggcaguccagccuagugcaauguuuuuauaccccuucaaccccaggaccaguauaauauaaugugacauuaaauggaagcaaacguuucauaaaacaaugcuuaccucacuuuguucggggugcucccucauuuuccauucuaucauauuguaaauuaaaauuaaguuaaaagugcugaucuuaaugcaacaaaugaucccacgacccucugguggguuguuagcagagacuugcaaaacacaggucuagagguuucuggcauauucuuuggagucagacggauguagauuugaauguuugcuuuaccacuuaauggcuguaaguggagcuuuguaaguagcuucauuuccucaucuguagaauggagaguagcuacucugccucauguggcuuguuggaagauuaagugaaauaacgcaugaaaggcauuugggcugagggucaggcucuaguuagggcuggaaugguauuaaugauggggaugaugaugaugauguucaacuucuaacuccagcuuucaauuuacauaacuuucauggaaauucuuacuuuugcugaaaaagcacacagaagucguugugaggaacuugcaggaggaacuugcauuugggaaaagacuauugugugcccaggaaaaauuacuacuaaacacugcuguuagauuccuauacgcgugucaucguguguguggguuuuuuuuuuuuuuuuuguacguuccaauagccacuguccugacccagagcaguaguucuagcucaccuccuucccuccauuuggcucuguauagagugcugcaugacucgugaaacugaagcauggcuuuucccaagucgugcacucagaagucauuauagcagccugcguaaacaagcucagacucuagcugggcaucugagacccuccugagguucaaguccugccuccucaucuagaggcgugggugacuuagacauuuucuuuucuuucuuauuucuucuucuuauuuuuugugggggcugccuuuuuggcuaugcuuuuccuaaucucuaaaaugaugauaauaggcugggcacggugacuuaugccucuaaccuuagcaguuugggagguugaaguaggaggaucacuugaggccaggaguucaaaccaacccgggcaacauagguagugaaaccccuguuucuacaaaaauauuuuaaaaaauuaggccaggcgcgguggcucaugccuguaaucccaggacuuugggaggccaaagcagguggaucaucaggucaagaguucaagaccagccugaccaacauggugaaaccccgucucgacuaaaaauacaaaaaaauuagcugggcgugguggcgcaugccuguaaucucagcuacucaggagacugaggcaggagaauugcuugaacccgggaggcagagguugcagugagccaagauugcacgacuauacucuagccugggugacagagcgagacuccaucucaaaaaacccgaaaaacaaaaaauuagcuggguguaguggaugcaccuguaguccuggguacuugagaggcugaggugagaggcucucuugaacccaggaagucaggacuguagugagcuaggauugcaccacugcacucuagucugggugacagagugagaccugucucaaaaauaaaaugaaaaaauaaaauggggauacuaguauuuaacugguuagagcuguuaugagaguuaaagaugauugaugugaaauacccagugcuugcuucucacacaccagugacucuuaugaagacaccccuguuggugcauaagacaguugcucugcucacaucagcaaacacaucuucaguccugcuuuggccgccgauaccaaccuuuuaccuccccuggcuugccugccaccuucucccugccuagacagcaccuccccauccauuaaggucuuccuuuaccauaaagcuuuccuuugccauaaagcuuucucuuauaugcccauuuaacaaugauuuauguauuccuuaugaacuaccuaacuuaguuggcaauuaauaauacacuaccuucugaucuuuauugcauagucuuuuauuauuauaauuauaggauuauuaguuagcuuuaugugauuuaucucucacauccucaguuaacuuauuuguuccuugaggguagugaucaugucuuaccgucuuugaaucccccacagcacucagcacaguuccuuguaacaauguguguuuaaugaauuuuugcugauccauugggugacuggguaauaagaaaaggcguuccauggccgggcgcaguggcucacgccuguaaucccagcacuuugggaggccaaagugggcggaucacgaggucaagagauugagaucauccuggccaacaugaugaaacccugucucuacugagaauacaaaaauuagcugggcaugguggugggcaccuguagucccagcuacuccggaggcugaggcaggagaauugcuugaaccugggaggcagagguugcagugagucgaguucgagccacugcacuccagcccaacgacagagcgagacucugucucaaaaaaaaaaagaaaaaagaaaaagaaaaagaaaaaagaaaagcuccagagauaauaugaauccuaggguaauguuauguuccucaagaucugauuucuauuuacuuuugguaguuccaggucauuuucauuagaucagggauugagaugauucaaagcugggcuucagccuuugauauuaguuuauuucuacuuaguuguauuacuuacaaagcuugugaggguguuuccaggaaccccuuuuccuagcugcauccugauguucaauuuuugucuccucagucaccugagugugucaaaagcucugcuuucaaagccccacagccuccucuucagaaaggagcagcugucccugcgcuaggacgacagcagcccuaaaugucagguucaccuuccuggguuucuuuuucuccuagaucuugccccccuaauuuuuaacuaccuuguuagcucucugaugcauuuaaauggauuuuaaaaauauauuuuguccauguuucuuaguuauucagccugggagucaggucugaauuaccuacuguaccauuaccagaagcaccaccccccucucagcuaaggaauuuauuaccuuaaauccagcaggcacauuuagaagucucuggaacagagaauuaacaugauuaaaugguauuuuaggaagaugacugucagugguuugcaagacggagaggaguuuggaaagucucaguaaguagaacaauuaagaggucuucauaacucagugcuuucuaaaguacgaugaaggcagagguuagaguggauaagccuggguguuucacguuagauaggccugaauuuaaaugagagucuuggcucuccacuuacuagcagguaauaaaggauaauaaagucccuauguccuaggguuguaaggguuaaauggcaaaacuuguagaaaacccuagguuuuuuauuuucuauuuuuagagaggggcugucuuucugccacccaggcuggaaugcaguggugugaucauggcucacugcagccucgaacuccuggcuucaagugauugucccaccucagccucccaaggagcugaaaagacaggugugucccaccacaccuagcaagaaaacccuaguuuuaaugcccagcacauaguaggugcucuguaaaugguaaccguugcucuuacuauuccaagaaccaaaauucaguuauuugggugaaaauucaaccucacuguuaauagcacuaaucauggauaguacugucaacuucaugggggaucauucgugacuuacgaaucacaaugaauagcuugcaugccuuauauagcaggcuuggcaccagugauauucucaguacccaccaugggcugaauugacuuauggccagaugccacaguuuugaagccagucccagccucaaaucucaaagguguaaagguagaugauuuuacaacgugccuuucgucaggcuccaggguagaugcuucaacucuuuuacuuacuuugaaguacagguugcucauauauuagguuugcagaaccauaaaauuuuagcauuuuacuucuaaaaacaaccugaugugcaagaagagaagcuuacagaaaaaaaaacaucagauuaugauucaucguaucauggauaaccccaggaaucaucuguuuaaaacgucccauuuuucuagaugaucaaagugugggccgggaagauggagggauuagcccaaggacacacaccagcaauggcagagucaaggucgcgacacaauguccugauuucugugcauuuugguucuuagacaaacauagccgcucugugucaucuccacugagcuaccugccuucucuaacucuguucgagguucacguggccugacuguuagcgccugugggaggcuugccuuacagaaagaccagcgugucaccuugacuuucgauaauggaagcuagacgauacauaccgaguaagcaucuuucuuuccaguccucaguccucugacccucugugccugucaucucagucuuuuaaucuccggaaacauaauuaaucuguuuauaguguccaacuaaaugauccguuucuggugcuaggcuugagguagauucugccuuugcuguuuuucacagaaguaaagauguacgcucacccucggcuagucgugagaaaccugugucaaauggcaaacuuuguaccgugucgcgaggcaagcgcacugguaaugcacuaccugcccagggcgugggagaugggucaggggagaaaaaucaagucacaaaggagaagggccuucaugugacuggguuagcuuuucauugagucucauuggagauguccuagcuacaaacaaaccaaccaaccaaccaacccaagcaaacaaaaccugaaauaaguguagcccuuuuuaaguuuauuuuuuacucugaugaaauacuuguucgauuuuuugcuuuuucuaaaaguuaccuauaauuaguaacaguccugauugaagauugugaacuuuucuaauaaguuugcgguuuggcugagcugcauccuuacuagacaggcauguugcguaagugaggaaugcacccagccgguggaugacaagcccggcacgccgaccaguggaggagucuaucagaauggccaaaaugaccacacggcaggagcaugggagagccaggccauugagcaugaacaauaaggggacucuagagcuuugcuucucagagugugacccaaggaccuaggggcuugucagagaugcagaccacagcggucgccuggaauccacugacuugggauuccugugcacguucaaguuggcgaagcgcuggauuucaggauuucacacucagcucuucccuuuacguuggccaaacugacccuaucauucuuuugcuaaaauccuucgguuuccucuucagucuuagaucguggucaugaccaaaauccuaggcauggucuucugggugagccgggucucugggcccucccugucacugacugcuguccacaggggccaccuugccucagggccuuugcagcucucccuucucuguugguugcucagggcugccguaacagauggcucucacacaacagaaauguauuccaucacaauucuggaggucagaagucucagaucaaggcaucaguagggcccugcucugccucaagggucuuggggagaauccuuccuugccucuuccagcuucugguggcuccaggcaugguuagcugcagcagccucacugcagucucugccuuuggcuucacgugcccauccucccucugugucugugucuucacgcggcauucuucucugugucuguguccacacuucccucuucuuauaaggacaucggguuccugcgagcuacuggucacaauauuuugucagcugaucauuguauaaccuugucuuauguguuucuguuugaagacacccucuguaauauuuauuguugauugaugagcauugaacucacagcacuauaaugcaugccugagcaaagcuuaucuaauauacguauuuucccuguaaggcgcaucauagccuucugguucuuaggaacccgggaaggcacuucagcacaaugccugggggccauuuuaaacagcaaagucaccaaaaaaagcacaacgaugugacaaaugucgcacucuguagccugugaaaagaacacuugucugccauaggagagcaagagcgggaaggcagaguguggccuuguccagccucagcugggaacacgugcaucagaugacuugaauucagcacauguccccgagugaccaccaacgcaucugaguauugauuuggggguuguggauauauuucagugaguaggcaaauucacagauacagaaucugcgaacaguguggaucgaaugugucuucacacacaggcuuuaguuuuaaagacagaaaguuggguuuuuugucuuggugcuuugcuuuaccugacaauugacuuuuucaacuacuguuuccguuuaaaacugaucuucgcugucuuucagagagaugccugucugugagaacuuuaaaagccaucacuaauauaagaacgggaaccacugugggcuggagggggucaccugaauaggaaccauaccauauggcuuuuugaacuauuucagaugugaccauuguuuuuuuuuuuuuuucccccaacugguuauuugugagaaacauaauggaggaaauauuauauucugaguacuagcuggaggcagggccacuuccacacgccucucguguuuccauauugccaggcucaggcucagcugcagcgccagggaccacgcacagcacuucugcacgucaggcugucaggagaacuggcgucuguugcucucuacucgugaccacuauaccuaccccuauccuguaacuacucuucccucgcucuucccucuauuuucuugaccgcucuggauuuaguggucuccaaucugugucuugaggucuuuuccagagggaagaucaggcugggcugguggucaccacccuggcgggcagagcucuugcagggugagccuuugaggggucaccagugcacuccucugugcacagcuuuucccagcacucccuagucuuuucugaaacucuuuaucaucuucauggggcaugguaccucccuucuuuccaguguccuguuagguugggaguuccuagauggcagggaaugucaucuuucccuguuccuggagcaucauucucaauacaugaccuuugaauggguggaugaacaaaugaaugaauggaacaaaugaaugaaugagaccaagagcagcaguaucugcaacuccuuguggccauuccguguucuugugaaauaucucuaagguucccguuugugucucaaagaaugguggcuggagccuccauaugaguggaggaggccaaccucugacggcaccccaccuaggcccucagagccgucuucagagcuggccugggccuggcagugaguguuuccuauguggaaggcaacauuugcgcuuuguaggacuagcaaaagaccuagaagagggcggagcaugggagcucaugucuguaaucucagcacuuugggaggucaaggugggaggacugcuugagcccaggaauuugagaccagccuggguagcauagggagaccccagcucuacaaaaaauaaaaaaaaauagcugggcgugguggcucacaccuguggucccagcuacugggaggcugaggugggaaaaucgcuugagcccaggagguugaggcugcagugagcugugaucaugucacugcacucccgucugggugacagagugagacccugccuccagaaaaaaaaggugaugcucuuccugcgguagaacuuaaauuugguuaggaaaagagaguggacuauacacagcugagagguguauagguaaggcaagggauaagaugaaagacuuuacuuaaaacaacugcccuaaagcaauguuugguuuuucaaaggagcaguguaagaucagugaguaacauaggagcuggaggcagagggacuacuuuaggcgggaguggucugggaagcccuuguggaggaggaggcuaggucuuagagggcggauaaggaccugcaaggccagggaaugaagagcagagggcacgggaugagcacggagcaggaggugucugcagcagucagugggccagacugcaggaggcauacaaggaaaaggcugggccagacugcaggaggcauacaaggaaaaggcugggccagacagcaggaggcauacaggcccagggugaggcccaggggcugggggucacggaaggaugcuuguaacucuggcauguucugggcgcagggaauagaggagagaggaaguccauggcaagcugggaaggagaguuauugagacaucagcccaaaugccaaggaauagaauuuucagagcucaauuuuggaggaaaugaacaaaagaaggaagggaccaaucaggauugagaagaggauuacagugucacacugucugugagguccuauagaauggaggcuugcaccugacccaucuuugcuuuuggagcccagauuagaugugaaugcaggcauagauagggugaagaugagugggggacaguguggaagguacuuuguuagugauuccccucuggaucuauuccgauggaccaggagaagucuaucuuagaaaggaaucuggaagcagcagggaggcauuguguggacuggcggaggaaggguggucagacuaugaaaaugauuuucaaagggaaaguaaguuaaaggaaaagggggugaugucaggucagcggggaggcuggcauugaagaaagacacuugggugagagacugcauucggguaaaagcaaaagcaaaggagauaccugugcaggcuuccaggggcucuggaaguaaagucaggagggacggguaguugguggaaaacuuugggaaagccaaauuaacugauuccuuucgagcuuuaaauguuaauauuggggguugaaagcguuuguauaacccagauucucaaaaggaauggcuuggcuaucauaauuuuuucccacaacugcuuugcucugcccaccccuuggcucuuggaaggaucauccccaaaggcguuggggccucugagcaacggaagccucaaaacacggccagugcaguggggauaaagccucccucuaggcaaauuccuggggaggaguguggguccuggucuccaauguccauaggacccucccagcggagggcaggccuggaccauccugugucuccagauagcccccuggccggugcgagggcugggcuugcacagguggcacagccccugaguacaccgaccccccagcccccugguccccagccccaggaaaggagagaaggaaagagucaggcgggguguagaacucugcagugcagacaccacacugaguggcaccaacgccugacgcuguguuucucucccucaagggcaccaugccgguggaaaggaugcgcaugcgcccguggcuggaggagcagauaaacuccaacacgaucccggggcucaaguggcuuaacaaggugagugggucaggguggguguaugugugagagagguccuggcugaaacacgcccaugcggacugcugaaaguaaaaucguguguauucaaaaucuuaggcuuauucaugacaaaaaccagccaacccaaaaugaucauaaaacaucaaguuaucaucucaaaggcuuuuuuucuuuuagagacagggucucacuauauggcccacgcuggagugcaguggugcagucauaacucacugcagccucgaccucuuggguucaagugauccucccaccucagccuccagaguagcuggaacuacagguaaacgucaccacaccuggccaauuuuuguauuuuuuuguagagcugggaucucgccauguugcccaggcuggucuugaacuccugggcugaagugauccucccaccucagccucccaaaguguggggauuacaggcaugagccacugaacccggucacaaaaggauuuguauccuguacgacuguagccucagccuggagucuccaaugucugcucaccuuugguguuuuggcugacugccucucgaaagcuccuugcuuuuuuuggaaagcuccuugcuucuuugaggauucuuacccucuuccuucuccaaauuccuuuuuuuugcuucuccuggccuuuuaggacuagaggacauggaaacuccaggguuuuauauuaggaauggagcauuuccuuuuccauguucucuguuuaaagaaagcuuguuuuugucuuuaaaaaaagccuucuuuuuaccucuguaaugaagcccuaucuguguguccaccuuuccuaagaaagcagccagucauuuacaaccugccccuuccaggcacaaacacucccuuacuuuguuaaccuaaaaacucuuaauuuaauugauccuagcuguuaggggugaaucagaaagagauaaugucggcaaaaaugaaaaacuucuagaacuauauaaucuagaaaagcaacuaaauauauaucaugccuucuuuaaggaggcccaggagagaaguuccucuccuaccagaacaguucugagucaaugccuuuuuccucuucuccacucccuccccuuuucuuuuuuaaucuuaaggacacaaugaauaauuuagcuggccaggcuuuaucuuuguaucagguacaagagcuuagagccagauugcagauuguagccugcuuccaacaagggaacaggauauugcaguauaauuuuuuuuaacuaauaucauuccuggccuuauugggucuuuucagauaucuuucaaaucuuauuucuuuuuacuauuuuccuuuuauccacuuauuuugauuuuuuuuuuguuuucuuuagacaaggucucccucugucacccaggcuggagugcaguggcacgaucucagcucacuguaaccucugccucugugcugaagcgauccucccaccuuugucucccaaguagcugggaccacaggugcgcuccuggauaauuuuuauauuuuuuguagagaugggguuucacuauguugcccagacuggucuggaacuucaggacucaagugcugcccgccuuggccuuccaaagugcugggauuacaggcaugagccgcagugcccagccugauuuugaauuuaauguuacuguguugaauaugucugucugagccuuucugaaacaaggugaggcacuaaguaaauagaaaugaagaaaccaucugcuuauuuccugugaccugucccauaucucaaggucuuaccacaauguauuuuucuaggguugcucuaucuauaguguuuuagauuuacauauguaaucagcuucuuccaaagaaacaaacaagaaauggaguugcuccuuggucagcucaguuagcaggggugccguggagguauaaggaaggggggaccagaguaaaggggagcuggagagccaggguagcaaaugacacugaaugaaagcugacuuguacucagcacuuacugugugccaggcacccuucuaagcaagguacaugcauuagcucacguuccgccaccaugggguagguacaguuaauauuuuccauuuuacagacaaggaaaccaaggcacagagagguuaaguaagauucuguuuugaggaacaagguagcauuacuguuugauguggagugggagaggaaagcaaaugcuccuguguucuaaagagaagcaaguggucugcuucugcuuuuccuuuuucaaaaauaccuccacuaguuuugguuggcaggaugcaguggagaagagacagugucucacaccucuccuguugagcaggugccugauauguugaccgcugugguugguuuagacuaaccauuagucccuucuuggugcuguaguagauggaacuguggcucccggagaagauauguccacauccuaaccuccagaaccuguggaugucaccucauuuggaaaaaggguuuuugcagauauagugaaggaccuugagaugaaaucauccuggauuuucugggugggcccugaugccaaugaggagugucuuuauaagagacagaagaggagaaggcacacacagaggagaggggcaugugaggacugaggcagagacuggaaauaggcagccgcagccgagggacuccaagaagaggcgaggaaggauccuucccagagccuuggaaaggagugagcccuggcugggcgcaguggcucacgccuguaauccccgcacuuugggaggcugaguugggcagaucaccugaggucaggaguuugagaccagccuggccaacauggugaaacuccaucuccacuaaaaacacaaaaauuagcugggugugguggcaggugccuguaaucccagcuacuugggaggcugaggcaagagaaucacuugaaccugggagguugagguugcagugguggagguugcgugagcugagauugcaccacugcacuccagccugggugacagagcaagacuccaucucaaaaacaaacaaacaaacaaacaaacaaacaaacaaacaaaaaccggagugagcccugcagagaccuugauuuuggacuucuggccuucaggacugugauggaauacauuucuguugcugugagccacccaguuuguguaauuuuucaugacagucuuaggagauugaugcacccucuaagggucacuuccuuucugggacucucaguugagaugccuuuucuuccaucuauuuuguccauguuuuucugauacaggaccagaaggcaaauggauuucccuuugugcaaaugaacacuuggccccuuucaggcaguccuuaccugcugagcgucacucaucuggcucuuggcucgagaguucucuucccgaggcauggaaggaaaggagaccucugugucaucucacagggcuccuccgcuacagcuggaccugagccaggcugaugaaggagagcgugcccguggcugccggcccgugccgccucucagcaccgcccuggaacagaggccgaggccugcacuguggccccgaggcccugucaagcugcauccugcugaggccuagccagagugggcacguggcauugcucgugcacaugggcacugccaucacugucacugcaggccucggcuggggucaggaucucuucucuccauaccuacacucccacagggcauuuuuuuauagguuuccguuaacuuaggcuuguuggcauucaucuguccauauaaauacuuaacugagagccuaauguucuucccucccauucacaagcauucugccugggaauccuuguuuauauuuugagugguuugaggucauuccaagaucucuuuugccacugaagauuguuguaacucuuagaauacacuguccauggggcugugggacucacuucugcuucagucggcauucaggauguguucauguuuauugugaagugcuccaggcugggagccccaugcaccagugccuuggcuaucuucuucaugucugcaugcucagggccaggccuagugccugguaagugggaggcccucugucaaaauuguucugggaauacacagaugaaugucauggauuugaaggggagcaacauuggugguguuuuuguucuguuaagauaaucagauuuauggacacuggcuuggcaguugucacauggcucucagaaaguccauucaaccuacuccauucuuaguaagagagaaagaguugguuaauuaaugccuuaaauuuguuuccauccucuauugucuuagucuguucccuguugcuucuaacagaauaccugacucuggauaauuuguaaagaagaggaauuuauuucuuacaguuauggaggcugagaaguccaagguugaggggcugcaucuggugagggccuucuugcugguggggacccucugcaaaguccugaggcagugcaggauaucacccggugcggggaaagagcaugcucacgugcuagcacaggucucucuuccucuuaaaaagccacaauccuaccccucaugacaacucauuaauccauuaaucccugaauggauuaauccauucaugagggcagggcccucaugacucaaucaccucuuaaaggccucaccucucaguacugccacauuggggauuaaaugucaauauaagugucauagggggcaaauauucaaaccauagcaccuacuuuuaauaaguuugaaggagggugggaauggaaugggucccuuggauuccucugaaggaacagcgaggaaguuuggaaaagugcauuauaaccagcucaugaaugagaccuuggcuggggcaauuuaccuuugguuauggguauuugcaaaugugcauagcauguuugaguagcccaaugacaaaaagaaauaggauagcaaauuuucauaugccuguaucuagauguaugaauauuuugccuuaucuuuguguguguguguguguguguaucuguguguaucugguauauuaaagcagcucccugacagcauacauuguaagacauaagggcauuuucuuauauauccacaauauaccauuguuaauuggacaaaauuaguacuguuuaauaucaucacugcuccauucauauuaagaaugccuugaguauucccaaauaaucuuuuuacaguugauuuguucaaaucagaauucaaagacuguccacagguuguguuugguguuuaugacucuaagucucugcugacugugggccucuguuuuuuuccuucucgccauugacuuguugagaccagguuaguuuuggguuuguccacaugcuugcuugugguucccugggccauuucuugaggaaggaaggaggcagucacauccgggguccugguuucucucguggcuccaugugacccccaacucuggugggguuauugauguucuuaguucuuccuggauccaugcacuaaggcaggggaaucaucagaucuuucccuuuuuuucacuuugagaguagacuuguguuuguguaaacaucaggcuaucucugaccacgguaaggaguccagacaaaaauagcacacuaauuggaacgucuugcaaauguuggggggaagaagaggcagaggagauaacagaacuaguuuccauguggggccaaggaacauuguucuacauugcucaaaauaaugucagaugcuuuucugaagucaagcagcgcucaucucuccugccuuccuucagaugggcagaguugugcacacacguacaaauggugggcccuggcauggcgcgucugucuauacacagcauguaccaccaccacgugugcaggacuggucacucggggaugagacaccuggcacauacugacgucacggggucuacacacacauagcaacaccgucaugucccauggaacacacaacuugugaccagaauguuuacuggucagaaucucuuucaguuuuaaaaugaaucuugcuuucucuuaccuuuucauauggucuucuucaaaaaaagaaucugugauacaauuuuaaagauauuucugauaaguuuauuagucuuuucuuuuuuuuccugaaguaugaaaaacuagguaaaggugacauguaguuuaaaaaauauuuaccauuuuaaagugacauucacgaugucaugcagccaucaccacuguccaguuccagaacuuuuuaucccuccaaaaggaaaugcuguacccauuaaucagucacuucccauuucccuccccccuagcuuguggcaaccaguaaucugcucucugucucuauggaucucugcucucugucugcucucugcucucugucuuuucuggaauauuucauguaaauggaaucauucaauuuuuggccuuuugugucuggcuucuuucauccagcauaauguuuucaagguucguccacaugguagcaugugucaauacucuauuccuuuuuguggcugaauaauauuccauuguauggauauaccacauuuuguuuacccauucaucagcugauggacacucggguuguuuccaucuuuuggcuuuugaaaguagugcugcuaugaacguuuauguuuugguuugaauguuggcuuagaauucuuuggguauauauccagguguaaaauuccuggaucaucagguaauucuguguuucacuuucuugaggaauggccaaacuuuuucuccagaguggcuguaccauuuugcauuuccacagcgaugugugaggauuccaguuucuccacauccucaccaacguuuguuauuuguguaucuuuuuuuggagacaugucuguggguuagucuguuucauguugcuacaaaggacuaccuggggcuggguaauuuauaaaaaaacgaggcuucuuugggucaggguucuaggcuguacaagaagcaugaccuuggcaucugccucuguuaaggccucaggaugggaggcaaagggcauuacauggcaagagagggaggaagagagaauggugcaggcgacaggcuguuuugaauaaucagcucucaccggagcuaauggagugagagcuuacucauuaccacgagaacgacaccaagccauucuugagggauccugccccaugacccaaacaccguccaccagaccccaccugcaacacuagcgaucaaauuuuaacacgagauuuugaggggacaaacaccugaacuauuccagucuacucaggccuguugcacauuucaagaggguccauaguguauguugcuggguuuggucagcgcuuuuguaguugcauggcuuuugcgguuucugugggacuagguuugguuguguguguguguauguguaugcaugcaugcgugcagaugcuuaaaaagaucuacuuuaucuguaucaauuuugugucuugcaaguuagauuucagauugugucacccuagaacuccuuugaucuagaaaaaagugcaacagcaaauucuuaagaaucucgguguuuaagcauaaagcuuuagauucugggcaugcacuucaggaaaagcucuuucacgaaaugaauuuucacuuguauucauuuucaugugaacaucaauaaauggcauuaagugauuuugcugucgauuuucaucuacauuaaagcauaaaaugucacucagccccuuucugaucacuguccuuuugaaauuggcuaacccgaagcccucucuguggaugauacagaaugaacaccgaggaauuuaugaaaaagucucucacuuucaguucuccuuuaauaacugacuuuuuagaagaugguagaauuuuccuuuuaacagguuuugggaaacucuccaauguucugaaauagucuuuguucuggcuuugugauugguucuguggagaggcgcugaaucucuuuggggacagcugggacccuuucuguguuucacuaugugagacugaagugguggaaacucccugcugacauuuccucuccuuccucagcaucuagugcagggauccgcauaccuagcaauuaccagaacugccuugagagcuuugaaagaguacaaccuccugggcuuuaaucuccacagaauccaggucucaacuggucugucauaggacagggacucuuccaaaucuaaaagcugggagacaaugagugggugauuaaguaauagcauauggagucgcaugaccuggguuuugaacuuagacacuuauuauccugcaaguuccuugacuaaauaguuaaaaucugcuucuugguuuccucagcuauaaaauggaaaucguaacauauaccucacucaguaggcugugggaggaagacaaaacugaggucccuguggauguggguagucagaugcacagugccaaugggaccuuaguaccugccgguaccgccacaagagcugcuugggccagguuccucaucuguagcuuuacuaagaguacggcuuuguuacuaaaccauggguuuccaaucauguguuuuucaggguugcuugaggcgguuuugaguuacagaccucaacacugagagagauguagagauagucugauauaaggauuguauugagggauguuucuccagaaaaaugugucauuucauaaccucuaccucuuuguuugcacuucuugcuauuucuugcaggcaguagacccacagggauucgaacauuacuuucuauuucuguuggaugcacaagcaaauggagauauuugguuucugugacaguggccucagauguacccgacuuuucuuuaguagcaucaaggguuuuggaaacuugucuaauuuuuaauuuaccuaagauagcuggaguuacuauuuaccaaacgacgagaauaaauuauaagaguaagcauuagaaguuucgguagguggccauuuuucugugguuuuauaaaaaaaagaggcacagggccgggugugguggcucacaccuguaaucucagcaguuuggaagccugaggugggcagaucacuugaggucaggaguucgagaccagccuggccagcauggcaaaaccccaucucuaccaaaaauacaaaacuuggccaggcgugguggcacaugccaguaauccuagcuacucaggaggcugaggugggagaaucucuugaacccaggagguggagguuguagugagccgauaucgcgccacuacacugcagccugggcaacagagcgagacucugucuccaaaaaaauauauugaaaacuagaaaagaggcacaaauaauggaacacacaaggucaaaucaucaccuuugaccuuggaaaacauuccugcucugcaagacuucacgagacugacugucacucgggguagucuaucaagauuugggauccagcgggggaaguggguuugguuuacaguagauuuucuugucagcagucaacacauucagcgaugcuugcuggggaaucuugcuggcuagaccuucacaaccuuuugcaauggugggccaaaacccaugacuccaguucuuuaccuuuuuuuuuuuuuuuuuuuucaggaaaagaagauuuuucagauccccuggaugcaugcggcuagacaugggugggauguggaaaaagaugcaccacucuuuagaaacugggcaauccauacagguacuaaaacucccugcggcguuuauagaggaaggcacucuugcuuaguuuuguuuuuauuacacauaaaauagccuggcuuaugaccucaugaagauggcucugaaaaaccugugacuugucccuaggcacauccaggacacaugggguacaaacugcagcccucagaaguaaugcuccccucaucccauacacucuuaguccuucaauuuccuauaaaugugguauucuaagaaguucccuagguguuaccggggaauagaaacucaguuguucugaugcuauaaacuuuggucaaauuuaucucccccccaaaaagguagucagaaauaccuguauuuauuacaaccuuuacguagggagcuguuuacaggaauggacuuuguuggagcgucagaugaaaaagaggcacucagcuucccucugccuguugacuuugcagccucucagucuucuauauuuuucuuacgcugaugcuccauucuuccagcauuuauaguuuccucaagcuguucaguagaaccagggugaccaacuugucccaguuugacuggaacuguucagguuuuaaaaacaaaauucccacaucccaagaacuuucucacccccagguacaccaggacgauuggucacuggagguauagcauggagugaaaagguuuccuuauacugccugaccagcaauacuguguuuccagaaauuccuuccucuguaucuaauguuuucucucuuuuucuuaaucuuugucucuuuuguuaggaaagcaucaaccaggaguagauaaaccugaucccaaaacauggaaggcgaauuucagaugcgccaugaauuccuugccugauauugaagaagucaaggauaaaagcauaaagaaaggaaauaaugccuucagggucuaccgaaugcugccccuaucagaacggccuucuaagaaagguaaaggcauuuacagacuaaaauaagguaaaucaauuugugucaucgugccuucgugaucucuucauuucuacaucugcagucaguuugcagguagaauagccuguucaugcuguaggggaucauuccgccccuaccuggcuuggaaacaagacuuucgauucaccagaggcagugaaagauacauguggaauuuugaccauguacagauuaaagcaacagguucauugagaguuucagaaagaauuuaauuugagggaaauguuucucuggaggcccuucgugaauuaauccaaaacuacauuuuuguugccacaggaaagaaaccaaagacagaaaaagaagacaaaguuaagcacaucaagguaaucuugggugauucagagagaaagccaaaguugggauccuauuaaugacucauauucugccuuguaaagaugagucacaggaccucaguguguccucuuucuuccuuugcuugugucuucugugcuuuacauguuugcucuucagcauguauccacuugcagacauggagguacacagggcccugccucaucccguuucucugggaaauuuaugaaugaagucacagauucucacugugcucggcaggcugaggccuccaucuggccaccacagccguugccaguggucauuuugugccagcuaaacuccacaacagcuuauucucauacuauuaaguauauuuucaggcuauuaaguauacuuuaauauguauuaaauguuauagaccucuauacaauguaugaacucuauguuacagacauuccgucacaggcccuuuggugggggacagaguggucaaugucagcacucuaucagaacagcucucaauggcugccuucuguccacuguagaaucaucucucacaccccacaaggguuuuccaugggaugugcaugugugugucagcuucucacuaggcugugucgucugaacuccccuacagucugaggaucuuuaugcauagauuagguggcccuuguuaaauaguaagagaagagccgaauaugcccugcaaaacuggggacgagcuucaguggcugagcagagagcauacacugcggucacagacccagggaucucagagagauugucgagcucccuggccucccuuugcagaugaagaaauuuaggcggaggguguuuuugcagugaugcuuucaguuucacuuuuacuaguuuuuauuuuuaacuaaauuuaaauauuguacuguauuaaaggccuaauuuuguuuuaacuuuucauuguggaaagauuuuaugcacauaggaaggagacaguugaguaaaauuuaccccauaggccaucauucagauuaauuuuaaccuuaaucagcuccuggccaguuuugcuucaucaauagccccucccauuuccugacuucuaacaugaaauugcagcccuucaaccauuuuugacuuacagaaguaauuuauuuauuuaauuuuuuuuaaacugagauggaguuuugcucuauuggcacaggcuggagugcaauggcgcgaucuuggcucauugcaaccuccgccuccuggguucaagcgauucuccugccucaaccucccgaguagcugagacuacaaacacgugccaccaugcccagcuaauuuuuguauuuuuaguagagaugggguuucaccauguuggacaggcuggucuugaacuccugaccuuaagugauucgcccaccucagucucccaaagugcugggaauacaggcgugagccacggcacucggccccaaaacaauuuuuuauaguucagcuuuuuuuugaacuauuuuuuggaauuugaagcaaauuccaaaccucauagcauuucuuccauaauaguucaguauauauauuuaaaagauaagugcucuguaaaaauaccaugaugucauuacuguaccugaaaaaguucacaguaauuucucaauaucagugaauauccagccaguggucagaguuucaguuguuucauacauguuauaacauucguguaguuuguuacuuaaauuaagacccauauaaaauccacaugugauuuuugaaugucuuuuaaguauuuuuuaaggauauauguuucuccuauauuaccucuuaaaacauuuuuuuuuuuuuacaauugaacaaaccuaguuguuagccauaucguuucucacaguuuuuuuuuucguuuuuuuuuuuuuuuguuuuuuuuuugagacaaggucuuacucugucacccaggcuggagugaagugacgcgaucauagcucacugcagccccaaccucccgggcucaggugauccucccgccucagccucccucuaguaguugggucuacaggugugugccaccaagcauggauaauuuaaaaaaauuuucuuuuauagaggugagguuucauucuguugcccaggcuggucucaaacuccuggccucaaguaauccucuugccucggcuucccaaaauguuggaauuacaagugugagccuggcugaguuuguauuuuuaaggccuacguuuugauucauguuauuuagucagaaaagcacagcuuucucacacaugugugagaauuugcuacaauuucaagugugacugaaucguauuuacuacucuuuucccauuaucuagcucagugccuggcccagaacagaucacuaauacguauuugauaacugaauagaugcauccgcauuuguugacuaaauagauguauaaauaaguaggauauguggggugggagugagggguuuuccauuaggaugcagauuuaauuucauaaucgcaguuaauggagaaauaagaacggaguaacagauguugccuuuucaacacacuuugcucacauguacccacuguauuccaucgaacgccagaugccaaugaugcuaagaugcacuguuauuuuauguaucucuuagaaaaacugcuugcaaugaaaccaugacacguaauggauugaaaggcauguccucuuucagggauguggcaaugcgaggaaauguacaucuuaguaguucaugccaugugguggucccguuugucugggaucucuacagccacaugggcacugguggugucuucacauggcccugaaaugagcaaguuguggaaggcacgguccugggugggcuugaccauccuggcccagggaaguaagugagagaucccguuaggugcagccgugugggucaagagccaccucagccaaguguguuuuaugaaauccuugugccgugaagauaugauucauaccugaaacuuuuuucuugaaaggaccugauuccuucagcggaaggcaggugauucauuaggccuaaacacagccuuacuuuugaauuuagaucuacuugcauugugcuuuccaguguagcagggaagcucagaagaggccagugggcuucccgaguucugugcuuccuggcuguucaagcuauuguguggacucagugucucuguagaguguuugaaaagugaacucccuagggcgucuggaauuggaaagucagaggacaauuacuagcuauuaauauauuacuuuuuaauuguguaucaaaacacccaagcacugaguuaauauauccugugcaaauauacuaaaccuacuuagucuauccaaauauguaacuggauacacuacguagguuucuucuacugaggaaauuugucuuucauaugguaacuagguaugaauauuugcuguugaagcaagcuuuucccaaucuucaaguugaaguuuuaauuagcaaacaauguuuacaacauguaggccaaguauuagaauuuucuuggggucacucaugauuuaucuccaugcuauaugucccccaacaaauagucuccccaagacuggaacacccaaggcccauuggccauguggcaggugcagaaacggccucagcauccucugacauuucgcuuugugagcauaucccuacaaacucagucagccauguuuuccuugagcuaagccccaccugugcggcgguaacugguuaucuaaggaaauaagaacaagaaaaacagcuggguacagugguacaugccugucccagcuacucaggaggcugagguguaggaggauggcuugagcccaggaguuugaggcugcagugagccgugauugcaccacugcgcuccagccugggcaacagagcaggaccccuuccccaccucaaaaaagaaagaaaaacaauaaugagaaauccuggauucuacaucaucagugcauguauauguuucagaaaauaucauggaacgguuugcucugagacuucagacaaggccaagaacaguaagaauagaaguaguuaaaacagaggggugcuaguugauauuuuugagcugauuccaaguucccagcuaugauuuuugucucacugaguucucccugugaugggcaggucauuucccuuuuauacauuuaggaaaugggugcacagagaagcugauucauuuucccaaggcugcauugcuuuacagagcugagauuugaauccaaguuuguccaccgggugccucguagccuuuggggccuaagccaggccuugagggguggacagggucaaacugguccuuccgcagcacuaggggcaucaggaaugaaggccuggagauuacaguugguuugucuuuccuggaugagacaggaaacuggcuuaauuagagcaggaguuugugugagagggcaaugggaaauacaggcauguagguggggcgaauagaaauggguacuuccugcuucggaggguuguuugcagcugaaacauacaugcuugaaacuguaaagugcuuccggaucaaaguguuaguguuaugaaggagacagaauugggaagggcugccaaagucgcuuggaaaagauuaggccuggucuguauucguucugagcacagaccuauggguagaaguuacagaaaagcagauagggguucggcugcucuuucucauagagcuguuggcucuaacagugaccugagcuggauuaaaacacagcacacucccuggcagggcugcuacuggagugaucccuucacuaguuggaagaggucuucaguuuuuaaacuuuaaucaaaugaaagcacacaccagcaacucacuugaaaaacagauaagaugagagaugcccugggugaagcagguuaucaggcuuauucugccugcccgggauccucccuucccaugugguagcucagaacgggagcuccgaacccaguuggaagagcuugagggacaguuuuacggaaugagacacaguugaacuccuuguagcacacuuagagcaggcgggaauugauauguaagggaggccuuucucaccgggaugggaaggagugggaggcaggagagacugcuguggaaaggcaguagcuggugccacuggcauggagggaggagacauuucuccagaaaguggaagaggguacggaggaugcagauaagagcggccuaaagaggaggccccggcguuuugcaccuucagaagcgaguguugggaaugcaggucguuuuguggagaggguguuucgcuuuggacaugcugccuuugaagugacagagagcccugaagguaaaugccagcuagaaaguuggaggguacagcacuugagugagugcccaacgggcagauguguggucauuuacuugagaauggcguugguagcuuuggaaacugaugccuucucuaagagaugcagacaaaggcccgcagagaagaugcagagaaaagugagcuaagggaaaaagucaagagggaagcugcagugagagaagggaggaagagaaugacgauggccucauuccaagcaaggagcagaaggaaggugguucugggaccgggcaggaggccccagccugucuuacgagagcuucuguugucaguggcauugcgccucugugcugggugugugcacucgccaagguccaguucccugaccugcuugugaaguccagcugucagccuacacguucuguuagcagagacuuagagauguccuuaaauuugauguccuuaaaucuggcuucaaagagacuggcuuugcacagaugaguuagagcauuuuggaaggugggaggugggcuggaggcccauuaaaugggacuucagggacaaggggcauuagcacaggguugagacagcaugggcucggagcagaggggagucccucugcuguccucuaacucuggucuguccccaagcccauucagcaaguguagcuucaagaccagcuaaagguguauuauuuuacaggucuaaagaagugugcuccugccccugaacucucucuugugccaguuugcuuuugcuuaaaaucccuuaaaccagagaccaaaccuuggauucuguaauuauagcaaagguucuugagcgucaauguuuggcggaguucaugcacccacguagaucaauccuuggauucuacaauuagagcaaagauuuuugaacauaaauguuugcuggaguucaugcaccguggagaagucuggacccaagcagagucuuuuuuuuuuuuuuuuuuuuuuuuaaucuuuggagcaaggggagaaaauuaaaagccaagaaagcuauggguuacuugauuuacagaagagucucuaucuaaagugagaaagggagcagacagaggggaugugaauccugaccaggauuaaccgggccagguuauggugcagcaaagcaggaguugagccagggcaggaguggggcaucggggguccaggagaggcuucgggcgaagaguguucagggccugcaggaucucuguguuuauuuuacauagagaacuccacaccccuuuucuucauuugagauccuuggauuuuuaauauaccuuagauuuagauauuccuacuucuaaucauuucaaaaauugugacccaguuuagugaagauccuucucuccugggccuguucugcacccuggauggagguguuucgggaggugcuggcuccguuuuacugugccauugacuguacugucuguccagagugacggugucagugagaugauuggcacugauggcucugaaaugacaggguuucuuuugaaguggggugaggggaguaacacaguguuuggaauagucucuccuagccuccaucgguggaauauaugaugccauuauagaaguggucagugcaggauacaggguaagaauggagagaguagaaggcugggcaugguggcucaugccuguaaucccagcacuuugggaggccgaggugggcagaucaccugaggucagggguucgagaccagccuggccaacauggugaaaccccaucucuacuaaaaauacaaaaaauuagcccggcaugguggcaggcaccuguaaucccagcuacuugggaggcugaggcaggagaaucucuugaacccgggagguggagguugcagugagccaagaucacgccauugcacucuagccugggugauagugugacaccccaugucaaaaaaaaaaaaaaaaguguggagagagaguagaacaguguucaaaagagugucucagucuccgcuggaauuagggcaggauacaagggcuucuuaagacagaaagcuccuggaauugaaccauauuucgugaccaaagacagaguucaguuccggugucucugcaggcuaaaaguagcgugaucuuggaaaauuaauuuagucucugagucaucguuuucucaagugauaaaaguaucacuugucacuaauuaaacuguagaucauguguaacacuuagaggucuucaauggagaaaucagaauuaauuuagcuuuuuaaauauaugcaagccugacugccucauuacuuuuauaagaaaccuagaaacagaaugacuaaaaaaauaaggucagacagcaaaggaagcccauacaaaugagcaguucucuuguaacuucuucagaggccugugcuuaguucuuuuugagggaguugaagagauggagguggacuagugaaagguggggcaugacucgggguggggaaacugaccaggggucauugaggacgccauugagaaaggaggcugcuguuggagagauggagaauugcagcagugucagacaguucaggccgccauggagggauagcaugguccaucagaggucagcauauggggcugggggaagggauuugagaaaaggccauuggauuugggagagcacaguuuuguuggugaccuuugguaauggugagugcuuauuuacuaguaagugccauguacguaguuagcucauuuaaucuucaccuuaucccuaugacguggguccuauuauuguccucaguuuacaacuguccgcagugcccuaggguggcuuacagagguuaaauaaggagcugcaaccagugaggaguggaggugccaggcuuugcuccaggcccuucugauuccaaagcccgagcucucaagacccuucugggagcuugauucugcagguggagaggaagcgagaccacaggaacuaaugggggcccagguggagaggcgaaguccggaaaggcagacagcgggucggaaguuugguugugaaggaagggaaaaccugcugacucacccaggucacaggcaaguggguuuuuuuuguuuuuuguuuuuuguuuucagaaggggcagacuuuuuuuuuuuuugucuuuaagaaucaggcucucgcucugucacccaggcuggagugcagugacaugaucauagcucauugcauccuugaacucccgggcucaggagagccucccaacaccgcagccucccaaguauccaggacaagaggcgugcaccaccacacccggcuaaugcuuucauuuuuuguagagacagggucuugcuauguugcccaggcuggucucgaacuccugggcugaaacgauccugcagccucagccucccaaagugcugagauuccagggugagccaccgugcuuggcccaagaaaaggcagacuucuuauuuagaacuuguaagagagaagagugcaagaugcugggggagaaaggaguaaaaaucgugccugguagggauggauauucugggccugcccuuacgcuggaccuucgggacaucugguaaaccaggcaguguaugguuuguuuaaaaaccgagcuauacaguggagugaugccuuugaagucauguuauuaaggugggaguuugccaggugggauuaugaaggaggagguuauuuccccuccuuccguuagugacuuuuugaggauuuuggggggauugauuccaaguaguguauaaauaagcugaugagaacacccaccauguuucagagccgaccacuguugacuuuuccaagcacagucacgucuacuugcaugauccucugcuuccaguccuguguuccuucugcucucuacccucuuccgcuuuggauuccuuggguguuguccuguguggcuuuugucugacuugauugcuaucguagcagcagaugcaaacuuaccuugagagcugaacguccacaggcaccucagggcuggcuuuugcagagcuguuuaguacaagggaguggaggguucuggugcacuugaaaaaaaagcacacauuuagagcuccaauaagggaaaggaauuuguucucauuauuucauuagugugcacgugcagaauucuugggcuggaugagauauucagccaccugaagggcauuuauguaaagcccauggugugggguugcccggcuggacucaggccagggugaucagccagccauccaaugcagggccucagguggccagaggccauggcaaaacuuaucugcagagaauucaucuacaauguccucugggcuccuguucuugggccagucacugaggcagagcuuuuccuaagaaauaauuaugaaagagguagcaugauuccucccuggugaaagccaggcauugauucuuuugagcacccccucagaggaggagaguguagaauccacgcagugcagcauuuuacagagacaaugaugcagcucugcguagccccaaagcuauugucugcagguggaagcauuuccuaaaggcaagccagaugggccgguaccguuuccuugaaggaaaauggaaggagcugaauacccagcagugcacccugggcagaaaugugcuuuaaaacaggccaguuuaaagaagcaggggaugaauguauucggcagcugaacaugaaugacccuagcauuaaagaaaguaggcagaggguagaauuucagcuaagagaagggaggggaaaggaaguguucucaauucuuuuuucuuuucuucuuccuagcaagaaccaguugagucaucucuggggcuuaguaauggaguaagugaucuuucuccugaguaugcgguccugacuucaacuauaaaaaaugaaguggauaguacggugaacaucauagguaaacuguuuugacgucucauuuuuuauacauaccagcagcccccuggggccuaaaauuuguaaaacagagaacuucaaauaacauagucagugggaggaggucuuggaaucaucucagaaugcaaguuccagcccccagauuucaaggcugagaaacgaaggcuuuugaggaucagauaaaggaacuuagacgggucagccuccguggaagaaggcuggggugaccucccaggaaaaauguuuguuucccggcggcucguggcuagcgaucccagucuuucacuauuugguucacgugggcaaaagaguauuuauuuaacucgggaaccaaggagagggaagaugguccucgcgaguccucucagcaacugcuuccuggcagacagagaaacugaggcacagagacauguugccaaagggcccacucugauucagcagauauuuuugagcaccuucuguauaucagacucaguacuaggagcaggaaauagauggaggaggcccaauuucuuuucucauggagggacagagauaguaaacaaagacacccccagauaacugcaguguuaccaugugugguaaauacugcaaaagaaaagaaaggcgagagaaaaaucaaggcaccaaauuuagauuggaggucucagaggagcaguguuuucccuccuucguaacaguugaacaacuuccagauguagcuagcugcacccccuguaaagaugcaggcucuuuacaaugaagacacaucuucugauguuccuucucuccuguauggccagaugcacaggaauagugcccaaaagaccucagccugcuuucccuuuaaggggaaggagaagaaaaaacuccuuuuuauuuuuacuuucuuucagcauugaauuuuuguuguguguauggugacuucuguuuuugggaaacggaagaagccagcagcaugcugaauuguccugacaggccuccgcuggccucuugccgagguuagcagugcuuuuuuuguauuuaaaccaucucccgggcaguguaaaaaguuugcaggugcggacauucugucugacuggucucggcagugcucuauaacccuguuguguuucuugauaaaacacagccccacccuuuaauaaagcaaagauugcuaugaaaccagagagucuauucauuacuguggaguaacuagagcagucuguagugacuagacauacggcaauuaggaagucauggaguugggauuuuugucuuaauuuuggcugcucaaagugcccccuguaggauauucuuuuuucgggaauuguuuccaaacuugccugucuuuaucuauggugaaacucaagccgcuuuuuaaggcaagccugcaaacccaaguaucaacaugggcuccugaaggcacaggagagcagauucacagcuuacugaccaguguuaggguccccacgagggccacccauuugaacucaagguuggcagacucuggccccagcacuugccgugguuucaggauggccagcggugacacagggcuauggaacccugggucuucaucucuucccauauccuuuguuucaccuucuuuuugccauauuuuauugugcuucagauagaaauuuuauuuauaagauaaaaaguagcucugaggcugggcgcgguggcucaugccuguaaucccagcacuuugggaggccgaggugggugguucacgagcucagcagaucaagaccauccuggccaauauggugaaacccugucucuacuaaaaauacaaaaauuagcugggcgugguggcaggugccuguagucccagcuacucaggaggcugaggcaggagaaucgauugaacccaggaggcggagguugcagugagccaagauggcaccacugcgcuccagccugggugacagagggagacugccucaaaaaaaaaaaaaaaaagauaaaaaguagcucugggugagucuuuagauggaaggcaccaccucuuaggagaucacccaugcugucagcugugcccaugccuucuuccuggaagcugaguuguucaccccuuaggagaaggggccugagacaaggcauucgauuuuauccacaccccuagaaugcucuuagcaagaugaaacuccauaugagaugugaacccuuacaucgcaauaugcccagacacagaacccacaacaacauacuuuauucuuggcuguauuggaccuggagcaccugggcacugaggugagacuguggggccacuccucagucaccaggugccaaccgagagaccugggcaguggaguugggcugcuguguuuucagccuuaagaaguuuuuauuuacucaagaaagcugucaucuuugugugaggcuauauauuauuuucuccuucccucucucccuggcugccgcugccucguuuauaauuagcugucagcuccuccuaucuucccucaccguacuucucaaguccauccccuuguuucugacacugugugugggccugccuuggcugucaccugggcucugcuuccauucugcuccccauuucuucuucucacaaaauaaagaaugccagugucaucaugucaccacugccccuaagagaaggagcugaguucccccagguccccggggucuggcaugaucuaggcccugcccacugcuuucauaccugucuuugaacuugaauuacucugaacgaguuaagcucccuguggcugcucauagagacagugagguugguggugggucuccuuaugguggagcagcugcaaaggcuuuguccacagggcacagugagggguggacacguggcaguuccagcaggagguauagcuccagcccaacacgucucauccacacuuccgcucccagaucauugacccuugagacacugguuaccucuacugaguuuuguuuuguuuuguuuuguuuuugagaccgaguuucacucuguugcccaggcuggagugcaguggcacaaucucggcucacugcaaccuccgccuccuggguucaagcgauucuccugccucagccucccaaguagcugggauuacagggaugcgccaccaugccuggguaauuuuuuuuguauuuaguagagauggaguuucaccauguuggucaggcuggucuugaacugcugaccucaaaugauccaccuaccucggucucccaaagugcugggauuacaggugugagccaccgcgccuggccucuacugaguuuuuacugggauacauccugugcuucccuucguguaguagccugagaugcuguuuucucacggggugcaaggugcacgcugcccugucccacucuugccuccuccugcacucugucacccuggugagguguaugcagccuguagucagggacagccuggcccaggcaccuacagaucccugucucggagucaccggccccgcggugaucuucucucccaccauggcucucgagugccuaaaccaaaucauggcuguauuuuauaccgaaagagcacgagauuagaagucaaaaggcguggguucuagaccugcuucugaaguuuuuuauuuaccaugugauuuugggcaaacuccuuaaucuuuugaaauucaauuucuauauagauuggaaacaauauauaauuauuuauaaaauggaaauauuuaaaauuauauagaaaauggaaauaaucguacugauccugcccaucucgcagaguuauugugaggaugaagugaaauguacagauaaaucacucuggggcuagaaggggguaaaaugauaugauuaucauauuaccaaaaucauauuaaaauauauuugauuaagaaaaguagccuccaucugugccaugucaucaaggcuggugugaaguuuaacuccugaaacuuucagaggggucaggggaaauuucccugcaugaugcucugcugauggccugauuuuuuaugccugcuaguaaguuucauucuugacucugcagcuaccugggugaccuuagcaauuuaccugagcucuggguuucagcuuuuuucaacuguaaaaugguaggaccaaaccaccuccaaggaccccucuguuucuaauaaucugcuuuuaagcacuuucucugaggcaugggagcaaguugcuuucucagguggagaccuacauuaagucaacaauugcuaauaaagugagaaugaccuuuuaaagaagcaaaccgguucaucaguaaccagccauaaauaauauuguuauaauucucagcaacuagauucagauaaaauugcauuccugugggugacucuuuucagaugugcugacuuuaauaaacuggagaaacuuaguggauuucuaguucuucuguuugagaauuucccuggcacacaauagauaacuguugaaaagaaaugucacuauuaguucugagccuggagacucacuaaggugagauucaaaaguuuuuauccugagaggggcuaagaaagcccucaguaacucaguuuggacuucauuaacucucucuguuagggagagcauauuauaaagaguugaaauuuggaguuggguaaggcuaacauugaaucccgguucugcugcugauugucugucugaccuugaauuagucauguaguucugucuuguaugguuguuucagcaugucuagaauggggaucacuauugugccuuccucauggguugugaggucuugggaggugguagggagaggcaaagaucagugcucagaaagacagguuuugucauuauucagucaggacacucuuugguacccagaggagugccacuucugacuguuuacuguagcagguaaguuuguuauuccugucuuuucaccugucaggagucaguguugcugucuguuuugccgcuuggugguccagggaaaucaguucacaugucgagagagagagagagaaacagauagagacugguuagugagaguguugaugcucaucugagagcauuucgauauugggauuucccugcuucucucaugggcuuucacucgagagcuggaaaguuucuaaaguacccacgaugucuggauggagagaagccauugucccuuaccagggcauaaagcaacacacuccuaugggggaauuuggccugagagauaacguaauuauauuaacuugguauccagaucauagcccagaaaacagacugacuuuucucuccuggucagccgcauucaggauacaccuaaaaucugcauggacgugcuuaucuacuuuuuuccccaagucauguauauuaagugaaauacgguaaaauucaccccuuuuaaggcacacgguccuauaaauguugacagacgcacucagugauguaacuaccaccauagucaagacagaacauuuucaucaccccaacacguuuccucccuggccccagcccucgcacccacagccggcugucuuuaucacuucccaaagguuucaagaguccacuugucagaagucuugacauuuuucuagaaaacauuaauugucacgucccguauuugcagauugucacaauccccugcaggacuccacucuggcuccagucagugagccucggccccaucacauguccauuuauucaggggagagucccugagcgccucuccggugggaguugugagcaugugucaugacuggacacaaaaaguucauacuuugguugaggagagaugccauugaccaacucaaagcuccauacggguauauagcguuaaccagcaacuugaggucagaagugucacaaggucgcggcccaucguaguuucggccgagugacggggacagugagugagaggcacccaggggagagaggccagucugugcuggcgggucaggaaggggcuccagaagucaggggcauggugaaugcugccuguugcucaacccccacuccugugccacuaccucauugaagccuuugauuccucaaacuggaaaaaacaccccacuucucuagcuuccauuguauggcccccuucuuuuucuuuucuuucuuuucagugcucacggccuuaaacugacucucuagaugguuagucgcuggccuauagccauguauaugaacuucuuacaaaccggauccuugacugcaucgaucuuccgcugcuccuucuagcccugggaggcugggaggugcaagcagguguuccauaaaucucuguuaguugaauaaccgacuaggacgucauggggagaagcagugagagaaagaauuccugguuggaacaaagggaucugacuagggggauacuugagcugcugccauuguuuguagucccagcuggcuugcccucuuucuguuaggagcaacgugcaaaggagagaugaguuuugaaauauuggaaguuaaaauggcuuugacuuaagucacauuuaucuaagaccuucacugccuuaguaugcaagguaucgcugcgcccucccuccucaaacucucacaccccauuugguuucuaccuccacccaccagcugcuucuuaggacuuaggauagggcaggccauuaucuuguuuuccugccauuuuauuuuacuuggcuggaagaggcagaggaaacuagagagagguugguguaggucagcgucagucugugucuagugaccugcauaauugauguccucacccucacguaggauaauccaaaggaugaaauaaaugggcuugggagucugccugccauauauagccugccugccuuuucuuuaauuuuauccccaccaggaaaaccuaaacaggauccgguuucccuuccauucuguaugcuguggcuuuuggacucuuguaucacagccccaaauccccuuucugagccucuuuugugccuuuccuuucuuuauuaaagaaccuaugaauugccacugcccucuaaaaccuucccugcguagaaaucagauaaugugcuugucacuccacagacagcaauuaaaacaggaaccuguuuauaaacaaaaauacuucagaaaauaaaauacuuggagugauuaaaacgagccucuccaugacgccuggcgucucaaggagacuggaaugcguucuaaccugaauacuuugccgauuggugagaaaaugacugcaacauagagcaccacauauacuccaagcugugcgagucuggacaagucacucucccucucugugccugaguuucuucaucuauaacaggauaacgaugcuuucucugucauccuuauggguuaaaauguuaaaauaacagauacagguaugaguaaaacguugaugaugguggcaaagugcuuugaggaccuugggaauuauuucuucaccuuuauuuauugaagcuaauuuucagggacauuucauccaacuaacagugguaugaggucaguuucauucaaaaugagggcaggaccuuagggaccuucaaauuaaaauggccaugaaacaucaugacuuaccuaugagaauggccaaaauaaauaaacagugaugacacgaaaugcugccgaggcuguggagaaauuugaucacucagacacugcuggugggaauguaaaauggcacggucacuccgggaagcaguuuggcaauuuucuuguaaaauuaaacaugaaauuaccauaugacucagcaauugcauucuugggcauuuaucccagagaaauggaaacuuauauucauacaaaaccugaacacaaacauccauagcagcauuauuuguaauagucaaaggcuuguagcaacucagacauccuucagaggggagaauaaacacacugguacaccuauaccguggaauacuacucggcaauugaaaaggaaccgaugacugauacacacaacaacuugggugacucugcggugaauuaugcugaguaaaaaaaaagccagccccaaaagucuacuguaugaguccauuaauauaacauccuugaaaugaacaaauuaaugaaauggggaacagauuaauaguugcccaggggucauggacaaagagauggauggggagguacugaaggaagguggcuaugguuacaaagaguaacgugagagagauuggucgugauggaacuguuugguguuuugacaguggugguagguacaugaaccuuuaugugugauaaaauugcacuuaguccuggugcagguacacacucacacaaaagagugcaaguaaaacugaggaaaucggaacaagauggguggauuguuauuuaugucaauacucugguugcgauauuguauucuagcuuuguagccuauaaccauuggaagaaguugaguaaaaggcacacaggaucucucuguauuauuucuuacaacuguaugugaguuuacaaugaucucaaaauaaacaauauaagaaaaauauuugaggcaguuuucagagccaggguggucagaauccaucuuaucaguguuccggggagcugaugcuacuaauguuugccagaauuggagaucugacucuauuccauugugcugauauuucagccaguuggacauguugccuguagagcaggaagagagcugggagcguaagcagagcgccacccagcuagauggggaccuugggcauuuaucccagagaaauggaaacuuauguucauacaaaaccugaacacaaacauucacacagcuagaugugacacaauuggguagauuuucauggcccuuccucuuuaguaagguuugauaaugucucccuggauuguagaacccagaaaauaagcacagcgccuucuuuuggagcaagagcagggagcagaaaucggucagguucaaaguacugucaugucuggcccuggggcuggggcuggaugccgccucugguccuguggccucggcugugacgggguugacuguggaauucugcugagcuggaaaggacauggccaccgugcgugccauuggcaggcaugcuggagauagaccuggggagccaagugcuggccggcugcucccugggagacaucacaccagagcuacagagcucaggcguguucuucagccccauggcaggggacagauggugaugggagccuggcgaccuggcucuuuuggggaagacucuuucuugagaaagugugcuagaauugugaggucagcagacuuugcaugauggcugucuuuucuuugaaguuguaggacagucccaucuggacagcaacauugagaaucaagagauugucaccaauccgccagacauuugccaaguuguagaggugaccacugagagcgacgagcagccggucagcaugagcgagcucuacccucugcagaucucccccgugucuuccuaugcagguaagcgucagcgggaggcuccgggaggcgugggaaccggccgcgcaguccuuuggucuagggucacccaucucaccaccccacggagcaucccuccucuguccuaggaguuauucucccuggaguuuuucauacuuuaauuaucuugaucaacaucuucuuggacacuuuuguucucagguagaggacaggaucacagcauuucuuuacucaguuggccaugacauuuuuuauuuauuuauuuauuuuuuuuuuuuuugagacagagucucgcucugucucccaggcuggagugcagugggaugaucucggcucacuguaaccuccgccucccagguucaagagauucuucugccucagccuccugaguagcugggauuacaggcgcacaccaccaugccagcuaauuuuuguauuuuuaguagagacggggauucaccauguuggccaggcuggucucgagcuccugacgucaggugauccgcccaccuuggccucccaaagugcuggaauuacaggugugacccacagugccuggccucccauaacauuuuuauauaugguuacagauaagauuucuuuagggcaguaguucaucagagucuaauuuauuagcccaaguuauuagaaauuuggcagaguguuuuaauggauucucaguuugagcaggcuggauaggaccuuagagaugaucucuuccuguuccuucauuucugaaagggaaggggcuugcgcagggucguacagucagcaaguguuugggccaggacuugaccucagccuucagaccccaagcucauugcuagauccauuccauccaccaagcguacuuguccuuuccacauauuuucucuuucuuuuuauaucuaguacagguucuaauuaggccagaugacugagccauuuccaauucuccagggacuuggcuacauaaugacaggaguuggcccaggcagagucacagggggaggaacagauccaguugguucuuccauucuuccagaguaaaaggauggcuccucucguucgccaacauuacuucaucuucuccucucuuccugaugaucuccauugaauuuuguggaaaucaauuguaauuaggaaauauaaauucugagucaguguuacugcuugcagauauuaaaaauaaaaagcagaguccccauccugggaaacugcaguucagcucuagcaaauaguucagggauucuucccugugcucuuuacacgcugccaaaugggauguccuccaguaggugccacccccaacacuggcuccgaccagcguuggaauuagaguugacucaaaggacuguuguuugugaauuaucagccacuaagucuaaucucauuuucccugaaugccaacuuucuuuuuuuuuucacuuuuaaaaauugugguaaaauacauuaacauaaaauuuaccauuuuagccauuuuuagguacacaguuuaguagcauucagugcauuaauguugucgcagccaucaccagcauccaccuccagaacguuuuucaucuugcgaaacugaaacucugucugcauuaaacacuaaguccucuuuucccuccuccaccccagccccuggcaaccuccugccuauuuucuaucucagugaauuuggcuauucuagguaccuccuaugaguggaaucauagugcuuguuguuuugugacuggcuuauuucacuuagcauagguccuagugugcauuuaugcuaggagcguaaguggaaugugagaauagaccuuggccacaggaagauuauaaucugucaaacaggauaagcuugucuucggugcuuuauucagcaaaugcguuuuggacucuuacacgugccagucccuguuugguccuugccagagugcagucacaagaacuacuauguuuugcaaauuuauugugcccugggaaccaugcucagugcuuggguacaguugacuguuguuguuguuguuuguuguuguuguuaauagaaauaggguucugccuugcugcccagguuggucuagaacuccugggcucaagugaucugcucgccucagccucccaaagugcugggauuacgggcaugagcugccaugccugguaugauacaguugacuuguuuaauuauaauuagaguaacccugucagccuggguaucgucaucaucccguuuuuaaaagugaggaaucuggcugggugugguggcucacgucuguaaucccugcacuggaaggcugaagugggaggaucacuugagcccggaaauuggagaccagccugggcaacauagugagaccacacuucuacaaaaaauaaaaaaaguuaaccgggugugguggcaugugcccguagucccagccacuuggaaggcugaggcaggagcauccccuugagcccaggaguucaaggcuucauugagcccugguugcaccauugcacuccagccugggugacagagcgagauccugucuuaaaaaaaaaaaaaaagaaaaaaaaauauauauauauggaucugcggcuggcguggguagagcagcgugucugagggaggaacgauugggagcacagcuagaacccaugagccguugaugccaaaggccgguccuuaacgcccgcccugugucgcugcccuggacagcgcacgggcucugccguucagaacacagccacaucccgugaucucauuugauuuucacaaggacccaccaaaggaggcagagcagaauguuuaugccuaaauuuuacaguagagcuaaccgaagcgugaaacacucagccacuuugcuuauauuuacauaguuauggcuaaaaacccaugacuuucuucuauagccugcugcugcaggcaucguuacacuccaugugguuuucuuucucucuucuuuuuuuaggggguuggagcuuuagaauagacuucuauguuuaucuguugaguaagacuuuucugaggucuucuuggggauucuggaaagaccucuucuugcuguucugccagcaguggcauuugcucaagcaaaagauuccggagaacagcagauccaugcagagagaaaugaacauuucauuacucucuucaggacauuugcauagguuugaaaggaaggauuucagugccaggauggcagucaacaggagguuuugcuggagccuggcuuuucagccuggccuuugguucuuuccguuguuuucauugucuggauucuccagaaccucguggagggaggcuuacugguuggaggcaaaauguuccaucgcugcugauguucuagagcucacagugguguaaaacauuucccugcuacugacuguagcuaauuuuaguuccuccgucagaaauuguauaacaugcugucaggaaaggcagcuuucugcguguauucaccuuucuugcuuuauguucuccaguagagucggccauuugccuguuuuucaugauggaguuccuuuguuugggcuguucaucugaauuucaaucuccucugaccaccuuuuuuuuuuuuuuuuuuuuuuugagacggagucucgcucugucgcccaggcuggagugcaguggugcgaucucggcucacugcaagcuccaccucccggguucacgccauucuccugccucagccucccgaguagcugggacuacaggcacccacaaccaagcccggcuaauuuuuuuuguauuuuuaguagagacgggguuucaccguguuagccaggauggucucgaucuccugaccucgugauccacccgcuucggccucccaaagugcugggauuccaggcgugagccaccgcgcccggcaugcucugaccaccuuuauucaucuguuugggaaacugguauuuggaggcugcuguuugcuaguuuuucccccuacugaucguugaaucauaaucccaguaguauauuacaaaaccacauucaguuuugcaagucugucuucuccucuguggucuaaauauuaugaugagaaagagaagagauaguacuugcguuggauguuuuaagacaacauaaaauucuagugugauuugugaaacuuucauacuagggagggacauuucaaagugccacuuugggaagcucuggcggagagacaugucauguuuaaaggugcauuacaaagugaccccuugccugaucuguggcaucagaauuuuauuaggugguugaugguuuaguagaagaaaaccacaguagaauaauggggugggggaggauggguaagaggggcuggagaguagacucgagaagaaaacaucaucugaaggacucacuggcuauaaugagagaguggagaucgccugcugaccagcagccaucaguaaaggcuuugaauccuucgggaaaccacaccaggcuugcauuuuguugggcagagcaaagacacaaucgcuuugagauuaagaggauuccgauuugaaaauaauuuacuccuggugaaaguaauugagaauaugaucaauagaaagaaauucaaaucaaacuugcugaacaagagccuuccagaaaguguagcagaaugucagagugcaaaaagccuuucaggugaaaaugcauccucucccuucccgcaguguuccugcuuagacaauauguauauccucagcgaggcguuaaaaacuggacuggauagagagugaaccuacaaccagugucacccuagaacuggaagagcuuuugagaucaucuaauccaaauccuccccuucccucccacccuagaugcuuucaggaaaacugagaccagaaagguuaagugaauuacucaugugccuguugguacuguacgaacaccuucagcuucuucauuuguuuggaguugcuggagaagcaacuccagacuucuuuauuccauuguauucgaaguaaguaauaaacaaaaagcaaaaacaaauucaaacuaaucaaaagggaaaaugaaaugacaacguauguugauaguucgauaguaacacugaucuggaggcccagcugcagucagcucccuuguguaagaagucagcguggaaguggcaaugguggucaaaccaaggaaacagaggacacggggcgcagugcauccaacaaagcacuuggagccaccgauucuggggucacagagagaacugcuccccucagggggagguucaggguucucugcuccuaagcuaagguacugaaggccccuuuuugaaacugucaguguccuaauagggcgcaucuuccugacgacuucagaugcuguggaacuuaaucuagacacgacgcucuuuaacucgcauuugugucagcugaaaacauaaguucggagcauguguaucuuuucuuaucugcagcuauuuccccgaagcugaaaacuggguacuuaaaggaaguuagcaucccggucacauucaugggcggugcaaggucuuacccgggagccuuaccccaggaucugacuuccagccccuccugcaccugcgacuggggcugugcuggaaucccagcccccaaagcaugcuugguugcguaucuuuguuuguauuuggaggggaaaggaaaagaagacagugauauuuauggagagucauuaggagugaagagcaucugaacccguaugaaaggaagagaaagcuuggcuuuggagcacaaagaaagcuaagcauaaaauggaaagcggaucuugaaauguugucagagaccagaacaccagggaagcagggcugcugugugcagugcacaggcccuggaaucagaaguacaguuuuguuuucucuccucugugcugucucaguuggcaacuuuggcaaguuucucaacaucucuguuccucauuuuucuucuugggaguggcuguuccgauuccugccuccucaggauacugagccagcacgaggguucucugaggaggggaauuuucuuuuucuguugguuuucauguguuucugcguggaaacaauucuugugcucggcaacgucagcucaucuucauagcugggaucgucgucagcugaggcugagggcuucucugggucucuguggcucccagcacgggguguuuuggggaaacaugcccaguccgaggaguggagagaucugucuucugcaugcucauggccagcccaccgcgaucacucagguuugugugaaguuacuggagaacaguggcugagaaacaggcccagagacuccaggcugggaccaguggaguccacauucuuacuuuccuuguuuaaggaaugcaccuguggcacaguuuguccauuuguucuuuugccuuuaauugauagagagccuggucuggggcuaaugcucucaguggaagaaagggcucugucugggcuggagccaucucaucccagcucugccaccaggaagaugugagacagaggccagccccucagcagggaccggguggaaagcuggaaggcacuggagcauaagagcucuucugcguaacgggggaugagagcagcugcuugcugacgugggaccccugugagaccugcaugcaaagccucugacauggcacugacccauagggcucccuaaauguuugcuucuuuuagaacacgagcuucacuuuuggauuuucuuguguugugaaauauacgucaccuaaaauuuaccauacuuuuggguaugggguuauuaaauucagcauuggaacuaaauaggaggaaaggcaguuaaagguugccaucaggaagagaagcuauugcaguuacucuuuaggccuugucuguaaaacgaauggcucaggcuaagugaucucuaaaugccuaaauauugcacaggcucugcccucugugauugcauuucucaaugguuauggacacuggaauaaucgcacaccauugauauuuuauuuuacaaaaucaaaauguuuuuacguuuaaaaagcuuuuuauaagcauaggucauguguaaucacuagacuucgauuccauuaauccagccuguugugcaaacccaguguuaagcagugcugauguauggagugugugcugugugccaggcccuugcuaggccuuucccauguacccucucacucacucuccauguaauccucuuagaugguggcagugcccucauuuuacagaggagaaaacugcagcucaguaaaggugagaaacuugcccagugucucacagcuggcaggccaaauggggauggcaacugauuggcugccauagccaugcagccacaaacuuaguggcuugaagcgacacacauuuggaucuuacaguuucuuugagucacgaauccaggcguggcuuagcuggguccucugcugcagagucuugcaaaccugccauggagguguuggcuacagcugcugucucaucugaggcucaacuggggaaggguccauuuccaagcucaugugguuuuggcaaaauuaaguuucuugcagguuguuggacuaagggccucagucucuugcuggcuguuggcuggaagcaguccuuaguucuuugccauaggagccuucccaacaugguugcuugcuuuaucaaggccagcaaggcagaguguuuccucucccagcagguuucugaguuauguaacaugaucauggacacaggaucacauccauuucauccccuuugcuguaucuuauuuguuagaagcagacacauuccauccacacucaagggaggcaaucccaaagaaagugaauccaaggaggugaggaucauggggagcaccccagaucuguccaccuacaguaacccacauggcagaugcaacucuagaaauccaggaucuaaguccuaaaggggugagagguaaaggaaggaucugagugggauggggauaauguaggaagaccuuuuggaaacggucaacucugcacugggaauuaaaugaauugguuggcauggauugaaagacaggacccaugugggcauuguggacagagcugcagugaggagggccccagggaccagcgccccuuccugggagguagugcccaguguauacacagcccggcccuggccaagggagccuccucacagcucucaagccugguuucuccgaagauuacagaguugaaauucacucuagcuucucccauguagaauguuucgcuuuacaaagggagggaggugaugcguuuaguuacucagucuccuuuuuauaaacacugccugagccuggggacagcuugagggacaggaaugauggcccuguguuuuucucucugugaacagaaagcgaaacgacugauagugugcccagcgaugaagagagugccgagguaagccacugcccagccugcccacgaugcugccaaggaaaagccucccgaccagcuccgggcuuuccuugcugcugguuaugcaccuuuccuuuagaucacaagcuucacuuugggauuuucuuguguggugaaauaugcaucaccagaauuuaccauacuuuuggguuugggguuauaaaauucggcguuggaacugaaaggaggaaagggaguuaaauguuaccaucagguagagaagcugugauagcaggaaaagggaauugaaguggaggcugggaaaugccgaugcucuuaccacuuaaacauccuacuucaccggcaaaaauagagcagccuucccagccaaaagcagugaccaguacacgucacaaaaugcuaagcaaaagccucuuccacgugugcguggguucccucccgcugugacccgugcccagagcugguugugugccccaucucgauuccgagugggucccguccccucucccucccauagauggggcgugcacaauggcagaaaguggcuggaauggagauggaaagcauuccugcuggccaccugcugggggucugcgcuugagugaaugagagagagagagggagggagcaagagagagggaagcucaugguuguuugaauuagugguuucccauguacuaaacacuuugagaaaaagugcagggauucugaaaagacagauguacacgcucccauacacccuggccugauuucuucaagguugcagcucuagccacuucucugaaugaagccagcccugaggccgcugcuugcuguacaccguggagcucuaagccgcccccauuugaaagcaaucaaggggcauucauugccugucacuaaguuccucgcugccuuuucucugaaaaugcagguuggcucagguugacugggccagcauugagggaccgagucgcugugccacacuggccauggugaccugaaaccuaucgaauaaucgggccgagccgcagagcacaagggaaccagaaaccaagcugcugccuucuuuuccugccuucacagaguagucuggaaaguauuucugggagguagcaaaugggaauugauuuuuuaaaaaaaaagaaaagggaagaaaaaccauuacuuggcauaugaauagcugggugcaauagauuucaguugagggauguagaggugcuaagccuuuguucauucugcaguucuuaagaaacucagcuaaagcaccaacacaugggaacgacacauuuuucauuuuaaaauuuuuuuuguggguuguuguuuugagacaaggucucauucuguugcccuggcuggagugcaguggcgcaaucauagcugacugaggccuugacuuacugcgcuccagugauccucccgccucagccucccgaguugcuggggcuaaaggugugcaccaccaugccuagcuaauucuuacguuuuguagagaugaggacucgcuacauugcccaggcuggucucaaacuccugagguuaagugauccuccagccucagccucccaaagugcugggauuacaggcaugagccaccacaccuggccagugaugcauuuuuaaaaagccauccaauagaaggagaaggaaauacauaucuuaauuacuuucuugaaaggggcggccacacuggcggaagaggaauauugaaggcaaacaguaccucagcaacauggggacucgaggcuccuaccugcugcccggcauggcguccuucgucacuuccaacaaaccggaccuccaggucaccaucaaagaggagagcaauccggugccuuacaacagcuccuggcccccuuuucaagaccucccccuuucuuccuccaugaccccagcauccagcagcagucggccagaccgggagacccgggccagcgucaucaagaaaacaucggauaucacccaggcccgcgucaagagcuguuaagccucugacucuccgcggugguuguuggggcuucuuggcuuuguuuuguuguuuguuuguauuuuauuuuuuucucucugacaccuauuuuagacaaaucuaagggaaaaagccuugacaauagaacauugauugcuguguccaacuccaguacuggagcuucucuuuaacucaggacuccagcccauugguagacguguguuucuagagccugcuggaucucccagggcuacucacucaaguucaaggaccaacaagggcaguggaggugcugcauugccugcggucaaggccagcaagguggaguggaugccucagaacggacgagauaaugugaacuagcuggaauuuuuuauucuugugaauauguacauaggcagcacuagcgacauugcagucugcuucugcaccuuaucuuaaagcacuuacagauaggccuucuugugaucuugcucuaucucacagcacacucagcacccccuucucugcccauuccccagccucucuuccuaucccaucccaucccaucccaucccaucccaucccaucccgcucuuuuccuacuuuuccuucccucaaagcuuccauuccacauccggaggagaagaaggaaaugaauuucucuacagaugucccauuuucagacugcuuuaaaaaaaauccuucuaaucugcuaugcuugaaugccacgcgguacaaaggaaaaaguaucauggaaauauuaugcaaauucccagauuugaagacaaaaauacucuaauucuaaccagagcaagcuuuuuuauuuuuuauacaggggaauauuuuauucaagguaaaauucuaaauaaaauauaauuguuuuuuaucuuuucuacagcaaauuuauaauuuuaagauuccuuuucuuguuuaucagcaguuguuauuacauccuuguggcacauuuuuuuuuuuaauuuuguaaaggugaaaaaagcuuuuaugagcucauguagcaaucagauuuuccuguggauugauaauaaaugaauaugauauauaguuaaauuuuuaa

SEQ ID NO: 192941 - RNA, 86851 nt, Homo sapiens
uuaaaaauuuaacuauauaucauauucauuuauuaucaauccacaggaaaaucugauugcuacaugagcucauaaaagcuuuuuucaccuuuacaaaauuaaaaaaaaaaaugugccacaaggauguaauaacaacugcugauaaacaagaaaaggaaucuuaaaauuauaaauuugcuguagaaaagauaaaaaacaauuauauuuuauuuagaauuuuaccuugaauaaaauauuccccuguauaaaaaauaaaaaagcuugcucugguuagaauuagaguauuuuugucuucaaaucugggaauuugcauaauauuuccaugauacuuuuuccuuuguaccgcguggcauucaagcauagcagauuagaaggauuuuuuuuaaagcagucugaaaaugggacaucuguagagaaauucauuuccuucuucuccuccggauguggaauggaagcuuugagggaaggaaaaguaggaaaagagcgggaugggaugggaugggaugggaugggaugggaugggauaggaagagaggcuggggaaugggcagagaagggggugcugagugugcugugagauagagcaagaucacaagaaggccuaucuguaagugcuuuaagauaaggugcagaagcagacugcaaugucgcuagugcugccuauguacauauucacaagaauaaaaaauuccagcuaguucacauuaucucguccguucugaggcauccacuccaccuugcuggccuugaccgcaggcaaugcagcaccuccacugcccuuguugguccuugaacuugagugaguagcccugggagauccagcaggcucuagaaacacacgucuaccaaugggcuggaguccugaguuaaagagaagcuccaguacuggaguuggacacagcaaucaauguucuauugucaaggcuuuuucccuuagauuugucuaaaauaggugucagagagaaaaaaauaaaauacaaacaaacaacaaaacaaagccaagaagccccaacaaccaccgcggagagucagaggcuuaacagcucuugacgcgggccugggugauauccgauguuuucuugaugacgcuggcccgggucucccggucuggccgacugcugcuggaugcuggggucauggaggaagaaagggggaggucuugaaaagggggccaggagcuguuguaaggcaccggauugcucuccucuuugauggugaccuggagguccgguuuguuggaagugacgaaggacgccaugccgggcagcagguaggagccucgaguccccauguugcugagguacuguuugccuucaauauuccucuuccgccaguguggccgccccuuucaagaaaguaauuaagauauguauuuccuucuccuucuauuggauggcuuuuuaaaaaugcaucacuggccaggugugguggcucaugccuguaaucccagcacuuugggaggcugaggcuggaggaucacuuaaccucaggaguuugagaccagccugggcaauguagcgaguccucaucucuacaaaacguaagaauuagcuaggcaugguggugcacaccuuuagccccagcaacucgggaggcugaggcgggaggaucacuggagcgcaguaagucaaggccucagucagcuaugauugcgccacugcacuccagccagggcaacagaaugagaccuugucucaaaacaacaacccacaaaaaaaauuuuaaaaugaaaaaugugucguucccauguguuggugcuuuagcugaguuucuuaagaacugcagaaugaacaaaggcuuagcaccucuacaucccucaacugaaaucuauugcacccagcuauucauaugccaaguaaugguuuuucuucccuuuucuuuuuuuuuaaaaaaucaauucccauuugcuaccucccagaaauacuuuccagacuacucugugaaggcaggaaaagaaggcagcagcuugguuucugguucccuugugcucugcggcucggcccgauuauucgauagguuucaggucaccauggccaguguggcacagcgacucggucccucaaugcuggcccagucaaccugagccaaccugcauuuucagagaaaaggcagcgaggaacuuagugacaggcaaugaaugccccuugauugcuuucaaaugggggcggcuuagagcuccacgguguacagcaagcagcggccucagggcuggcuucauucagagaaguggcuagagcugcaaccuugaagaaaucaggccaggguguaugggagcguguacaucugucuuuucagaaucccugcacuuuuucucaaaguguuuaguacaugggaaaccacuaauucaaacaaccaugagcuucccucucucuugcucccucccucucucucucucauucacucaagcgcagacccccagcagguggccagcaggaaugcuuuccaucuccauuccagccacuuucugccauugugcacgccccaucuaugggagggagaggggacgggacccacucggaaucgagauggggcacacaaccagcucugggcacgggucacagcgggagggaacccacgcacacguggaagaggcuuuugcuuagcauuuugugacguguacuggucacugcuuuuggcugggaaggcugcucuauuuuugccggugaaguaggauguuuaagugguaagagcaucggcauuucccagccuccacuucaauucccuuuuccugcuaucacagcuucucuaccugaugguaacauuuaacucccuuuccuccuuucaguuccaacgccgaauuuuauaaccccaaacccaaaaguaugguaaauucuggugaugcauauuucaccacacaagaaaaucccaaagugaagcuugugaucuaaaggaaaggugcauaaccagcagcaaggaaagcccggagcuggucgggaggcuuuuccuuggcagcaucgugggcaggcugggcaguggcuuaccucggcacucucuucaucgcugggcacacuaucagucguuucgcuuucuguucacagagagaaaaacacagggccaucauuccugucccucaagcuguccccaggcucaggcaguguuuauaaaaaggagacugaguaacuaaacgcaucaccucccucccuuuguaaagcgaaacauucuacaugggagaagcuagagugaauuucaacucuguaaucuucggagaaaccaggcuugagagcugugaggaggcucccuuggccagggccgggcuguguauacacugggcacuaccucccaggaaggggcgcuggucccuggggcccuccucacugcagcucuguccacaaugcccacauggguccugucuuucaauccaugccaaccaauucauuuaauucccagugcagaguugaccguuuccaaaaggucuuccuacauuauccccaucccacucagauccuuccuuuaccucucaccccuuuaggacuuagauccuggauuucuagaguugcaucugccauguggguuacuguagguggacagaucuggggugcuccccaugauccucaccuccuuggauucacuuucuuugggauugccucccuugaguguggauggaaugugucugcuucuaacaaauaagauacagcaaaggggaugaaauggaugugauccuguguccaugaucauguuacauaacucagaaaccugcugggagaggaaacacucugccuugcuggccuugauaaagcaagcaaccauguugggaaggcuccuauggcaaagaacuaaggacugcuuccagccaacagccagcaagagacugaggcccuuaguccaacaaccugcaagaaacuuaauuuugccaaaaccacaugagcuuggaaauggacccuuccccaguugagccucagaugagacagcagcuguagccaacaccuccauggcagguuugcaagacucugcagcagaggacccagcuaagccacgccuggauucgugacucaaagaaacuguaagauccaaaugugugucgcuucaagccacuaaguuuguggcugcauggcuauggcagccaaucaguugccauccccauuuggccugccagcugugagacacugggcaaguuucucaccuuuacugagcugcaguuuucuccucuguaaaaugagggcacugccaccaucuaagaggauuacauggagagugagugagaggguacaugggaaaggccuagcaagggccuggcacacagcacacacuccauacaucagcacugcuuaacacuggguuugcacaacaggcuggauuaauggaaucgaagucuagugauuacacaugaccuaugcuuauaaaaagcuuuuuaaacguaaaaacauuuugauuuuguaaaauaaaauaucaauggugugcgauuauuccaguguccauaaccauugagaaaugcaaucacagagggcagagccugugcaauauuuaggcauuuagagaucacuuagccugagccauucguuuuacagacaaggccuaaagaguaacugcaauagcuucucuuccugauggcaaccuuuaacugccuuuccuccuauuuaguuccaaugcugaauuuaauaaccccauacccaaaaguaugguaaauuuuaggugacguauauuucacaacacaagaaaauccaaaagugaagcucguguucuaaaagaagcaaacauuuagggagcccuaugggucagugccaugucagaggcuuugcaugcaggucucacaggggucccacgucagcaagcagcugcucucaucccccguuacgcagaagagcucuuaugcuccagugccuuccagcuuuccacccggucccugcugaggggcuggccucugucucacaucuuccugguggcagagcugggaugagauggcuccagcccagacagagcccuuucuuccacugagagcauuagccccagaccaggcucucuaucaauuaaaggcaaaagaacaaauggacaaacugugccacaggugcauuccuuaaacaaggaaaguaagaauguggacuccacuggucccagccuggagucucugggccuguuucucagccacuguucuccaguaacuucacacaaaccugagugaucgcggugggcuggccaugagcaugcagaagacagaucucuccacuccucggacugggcauguuuccccaaaacaccccgugcugggagccacagagacccagagaagcccucagccucagcugacgacgaucccagcuaugaagaugagcugacguugccgagcacaagaauuguuuccacgcagaaacacaugaaaaccaacagaaaaagaaaauuccccuccucagagaacccucgugcuggcucaguauccugaggaggcaggaaucggaacagccacucccaagaagaaaaaugaggaacagagauguugagaaacuugccaaaguugccaacugagacagcacagaggagagaaaacaaaacuguacuucugauuccagggccugugcacugcacacagcagcccugcuucccugguguucuggucucugacaacauuucaagauccgcuuuccauuuuaugcuuagcuuucuuugugcuccaaagccaagcuuucucuuccuuucauacggguucagaugcucuucacuccuaaugacucuccauaaauaucacugucuucuuuuccuuuccccuccaaauacaaacaaagauacgcaaccaagcaugcuuugggggcugggauuccagcacagccccagucgcaggugcaggaggggcuggaagucagauccugggguaaggcucccggguaagaccuugcaccgcccaugaaugugaccgggaugcuaacuuccuuuaaguacccaguuuucagcuucggggaaauagcugcagauaagaaaagauacacaugcuccgaacuuauguuuucagcugacacaaaugcgaguuaaagagcgucgugucuagauuaaguuccacagcaucugaagucgucaggaagaugcgcccuauuaggacacugacaguuucaaaaaggggccuucaguaccuuagcuuaggagcagagaacccugaaccucccccugaggggagcaguucucucugugaccccagaaucgguggcuccaagugcuuuguuggaugcacugcgccccguguccucuguuuccuugguuugaccaccauugccacuuccacgcugacuucuuacacaagggagcugacugcagcugggccuccagaucaguguuacuaucgaacuaucaacauacguugucauuucauuuucccuuuugauuaguuugaauuuguuuuugcuuuuuguuuauuacuuacuucgaauacaauggaauaaagaagucuggaguugcuucuccagcaacuccaaacaaaugaagaagcugaagguguucguacaguaccaacaggcacaugaguaauucacuuaaccuuucuggucucaguuuuccugaaagcaucuagggugggagggaaggggaggauuuggauuagaugaucucaaaagcucuuccaguucuagggugacacugguuguagguucacucucuauccaguccaguuuuuaacgccucgcugaggauauacauauugucuaagcaggaacacugcgggaagggagaggaugcauuuucaccugaaaggcuuuuugcacucugacauucugcuacacuuucuggaaggcucuuguucagcaaguuugauuugaauuucuuucuauugaucauauucucaauuacuuucaccaggaguaaauuauuuucaaaucggaauccucuuaaucucaaagcgauugugucuuugcucugcccaacaaaaugcaagccuggugugguuucccgaaggauucaaagccuuuacugauggcugcuggucagcaggcgaucuccacucucucauuauagccagugaguccuucagaugauguuuucuucucgagucuacucuccagccccucuuacccauccucccccaccccauuauucuacugugguuuucuucuacuaaaccaucaaccaccuaauaaaauucugaugccacagaucaggcaaggggucacuuuguaaugcaccuuuaaacaugacaugucucuccgccagagcuucccaaaguggcacuuugaaaugucccucccuaguaugaaaguuucacaaaucacacuagaauuuuauguugucuuaaaacauccaacgcaaguacuaucucuucucuuucucaucauaauauuuagaccacagaggagaagacagacuugcaaaacugaaugugguuuuguaauauacuacugggauuaugauucaacgaucaguagggggaaaaacuagcaaacagcagccuccaaauaccaguuucccaaacagaugaauaaagguggucagagcaugccgggcgcgguggcucacgccuggaaucccagcacuuugggaggccgaagcggguggaucacgaggucaggagaucgagaccauccuggcuaacacggugaaaccccgucucuacuaaaaauacaaaaaaaauuagccgggcuugguugugggugccuguagucccagcuacucgggaggcugaggcaggagaauggcgugaacccgggagguggagcuugcagugagccgagaucgcaccacugcacuccagccugggcgacagagcgagacuccgucucaaaaaaaaaaaaaaaaaaaaaaagguggucagaggagauugaaauucagaugaacagcccaaacaaaggaacuccaucaugaaaaacaggcaaauggccgacucuacuggagaacauaaagcaagaaaggugaauacacgcagaaagcugccuuuccugacagcauguuauacaauuucugacggaggaacuaaaauuagcuacagucaguagcagggaaauguuuuacaccacugugagcucuagaacaucagcagcgauggaacauuuugccuccaaccaguaagccucccuccacgagguucuggagaauccagacaaugaaaacaacggaaagaaccaaaggccaggcugaaaagccaggcuccagcaaaaccuccuguugacugccauccuggcacugaaauccuuccuuucaaaccuaugcaaauguccugaagagaguaaugaaauguucauuucucucugcauggaucugcuguucuccggaaucuuuugcuugagcaaaugccacugcuggcagaacagcaagaagaggucuuuccagaauccccaagaagaccucagaaaagucuuacucaacagauaaacauagaagucuauucuaaagcuccaacccccuaaaaaaagaagagagaaagaaaaccacauggaguguaacgaugccugcagcagcaggcuauagaagaaagucauggguuuuuagccauaacuauguaaauauaagcaaaguggcugaguguuucacgcuucgguuagcucuacuguaaaauuuaggcauaaacauucugcucugccuccuuugguggguccuugugaaaaucaaaugagaucacgggauguggcuguguucugaacggcagagcccgugcgcuguccagggcagcgacacagggcgggcguuaaggaccggccuuuggcaucaacggcucauggguucuagcugugcucccaaucguuccucccucagacacgcugcucuacccacgccagccgcagauccauauauauauauuuuuuuuucuuuuuuuuuuuuuuuaagacaggaucucgcucugucacccaggcuggagugcaauggugcaaccagggcucaaugaagccuugaacuccugggcucaaggggaugcuccugccucagccuuccaaguggcugggacuacgggcacaugccaccacacccgguuaacuuuuuuuauuuuuuguagaaguguggucucacuauguugcccaggcuggucuccaauuuccgggcucaagugauccucccacuucagccuuccagugcagggauuacagacgugagccaccacacccagccagauuccucacuuuuaaaaacgggaugaugacgauacccaggcugacaggguuacucuaauuauaauuaaacaagucaacuguaucauaccaggcauggcagcucaugcccguaaucccagcacuuugggaggcugaggcgagcagaucacuugagcccaggaguucuagaccaaccugggcagcaaggcagaacccuauuucuauuaacaacaacaacaaacaacaacaacaacagucaacuguacccaagcacugagcaugguucccagggcacaauaaauuugcaaaacauaguaguucuugugacugcacucuggcaaggaccaaacagggacuggcacguguaagaguccaaaacgcauuugcugaauaaagcaccgaagacaagcuuauccuguuugacagauuauaaucuuccuguggccaaggucuauucucacauuccacuuacgcuccuagcauaaaugcacacuaggaccuaugcuaagugaaauaagccagucacaaaacaacaagcacuaugauuccacucauaggagguaccuagaauagccaaauucacugagauagaaaauaggcaggagguugccaggggcugggguggaggagggaaaagaggacuuaguguuuaaugcagacagaguuucaguuucgcaagaugaaaaacguucuggagguggaugcuggugauggcugcgacaacauuaaugcacugaaugcuacuaaacuguguaccuaaaaauggcuaaaaugguaaauuuuauguuaauguauuuuaccacaauuuuuaaaagugaaaaaaaaaagaaaguuggcauucagggaaaaugagauuagacuuaguggcugauaauucacaaacaacaguccuuugagucaacucuaauuccaacgcuggucggagccaguguuggggguggcaccuacuggaggacaucccauuuggcagcguguaaagagcacagggaagaaucccugaacuauuugcuagagcugaacugcaguuucccaggauggggacucugcuuuuuauuuuuaauaucugcaagcaguaacacugacucagaauuuauauuuccuaauuacaauugauuuccacaaaauucaauggagaucaucaggaagagaggagaagaugaaguaauguuggcgaacgagaggagccauccuuuuacucuggaagaauggaagaaccaacuggaucuguuccucccccugugacucugccugggccaacuccugucauuauguagccaagucccuggagaauuggaaauggcucagucaucuggccuaauuagaaccuguacuagauauaaaaagaaagagaaaauauguggaaaggacaaguacgcuugguggauggaauggaucuagcaaugagcuuggggucugaaggcugaggucaaguccuggcccaaacacuugcugacuguacgacccugcgcaagccccuucccuuucagaaaugaaggaacaggaagagaucaucucuaagguccuauccagccugcucaaacugagaauccauuaaaacacucugccaaauuucuaauaacuugggcuaauaaauuagacucugaugaacuacugcccuaaagaaaucuuaucuguaaccauauauaaaaauguuaugggaggccaggcacugugggucacaccuguaauuccagcacuuugggaggccaaggugggcggaucaccugacgucaggagcucgagaccagccuggccaacauggugaauccccgucucuacuaaaaauacaaaaauuagcuggcaugguggugugcgccuguaaucccagcuacucaggaggcugaggcagaagaaucucuugaaccugggaggcggagguuacagugagccgagaucaucccacugcacuccagccugggagacagagcgagacucugucucaaaaaaaaaaaaaauaaauaaauaaauaaaaaaugucauggccaacugaguaaagaaaugcugugauccuguccucuaccugagaacaaaaguguccaagaagauguugaucaagauaauuaaaguaugaaaaacuccagggagaauaacuccuaggacagaggagggaugcuccgugggguggugagaugggugacccuagaccaaaggacugcgcggccgguucccacgccucccggagccucccgcugacgcuuaccugcauaggaagacacgggggagaucugcagaggguagagcucgcucaugcugaccggcugcucgucgcucucaguggucaccucuacaacuuggcaaaugucuggcggauuggugacaaucucuugauucucaauguugcuguccagaugggacuguccuacaacuucaaagaaaagacagccaucaugcaaagucugcugaccucacaauucuagcacacuuucucaagaaagagucuuccccaaaagagccaggucgccaggcucccaucaccaucuguccccugccauggggcugaagaacacgccugagcucuguagcucuggugugaugucucccagggagcagccggccagcacuuggcuccccaggucuaucuccagcaugccugccaauggcacgcacgguggccauguccuuuccagcucagcagaauuccacagucaaccccgucacagccgaggccacaggaccagaggcggcauccagccccagccccagggccagacaugacaguacuuugaaccugaccgauuucugcucccugcucuugcuccaaaagaaggcgcugugcuuauuuucuggguucuacaauccagggagacauuaucaaaccuuacuaaagaggaagggccaugaaaaucuacccaauugugucacaucuagcugugugaauguuuguguucagguuuuguaugaacauaaguuuccauuucucugggauaaaugcccaagguccccaucuagcuggguggcgcucugcuuacgcucccagcucucuuccugcucuacaggcaacauguccaacuggcugaaauaucagcacaauggaauagagucagaucuccaauucuggcaaacauuaguagcaucagcuccccggaacacugauaagauggauucugaccacccuggcucugaaaacugccucaaauauuuuucuuauauuguuuauuuugagaucauuguaaacucacauacaguuguaagaaauaauacagagagauccugugugccuuuuacucaacuucuuccaaugguuauaggcuacaaagcuagaauacaauaucgcaaccagaguauugacauaaauaacaauccacccaucuuguuccgauuuccucaguuuuacuugcacucuuuugugugaguguguaccugcaccaggacuaagugcaauuuuaucacacauaaagguucauguaccuaccaccacugucaaaacaccaaacaguuccaucacgaccaaucucucucacguuacucuuuguaaccauagccaccuuccuucaguaccuccccauccaucucuuuguccaugaccccugggcaacuauuaaucuguuccccauuucauuaauuuguucauuucaaggauguuauauuaauggacucauacaguagacuuuuggggcuggcuuuuuuuuuacucagcauaauucaccgcagagucacccaaguuguuguguguaucagucaucgguuccuuuucaauugccgaguaguauuccacgguauagguguaccaguguguuuauucuccccucugaaggaugucugaguugcuacaagccuuugacuauuacaaauaaugcugcuauggauguuuguguucagguuuuguaugaauauaaguuuccauuucucugggauaaaugcccaagaaugcaauugcugagucauaugguaauuucauguuuaauuuuacaagaaaauugccaaacugcuucccggagugaccgugccauuuuacauucccaccagcagugucugagugaucaaauuucuccacagccucggcagcauuucgugucaucacuguuuauuuauuuuggccauucucauagguaagucaugauguuucauggccauuuuaauuugaaggucccuaagguccugcccucauuuugaaugaaacugaccucauaccacuguuaguuggaugaaaugucccugaaaauuagcuucaauaaauaaaggugaagaaauaauucccaagguccucaaagcacuuugccaccaucaucaacguuuuacucauaccuguaucuguuauuuuaacauuuuaacccauaaggaugacagagaaagcaucguuauccuguuauagaugaagaaacucaggcacagagagggagagugacuuguccagacucgcacagcuuggaguauauguggugcucuauguugcagucauuuucucaccaaucggcaaaguauucagguuagaacgcauuccagucuccuugagacgccaggcgucauggagaggcucguuuuaaucacuccaaguauuuuauuuucugaaguauuuuuguuuauaaacagguuccuguuuuaauugcugucuguggagugacaagcacauuaucugauuucuacgcagggaagguuuuagagggcaguggcaauucauagguucuuuaauaaagaaaggaaaggcacaaaagaggcucagaaaggggauuuggggcugugauacaagaguccaaaagccacagcauacagaauggaagggaaaccggauccuguuuagguuuuccugguggggauaaaauuaaagaaaaggcaggcaggcuauauauggcaggcagacucccaagcccauuuauuucauccuuuggauuauccuacgugagggugaggacaucaauuaugcaggucacuagacacagacugacgcugaccuacaccaaccucucucuaguuuccucugccucuuccagccaaguaaaauaaaauggcaggaaaacaagauaauggccugcccuauccuaaguccuaagaagcagcugguggguggagguagaaaccaaauggggugugagaguuugaggagggagggcgcagcgauaccuugcauacuaaggcagugaaggucuuagauaaaugugacuuaagucaaagccauuuuaacuuccaauauuucaaaacucaucucuccuuugcacguugcuccuaacagaaagagggcaagccagcugggacuacaaacaauggcagcagcucaaguaucccccuagucagaucccuuuguuccaaccaggaauucuuucucucacugcuucuccccaugacguccuagucgguuauucaacuaacagagauuuauggaacaccugcuugcaccucccagccucccagggcuagaaggagcagcggaagaucgaugcagucaaggauccgguuuguaagaaguucauauacauggcuauaggccagcgacuaaccaucuagagagucaguuuaaggccgugagcacugaaaagaaagaaaagaaaaagaagggggccauacaauggaagcuagagaagugggguguuuuuuccaguuugaggaaucaaaggcuucaaugagguaguggcacaggaguggggguugagcaacaggcagcauucaccaugccccugacuucuggagccccuuccugacccgccagcacagacuggccucucuccccugggugccucucacucacuguccccgucacucggccgaaacuacgaugggccgcgaccuugugacacuucugaccucaaguugcugguuaacgcuauauacccguauggagcuuugaguuggucaauggcaucucuccucaaccaaaguaugaacuuuuuguguccagucaugacacaugcucacaacucccaccggagaggcgcucagggacucuccccugaauaaauggacaugugauggggccgaggcucacugacuggagccagaguggaguccugcaggggauugugacaaucugcaaauacgggacgugacaauuaauguuuucuagaaaaaugucaagacuucugacaaguggacucuugaaaccuuugggaagugauaaagacagccggcugugggugcgagggcuggggccagggaggaaacguguuggggugaugaaaauguucugucuugacuauggugguaguuacaucacugagugcgucugucaacauuuauaggaccgugugccuuaaaaggggugaauuuuaccguauuucacuuaauauacaugacuuggggaaaaaaguagauaagcacguccaugcagauuuuagguguauccugaaugcggcugaccaggagagaaaagucagucuguuuucugggcuaugaucuggauaccaaguuaauauaauuacguuaucucucaggccaaauucccccauaggaguguguugcuuuaugcccugguaagggacaauggcuucucuccauccagacaucguggguacuuuagaaacuuuccagcucucgagugaaagcccaugagagaagcagggaaaucccaauaucgaaaugcucucagaugagcaucaacacucucacuaaccagucucuaucuguuucucucucucucucucgacaugugaacugauuucccuggaccaccaagcggcaaaacagacagcaacacugacuccugacaggugaaaagacaggaauaacaaacuuaccugcuacaguaaacagucagaaguggcacuccucuggguaccaaagaguguccugacugaauaaugacaaaaccugucuuucugagcacugaucuuugccucucccuaccaccucccaagaccucacaacccaugaggaaggcacaauagugauccccauucuagacaugcugaaacaaccauacaagacagaacuacaugacuaauucaaggucagacagacaaucagcagcagaaccgggauucaauguuagccuuacccaacuccaaauuucaacucuuuauaauaugcucucccuaacagagagaguuaaugaaguccaaacugaguuacugagggcuuucuuagccccucucaggauaaaaacuuuugaaucucaccuuagugagucuccaggcucagaacuaauagugacauuucuuuucaacaguuaucuauugugugccagggaaauucucaaacagaagaacuagaaauccacuaaguuucuccaguuuauuaaagucagcacaucugaaaagagucacccacaggaaugcaauuuuaucugaaucuaguugcugagaauuauaacaauauuauuuauggcugguuacugaugaaccgguuugcuucuuuaaaaggucauucucacuuuauuagcaauuguugacuuaauguaggucuccaccugagaaagcaacuugcucccaugccucagagaaagugcuuaaaagcagauuauuagaaacagagggguccuuggaggugguuugguccuaccauuuuacaguugaaaaaagcugaaacccagagcucagguaaauugcuaaggucacccagguagcugcagagucaagaaugaaacuuacuagcaggcauaaaaaaucaggccaucagcagagcaucaugcagggaaauuuccccugaccccucugaaaguuucaggaguuaaacuucacaccagccuugaugacauggcacagauggaggcuacuuuucuuaaucaaauauauuuuaauaugauuuugguaauaugauaaucauaucauuuuacccccuucuagccccagagugauuuaucuguacauuucacuucauccucacaauaacucugcgagaugggcaggaucaguacgauuauuuccauuuucuauauaauuuuaaauauuuccauuuuauaaauaauuauauauuguuuccaaucuauauagaaauugaauuucaaaagauuaaggaguuugcccaaaaucacaugguaaauaaaaaacuucagaagcaggucuagaacccacgccuuuugacuucuaaucucgugcucuuucgguauaaaauacagccaugauuugguuuaggcacucgagagccauggugggagagaagaucaccgcggggccggugacuccgagacagggaucuguaggugccugggccaggcugucccugacuacaggcugcauacaccucaccagggugacagagugcaggaggaggcaagagugggacagggcagcgugcaccuugcaccccgugagaaaacagcaucucaggcuacuacacgaagggaagcacaggauguaucccaguaaaaacucaguagaggccaggcgcgguggcucacaccuguaaucccagcacuuugggagaccgagguagguggaucauuugaggucagcaguucaagaccagccugaccaacauggugaaacuccaucucuacuaaauacaaaaaaaauuacccaggcaugguggcgcaucccuguaaucccagcuacuugggaggcugaggcaggagaaucgcuugaacccaggaggcggagguugcagugagccgagauugugccacugcacuccagccugggcaacagagugaaacucggucucaaaaacaaaacaaaacaaaacaaaacucaguagagguaaccagugucucaagggucaaugaucugggagcggaaguguggaugagacguguugggcuggagcuauaccuccugcuggaacugccacguguccaccccucacugugcccuguggacaaagccuuugcagcugcuccaccauaaggagacccaccaccaaccucacugucucuaugagcagccacagggagcuuaacucguucagaguaauucaaguucaaagacagguaugaaagcagugggcagggccuagaucaugccagaccccggggaccugggggaacucagcuccuucucuuaggggcaguggugacaugaugacacuggcauucuuuauuuugugagaagaagaaauggggagcagaauggaagcagagcccaggugacagccaaggcaggcccacacacagugucagaaacaaggggauggacuugagaaguacggugagggaagauaggaggagcugacagcuaauuauaaacgaggcagcggcagccagggagagagggaaggagaaaauaauauauagccucacacaaagaugacagcuuucuugaguaaauaaaaacuucuuaaggcugaaaacacagcagcccaacuccacugcccaggucucucgguuggcaccuggugacugaggaguggccccacagucucaccucagugcccaggugcuccagguccaauacagccaagaauaaaguauguuguuguggguucugugucugggcauauugcgauguaaggguucacaucucauauggaguuucaucuugcuaagagcauucuagggguguggauaaaaucgaaugccuugucucaggccccuucuccuaaggggugaacaacucagcuuccaggaagaaggcaugggcacagcugacagcaugggugaucuccuaagagguggugccuuccaucuaaagacucacccagagcuacuuuuuaucuuuuuuuuuuuuuuuuugaggcagucucccucugucacccaggcuggagcgcaguggugccaucuuggcucacugcaaccuccgccuccuggguucaaucgauucuccugccucagccuccugaguagcugggacuacaggcaccugccaccacgcccagcuaauuuuuguauuuuuaguagagacaggguuucaccauauuggccaggauggucuugaucugcugagcucgugaaccacccaccucggccucccaaagugcugggauuacaggcaugagccaccgcgcccagccucagagcuacuuuuuaucuuauaaauaaaauuucuaucugaagcacaauaaaauauggcaaaaagaaggugaaacaaaggauaugggaagagaugaagacccaggguuccauagcccugugucaccgcuggccauccugaaaccacggcaagugcuggggccagagucugccaaccuugaguucaaauggguggcccucguggggacccuaacacuggucaguaagcugugaaucugcucuccugugccuucaggagcccauguugauacuuggguuugcaggcuugccuuaaaaagcggcuugaguuucaccauagauaaagacaggcaaguuuggaaacaauucccgaaaaaagaauauccuacagggggcacuuugagcagccaaaauuaagacaaaaaucccaacuccaugacuuccuaauugccguaugucuagucacuacagacugcucuaguuacuccacaguaaugaauagacucucugguuucauagcaaucuuugcuuuauuaaaggguggggcuguguuuuaucaagaaacacaacaggguuauagagcacugccgagaccagucagacagaauguccgcaccugcaaacuuuuuacacugcccgggagaugguuuaaauacaaaaaaagcacugcuaaccucggcaagaggccagcggaggccugucaggacaauucagcaugcugcuggcuucuuccguuucccaaaaacagaagucaccauacacacaacaaaaauucaaugcugaaagaaaguaaaaauaaaaaggaguuuuuucuucuccuuccccuuaaagggaaagcaggcugaggucuuuugggcacuauuccugugcaucuggccauacaggagagaaggaacaucagaagaugugucuucauuguaaagagccugcaucuuuacagggggugcagcuagcuacaucuggaaguuguucaacuguuacgaaggagggaaaacacugcuccucugagaccuccaaucuaaauuuggugccuugauuuuucucucgccuuucuuuucuuuugcaguauuuaccacacaugguaacacugcaguuaucugggggugucuuuguuuacuaucucugucccuccaugagaaaagaaauugggccuccuccaucuauuuccugcuccuaguacugagucugauauacagaaggugcucaaaaauaucugcugaaucagagugggcccuuuggcaacaugucucugugccucaguuucucugucugccaggaagcaguugcugagaggacucgcgaggaccaucuucccucuccuugguucccgaguuaaauaaauacucuuuugcccacgugaaccaaauagugaaagacugggaucgcuagccacgagccgccgggaaacaaacauuuuuccugggaggucaccccagccuucuuccacggaggcugacccgucuaaguuccuuuaucugauccucaaaagccuucguuucucagccuugaaaucugggggcuggaacuugcauucugagaugauuccaagaccuccucccacugacuauguuauuugaaguucucuguuuuacaaauuuuaggccccagggggcugcugguauguauaaaaaaugagacgucaaaacaguuuaccuaugauguucaccguacuauccacuucauuuuuuauaguugaagucaggaccgcauacucaggagaaagaucacuuacuccauuacuaagccccagagaugacucaacugguucuugcuaggaagaagaaaagaaaaaagaauugagaacacuuccuuuccccucccuucucuuagcugaaauucuacccucugccuacuuucuuuaaugcuagggucauucauguucagcugccgaauacauucauccccugcuucuuuaaacuggccuguuuuaaagcacauuucugcccagggugcacugcuggguauucagcuccuuccauuuuccuucaaggaaacgguaccggcccaucuggcuugccuuuaggaaaugcuuccaccugcagacaauagcuuuggggcuacgcagagcugcaucauugucucuguaaaaugcugcacugcguggauucuacacucuccuccucugagggggugcucaaaagaaucaaugccuggcuuucaccagggaggaaucaugcuaccucuuucauaauuauuucuuaggaaaagcucugccucagugacuggcccaagaacaggagcccagaggacauuguagaugaauucucugcagauaaguuuugccauggccucuggccaccugaggcccugcauuggauggcuggcugaucacccuggccugaguccagccgggcaaccccacaccaugggcuuuacauaaaugcccuucagguggcugaauaucucauccagcccaagaauucugcacgugcacacuaaugaaauaaugagaacaaauuccuuucccuuauuggagcucuaaaugugugcuuuuuuuucaagugcaccagaacccuccacucccuuguacuaaacagcucugcaaaagccagcccugaggugccuguggacguucagcucucaagguaaguuugcaucugcugcuacgauagcaaucaagucagacaaaagccacacaggacaacacccaaggaauccaaagcggaagaggguagagagcagaaggaacacaggacuggaagcagaggaucaugcaaguagacgugacugugcuuggaaaagucaacaguggucggcucugaaacaugguggguguucucaucagcuuauuuauacacuacuuggaaucaauccccccaaaauccucaaaaagucacuaacggaaggaggggaaauaaccuccuccuucauaaucccaccuggcaaacucccaccuuaauaacaugacuucaaaggcaucacuccacuguauagcucgguuuuuaaacaaaccauacacugccugguuuaccagaugucccgaagguccagcguaagggcaggcccagaauauccaucccuaccaggcacgauuuuuacuccuuucucccccagcaucuugcacucuucucucuuacaaguucuaaauaagaagucugccuuuucuugggccaagcacgguggcucacccuggaaucucagcacuuugggaggcugaggcugcaggaucguuucagcccaggaguucgagaccagccugggcaacauagcaagacccugucucuacaaaaaaugaaagcauuagccgggugugguggugcacgccucuuguccuggauacuugggaggcugcgguguugggaggcucuccugagcccgggaguucaaggaugcaaugagcuaugaucaugucacugcacuccagccugggugacagagcgagagccugauucuuaaagacaaaaaaaaaaaaagucugccccuucugaaaacaaaaaacaaaaaacaaaaaaaacccacuugccugugaccugggugagucagcagguuuucccuuccuucacaaccaaacuuccgacccgcugucugccuuuccggacuucgccucuccaccugggcccccauuaguuccuguggucucgcuuccucuccaccugcagaaucaagcucccagaagggucuugagagcucgggcuuuggaaucagaagggccuggagcaaagccuggcaccuccacuccucacugguugcagcuccuuauuuaaccucuguaagccacccuagggcacugcggacaguuguaaacugaggacaauaauaggacccacgucauagggauaaggugaagauuaaaugagcuaacuacguacauggcacuuacuaguaaauaagcacucaccauuaccaaaggucaccaacaaaacugugcucucccaaauccaauggccuuuucucaaaucccuucccccagccccauaugcugaccucugauggaccaugcuaucccuccauggcggccugaacugucugacacugcugcaauucuccaucucuccaacagcagccuccuuucucaauggcguccucaaugaccccuggucaguuuccccaccccgagucaugccccaccuuucacuaguccaccuccaucucuucaacucccucaaaaagaacuaagcacaggccucugaagaaguuacaagagaacugcucauuuguaugggcuuccuuugcugucugaccuuauuuuuuuagucauucuguuucuagguuucuuauaaaaguaaugaggcagucaggcuugcauauauuuaaaaagcuaaauuaauucugauuucuccauugaagaccucuaaguguuacacaugaucuacaguuuaauuagugacaagugauacuuuuaucacuugagaaaacgaugacucagagacuaaauuaauuuuccaagaucacgcuacuuuuagccugcagagacaccggaacugaacucugucuuuggucacgaaauaugguucaauuccaggagcuuucugucuuaagaagcccuuguauccugcccuaauuccagcggagacugagacacucuuuugaacacuguucuacucucucuccacacuuuuuuuuuuuuuuuugacauggggugucacacuaucacccaggcuagagugcaauggcgugaucuuggcucacugcaaccuccaccucccggguucaagagauucuccugccucagccucccaaguagcugggauuacaggugccugccaccaugccgggcuaauuuuuuguauuuuuaguagagaugggguuucaccauguuggccaggcuggucucgaaccccugaccucaggugaucugcccaccucggccucccaaagugcugggauuacaggcaugagccaccaugcccagccuucuacucucuccauucuuacccuguauccugcacugaccacuucuauaauggcaucauauauuccaccgauggaggcuaggagagacuauuccaaacacuguguuacuccccucaccccacuucaaaagaaacccugucauuucagagccaucagugccaaucaucucacugacaccgucacucuggacagacaguacagucaauggcacaguaaaacggagccagcaccucccgaaacaccuccauccagggugcagaacaggcccaggagagaaggaucuucacuaaacugggucacaauuuuugaaaugauuagaaguaggaauaucuaaaucuaagguauauuaaaaauccaaggaucucaaaugaagaaaagggguguggaguucucuauguaaaauaaacacagagauccugcaggcccugaacacucuucgcccgaagccucuccuggacccccgaugccccacuccugcccuggcucaacuccugcuuugcugcaccauaaccuggcccgguuaauccuggucaggauucacauccccucugucugcucccuuucucacuuuagauagagacucuucuguaaaucaaguaacccauagcuuucuuggcuuuuaauuuucuccccuugcuccaaagauuaaaaaaaaaaaaaaaaaaaaaaaagacucugcuuggguccagacuucuccacggugcaugaacuccagcaaacauuuauguucaaaaaucuuugcucuaauuguagaauccaaggauugaucuacgugggugcaugaacuccgccaaacauugacgcucaagaaccuuugcuauaauuacagaauccaagguuuggucucugguuuaagggauuuuaagcaaaagcaaacuggcacaagagagaguucaggggcaggagcacacuucuuuagaccuguaaaauaauacaccuuuagcuggucuugaagcuacacuugcugaaugggcuuggggacagaccagaguuagaggacagcagagggacuccccucugcuccgagcccaugcugucucaacccugugcuaaugccccuugucccugaagucccauuuaaugggccuccagcccaccucccaccuuccaaaaugcucuaacucaucugugcaaagccagucucuuugaagccagauuuaaggacaucaaauuuaaggacaucucuaagucucugcuaacagaacguguaggcugacagcuggacuucacaagcaggucagggaacuggaccuuggcgagugcacacacccagcacagaggcgcaaugccacugacaacagaagcucucguaagacaggcuggggccuccugcccggucccagaaccaccuuccuucugcuccuugcuuggaaugaggccaucgucauucucuuccucccuucucucacugcagcuucccucuugacuuuuucccuuagcucacuuuucucugcaucuucucugcgggccuuugucugcaucucuuagagaaggcaucaguuuccaaagcuaccaacgccauucucaaguaaaugaccacacaucugcccguugggcacucacucaagugcuguacccuccaacuuucuagcuggcauuuaccuucagggcucucugucacuucaaaggcagcauguccaaagcgaaacacccucuccacaaaacgaccugcauucccaacacucgcuucugaaggugcaaaacgccggggccuccucuuuaggccgcucuuaucugcauccuccguacccucuuccacuuucuggagaaaugucuccucccuccaugccaguggcaccagcuacugccuuuccacagcagucucuccugccucccacuccuucccaucccggugagaaaggccucccuuacauaucaauucccgccugcucuaagugugcuacaaggaguucaacugugucucauuccguaaaacugucccucaagcucuuccaacuggguucggagcucccguucugagcuaccacaugggaagggaggaucccgggcaggcagaauaagccugauaaccugcuucacccagggcaucucucaucuuaucuguuuuucaagugaguugcuggugugugcuuucauuugauuaaaguuuaaaaacugaagaccucuuccaacuagugaagggaucacuccaguagcagcccugccagggagugugcuguguuuuaauccagcucaggucacuguuagagccaacagcucuaugagaaagagcagccgaaccccuaucugcuuuucuguaacuucuacccauaggucugugcucagaacgaauacagaccaggccuaaucuuuuccaagcgacuuuggcagcccuucccaauucugucuccuucauaacacuaacacuuugauccggaagcacuuuacaguuucaagcauguauguuucagcugcaaacaacccuccgaagcaggaaguacccauuucuauucgccccaccuacaugccuguauuucccauugcccucucacacaaacuccugcucuaauuaagccaguuuccugucucauccaggaaagacaaaccaacuguaaucuccaggccuucauuccugaugccccuagugcugcggaaggaccaguuugacccuguccaccccucaaggccuggcuuaggccccaaaggcuacgaggcacccgguggacaaacuuggauucaaaucucagcucuguaaagcaaugcagccuugggaaaaugaaucagcuucucugugcacccauuuccuaaauguauaaaagggaaaugaccugcccaucacagggagaacucagugagacaaaaaucauagcugggaacuuggaaucagcucaaaaauaucaacuagcaccccucuguuuuaacuacuucuauucuuacuguucuuggccuugucugaagucucagagcaaaccguuccaugauauuuucugaaacauauacaugcacugaugauguagaauccaggauuucucauuauuguuuuucuuucuuuuuugagguggggaagggguccugcucuguugcccaggcuggagcgcaguggugcaaucacggcucacugcagccucaaacuccugggcucaagccauccuccuacaccucagccuccugaguagcugggacaggcauguaccacuguacccagcuguuuuucuuguucuuauuuccuuagauaaccaguuaccgccgcacagguggggcuuagcucaaggaaaacauggcugacugaguuuguagggauaugcucacaaagcgaaaugucagaggaugcugaggccguuucugcaccugccacauggccaaugggccuuggguguuccagucuuggggagacuauuuguugggggacauauagcauggagauaaaucaugagugaccccaagaaaauucuaauacuuggccuacauguuguaaacauuguuugcuaauuaaaacuucaacuugaagauugggaaaagcuugcuucaacagcaaauauucauaccuaguuaccauaugaaagacaaauuuccucaguagaagaaaccuacguaguguauccaguuacauauuuggauagacuaaguagguuuaguauauuugcacaggauauauuaacucagugcuuggguguuuugauacacaauuaaaaaguaauauauuaauagcuaguaauuguccucugacuuuccaauuccagacgcccuagggaguucacuuuucaaacacucuacagagacacugaguccacacaauagcuugaacagccaggaagcacagaacucgggaagcccacuggccucuucugagcuucccugcuacacuggaaagcacaaugcaaguagaucuaaauucaaaaguaaggcuguguuuaggccuaaugaaucaccugccuuccgcugaaggaaucagguccuuucaagaaaaaaguuucagguaugaaucauaucuucacggcacaaggauuucauaaaacacacuuggcugagguggcucuugacccacacggcugcaccuaacgggaucucucacuuacuucccugggccaggauggucaagcccacccaggaccgugccuuccacaacuugcucauuucagggccaugugaagacaccaccagugcccauguggcuguagagaucccagacaaacgggaccaccacauggcaugaacuacuaagauguacauuuccucgcauugccacaucccugaaagaggacaugccuuucaauccauuacgugucaugguuucauugcaagcaguuuuucuaagagauacauaaaauaacagugcaucuuagcaucauuggcaucuggcguucgauggaauacaguggguacaugugagcaaaguguguugaaaaggcaacaucuguuacuccguucuuauuucuccauuaacugcgauuaugaaauuaaaucugcauccuaauggaaaaccccucacucccaccccacauauccuacuuauuuauacaucuauuuagucaacaaaugcggaugcaucuauucaguuaucaaauacguauuagugaucuguucugggccaggcacugagcuagauaaugggaaaagaguaguaaauacgauucagucacacuugaaauuguagcaaauucucacacaugugugagaaagcugugcuuuucugacuaaauaacaugaaucaaaacguaggccuuaaaaauacaaacucagccaggcucacacuuguaauuccaacauuuugggaagccgaggcaagaggauuacuugaggccaggaguuugagaccagccugggcaacagaaugaaaccucaccucuauaaaagaaaauuuuuuuaaauuauccaugcuugguggcacacaccuguagacccaacuacuagagggaggcugaggcgggaggaucaccugagcccgggagguuggggcugcagugagcuaugaucgcgucacuucacuccagccugggugacagaguaagaccuugucucaaaaaaaaaacaaaaaaaaaaaaaaacgaaaaaaaaaacugugagaaacgauauggcuaacaacuagguuuguucaauuguaaaaaaaaaaaaauguuuuaagagguaauauaggagaaacauauauccuuaaaaaauacuuaaaagacauucaaaaaucacauguggauuuuauaugggucuuaauuuaaguaacaaacuacacgaauguuauaacauguaugaaacaacugaaacucugaccacuggcuggauauucacugauauugagaaauuacugugaacuuuuucagguacaguaaugacaucaugguauuuuuacagagcacuuaucuuuuaaauauauauacugaacuauuauggaagaaaugcuaugagguuuggaauuugcuucaaauuccaaaaaauaguucaaaaaaaagcugaacuauaaaaaauuguuuuggggccgagugccguggcucacgccuguauucccagcacuuugggagacugaggugggcgaaucacuuaaggucaggaguucaagaccagccuguccaacauggugaaaccccaucucuacuaaaaauacaaaaauuagcugggcaugguggcacguguuuguagucucagcuacucgggagguugaggcaggagaaucgcuugaacccaggaggcggagguugcaaugagccaagaucgcgccauugcacuccagccugugccaauagagcaaaacuccaucucaguuuaaaaaaaauuaaauaaauaaauuacuucuguaagucaaaaaugguugaagggcugcaauuucauguuagaagucaggaaaugggaggggcuauugaugaagcaaaacuggccaggagcugauuaagguuaaaauuaaucugaaugauggccuaugggguaaauuuuacucaacugucuccuuccuaugugcauaaaaucuuuccacaaugaaaaguuaaaacaaaauuaggccuuuaauacaguacaauauuuaaauuuaguuaaaaauaaaaacuaguaaaagugaaacugaaagcaucacugcaaaaacacccuccgccuaaauuucuucaucugcaaagggaggccagggagcucgacaaucucucugagaucccugggucugugaccgcaguguaugcucucugcucagccacugaagcucguccccaguuuugcagggcauauucggcucuucucuuacuauuuaacaagggccaccuaaucuaugcauaaagauccucagacuguaggggaguucagacgacacagccuagugagaagcugacacacacaugcacaucccauggaaaacccuuguggggugugagagaugauucuacaguggacagaaggcagccauugagagcuguucugauagagugcugacauugaccacucugucccccaccaaagggccugugacggaaugucuguaacauagaguucauacauuguauagaggucuauaacauuuaauacauauuaaaguauacuuaauagccugaaaauauacuuaauaguaugagaauaagcuguuguggaguuuagcuggcacaaaaugaccacuggcaacggcugugguggccagauggaggccucagccugccgagcacagugagaaucugugacuucauucauaaauuucccagagaaacgggaugaggcagggcccuguguaccuccaugucugcaaguggauacaugcugaagagcaaacauguaaagcacagaagacacaagcaaaggaagaaagaggacacacugagguccugugacucaucuuuacaaggcagaauaugagucauuaauaggaucccaacuuuggcuuucucucugaaucacccaagauuaccuugaugugcuuaacuuugucuucuuuuucugucuuugguuucuuuccuguggcaacaaaaauguaguuuuggauuaauucacgaagggccuccagagaaacauuucccucaaauuaaauucuuucugaaacucucaaugaaccuguugcuuuaaucuguacauggucaaaauuccacauguaucuuucacugccucuggugaaucgaaagucuuguuuccaagccagguaggggcggaaugauccccuacagcaugaacaggcuauucuaccugcaaacugacugcagauguagaaaugaagagaucacgaaggcacgaugacacaaauugauuuaccuuauuuuagucuguaaaugccuuuaccuuucuuagaaggccguucugauaggggcagcauucgguagacccugaaggcauuauuuccuuucuuuaugcuuuuauccuugacuucuucaauaucaggcaaggaauucauggcgcaucugaaauucgccuuccauguuuugggaucagguuuaucuacuccugguugaugcuuuccuaacaaaagagacaaagauuaagaaaaagagagaaaacauuagauacagaggaaggaauuucuggaaacacaguauugcuggucaggcaguauaaggaaaccuuuucacuccaugcuauaccuccagugaccaaucguccugguguaccugggggugagaaaguucuugggaugugggaauuuuguuuuuaaaaccugaacaguuccagucaaacugggacaaguuggucacccugguucuacugaacagcuugaggaaacuauaaaugcuggaagaauggagcaucagcguaagaaaaauauagaagacugagaggcugcaaagucaacaggcagagggaagcugagugccucuuuuucaucugacgcuccaacaaaguccauuccuguaaacagcucccuacguaaagguuguaauaaauacagguauuucugacuaccuuuuugggggggagauaaauuugaccaaaguuuauagcaucagaacaacugaguuucuauuccccgguaacaccuagggaacuucuuagaauaccacauuuauaggaaauugaaggacuaagaguguaugggaugaggggagcauuacuucugagggcugcaguuuguaccccauguguccuggaugugccuagggacaagucacagguuuuucagagccaucuucaugaggucauaagccaggcuauuuuauguguaauaaaaacaaaacuaagcaagagugccuuccucuauaaacgccgcagggaguuuuaguaccuguauggauugcccaguuucuaaagaguggugcaucuuuuuccacaucccacccaugucuagccgcaugcauccaggggaucugaaaaaucuucuuuuccugaaaaaaaaaaaaaaaaaaaagguaaagaacuggagucauggguuuuggcccaccauugcaaaagguugugaaggucuagccagcaagauuccccagcaagcaucgcugaauguguugacugcugacaagaaaaucuacuguaaaccaaacccacuucccccgcuggaucccaaaucuugauagacuaccccgagugacagucagucucgugaagucuugcagagcaggaauguuuuccaaggucaaaggugaugauuugaccuuguguguuccauuauuugugccucuuuucuaguuuucaauauauuuuuuuggagacagagucucgcucuguugcccaggcugcaguguaguggcgcgauaucggcucacuacaaccuccaccuccuggguucaagagauucucccaccucagccuccugaguagcuaggauuacuggcaugugccaccacgccuggccaaguuuuguauuuuugguagagaugggguuuugccaugcuggccaggcuggucucgaacuccugaccucaagugaucugcccaccucaggcuuccaaacugcugagauuacaggugugagccaccacacccggcccugugccucuuuuuuuuauaaaaccacagaaaaauggccaccuaccgaaacuucuaaugcuuacucuuauaauuuauucucgucguuugguaaauaguaacuccagcuaucuuagguaaauuaaaaauuagacaaguuuccaaaacccuugaugcuacuaaagaaaagucggguacaucugaggccacugucacagaaaccaaauaucuccauuugcuugugcauccaacagaaauagaaaguaauguucgaaucccugugggucuacugccugcaagaaauagcaagaagugcaaacaaagagguagagguuaugaaaugacacauuuuucuggagaaacaucccucaauacaauccuuauaucagacuaucucuacaucucucucaguguugaggucuguaacucaaaaccgccucaagcaacccugaaaaacacaugauuggaaacccaugguuuaguaacaaagccguacucuuaguaaagcuacagaugaggaaccuggcccaagcagcucuuguggcgguaccggcagguacuaaggucccauuggcacugugcaucugacuacccacauccacagggaccucaguuuugucuuccucccacagccuacugagugagguauauguuacgauuuccauuuuauagcugaggaaaccaagaagcagauuuuaacuauuuagucaaggaacuugcaggauaauaagugucuaaguucaaaacccaggucaugcgacuccauaugcuauuacuuaaucacccacucauugucucccagcuuuuagauuuggaagagucccuguccuaugacagaccaguugagaccuggauucuguggagauuaaagcccaggagguuguacucuuucaaagcucucaaggcaguucugguaauugcuagguaugcggaucccugcacuagaugcugaggaaggagaggaaaugucagcagggaguuuccaccacuucagucucacauagugaaacacagaaagggucccagcuguccccaaagagauucagcgccucuccacagaaccaaucacaaagccagaacaaagacuauuucagaacauuggagaguuucccaaaaccuguuaaaaggaaaauucuaccaucuucuaaaaagucaguuauuaaaggagaacugaaagugagagacuuuuucauaaauuccucgguguucauucuguaucauccacagagagggcuucggguuagccaauuucaaaaggacagugaucagaaaggggcugagugacauuuuaugcuuuaauguagaugaaaaucgacagcaaaaucacuuaaugccauuuauugauguucacaugaaaaugaauacaagugaaaauucauuucgugaaagagcuuuuccugaagugcaugcccagaaucuaaagcuuuaugcuuaaacaccgagauucuuaagaauuugcuguugcacuuuuuucuagaucaaaggaguucuagggugacacaaucugaaaucuaacuugcaagacacaaaauugauacagauaaaguagaucuuuuuaagcaucugcacgcaugcaugcauacacauacacacacacacaaccaaaccuagucccacagaaaccgcaaaagccaugcaacuacaaaagcgcugaccaaacccagcaacauacacuauggacccucuugaaaugugcaacaggccugaguagacuggaauaguucagguguuuguccccucaaaaucucguguuaaaauuugaucgcuaguguugcagguggggucugguggacgguguuugggucauggggcaggaucccucaagaauggcuuggugucguucucgugguaaugaguaagcucucacuccauuagcuccggugagagcugauuauucaaaacagccugucgccugcaccauucucucuuccucccucucuugccauguaaugcccuuugccucccauccugaggccuuaacagaggcagaugccaaggucaugcuucuuguacagccuagaacccugacccaaagaagccucguuuuuuuauaaauuacccagccccagguaguccuuuguagcaacaugaaacagacuaacccacagacaugucuccaaaaaaagauacacaaauaacaaacguuggugaggauguggagaaacuggaauccucacacaucgcuguggaaaugcaaaaugguacagccacucuggagaaaaaguuuggccauuccucaagaaagugaaacacagaauuaccugaugauccaggaauuuuacaccuggauauauacccaaagaauucuaagccaacauucaaaccaaaacauaaacguucauagcagcacuacuuucaaaagccaaaagauggaaacaacccgaguguccaucagcugaugaauggguaaacaaaaugugguauauccauacaauggaauauuauucagccacaaaaaggaauagaguauugacacaugcuaccauguggacgaaccuugaaaacauuaugcuggaugaaagaagccagacacaaaaggccaaaaauugaaugauuccauuuacaugaaauauuccagaaaagacagagagcagagagcagacagagagcagagauccauagagacagagagcagauuacugguugccacaagcuaggggggagggaaaugggaagugacugauuaauggguacagcauuuccuuuuggagggauaaaaaguucuggaacuggacaguggugauggcugcaugacaucgugaaugucacuuuaaaaugguaaauauuuuuuaaacuacaugucaccuuuaccuaguuuuucauacuucaggaaaaaaaagaaaagacuaauaaacuuaucagaaauaucuuuaaaauuguaucacagauucuuuuuuugaagaagaccauaugaaaagguaagagaaagcaagauucauuuuaaaacugaaagagauucugaccaguaaacauucuggucacaaguuguguguuccaugggacaugacgguguugcuauguguguguagaccccgugacgucaguaugugccaggugucucauccccgagugaccaguccugcacacgugguggugguacaugcuguguauagacagacgcgccaugccagggcccaccauuuguacgugugugcacaacucugcccaucugaaggaaggcaggagagaugagcgcugcuugacuucagaaaagcaucugacauuauuuugagcaauguagaacaauguuccuuggccccacauggaaacuaguucuguuaucuccucugccucuucuuccccccaacauuugcaagacguuccaauuagugugcuauuuuugucuggacuccuuaccguggucagagauagccugauguuuacacaaacacaagucuacucucaaagugaaaaaaagggaaagaucugaugauuccccugccuuagugcauggauccaggaagaacuaagaacaucaauaaccccaccagaguugggggucacauggagccacgagagaaaccaggaccccggaugugacugccuccuuccuuccucaagaaauggcccagggaaccacaagcaagcauguggacaaacccaaaacuaaccuggucucaacaagucaauggcgagaaggaaaaaaacagaggcccacagucagcagagacuuagagucauaaacaccaaacacaaccuguggacagucuuugaauucugauuugaacaaaucaacuguaaaaagauuauuugggaauacucaaggcauucuuaauaugaauggagcagugaugauauuaaacaguacuaauuuuguccaauuaacaaugguauauuguggauauauaagaaaaugcccuuaugucuuacaauguaugcugucagggagcugcuuuaauauaccagauacacacagauacacacacacacacacacacaaagauaaggcaaaauauucauacaucuagauacaggcauaugaaaauuugcuauccuauuucuuuuugucauugggcuacucaaacaugcuaugcacauuugcaaauacccauaaccaaagguaaauugccccagccaaggucucauucaugagcugguuauaaugcacuuuuccaaacuuccucgcuguuccuucagaggaauccaagggacccauuccauucccacccuccuucaaacuuauuaaaaguaggugcuaugguuugaauauuugcccccuaugacacuuauauugacauuuaauccccaauguggcaguacugagaggugaggccuuuaagaggugauugagucaugagggcccugcccucaugaauggauuaauccauucagggauuaauggauuaaugaguugucaugagggguaggauuguggcuuuuuaagaggaagagagaccugugcuagcacgugagcaugcucuuuccccgcaccgggugauauccugcacugccucaggacuuugcagaggguccccaccagcaagaaggcccucaccagaugcagccccucaaccuuggacuucucagccuccauaacuguaagaaauaaauuccucuucuuuacaaauuauccagagucagguauucuguuagaagcaacagggaacagacuaagacaauagaggauggaaacaaauuuaaggcauuaauuaaccaacucuuucucucuuacuaagaauggaguagguugaauggacuuucugagagccaugugacaacugccaagccaguguccauaaaucugauuaucuuaacagaacaaaaacaccaccaauguugcuccccuucaaauccaugacauucaucuguguauucccagaacaauuuugacagagggccucccacuuaccaggcacuaggccuggcccugagcaugcagacaugaagaagauagccaaggcacuggugcauggggcucccagccuggagcacuucacaauaaacaugaacacauccugaaugccgacugaagcagaagugagucccacagccccauggacaguguauucuaagaguuacaacaaucuucaguggcaaaagagaucuuggaaugaccucaaaccacucaaaauauaaacaaggauucccaggcagaaugcuugugaaugggagggaagaacauuaggcucucaguuaaguauuuauauggacagaugaaugccaacaagccuaaguuaacggaaaccuauaaaaaaaugcccugugggaguguagguauggagagaagagauccugaccccagccgaggccugcagugacagugauggcagugcccaugugcacgagcaaugccacgugcccacucuggcuaggccucagcaggaugcagcuugacagggccucggggccacagugcaggccucggccucuguuccagggcggugcugagaggcggcacgggccggcagccacgggcacgcucuccuucaucagccuggcucagguccagcuguagcggaggagcccugugagaugacacagaggucuccuuuccuuccaugccucgggaagagaacucucgagccaagagccagaugagugacgcucagcagguaaggacugccugaaaggggccaaguguucauuugcacaaagggaaauccauuugccuucugguccuguaucagaaaaacauggacaaaauagauggaagaaaaggcaucucaacugagagucccagaaaggaagugacccuuagagggugcaucaaucuccuaagacugucaugaaaaauuacacaaacuggguggcucacagcaacagaaauguauuccaucacaguccugaaggccagaaguccaaaaucaaggucucugcagggcucacuccgguuuuuguuuguuuguuuguuuguuuguuuguuuguuuguuuuugagauggagucuugcucugucacccaggcuggagugcaguggugcaaucucagcucacgcaaccuccaccacugcaaccucaaccucccagguucaagugauucucuugccucagccucccaaguagcugggauuacaggcaccugccaccacacccagcuaauuuuuguguuuuuaguggagauggaguuucaccauguuggccaggcuggucucaaacuccugaccucaggugaucugcccaacucagccucccaaagugcggggauuacaggcgugagccacugcgcccagccagggcucacuccuuuccaaggcucugggaaggauccuuccucgccucuucuuggagucccucggcugcggcugccuauuuccagucucugccucaguccucacaugccccucuccucugugugugccuucuccucuucugucucuuauaaagacacuccucauuggcaucagggcccacccagaaaauccaggaugauuucaucucaagguccuucacuauaucugcaaaaacccuuuuuccaaaugaggugacauccacagguucuggagguuaggauguggacauaucuucuccgggagccacaguuccaucuacuacagcaccaagaagggacuaaugguuagucuaaaccaaccacagcggucaacauaucaggcaccugcucaacaggagaggugugagacacugucucuucuccacugcauccugccaaccaaaacuaguggagguauuuuugaaaaaggaaaagcagaagcagaccacuugcuucucuuuagaacacaggagcauuugcuuuccucucccacuccacaucaaacaguaaugcuaccuuguuccucaaaacagaaucuuacuuaaccucucugugccuugguuuccuugucuguaaaauggaaaauauuaacuguaccuaccccaugguggcggaacgugagcuaaugcauguaccuugcuuagaagggugccuggcacacaguaagugcugaguacaagucagcuuucauucagugucauuugcuacccuggcucuccagcuccccuuuacucugguccccccuuccuuauaccuccacggcaccccugcuaacugagcugaccaaggagcaacuccauuucuuguuuguuucuuuggaagaagcugauuacauauguaaaucuaaaacacuauagauagagcaacccuagaaaaauacauugugguaagaccuugagauaugggacaggucacaggaaauaagcagaugguuucuucauuucuauuuacuuagugccucaccuuguuucagaaaggcucagacagacauauucaacacaguaacauuaaauucaaaaucaggcugggcacugcggcucaugccuguaaucccagcacuuuggaaggccaaggcgggcagcacuugaguccugaaguuccagaccagucugggcaacauagugaaaccccaucucuacaaaaaauauaaaaauuauccaggagcgcaccuguggucccagcuacuugggagacaaaggugggaggaucgcuucagcacagaggcagagguuacagugagcugagaucgugccacugcacuccagccugggugacagagggagaccuugucuaaagaaaacaaaaaaaaaaucaaaauaaguggauaaaaggaaaauaguaaaaagaaauaagauuugaaagauaucugaaaagacccaauaaggccaggaaugauauuaguuaaaaaaaauuauacugcaauauccuguucccuuguuggaagcaggcuacaaucugcaaucuggcucuaagcucuuguaccugauacaaagauaaagccuggccagcuaaauuauucauuguguccuuaagauuaaaaaagaaaaggggagggaguggagaagaggaaaaaggcauugacucagaacuguucugguaggagaggaacuucucuccugggccuccuuaaagaaggcaugauauauauuuaguugcuuuucuagauuauauaguucuagaaguuuuucauuuuugccgacauuaucucuuucugauucaccccuaacagcuaggaucaauuaaauuaagaguuuuuagguuaacaaaguaagggaguguuugugccuggaaggggcagguuguaaaugacuggcugcuuucuuaggaaagguggacacacagauagggcuucauuacagagguaaaaagaaggcuuuuuuuaaagacaaaaacaagcuuucuuuaaacagagaacauggaaaaggaaaugcuccauuccuaauauaaaacccuggaguuuccauguccucuaguccuaaaaggccaggagaagcaaaaaaaaggaauuuggagaaggaagaggguaagaauccucaaagaagcaaggagcuuuccaaaaaaagcaaggagcuuucgagaggcagucagccaaaacaccaaaggugagcagacauuggagacuccaggcugaggcuacagucguacaggauacaaauccuuuugugaccggguucaguggcucaugccuguaauccccacacuuugggaggcugaggugggaggaucacuucagcccaggaguucaagaccagccugggcaacauggcgagaucccagcucuacaaaaaaauacaaaaauuggccagguguggugacguuuaccuguaguuccagcuacucuggaggcugaggugggaggaucacuugaacccaagaggucgaggcugcagugaguuaugacugcaccacugcacuccagcgugggccauauagugagacccugucucuaaaagaaaaaaagccuuugagaugauaacuugauguuuuaugaucauuuuggguuggcugguuuuugucaugaauaagccuaagauuuugaauacacacgauuuuacuuucagcaguccgcaugggcguguuucagccaggaccucucucacacauacacccacccugacccacucaccuuguuaagccacuugagccccgggaucguguuggaguuuaucugcuccuccagccacgggcgcaugcgcauccuuuccaccggcauggugcccuugagggagagaaacacagcgucaggcguuggugccacucaguguggugucugcacugcagaguucuacaccccgccugacucuuuccuucucuccuuuccuggggcuggggaccagggggcuggggggucgguguacucaggggcugugccaccugugcaagcccagcccucgcaccggccagggggcuaucuggagacacaggaugguccaggccugcccuccgcugggaggguccuauggacauuggagaccaggacccacacuccuccccaggaauuugccuagagggaggcuuuauccccacugcacuggccguguuuugaggcuuccguugcucagaggccccaacgccuuuggggaugauccuuccaagagccaaggggugggcagagcaaagcaguugugggaaaaaauuaugauagccaagccauuccuuuugagaaucuggguuauacaaacgcuuucaacccccaauauuaacauuuaaagcucgaaaggaaucaguuaauuuggcuuucccaaaguuuuccaccaacuacccgucccuccugacuuuacuuccagagccccuggaagccugcacagguaucuccuuugcuuuugcuuuuacccgaaugcagucucucacccaagugucuuucuucaaugccagccuccccgcugaccugacaucacccccuuuuccuuuaacuuacuuucccuuugaaaaucauuuucauagucugaccacccuuccuccgccaguccacacaaugccucccugcugcuuccagauuccuuucuaagauagacuucuccugguccaucggaauagauccagaggggaaucacuaacaaaguaccuuccacacugucccccacucaucuucacccuaucuaugccugcauucacaucuaaucugggcuccaaaagcaaagaugggucaggugcaagccuccauucuauaggaccucacagacagugugacacuguaauccucuucucaauccugauuggucccuuccuucuuuuguucauuuccuccaaaauugagcucugaaaauucuauuccuuggcauuugggcugaugucucaauaacucuccuucccagcuugccauggacuuccucucuccucuauucccugcgcccagaacaugccagaguuacaagcauccuuccgugacccccagccccugggccucacccugggccuguaugccuccugcugucuggcccagccuuuuccuuguaugccuccugcagucuggcccagccuuuuccuuguaugccuccugcagucuggcccacugacugcugcagacaccuccugcuccgugcucaucccgugcccucugcucuucauucccuggccuugcagguccuuauccgcccucuaagaccuagccuccuccuccacaagggcuucccagaccacucccgccuaaaguagucccucugccuccagcuccuauguuacucacugaucuuacacugcuccuuugaaaaaccaaacauugcuuuagggcaguuguuuuaaguaaagucuuucaucuuaucccuugccuuaccuauacaccucucagcuguguauaguccacucucuuuuccuaaccaaauuuaaguucuaccgcaggaagagcaucaccuuuuuuuucuggaggcagggucucacucugucacccagacgggagugcagugacaugaucacagcucacugcagccucaaccuccugggcucaagcgauuuucccaccucagccucccaguagcugggaccacaggugugagccaccacgcccagcuauuuuuuuuuauuuuuuguagagcuggggucucccuaugcuacccaggcuggucucaaauuccugggcucaagcaguccucccaccuugaccucccaaagugcugagauuacagacaugagcucccaugcuccgcccucuucuaggucuuuugcuaguccuacaaagcgcaaauguugccuuccacauaggaaacacucacugccaggcccaggccagcucugaagacggcucugagggccuagguggggugccgucagagguuggccuccuccacucauauggaggcuccagccaccauucuuugagacacaaacgggaaccuuagagauauuucacaagaacacggaauggccacaaggaguugcagauacugcugcucuuggucucauucauucauuuguuccauucauucauuuguucauccacccauucaaaggucauguauugagaaugaugcuccaggaacagggaaagaugacauucccugccaucuaggaacucccaaccuaacaggacacuggaaagaagggagguaccaugccccaugaagaugauaaagaguuucagaaaagacuagggagugcugggaaaagcugugcacagaggagugcacuggugaccccucaaaggcucacccugcaagagcucugcccgccaggguggugaccaccagcccagccugaucuucccucuggaaaagaccucaagacacagauuggagaccacuaaauccagagcggucaagaaaauagagggaagagcgagggaagaguaguuacaggauagggguagguauaguggucacgaguagagagcaacagacgccaguucuccugacagccugacgugcagaagugcugugcguggucccuggcgcugcagcugagccugagccuggcaauauggaaacacgagaggcguguggaaguggcccugccuccagcuaguacucagaauauaauauuuccuccauuauguuucucacaaauaaccaguugggggaaaaaaaaaaaaaaacaauggucacaucugaaauaguucaaaaagccauaugguaugguuccuauucaggugacccccuccagcccacagugguucccguucuuauauuagugauggcuuuuaaaguucucacagacaggcaucucucugaaagacagcgaagaucaguuuuaaacggaaacaguaguugaaaaagucaauugucagguaaagcaaagcaccaagacaaaaaacccaacuuucugucuuuaaaacuaaagccugugugugaagacacauucgauccacacuguucgcagauucuguaucugugaauuugccuacucacugaaauauauccacaacccccaaaucaauacucagaugcguugguggucacucggggacaugugcugaauucaagucaucugaugcacguguucccagcugaggcuggacaaggccacacucugccuucccgcucuugcucuccuauggcagacaaguguucuuuucacaggcuacagagugcgacauuugucacaucguugugcuuuuuuuggugacuuugcuguuuaaaauggcccccaggcauugugcugaagugccuucccggguuccuaagaaccagaaggcuaugaugcgccuuacagggaaaauacguauauuagauaagcuuugcucaggcaugcauuauagugcugugaguucaaugcucaucaaucaacaauaaauauuacagagggugucuucaaacagaaacacauaagacaagguuauacaaugaucagcugacaaaauauugugaccaguagcucgcaggaacccgauguccuuauaagaagagggaaguguggacacagacacagagaagaaugccgcgugaagacacagacacagagggaggaugggcacgugaagccaaaggcagagacugcagugaggcugcugcagcuaaccaugccuggagccaccagaagcuggaagaggcaaggaaggauucuccccaagacccuugaggcagagcagggcccuacugaugccuugaucugagacuucugaccuccagaauugugauggaauacauuucuguugugugagagccaucuguuacggcagcccugagcaaccaacagagaagggagagcugcaaaggcccugaggcaagguggccccuguggacagcagucagugacagggagggcccagagacccggcucacccagaagaccaugccuaggauuuuggucaugaccacgaucuaagacugaagaggaaaccgaaggauuuuagcaaaagaaugauagggucaguuuggccaacguaaagggaagagcugagugugaaauccugaaauccagcgcuucgccaacuugaacgugcacaggaaucccaagucaguggauuccaggcgaccgcuguggucugcaucucugacaagccccuagguccuugggucacacucugagaagcaaagcucuagaguccccuuauuguucaugcucaauggccuggcucucccaugcuccugccguguggucauuuuggccauucugauagacuccuccacuggucggcgugccgggcuugucauccaccggcugggugcauuccucacuuacgcaacaugccugucuaguaaggaugcagcucagccaaaccgcaaacuuauuagaaaaguucacaaucuucaaucaggacuguuacuaauuauagguaacuuuuagaaaaagcaaaaaaucgaacaaguauuucaucagaguaaaaaauaaacuuaaaaagggcuacacuuauuucagguuuuguuugcuuggguugguugguugguugguuuguuuguagcuaggacaucuccaaugagacucaaugaaaagcuaacccagucacaugaaggcccuucuccuuugugacuugauuuuucuccccugacccaucucccacgcccugggcagguagugcauuaccagugcgcuugccucgcgacacgguacaaaguuugccauuugacacagguuucucacgacuagccgagggugagcguacaucuuuacuucugugaaaaacagcaaaggcagaaucuaccucaagccuagcaccagaaacggaucauuuaguuggacacuauaaacagauuaauuauguuuccggagauuaaaagacugagaugacaggcacagagggucagaggacugaggacuggaaagaaagaugcuuacucgguauguaucgucuagcuuccauuaucgaaagucaaggugacacgcuggucuuucuguaaggcaagccucccacaggcgcuaacagucaggccacgugaaccucgaacagaguuagagaaggcagguagcucaguggagaugacacagagcggcuauguuugucuaagaaccaaaaugcacagaaaucaggacauugugucgcgaccuugacucugccauugcugguguguguccuugggcuaaucccuccaucuucccggcccacacuuugaucaucuagaaaaaugggacguuuuaaacagaugauuccugggguuauccaugauacgaugaaucauaaucugauguuuuuuuuucuguaagcuucucuucuugcacaucagguuguuuuuagaaguaaaaugcuaaaauuuuaugguucugcaaaccuaauauaugagcaaccuguacuucaaaguaaguaaaagaguugaagcaucuacccuggagccugacgaaaggcacguuguaaaaucaucuaccuuuacaccuuugagauuugaggcugggacuggcuucaaaacuguggcaucuggccauaagucaauucagcccaugguggguacugagaauaucacuggugccaagccugcuauauaaggcaugcaagcuauucauugugauucguaagucacgaaugaucccccaugaaguugacaguacuauccaugauuagugcuauuaacagugagguugaauuuucacccaaauaacugaauuuugguucuuggaauaguaagagcaacgguuaccauuuacagagcaccuacuaugugcugggcauuaaaacuaggguuuucuugcuagguguggugggacacaccugucuuuucagcuccuugggaggcugaggugggacaaucacuugaagccaggaguucgaggcugcagugagccaugaucacaccacugcauuccagccuggguggcagaaagacagccccucucuaaaaauagaaaauaaaaaaccuaggguuuucuacaaguuuugccauuuaacccuuacaacccuaggacauagggacuuuauuauccuuuauuaccugcuaguaaguggagagccaagacucucauuuaaauucaggccuaucuaacgugaaacacccaggcuuauccacucuaaccucugccuucaucguacuuuagaaagcacugaguuaugaagaccucuuaauuguucuacuuacugagacuuuccaaacuccucuccgucuugcaaaccacugacagucaucuuccuaaaauaccauuuaaucauguuaauucucuguuccagagacuucuaaaugugccugcuggauuuaagguaauaaauuccuuagcugagagggggguggugcuucugguaaugguacaguagguaauucagaccugacucccaggcugaauaacuaagaaacauggacaaaauauauuuuuaaaauccauuuaaaugcaucagagagcuaacaagguaguuaaaaauuaggggggcaagaucuaggagaaaaagaaacccaggaaggugaaccugacauuuagggcugcugucguccuagcgcagggacagcugcuccuuucugaagaggaggcuguggggcuuugaaagcagagcuuuugacacacucaggugacugaggagacaaaaauugaacaucaggaugcagcuaggaaaagggguuccuggaaacacccucacaagcuuuguaaguaauacaacuaaguagaaauaaacuaauaucaaaggcugaagcccagcuuugaaucaucucaaucccugaucuaaugaaaaugaccuggaacuaccaaaaguaaauagaaaucagaucuugaggaacauaacauuacccuaggauucauauuaucucuggagcuuuucuuuuuucuuuuucuuuuucuuuuuucuuuuuuuuuuugagacagagucucgcucugucguugggcuggagugcaguggcucgaacucgacucacugcaaccucugccucccagguucaagcaauucuccugccucagccuccggaguagcugggacuacaggugcccaccaccaugcccagcuaauuuuuguauucucaguagagacaggguuucaucauguuggccaggaugaucucaaucucuugaccucgugauccgcccacuuuggccucccaaagugcugggauuacaggcgugagccacugcgcccggccauggaacgccuuuucuuauuacccagucacccaauggaucagcaaaaauucauuaaacacacauuguuacaaggaacugugcugagugcugugggggauucaaagacgguaagacaugaucacuacccucaaggaacaaauaaguuaacugaggaugugagagauaaaucacauaaagcuaacuaauaauccuauaauuauaauaauaaaagacuaugcaauaaagaucagaagguaguguauuauuaauugccaacuaaguuagguaguucauaaggaauacauaaaucauuguuaaaugggcauauaagagaaagcuuuauggcaaaggaaagcuuuaugguaaaggaagaccuuaauggauggggaggugcugucuaggcagggagaagguggcaggcaagccaggggagguaaaagguugguaucggcggccaaagcaggacugaagauguguuugcugaugugagcagagcaacugucuuaugcaccaacaggggugucuucauaagagucacuggugugugagaagcaagcacuggguauuucacaucaaucaucuuuaacucucauaacagcucuaaccaguuaaauacuaguauccccauuuuauuuuuucauuuuauuuuugagacaggucucacucugucacccagacuagagugcaguggugcaauccuagcucacuacaguccugacuuccuggguucaagagagccucucaccucagccucucaaguacccaggacuacaggugcauccacuacacccagcuaauuuuuuguuuuucggguuuuuugagauggagucucgcucugucacccaggcuagaguauagucgugcaaucuuggcucacugcaaccucugccucccggguucaagcaauucuccugccucagucuccugaguagcugagauuacaggcaugcgccaccacgcccagcuaauuuuuuuguauuuuuagucgagacgggguuucaccauguuggucaggcuggucuugaacucuugaccugaugauccaccugcuuuggccucccaaaguccugggauuacaggcaugagccaccgcgccuggccuaauuuuuuaaaauauuuuuguagaaacagggguuucacuaccuauguugcccggguugguuugaacuccuggccucaagugauccuccuacuucaaccucccaaacugcuaagguuagaggcauaagucaccgugcccagccuauuaucaucauuuuagagauuaggaaaagcauagccaaaaaggcagcccccacaaaaaauaagaagaagaaauaagaaagaaaagaaaaugucuaagucacccacgccucuagaugaggaggcaggacuugaaccucaggagggucucagaugcccagcuagagucugagcuuguuuacgcaggcugcuauaaugacuucugagugcacgacuugggaaaagccaugcuucaguuucacgagucaugcagcacucuauacagagccaaauggagggaaggaggugagcuagaacuacugcucugggucaggacaguggcuauuggaacguacaaaaaaaaaaaaaaaaacccacacacacgaugacacgcguauaggaaucuaacagcaguguuuaguaguaauuuuuccugggcacacaauagucuuuucccaaaugcaaguuccuccugcaaguuccucacaacgacuucugugugcuuuuucagcaaaaguaagaauuuccaugaaaguuauguaaauugaaagcuggaguuagaaguugaacaucaucaucaucauccccaucauuaauaccauuccagcccuaacuagagccugacccucagcccaaaugccuuucaugcguuauuucacuuaaucuuccaacaagccacaugaggcagaguagcuacucuccauucuacagaugaggaaaugaagcuacuuacaaagcuccacuuacagccauuaagugguaaagcaaacauucaaaucuacauccgucugacuccaaagaauaugccagaaaccucuagaccuguguuuugcaagucucugcuaacaacccaccagagggucgugggaucauuuguugcauuaagaucagcacuuuuaacuuaauuuuaauuuacaauaugauagaauggaaaaugagggagcaccccgaacaaagugagguaagcauuguuuuaugaaacguuugcuuccauuuaaugucacauuauauuauacugguccugggguugaagggguauaaaaacauugcacuaggcuggacugccucccgacagugugugugcaggugugugcgagcauguggacggcagagagagggagggggcacugugggaaguagaaugcagaagaggauaugugauucgccugccuuggccucccaaaguccugggaucacaggcgugagccccgcgccuggccuaauauuuuuaacauuuuuguagaaacagggaaacaaggagaagcauacccuaagagcuguacugacugcuaagagguagaaauaaaauguacaagaacuucauggcaugaaaauaguauguucggagcaaagauaacaggacccccuauaugagagaggaagcauggccugagaccuuccuaugcggccacgcuuccuccugcucugccugcgacauucaaaucacucuccagacucucaugggacccugacggcugaagucagccauugccaguccugaaaucagaaagacguuuaacguuuggauggagggcuagauacggaaaaaaccaugccucucaguguacauauuaucugcaccaaugcaaaacugauuuuuauguuuuguugaacuuuagaaagucauagguucauuuaagaaugggagucuccagccagucuuccucauaagguuucaagcaauucaaccaccaauucuccuacuacguagauuuuucaggaugaaugaugaggcaggacugcuacuccaaauacaucauaacccaccuuuauucuuuucuguucuguucaugccacuaucccaaaacugccuugcaaugcuauuaccuuaaaacuuuaaaaaaaaaaaaaaaaaagcggggcggagcggggguacuuaaaaaaaaaaaaaaggucccuggccccacucuaauaagaaccgggaauuuuuuuuauuauccuagaauaauuuugauaagcaauuaaguaugaaaaucacuguuauuuaguauccauuaacccaauggacuuccagauuccagauguuuaauaaacaucuccaguugagucaugggaaaacaggaggccaguggugaauagauuucaucauuaauggaauagaaacguauaugaaaucaaaagucuaaaaugcuuucaaauaccacaaaacuaguuuuccaggcugaaaaucauccagauuacaguuuuacauauuugccauucuaugcacaauuuuccuauuaggcacguuuucuauauccuuucggaagcuauucccauagcugcuuuauaaaauuuaccuugucucugaccacagacuccucugguaccugaaaugugugcugcauccgaaccauaaucgagcaaacugacuuggggccccuaugugugugugcacaaaagucaccugucuaucacugguucuugguucugcagaugacccaguggucacucuagaaaacaguucucaaugcagccuaacaagaacagcagcucuucguccagagaucaagccuuaaaaauacaugcaguguguuaacguucacccagauguguacuuuucugagaaagguccccacaaacucucaaagggcaguucccuaggcagauguaagaaacacagugcaagaacacgaaugggaaagcagcuagaccucucugcugacauuuucuugacuuucccuggcucaguagccacuucccuggcccucccacccauugccaugucagccaccaaggggugcagucuccaucugucagaccauccccauuacccacggccuccuuccaugcucccgcggcagccuguucaggggcucuccgcucugccccgagcugcugcagcgucccugucccggccacccucccuucaauccacuuccacauuccacacagcggaggccuauacuuacugcgugucugcugggugagaguacaagacuacguaggcuuauauauuaacgugggcagcaacguuaacaugggauuccagcuccaggggccuccccggccccauucuccuucccacacaguggccuggccacuuucccacuacaaacgggccuucaugccuccgucuuguuugcucacacugcaaacauuugugagaggcuggagaaccucgcagcagaugggcggcugaucgccucaucugagcucucagagucucugccucugcagaucuuuuuugcuuucuucuccccagguccuguucccauuuuccacaggugcaauuucagaucccucccugccuccagcuucacagagaaaagagaucugcgaggcucuucuuucugaaugucuaccucgccucccucuucauacucacuugggugugaccuuuuucccuuucuuagacuagaugggugggagugccacucugcaacagaagaugugggauguuugaggagagauacugagagugguuuggggccuacaggguuggagaucucugggauacccaaaaagaggugauggcugggcuacuagcugugcgaggcuggagcucaggagaaaggccuagccuggaaacgucucgccauaccuugaaagauuguucaaaugucucuuuuccacaauacuuggccuggccaacacaagacacauacaugcccccuucccuugaagucauaaaacucacugccucuaacagugaguuagcacgcaucuuacacuguccuaaagucacugguucauugugaugugcuuuaauccacugagaccaacgcuccuuaggccuaaauaggccuuguacucugcacccagcaaacacccaaugaauguagaccagcacuauccaguagacauuuugcaacuauuaacuuguuauuuaucagggcagucaacaagguggcuccugaauaccugaaauguggcuaccaugaaugaggaaagcuuugucaucaaagauggaaacaucguuucccggccgguucuaaucuuuccaaaucacagugaguggucaggugucugguggaaagaaaauaccugcucgugacaccccuguaauguuccugcuacugaaacagcuuuguuuugggaaaagcuuaguuuuaaaaagccugaugcacacucugcaaacuuaaucaccuuuggaacacaaccuguugguaagcaagggagcuuuucugugaguaacugccucauccagaucuagaccugcaaacccuugaaaaugauaccagcuggccagcagggagugucccacuuaccaggauguugucaauauccuccaccaugaggguauuaacaauagcuaaggaguauuaagcgcuuagcaguguuaggcaaguucuaagcacguuaagaggauaagcucaccugauucacagcaucccaagaacguggguacuacugugguccccauuuuauagaugaagaaacugaggcacguaagguuaaguaacuucccaaggucacagagcuacugagugguagaacucauauuugaacuggagucuuaggcccugacuuagcauuuggauaugaggcucgcacaggcaggccaaacugggguucacaucaagagguagagagggccccacaccuccgucugaccuggcaucugcacugggagccuguguggaaggggacacagccagggcagcaagauccccacagccugccaaacaucguuccagcuccugagcuggcccgggugcacaggaagcaguuucccagccuccuuuaugcagccccuuccaaagucacacuuccugccccauuuaauacuuucccagcgagugggcaucaacaaaacaugcugcguuuccuggccaacccgagcuuuccuuuuguaguccggacuaggaaaacacucccauacuccaaaauaaagauacucgcccucucuccaccccuucaccuccaugcucucuuuaaggaaacaagagagaaccagaggggcuuuuuccuggcuuugcaucaccuggaugcagaugaaucaguuguuucauuuuaguugcugcuucugccauaaagcagggccaccugggugcuuccagggucuuuugaaggcagaaggggaggaaagugugcccugcccagcccauaaccgauuaaccugaagaacuauuucagaagcacaaguaagucccauagaagacaaacgcgccacuaucuuaauguuaauuucacauuaacauuuauuuaaggugcugaaaaccagugaacuaguaagcauccucaauauuugucaauuuccaccuccugccguuucagugcauaugaagagcaaacacuucguuauggggccguuuugcuucccacucuaaaaaugaccucauuuuuaguaucaggaccuccaagaaguacaaaaacccugugccccaaaacuccuuucuccaaccuacuuaaaucucucagcccuguuuguuuuuuaccacuugauaccaaguacuucucucuuggucuucagaagauaacuuuguggggguggggguggggguggugggggcagcggggugggagggguuguuuuguuuuguuugagacagagucucacucuugucacccaggcuggagugcaauggcacgaucucugcucacugcacccuccgccucccagguucaagcgauucuccugccucagccuccuguguagcugggauuacaggcacgugccaccuugcccggugaauuuuugcauuuuuaguagagaugggguuucaccauguuggccaggcuggucucaaacuccugaccucagcugauccacccaccucagcuucucaaagugcugggauuacagguuguuuuuguuuuugcuuucaguuuuaaauucagggguaccugugcagguuuguuacauggguauauugcaaugauacugggguuugggcuccuaaugauccugcuguccaaguagugaacauaguacccaauagguaguuuuucaacccuugcccuacuuccucucucuccccuucuggaauccucacuguuucuuguucccauccucauguccauguguacucaguguuuagcuccgucuuauaagugagaacaugugguaguauuugguuuucugauucuguguuaauucauuuaagauaaugaccuccagcuccaugcuucuuauugugaaugauuucauuguuuuuauggcugcauaguauuccauaguguauauauaccauauuuucuuuauccgguccacugcugaugaggaccuagguuaaguccauaucuuugcuauugugaauaguguugcaauaaacauaaaaguacagguaucuuuugcuagaaugauuucuuuuccuuucaguauauacccaguaauggaauugcuggguugaauggcaguucuauuuuuaguucuuugagaaauccaggagacaguuuuaaauccacccaucccagaaagcuuucccuagccaguguaagcucaucuaugaccacaacuccugcugagaugacagcccuaggaaaugguuuggguauuaauggugaucaaucaugucugacccuuagcuuauuaauuuggcaacaugcaaauuccuaauaagugauuaggcccuucauaggccuacccuuauucaucauggaguaggauggcagcugcaaugcaggacucaggaugacacccgaggucugacagccacaugacuccaggacagcacagcccccuaagggcagggcagagaccagggaagaccucggcggcucccauauccaugacaagugggcaggagccagccuuggcuagugacgcuuuuuuaucacuauacuguauaugagaugaggagaggaaccuuaucucauauacaguauagugauaaaaaugagaccuuaaaugagaaaucaacaagccauugccccaaaaauucagaaauccccuggugcuggucaccaucuccacaacuguagaagccauucaggucuccauccggcaacuauagccacuucccagggcacugcuucaggaaccaaacgcagaagguaacagaacccaagacccuaugccucaguuuucuccucuguaaaaugggauaacuuccgcaugguuugcgguaaggauuaaauaagauguguaacaugccuagccuaguaccugauccaucaauaguugauauuuaacaaauaauaguuucugcagacacaaauuuauggucaacauuguucaaagagcauuauuuauauagcaaaacuaacccaaauaccagacagugggaagauguuuaaagaaaauguaauagagucaaauaauagaguauugggacuacagcagauucccucaucucaacaaagggaugauuuauguccugggcaggaagaggugggauguuacauuccaucaugcuacuugcaacagugcacaauuuaaaacuuaugaauuguuuauuucuggaauuucccauuuaauauuuucagaccucaguugaccauggguaacuguaaccacuaaaagcaaaaccacagauaagggagaacuacugucuagaauauuuaauuugugcaggaaugcacagagcauaaugugaaaaaagucggggagcaggugguuuuaaccaucagggcaaucaaggaccacgcgcaaacuuccaggcccugccguaccaugguggcuuccccaugaguccccagcugaguccacgugcugacacgcugcucucuucccccacagcaccaaugacagucagaguuccccguucacucacccuuacagaacucagagcaugcgccgggcugacaacaugcaccaagagacaguuguuugaccuggaacugggccucuggggggcgggggugugccccaaccccggguuggcacagaacagaaggugaacguguuuccugaacagcccagugucaucacacuaagugccauccugugcucacucuuaaguccugaguuuuccaagacuguccugaugucagcagggugcccuaauuuuagaugagaaaauaagaacaauaggccaggcacaguggcucacaccuguaaucccagcacuuugggaggccaaggcaggcggauuacgugagcucaagagaucaacaccagccuggucaacauggugaaagcccaucucuacuaaaauuuauauaaauuagcugggcaugguggugugugccuguaaucucagcuacucaagaggcugagucaggagaaucgcuugaacccuggaggcagagguuacagugaauugagaucaugccacugcacuccaaccugggcgacagagugagacuccaucacaaaaaaaaaaaaaagaagaagaagaagaacaauacaguaauagagaacauucuucucaaaacaacugaguuuccuucuucccuuccuuccuccacccuuccuuuaugaaugauuuacuccaaaagcccauuugaugcaacgcagcaaagaagauguacuggguugaacaguggccccccaacauucguguccaccuggagccugugaaugugaccuuuucugcauauggagucugugcagauauaaucaaguuaaacgaggucauaccagauuagaaugggcccuaaauccaauaugacugguguccuuuuaagaagagggaaacuuggacacagacacacauagaagaaaggagaauguuguaugaagacagaggcaggcauuagagugacuccuccauaagccaaagaaagccaaggauugcuagcagccaccagaagguaggagagaggcauggugcagauucccgcucaggguccccaauaggaaccaacccugcccauaccuuaauugccaacuuuuggccuucaaaacugugagggaauaaauuucuguuguuucaugcuucccaguuugcgguaauuuguuauggcagccacaggaaacuaauagaguagacacuagggguagaggggcaggugcagccaggguagguauuggcagaaagagagcaccuguuaggguggcuggggcagcagccaccuggcacacagaauacaaaagcccaugugggcagugaggauagacacaggagggagaccacagcccugugcaggggcugggagccagaacagggaggugaggagggcaucgucauugugguggggcaaccguggggacauaagaccacauacacacaggcaacugaguaaauuauauuauauaccaggguaauggaagugaggcuuuugacuacuggagaaggaaguuacagauacagaaagaaagaaaacuacaauaacccaggcuguggcacuagaauaggaggacuugauuugaauuugugcuuuuucauauaucucaauaaacacagaaauaaauacagagguaaaaaagcaugcauaggaggcggacggaucacgaggucaggagaucgagaccaccccggcuaacacggugaaaccccgucucuacuaaaaauaaaaaaaaaauuagccaggcguggugacgggcaccuguagucccagcuacucgggaggcugaggcagggagaauugcuugaacccaggaaguggagcuugcagugagccaagaucgcgccauugcacuccagccugggcgacagagcaagacuccgucucaaaaaaaacaaaaaaagcaugcauauguguaaguauauaugcaacuaauacacauauucucuaaccuugacacuaaaagggccugggaacagcaagaccccaacagcaaugagcacaggcagugcacaaaucuugguuuccaaacaccauccuccaccaaaaggaaucagggcuccuuggagaaauggcugacuccagagcuggggcagggaaagcaaaagauaagccugggaaaggaaauaaggaagggcucaaaagauaauagcaacaugucaaaaaaaagucacagaacccaaccugauggagcucccacuggccacaucuaagacaaucugagcacccaaauacaugacugaaauguauuucugucauugaacaaaauuggaaucuacgaauaaauaaauaggggaaugaaaaagcuuucccauaauguagaaugcaaacaaauaaauguaggaagaaugauggacuuagaagaucaacauuugguagcuaucaaaguaguacucagccaagaaauaccaauggaugcuaaccagugaguaaaaggcuggugaaaaaugggauacuuacauagccucaaaaauaccucccacaaaauauuuuuuaugacaaagggaaaaagacuaacuuuaucauggagaaggcugacugauggcuccuuaauuaaaagaucaaaugaacguuacgaauuaaggggcaaaucaaaagcauguaucaccuguaaggaugcaagaagaagaaagucucaccgccgugauauucuuguaagaaaugcauaaccagaaacgucaacaagcccaaacggauacacauucucuaagaaaauugccuugucauugucaaaagugucaaguucauggaagucaaggaauaaugaaggaggcagggcaccgaaauucaacaccuagcccugcaucagauucuccugcugcaagggacaugacugagacauuccaacaggaacagggucugcgggugggaggcgacucacacagcggugcuaguuuccugauucugauggccgugccagggucucaauggagacuaucuucguuacagcaaagacacauucaaguacucaggagugaugggauaucaguauuggcaaguuacucuccaaagauguagaaaaauaauucuuuguacuauuguuaaacugugguggaagucugaaauuagcucaaaagaaaacgacuuggccagaaagacaauaccaaguagguaaguaauuuccaguacagagggaaagacgacgacagccuuucugcaaauacaacaaacucuaggaaacccccuuuguggugcuuaaaugaagcugcuggcgguuuauucguccuccgugcaccaggaugguauuaauaagcacaugcaucaaucacuuuaucuauccauccauaaggggcagcuuaaucaagcaacaauuagcugaacaaggaggcucuaagcuucauuuccugggggagaugaggagugaugguccauaauucauuuaaauuguucaguuguguagaagaggagaaauaagacggccaaagagcucucgugcguauuugagagaaaagcgcucagauuuaggcgccaaagauuuaccuccagccaaacuucugugcuaauucaauagaaguuauuuauguuuuauauuuuaaagcacagaauugguuuccaagucacucugccucaccucaaaguuaagguggaagaaaaaccgccagaagugccaucgcugggucacugauagauuugcaaauuguagauguuuguccuccagaggccccuccaccaccaguucucugcaggacacuucaggguucccagcgccccaaaucuggcauucccagaauaguuucauuuucgaucaugacaacaguucccacucccacagcuuuucaagcacuuggcucagggaagacccacuaggaguaagggcuuugcuuuuuguuucuuguuuacaacguuuccucgacgugugcaagacggaagccugaacaacugucaguuccacuugcucguacuuggcugaacacugcaguuacuccccuggccucggacuccggagaagagcacacagcacuguccaagaacagcucccacacugagaacagaaaccgaaaccaggggugaagaaccgauccuuccuuccacaaagccuggaccaggcagccauucagacugcucuccucggcccccaaccccaacccagcucugcccuacagccagaacacccuuccaaaagcacaaacagacucucaucauuccacugccuaaagccuguccuuaccccacaagccuccagcgagggguccgucccaagucucugcgucugucaccccucagccucaagagcauccccucucccaagcuaacucuuacucauuuuucagauuuggcuucaaagucacuugacagcaaaccuucuccauuucaccaggccaggcccccaaaucuguagacaagaaucuccaugaggaccaaagucaauucuguuuuguucaccaugcuauucccagggcccagaguacggcagaggccaacgcucaauaaauauuaguugacuaaauaaugaacuugcuauauacgcccagcacagugauacgcaaugacggaaggagcuugcagccuagaaagagaagacagggacacaggcaaucacagugaggagaaggaugaacugccaucaaaagaagcgugcaccaaugcgugggaaaugccaucuagacaggcagucggggauaccuuaccaauaaugcuuuaaaugacuuuagguuuucaagauacaaucuggaauguuguuuauguagaucuuguuuauuuuauacaugggaauucacuagaaauguacugauguucaccaacacugcgcuggccguuaccaagaacuaugguaugugguuaguauggugaccaagccaaaauggagcacuucugaaugugaauggggucucauuaauacugacaccugaaacagauauaaagagcgacuguuccuggaaacaccaggaugugagaagccucugguuguaggggcuagguauacugacgcaggcucaccgucuucuauucaaaaucuuggggccagauaaagucuucagaauucaaaaguguguggauguuagcaagauaaugcgguacacauaccauauaccacaaggaacaaaacaccccggaaaguaauuagggcagaaccccuuaauccaacacaguuaauauuucugcagugaaacacgaacauucacacugauugggauaaauaaaagcuaugaauagcuucaugucaauucagggcagacuauccugccaaaugagucaugauaauaacuuucaguuucagagcauuuuggauugcaaauaagggauuuggggcuugcaguagauuucaaguuauuucaaucuuuggaauauauuauuguuaucacgcuacacgaaaaaucagcaucauuuuccuuaaacuguauuuauauuacacauuaaucuggcacacacuaggcuuaauguagugaauaauagcacuguuuaguucugaaaugaaaaaauguaaugcaaacuauuucugcuuauuagaaaguggaaaaauacuuuuccuaaauauuuuuauaaaauuugaaaucuuaaguagccauuuaaaaguauuauuuccuuuaagucgaguuuaccuaacaauacguaugugcuuuaccuuaccaaucaaauacauaaaauacuuauaaaauaagaaaagcuuuaaauauuuagauucaaaauuucuuuaaaauagucucccuaagguuccuuuaugauggcauuuguaauaucauuguucuuucuccaugacauucuaaauauuugauuuaaaaacuaaaguuauuauaaaaauaccuuuccaaggaucacguuaaauggcauuuguuuguuuguuuguuuguugcugugcaugcccuaugaaugacauccacaccguccacugagaccaguacguaagcaacugcuccauuucacaugcccuccuccuccacggaagcccuggugcaaaccgaaaagacuaaauacccagaagcacaaaugcaaaaacagacacaggaauugucuggcaaguuuaccuccuccauuucuuuuaucacguaauuuugaaucaaauggcaaauauuaugcaacgugagaaguugaaaagcacugaacuguuuagauuccaugguacuuggguagaaauucaguucaaagaggcacauacuuccucaugaaagugugaagaaagaagaaacucuaaagguaaagagggucaaggugaaggggccccagagaccuuccuaccauaagggccaagguacuuaaaucagcuucuacauuugcaggcacugaauuguuuauaaauauauacaugcaaaaguccaaaguugcuucacaaaauuguucuccugaugucuagggagauaauaguggugguggggauugugagagcaaugacuauucacugggcacccaugaugcacucagcauuaaacucuauacauuaucucauuuaacccucacaguaaccccauggggucguucucauuacuauccucauuuuaaaagggugcucuggcuuagcccaugccaaagcugacucuaggucaucaaacuccauuaucaugagaacugaggauccaaaaaugggcuucaucuucagggguauucuugguaauauagaaccccugggauauaguauuuuucuacaugugccauugauccugaaacauaaaugcuaggaaacugguuuccuuccccagcuggcacuggacaccacacuaguuccuaugguugucuccuccugucaggaaagugaacauugaagucccccaggcccacagaucagaaagaaaacacaagccagaauguucccuggggcccuucccaacacuuucugcuugcucagucuuuguucagagugaaaggcaauuaaaaauacaaaucccccauaaacagggauggaacaagaagauaaguuagcagcugucugggacucuuccuaaaagaggaagccuuuugacccuguaugacccuaggguugcaccaauaaaaacauacacauuuuuugcaaucucucacaccaaaugcagcagcaaagacaagcaaggguuuaaagccugaaaucccuacacaaucucuguaaaaccuucacaccucuauuuggagacccuccucaggugauguagggacccaggccaggcccaaguccccccagcacugcagucaugggaaaugaugcuggcagaggugacaggggcaacgacagcagcacaggggcacaggagagcugagcaaaggggcuggcucuccaaagugaccauugcuucuuuccaaauuauaccgcugcacaaagaaugcgaagaccauaggcuucggcccaggaaaagcauucugcaccuguccuaccugaugaaucaagaagcagagugaaagacgaggccauagccauauccagaggcucccagaaggaaggagucucaucacagccucucuuugcucauguucucaugccggcugccauggaagugcagaccgggcgcagcaacaacauggaccguggagcucugcggcacugccugcuuucgcccccagcucuaucauuuagcugugacuuugggcagguuacugaccuucucuguucucaucaggcuuugugaggauuaaaugaagaagcauguaaaauaaggcaaugcgguggcucacaccuguaaucccagcacuuugggaggccgaagcaggagguucauuugagcccaggagguagaggcugcagugagcuaugaucaugccacuacaccccagcaugagcaacagagcaggacccugucucaaaaaaaaaaaaaaaaaaaaaaaaagggaaagaaagaaagaagaaauagagagagaagaaaaaagcaaauaaacauguaaaauaucuagaauaguguuuugcaucuuacaugcacuaugggaguauaaaauagguacaaaauuuccaaacagcagcuuggccaagguauuaaaaauuuuaaaacuacacccuuggacccagccaugucacuucuaggaaugcuucccaaguaaucuaaucaugugugaaacaugcugucuuaaaauuaaaaaaagaaaaaacuacaaugaucuugaaaucugaugcagauacacauguaauauucuuuucuguaaaaaacagacaacaugagaaaacugugaauugcagauaaauuaccuuccagauacauuuaaauuaugaaaaucuaagaguauuuuuuacuccaucauuuuuuuaaagagcauuuucuagaaaaauuuaugcaaggccauuaagaccuaaaaggguagacugacuuuuaaaaguauuuuauaaauugaaacucaugcugggacccuuagguguguuuggcccugggucgcagcaucuagauggcaucagccucugcaauucagcaaagcaagaaucaugcacagauuucaaagcauauggacucgagcacauacugcauuuucaaagcuucuuuccauauggaaaacgggaaaagaagugauccuauauuucccuuaaucagcacguccucugagcacugccuuugcaguacaggagaaguaacaugaccucgagaaggcacagcuccuccuccucagagugcaguaggaaguuccuuuaagacugugucagccugcaguaugcaagccggaaaagaccucucaguccucugaugcagacacuggagacguaacaguauagagaacaaguucaauaagaggaggcacgugggaaaaggguagacaucagaguggauaacugagccaugcuggcuugaggaggaggagcguggcagaaacggcaggaccugaauuaccugagcuguuugugucacccagucaccuuugacuucauuuuugagcuccacagaccucaaaagguguguuuugccccuucaggaacacagaaaagacaaggggacaagagagaggagaugucaauguggucaguauuugugaaaagucaaauaacagaaacucaaagagccagcauacuggaacuggaaccuaagaaaaccuauuugcauagagcaacaaaauugcugcuuucugacuucaaucacaucacuagcagacuaccuugaaaaccaacgccuucccaaaaaccaguugccugaaaauaaccuguucugaaagguugauuugaagggcacuaucuuuuccccuggaugagaguaaaugauuuccucccacacuccacauccacaggcuggcccucaggaucugcuucuugcugccacuuuuccuuugaggauuuccuuuaagcuguccccucugccagggagcucuccauaaagguuaccagcuauucuugguguuauuauuauuaauuauuauggagacauccaauuuaacucuuuauguucaaaucuggucaagcuccagcacacaaacuauaaacuuacgcacuacaguuuccgcuaguuugauucuauuccugggauaaaccaucccaauuaccaaugaauuccaacuggaaaaagagccaaaauugcuaccacucuaaguacaggaauaccuccgaagcaagaauccaugucuccucugcaagcugcagaacugucuucaaauauuuuuggaagauaccuacugccucucaccaguuuccgaaugguagccagaggugggagggucggaucuggcauccauuggauggucacuauuuccccucucugccaaccccucccaggaccacaaugauuucuuuucuuucccucuccuuguuaaagcauaauaugguagugggagcucagauuuggcgucaagcacaccugaacuggaaccucaccacucacaaccuucaacuucgccaagccauaguuuccucaucacuaaacagagaucuuaauagcaacuuagcagagcuaccgugagaagaaacagauaaaggcuaguuuauguuaggaggaaaaguaugaggugagauuuccuuggucuccccuaagacuuccccaaagaaauuccaaacaguagggcccgugcuccaccuaacugcagugacuaagucaguguuccacaaggagcaagacgauguccaggguccaccuucuguaauagaagcauauucuccacccugcacauucuuggccagauuaaucuccccaaauggcuccugaccuugcagaaaauccuuccaugguuccacaacgcccauugaauaaaaucuggacuccuggccaccauaauucauccccaucccaccuuucuaaccucuuguucccacugauucccuccaccuucuucuucuaaccucuuaucccacugauuccuuucuucuuccuccccuccccucccccuucccucccucucccuccccucccccucccuuccuucuucuucuuuuuuuuuuuuuuuuuuuuuuuguagagaaaggcgucuccccauguugcccaggcuggucucaaccuccuggccucaagugauccucccaucucagccucccaaagcgcugggauuacaggcaugagccaccgcacucagccuccuuccaccuucugaugcaaccaaagcuuacagcuucagguacuuggcaacgggcuuaucucuguauaaaguccugugaggaggagucccaucucacucaucccaaaauaccgagcacaguagcuugcacauaaugacauguaguaaucacucauugauaagaaaguggaugaaucccuccuggaaaacucacugagggcaagggcugaggaggauaaggcggaugauauuaacuauacguugugauggauaaacuuaugaacaaaugauaagcaaaggaaauaaaaugacuacaaaaagcaugcaaccuaaaaaaaaauuuuacuauuuacaugccauuuuccgggugaauccggcuaaggauguuaauacacuuuugaauuacguugguucaacuuuucauuccaaaaaccuuaccccgagccaaccgcaugaaaaucgcugugugccaagcauuaucuaaagcucuguggaguauacaaagaugaugaagacaugaucucuggccucaaaggacuuacccugcaaagacgaaggugggcacgucaguguuaaagcaagcuuucaagcaagacguggugucccggaggugagacucgaagccugccaggaagagcacaccggagugggugccugcccugcggccgcacacccaccaucacugaucacacugaucacgggcgucugacacacuggguucgaguucccucucugcaucagacucacccccauuaguucauucgccucacaaaaaugugacucugcacuucaaauagaugaauuuuuuucaaaggccuauggggaaguuuuaauauuuuauguaaaaacccagaagagaggacucuggaaggcuuccuagaagagggggcaucugaacugggccuggaagccaagggauccucagguggaagggaagaaagaacauucccaacaaaaggaagaacaacgacaagggcaagagagggguggcgcccgcguguccgagccauuggugauacgaagaagcugcgccacggggaacgugagagccgcgguggagaaacugcuggaagguuucccugaagcugcgaguucagagucagccauguguccucgcaccucagcgagggucccugccgacugagcggaggaaaccccucgguccagccagggcacacacccggcugacgcgcuuuccugcggcccgguccgcccucccuaccgggaaaccgggugccugagcccaggggcaccaauguccugcaggcgccucugugucuggacagcaaauaacaauuggaggaccaagucagucacugcaacugaauucagccaacacguacugaggguaccgagucuacgcgaguccuguggcucggcccuccacaacauacaaccgguucaaacacggcaguuagugauaauacaguggagacggugaaauacugaaauaaaccacaggaauaucuaggccuuugaauaacaucuuccaauuuaucgccccagggaagugaagaguccggcaaacauccagucaaugccaucaaggcagccggucaccccagcugugagggccucggcaccugauggccacaucuccccaaacacucuguagcugcgucggaugaagagugugaggugguuugguuaacacaugauacagguggaauaaugccucccaaguaucccacacgcuagccucugcgaccugugaauagacuguguuaugugacaaaugggaauuaaggaggcaggugauuuaaagguugucuguugaccuugacagaggggaauuuuccuggaucauccauguggucccaaugcagggaagaagccucaauauggcacgggcagcucuggggcucccuccaguuccugagucccacuggcuaagguuugcaccugagguguucgcccagcccuucuguggcccggcgugacgucacucggaagaccuggggacacucugggcggauaggaagcccuguccuaacuucugcccuaugaaggcauuguuucugggggucuugccauuauccuugauucucuaacuuggguuucuuaccugaauuugagccaacugucuuuaauuccuccucacuugaggauuauaaacuuacuauaaucacucucuuuacaaaccaauucaaaacaaacaaaagagaguacaaaaaauauuuuuguaccuauucaucauuuccucuuagaaacuuauauaaaagcaccucaaagacaggccuggcuauuaucaaaggcacaacccaguccuucccgcaauggaccgcagacuacaaaugcacacgccucagagcuccucuccaacgcugcaggugcacagcugcgacacgcccugcugcuaacagucauuagcuaucauuuucugaaaugcacaggggaaaauguuccaaauccucaaaaaccuuccaaaaaaaaaagaaaaaagcuggcuguauccucggaacaaaacccuuccuuacugggaaacaggaacacaugcacugagugagauauuuguggccaccaggaacuggcucugacacucccuccuucaucuguuuguuccagccacccuggagagugguccaugcaccaggaacggaagaaacugucaacccuucaugucuuugcucuugcuguucuuucaaccaaaaaugcccugcucacccacuggccaccagaugacauugccucccuccuuccggccagucagaagucaguggugaggcacgccccaguuucucuggucaaagacguaauucuuaguucaugauggguagcuccaguaaauuaaaaagaauaaaaagaagauacugcuucuuccucuucucucccuuagccuuuggcuugcugugcuuccaugaagcccaucuuucguucuuuucaugaccaggaaugguuauuuaccugcuugucucucuaaccaaaugauaagcucuuugagagcauggaucugaaauuuucaaccuuacaucuucgcagcauagggcuucacacacagcuguucaaaauugucugcugaaggaaugacuuccucugaggguuuuauuuaagauauuuguuuguagaagagagucuucaauuuaauuucaucauuaucauguuuguuuucacaguacuuaaaacuaauuuuaaggauuuuuaaaaucguugccccaagccugaagagaauaaaaauuuuugcaacuccucuuaccacucugcuucacaacacauauauuauuucucuguuucucacauauauuaugcaucuucuuccaauuauuuacaacucaguuauaauccacacaugaccuugccaggcuauaguuuucaauaaaguucaacucuucaaaaggauucagcaaaacgaaaaauuuccgcaggacauaaaacuaaaccaacaaugaauuugcuuccauacaguugugauauuucacugaauuucuuuaucuacuauggcucuuguaagaacaaaugaauggcuucuccugcugucaacaauucacaauaaauacacaaaugcuuuuauccauuuuacuuaacagaucuguuauuacggcaauauuuuuuuuucauccacucaguaauacuauugaaccaugauugaauggauuauauuuaaauucuuaaguccccaaauguuacucugaggcuguuuuuacuaaucuuuauccugaaauaccacagaagugaagaacucuaaggcuuuuuucaugagucccaagcagacagagcagccgcaaugauaaauucacuaccauauccgagucccaagcagagaggcuaccacaagggcagccgcgaggauaaauccacuaccauauucaagcacugcuauuucuccucucacaagacauuucuggauucaaaauacaacagaaaaaaaauaauuauuuacugcacaguucaacaaaacauacuaaguacuuaaccuggcuacaauacacugagcagguuacuugauuucuccagcugaaaaaaugaagggaaggggcaggcaaucguugcuacagaaacucccaauuccagcauggugcgagauucuaucugauucucacuuacccaugcgcucugauuuacuucacuccagccuaaguuaauuccucaaagugugcuucaucagcuucacagcaucucaaaauucuaaaacagaacuuuuugccacaugcuacauauacuguaauggggagaagcuuaguuuuucagacuuacuagugugucauuuucaaaaccacaaaaugaaugacucaaaccuacagcucaacaacaacaaaaucaaaaaugaagaaagcccuugaauagacauuccuccuaagaagauauacaaauggcuaggagcacaugaagugaugcucagcaucauuaauuaccagggaaaugcaaaucaaaaccaucgugagcuaccacuucauaccuauuaggguggcccuaucaaaacaaaaagauaauaauaacaaauguugguaaaagguguggagaagcuggaaccggugugcauugcugauggggaugcaaaaugguacagcuauggaaaacaauuuggugguucuucaaauguuaaacauaggauuaccguaugacccagccauucuacagaauugaaauaacugaaagcagggacucaaacagauacuuuuauaccaaugaucacagcagccuuauucacaauagccaaauuaauaagaaucccaguaucuaccaacagaugaauggacgaacacaaucuaggaauauuacucagucuuacagaggaaugaagcucugaugcaugcuacaacauggguggaccuggaaaacauucugcuaagcaaaauaagccagacacaaaaagacaaagacuguaugauuccacuuacaugagacaucucgaguggucagauucacagacagaaaguagaaugcuggcugccaggggcugcgggaagcaguuauuguuuaauggguauagagauucugauccagauacugaaaaaguucuggagauggaugguggugaugcuuaggcaaccuugugaauguaauuaacgucaccaaauuauacacuuuaagaugauuguaaugguaaauuuuguuuuguaaauuuuaccacaguuuuaaaaagaaugcuucaacaugcauuuaugaauucccuacuugcugccacuguuuccuucagugcuuuuauggaugauaauuauuccuuaauuucaggcaacuuaaaguauucacuauagccaaacacacacacacgcaugcacgcacacacacacacacaugcacgcgcacacacacacacaugcacgcacacacacacaugcacacgcacacacacacacgcgaagagagaaaaggaagcauuuucaaaaugaaguaaggaccaguuuccccuucaaggcaaugucuucucaagcccugugaggagaggguacuaaaugauaucuaaaguaggaccuacguagaaaaagagcuacauaaaaucccuuuuagaucgacguggggaagcaaacaaaggaacuuacaaauacacucuauuaggcuguuauuuuaaauaagcaacaguaacucuagagcacuaaugggaagccuuaaaaaaaccuuuuuauuuugaaauuauuuccaauccacauaaaaauuucaaaaauagugccaagaguuccuggauaucuuucaucagcuuccuucacuuuaccgcggggggcaggaguacugauucugcagcucugcugguuacagugucuccccacaagggaaggguaaguagagaggggagauaauuaucaggauuuaaccccaucaguuuuccuuaaugacaccagaccauaguuccauguuccaaacuaaaugugggagaauuguggaaaaacagaaagaacaacaaaacaauauguuguucuaugccuauuuuacaaucuauuaagagucuguuuuaaaaaaaauaaaauguauacacuuggcaaaaaaaucugucacauuagcacugcggcuuccccuacaaucugaaacaaccccacagggcccauggaagaacuauaaaagggauucacagauaaguaaaaucguuucuggaacugucaucuuacuugccuaauuguguuuucucuaucuggaagaauuaggcuccuaacuguaaggaaugcagaccaucuaccuaccuggcuaccucaaaucgaagauaauuuucuuucguuuuauaccucccucuacauaucguuagcacugaauaaacaccugcuaaauaaaugacugaauggaugaaugaucaaaauagucaacgguuucagcugagcacucuccucuacccgcccccccaccgccccccaacccccaacccccaucucccaaacugcgaggacuuucaagaaaaacaaaaaucgcaaugcauuaaaagcaccuguaaguuaaguaaauccucuccuguaacauuuucaauucacccugacuucaccaauagucaggaugaccacacccaaaaguggaaaaaaugggucagcuacauucccuacagggaccuuccucgcaggcuucccaaguuuccacccgccuacaauggagagaagaaagaggagcagcaguccugccccacauccccagguguccagccuccgucugccuucuagggccuuaccuucaaaggucagcuaaacaguguguaugaguuaaguuuucccauaugaacaaaaaucccagcauccuaagaaagagccaauagagauuuaccuucaggacuauuauuuuaaagugagauuacacuuugcuguucuucugucaguugcaaauccccaaaccuacuagaauucacuuaaaacuaaucuacaguguuuucauuggaagaaagcaaucaggaaagcucugagccacugagcagcugggaauuucgcugcugaagguuugguuuagucuuuauuuuucuagcugcuggcccugcuaacaugauuccaugaaggucgcauuuaaucuugcagagaaaagcuaccuaagcaguucuuagguagucuucaguaaaaauaaauugccuuggcucucuggauaagucuguugcuucaacccaacaauuacagucaaagagaacaaaugaaggcaacuguaaaauacuauacuugauuucaaaagaauuucaucgccuagauguugugggcuguguuuguuaauaacaaaguuauuguuaacaaagaacccauggaaaaaguagcagcuuccaaauguuuaucuucaggucaucaccaaauauagcuuauuuaucccuacaagaaaguauuaggaucaucauuggaacuuaaacaucaaaagaagaaacugauaauauuuuuuaaaggucuggauacaaaggagaaaaaccgaacaauuuuucaccuucuggguguggaaccccuaauacaaaguaacaaauccuaaugcaaagugacaaauccuaauguuuauguguucaauucauauaccauuagguuucuaguacaaacuagaucugugccacccuuccugagcuggaauucagccuuucaagcuaaccuuugcuuuacagcugaaaaucaaauaaacuaauauuuaucuaggucuuaaaggugucaaacaccggugaggaaugcaaauaaaucggacuggauccuggcucucaaauaacuuaccacauaggugauacaaauggaaaaauucaaauaaucuaagauuuucauaacaguucaagagucuagaaugaaacauucaucucaucaagaugcagauagcuaacuacccuaggaaugggauguagaguaugcugcuucuauagaaauucagagcauuucauuguuuuaggcugaagagaucagguaugguuuguggggagagccacagggagauucauacaguuaugaccaaaauaaccacuccaacucuacuuuccuucaguccuuucaggacuguacuacaacuuuccccuguauugucuucacaccuugauugauuuccuuaugcugcaccaaccaagaugguagccaccagccacaugggucuaccaugcccuuggaauguggcugggcugaauuaagacgugcuauaggugcaaaggacacauuggauuuuaaauacucaguaugaaaaauggauacaaaauaucucauuaguauuuuuacauuaacgacauacugaaauauuuuagauaaaauuaguuaaaugagauauauuauuacaauuaauuuuaccuacuucuuuuuacuuuucuaaguggcuacuagaaaauuaaaacuauacauguggcucacauuauauuuguauuggacaauaucgugcauauauauauauuuuuuuuuugaugggcugugguacggcauucagccucugaacucauaauggucaugcccaauccuacuuccguagcaauccaaaaacgucuccauguucauaaagagagugaaacuauucuaauauuuuuucagauaaaaauuggagauuugaggucuucaguuugaaaagucagaggucacacucugauuaagcucuacugucauucuccaacaggggucugguaaaggcaggugugaggggaaaauacaacuucucaggcuucuuuccagacuccuauaaaaugccuucaccuccuaacacacagaaaugaauagaauauaaagggaaaaaauguauaggacacgaagauagggaaugcauaugaugcgaagauagggaccguuuaugacaugaagauagggaccguauaggacaugaagauagggaauguauuggacaugaagauagacaauguacagcauaugaagacagcgaccauuuaggacaugaugauagggaauguauaggauaggaagauaugaagauagggaauguacaggacaugaagauggggacuauauaggauaugaagauggggacuguuaagaaaugaagauagggaauguauaggauaugaagauggagacuguucaggacaugaagauaaggaauguauaggguaugaagauggggaccauaaaaggucugaagauaggaccauauaugacaugaagguagggaauguauaggauagggaauguaugggauaugaauauaggagccauauaggauaugaaaauagcgacuguauagcauaugaagauagggaauguacaggacaugaagauagggacuauacaggacaugaagacagggaauguucacucucacuuccccuacaaacauuuuauacuucacuuaccaugagaauuagaucuguagccauuuguguacauuaaaugcucuuuuccaaaaggauaauaaaaccucuaaucuccucaagaggaccaaauaauuucaccuugguucccaaggugcugggaagacguaucucccuaggcauguguauuucaaaaagcaugaaaaacagaccuuggagacauccccagguuacaagugucucacauucugaaagguuaggauaagaccccuggaaccuuuucaucccaugucaggggagcuaagguguuugucuguuugguuuuccuuuuucuucuucuuuuuuuuuucucucucucuccuuuugggacgggagagggacagcugcucugucccugucaacaaaguguagcccacauguacauuccauuaguuuucagugucaccuaagggucaagguuuaggggccugacacaauagugucacucaggcuguugccccaguuguaaauaucaacaaggaacucuuuucuccuacccagggguuuuguguuucugcaguauucauauguauaaagaauguuaacugugaagugaaaucauaucucaagcccuucacaguuacugacaaaacauuaugucccaaccucaccaaaaagccaccaaucuaagugucuccaaguagccacagcugucugaggacaaaggcuuccaagagccuggccaggaaagcccuggcucuagagccugcuccacacauggaggcagaaaggcucgagaauggccccguccaugcacagccuccuccucggcagcacccaguguguuuuuccuaaccuuacguggaccagaggugagggcagagaugacauauuagcacucucuugagaauauuuuucugguuaaaaggguaauugguaauugugcuugcuguuuuaaauuuggaaaauacaaaaauguuucaagaaggaaaaaaaaagccaaacacccacaauuucaccaucaaaaagauauguuuucuuccagguuuuuaaaaauaccccaauauacacauauguuuuaaaaauaaaacuagaagcacaauuucauauccuuuuuuccccacccaaucagcauagaucauaaauauuuucccaucacuaaacgcugcucgaaaacacgagcuuuauaagcuaccuauagucugucuggaugugccguaauucguucaaaugugucucuauuguuggauauuuagcuuguuuccaaguuuuuacauaacaaaagcuaauucaauaaacauccguguacauacaucuuuguucccaucucugguuacuucacguaaguagguuccaagaagcagaauuucuggaacagagagcuuaacauuuuuaagacuuuaaguauauagcaccaagguaaauuccagaaaguuuauuucaauguagaauccugacuacagucacuguggaguacucagugccccacucagugacccacacuacccacuuauggaauucauaguucaguuuuaacuugucccaucugguuguuuuuuguuuuuuguuuuuuuuuugagaugaagucucacgcuugucacccaagcuggugcgaucucggcucacugcaaccuccgccgccuggguucaagcgauucuccugccucagccucccgaguagcugggacuacaggugcccgccaccaugcccagcuaauuuuuguauuuuuaguagagacgggguuucaccauguuggccaggcugaucuugaacuccugaccucaggaaauccgcccgccucggccucccaaagugcugggauuacaggcgugagccaccgcgcacggccaaucccaucuguucuuuaggaaaacacauuaucagcccauucuauuucccugauuccauauuuaccucccacaaucucaauagcacaauuacauugauuuaucauuacaaauuacaaauaugaaugcauuaaauuauuacaugugcccugaaaauacauacaucuauuauguauuauuucaagaguuuaaaaauaaaauaaaacaguaccaaggaagaucaguacggggggagaaggccuaagagagcuauuaccguauuuccgugguugccuccaaaggcaauuuuagauugaguuuggggccucacauagugaguaucaguuuccccauccccaaacaaugcaucaacaucagcacacuuauacauucugagaaaugcaccauuaagcaauuuugucauugugugaacaucacagaguguacuuacacaaaccuacaugguauaaccuccuacacacccagguuuaugguauggccuauggcuuccaggcugcaaacauguacugcagguuacuguacugaggaccguaggccacuguagcacaauggcaaguaucuguguaucuaaacauagcaaaagguaaaaguaugauauuaucaucuuauggggccacagucauguguauggcccauugaugaccuaaacguugugaugcagcaacaucacuguacccuaaggugacuucagccauguccaagugacaacuacucacaacuucauguuuccuggugguauaaugucagcagcugccuagcaguuuucccaucagccuuucucauccccaggauaaaaggaucugaucccacagucagcaguggaggguccuccagucuuucaacugguccuugaguuaucacuaauugccuaaccaacuucaccucaccccuccgaucucuaaaacucuuucagugacauuuaugcaaagacagaaaaucucccugccugauugucucuucacucucucccauucaagaauccaggagucacuagucaccuauuuuccuucucaucaccccaucccccaacucucacuuuccaccagccucccauugcuauccuuucacccgacacacccaucauaucuagguguuaagacacucuuaucaccacuguaauuuuucucaucuuuuccaauagaucuaggguaaaaaggacaaaagaauucuuucaaaaauaacaugguagauauuacuugaaauaaagcaauuuguaugcagucccuccucaucugaaaggucaaucucaugaaaugggaaaauugguaggauucuaagcuuagggggccaggacagcguauucugucuacagaguacuucuuuggaucuucccaaaaucugacauucauaagaacaauuaaaauguacacucaauaagaacaaauuaaaguguauacucaucucuccuuugauggcauuaggugugcgaguaucaaaugccuucagcagauagcaacaguguuaaguaugcccaaaugaaauuauuuaugaaaaucacacagcaaguaguuaauucucaaaaaucgucauuuaaugaaaacaggacaggcuuuuaucacacaaaauccuaaauuaagguauuuugcugaacuaaauuagucuugccuuugggauaaaaauacuuagaauccaucaucagaaggaaccucacacaccugcuucucaucugcagccauucuuugucaacuccgcucuuucuugcuuaucagaagggaauacuaaacugauaaaggaguuauaaaccaaaauagaaacaaaacaaaaccaaacgccuaauucuccauggccuuccuggacaaagagacaaauacauaaaauaaaauaaaguccuucuugccucuucaaaauggaaaacugggcugggcgcgguggcucacaccuguaauccgaauacuuugggaggcugaggcgggcagaucaccugaggucaggaguucgagaccagccggccaacauggcgaaaccucaucucuacuaaaaauacaaaaauuagcccggcgugguggcauaugccuguaaucccagcuacucgggaggcugaggcagaagaaucacuuuaacccaggaggcggagguugcagugagccgagaucacaccacugcccuccagcccaggagacaagaucgagacucuuucucaaaaaagaaaaaaaaaggaaaauucaauguaucacaaacuuaacaugagucccauuucuguauggcaagcaagggcaagugggcagagccaacagagugaccacaggccccuguccgaagugcuuuuuaaaauguggaaagagguuucaucugagccaaggaaaagaucaacuauuuggcccugggaagagauccucgauucaguggcuuuccauuucuacucuggccacacaccugagggaggcuggggagcagggauccaauggugaauaagaggcucgcuaucaaggcaggaaggggaaggaagggaaagggggcuacagauagucucaaaucuaaaaggucccguguaauuucuaaaaguccccuccccaggugauuuucacaacacacacagguucugucuccugaggaugacagaauuauccagccacauuuuacagugaaaacuuccaaaggaggaagugauuggagaacuaaaaggccacucuaggcaucugaguucaugcaccuuccaccgcagagccuuguacacagcuggcugucaagaaauauuuaauaaacaaaugaaauaauaacacaaugugugcauuuaagaaaaccauugcauguguuacuacauuuaacaaaaucaauuauucauuuaaaauaauugcauggggucccuggauccccaagcagaccaaguuauugauggagggucccggcuaguuucagugccucagaaagccuaacgggauggugaguuucucucacacggagccggccagccuguccaacacaccacgggucucuaccuuuggcuauaaugaguucagugagauuugaugauaccaguuuucucaaggcaaucaggaguucugacuggaagucauauguguuucugaggaauaaaaaugggcacuagggccgggugcaguggcucacgccuauaaucccagcacuuugggaugcugaggagggaggaucauuugaggccaaggguuugagaccagucugggcaacauagcgagaccccgucucuacacaaaaauguaugucgggcuuugggguggcacaugccuguugucccagcuacucaggagacugaggcaggaggaucacuugugcccaggaguuugagccuguagugagcuaugaucgagccaccgcacuccagccugguggacagagugagacuuugacucuaauaaaagaaaaaggauacaugaagucuacuuaaauaaacacaauuuguuucagagacaguuugucauaagauggagcuucugagggggaaaauuauuuuuaggggaucuuugaaggucaaugccaagacuucaggccugcugcuugcucugaauccaacgagccucagacggagucccagggacaaaggggaccugugagcuguguuuccugcuuguguguuuuccuugguacucuauaaaaaauacugucuucauguucaaaucuggacccuauauguuauucaucauucuuuguucuuuguugauaaauuaaaguuugauggaacuuccucacccacuuuuccaucagucacucccgccaccagagccacuccucaauucagcacacugugcaugaagcuggcaucgugcaccgaccacugauuacacucaggccaaacacagggggccgacggggcaggcagagaccgaagguccugaccuccuaccccugugcaggaaggaacaucaugucucauacagaugaaaagaagaacuaauuuuuacuaauaauaacugacauuucaccgcaguuucguuuauuugcauauauuacguauuguaauauauguuauaaauauaugcuaucaguuaauauuuacuuucauguauguugucacauauacaguguugggcacacaguaagcauucaauaaaugcacaugagccaagaugguaaagcaggccggcgcaguggcucaugccuguaaucccagaacuucagaaggcugaggugggcagaucaccugaggucaggaguucgagacaagccuggccagcaugcugaaaccccgucucuacuaaaaauacaaaaauuagccaggcaugguagcgcacgccugcgcacaccuguagucccaacuacucgggaagcugaagcacaggaauugcuugaaccuggaagcagagguugcggugagcugaaagugugccacuguacaccagucugggcaacagagcaagacucugccucaaaaaaaaaaaaaaagaaaagaaaaaaaaggugguaaaagcaaaauacuacaaucagcccagugcacaccugcaaugacagauaaugaagaaguugacacgagagugaagaagauucagacuaaagcacagagaggcuugggaagauuuucuuaucugacauaaagagggaaaauacauugguccaaucacuguuauuuccauaucauuuggucuccauggauaccaccuaacuuuccuucugacaggaaaaaauucacugacaauaucggauuccacugugaaauuuuuuugauacuuuauauaaaaguuauuccauguuuaaucuuuuaucauuauuuauauaugcucagaaguaaaaucccuccuugcuggaaauucuaugagaaagauagugucuaauccagucaugauuaucuggccuuuuuacacuaagaauaaucugauauaauuuugaaaguuaaugccuuacacauuuguagacugccauaauuuaugcaauguucuuucauauacaguaucucaauuguucaugaaagcaacacuuacgagauauaguuaaaaauuauuauuauccuccuuacagcuaaccccaaaagguaauaacuauauuuuuuguuguuaauggucagcucacucaccagaacacaaccuaguguaaagaugcugucuuucucgcugucaguugaguauacagaggcuagcacugugucuggcuuauaauagauguucuaaggauauuuauugaguguguacauaaauucucuugucugcguuaagcccuuuuugguauaaggcagauaagggaacuauaacccagauacuccauuuagauagaguacagugguuuuucacuaucaaaaggauauuaugugaaaaugcucuaaaaacaacaguuuuguacgagaugauguuaagaauaaaaauauaacaucguugguaacaugagaaaauugaugcacaucaaauguggagcauccaaagugucuauuuuuccaguaaguuuaaacaucuuuugcucuggugcacuauuugccuaauaaaguguuucagaaagugggauaaaagugggaccauuguucauaaggcugucagaacuucauggcacgcauguguuugccauaauuugcuuccaguuugacuacagauccuuacuuuugauuaugcugacauuuuuacagguaaguaaaucugaaauaacuggaacuuucucuaacaaaaaaaugacaacucacugagaaugaaauauguaaauguuuaauuuuaacaagcaguuacaaaucguaacagacaagaacucuuggaucuaagagaccaaaauguaauuucuuacauaacagacaaaguuacaaguuauaaucguucacuaauuacagugaaauuccggacuuugacacaucaaucaauagauguuccaacguucccccuagagaucccaguucaagucuuaaauauuucaucugcugaaguuuccucagaaaaggcuccuuuucccaggauuuuuuagguuucuacuuuugccccuucucccacuaaaagaagaauaaaggaaaguuggggaaaucagagaauccugaaucugcgugcguggugaaguuaaacagagucacccucugggccugguagggauaacugcaucugccuagcaucaagacuauccaccgccuggucuaaccccagaccccguugugcaccugcccuuaagcaccaaaaacugaacugcucaaagagaaccugcagucgauaugaaaacuaguaaaugacugcaggcuugacagcagucucggugaugccugaaaauccacaacaggaaaucuaacuauccuccauaccuccuggccauucaucaaaagcagaccgagucacagccauaaggaggccgguggcugaagacgaaugccagcaccacuuuuccucauuuagaacaacugaguuuuuuccuuccauaaccaaggacaaggagcaaccggagggaggagguugaagagggagggggcgggcaauauguccccaaguuucagacaguagcgggucagaaacgagcgaaagccaccucgcucuucugagcuaccucggccgccaguccccgggaucacauccgcagccgagcgccaaggguccggccuacacagacugacccgggcguuucaccuggugcccgaccacggcucuggcgcccugcccaggcugcccgccuccuuccccucccccgcuucuuagggaacaaggaggagaggguggcaaacgcacccagaccgggggccaaggggagacgccggcgcgugcugggaggggcaugaguuacacccgcgacccuuggaacuuggaacggcuuccccagccccggcggacgccggcccccaggccgugccacugggagcaggcgggcgccgcgauuggccgcggccggcuucacucggugggcgagcccuaccggcgaggcggaaaggaaguggcggccgccgcggcuuugcaccaaccauguucggccagcgggcgaaugucacccggcgcccggagccgggucggagggcacggggcgggcacucgcguccccaccccgccgcggcccgcgccccgggaccccgaggggacgccggcccccacugcgccgcucgguccccggaggcuccccgcccccaccucgcccgcuccguagccgaggcgggucaggcccagcgcgcgaggccggccgggggcgccugcggggacccgggggcgcacggcgcuaggccgcggcccgggcggcugaccccucggcacggugccuuccugggacgcgccgcccgagccccuggcgcgcugggacaagugcaaugacaaagccccagggcccgaccgggcgcuggccggcgggaaggaggacgcggcgucccuucugagcggcggcggcggcggcccagcccccaggaagcagggcgcgucggccaggcccggcgcccggcccggcuccgagcccgcccucccgccccggccgcuggcacccgacgcccgcgacccgaccccgagcccggcaggcaggcgagccccuggaccgccgcggggcgccccagcaaguuuccucuggccguggcuggaggcgcuccucccggccggggagcggugccugcuuauuuacgcuggaggcagccuggagaggcgccgccgcgggcaccgagaaggacccgcuccccuccuucggauccgguggcggcgguggcugcacacacacacacgcgcgcacacacaaacacgcacauacacacaauuuuguuuuaaaugaggcccgacuccagcugaccugcacccccacacacaacaccuggggcgcagaagcacacacagcaggucuguguccauggagccaccucuccgcaucugcaaauccaaaagugaaauuaaaccuccaccaaccuccuccuccuccucccucucuaccuccuccuccuccuccuccucgcagccucagcagccccaguagcagcagcaacagcagcagaaccugcuuccccuaaaaucagaugauccauaauugcgccgacuguuccuccaaaaaucaguauuaauauuuaugaaccccggcauuuuccgucugcaaaacaucgugucaaggcaucaggacacgcauacacacacggccccccacaguccccagaaacaugcccucgagagaaacacacacagucacaacuauuauuugaaaaauguuaccucucagugugcuuuuuucacgcuaccaauacaauuccgcaagguauaaguguugcuaggguaugugaaauggaaaugaaagcccgucaguugaauaaucgcaggagcaaaacuaaaaguuacuccccggcuugccugagaacaguccagaucgaaagcaaaacaaggagaggaaacugcgaagagccgcggcu

SEQ ID NO: 192942 - RNA, 300019 nt, Homo sapiens
uuugauucaacuuuuuuuuauuuuuuuuuucuuuuugaaugucaugcaauaauucacagucccaagcccacgguuuucaaacaagguaggaaaaaaggaaaaaagaagcaaaggaaucgguggugaugguggguuuuucuucuucuuuuguuguuucaagcaggaccaaaugucagaaaaaaaugccucuuuucucaaucauuaauuuuuuuguccuuuuuaaaauuguuuauuguuauuauuauuuuuuuaaauugauuucugcaggcaguaauaguaggguuugguauaaccggcaagcacucuugugugugucugagaacgugugugggugugagugugucuggugguggguguagggcacugggauucugguuccuucuggcuucuuugccgcacucggccaccagcugucuucaucagggaaaggaaagauucaauugagaugauaaaacucaucaauagaagcuauuuuuuucuccccguuuuuucuuuuaaaaauguuuuuuuuuuuuuuuuuuuuuuuuuuuuucauguuccccaaaguucuccaaaaauggcugaguuaauucaaaucccuuggcugugugguuugucugcucccugccucccacccgagagccccugucguggguggggggaucggggcugguuggggggcgccguggcugcccaggagggucucuuuuggccgagggucucugcgggacacccuuguggcccagcccuggccucuccagagucuggggucucccggcuggcccucucccgggcccucugugcugggcccccgcggccucugcgcggcuccucggguggggugugugcguggggugcguggggggccgggcgggcgccaccucgcccgggcuuagcaccaaucaucgucacucucgcuguaggguucgugcaggcccuuccuggagcccggcccgcggggccuggccaguccgugcgccggguaguagccguuggggagucgccggccgugccgagaaggcgaggcgcaggccgggcccgaggcccggggaguccugggcgagcgcccgguggcgcccgaggacgcgugucguacgggggguggcgcgucguaggccccggccauggccuccucgccgcccccgcugcccgggccaucggccucgucguagucggagccccgguaguagccauggugccggggacccgggggccccucggacacgugcgggccagaugccggccaccgggccccgccgugucgacaggcccugggggacucgcuccgggccgggccugggacccgccucuccauccugggcgagcggccgcugcuguggccccccgugggcggccgaucuccggccagaggcucggccguggggccuggguaccuccgagggccgcugguggccgcccggcccggccuggccaccgccugcugcugcugcugcugcugcugcugcugcugcugcugcgggggccccgagccgccggccuuacggaucacaggggaauaggacacguguggccgggggguggagggggucugggggagcuggcggcggccccgccgcggagugcugguaccagauguugagggggcugggcuuccacuuacggaacuacugcccuacacgaaaauugaaacaaaggaaaucaaaaaaaaagauacaacaaaaucaaaggagacacgggauugggaggaagagaggggagcgaagggagaggggccgggaggagagggaggagggggagggggaggaggaggaggaggaggagaggggggacacaggacauugaauggaaaaaagcaacagccacagggaggagggaggggaggagggggagugagacagggaggggaggagucgaaaaccaacacaacaaagugaaaagagaaaugagaaauggaguuuuguaaguuucgggguuaaaaauagcagaaguuucaaaaauuacucacaggcguccagaggacagaaaucauaauugaaacaaaaacagaagccggguuaaaggaaagugaaaggucgggcggcacggcccagaacucaaauaugauccacaaccgaggagcaagcagcugcgggcggcggggagggggcggcgggugggcaagggggcuggggggacagcauaggcagcuggugugguggggauccguguccgcuccggccgccgggcaccccgguggcuugggggcaggaugggagguggucacagccgggauccggggaccuuugccuagaguggcuguuggaugggguauccccuucucuccuccccgccucccggccgagcccagccuggggucacuugcagccgcacccaccugccggugcgccaugugcucucggcccucgcugggcgagcgggaccagcgcuggucccgagcccgugcccggccgugguccggccguuccugggcauagcgguccuugucggggggcgggggauggugguggugguggugguggugguggugcugucgaugcuuccgauccuugggccggccccgcuccuggucccgcuccuucgacggcagguccccggauuggguggucaugcucaggucuguccccaagccugggccgggugagggucagacagacacacagguggucgugagggagagguggggcagaugcacacacaggaggccaccuggaaggugugggggcccuagagauccccugaaccgaggcaggucaguggguuggggggaggggguaguacccagguuccugcagcugcugccuggcccccucuguccccucuccauggaggccucucccuuucuucuuccuuagugucuccuccgcccugccuucuccuccccucuccucuccucuguucugcuugucccugagcaccacagggcugcccaccuguguccacaucgguguagcggcccagggagcgcucagaggcgcgguggcugcggucgcggcgccgcugguggugccgcugguucuccucgggcgggacccgcuccagcgaguaaucguccaggcgucgggccuuggggcccagcacggaggcugaacgcuucauggggcuggugucugagauggucugggggaggggacaggccggugggcuggggucagcagcuagcaccaaguggucccgguccuuccugccccauuguggcagccuggugguggccuucggugacugcggugugaccauccuggggcaggggccaggggaugccauggggccuuggcucccccugaucaaucagggcucuggguguggccaggccucugaggguggagccugaggauuccucugucccucagagacaggacugcuccuuuugagcccauccuggguucugaccagaaagaucugauccucacucuccaguccugggggcccagccacaguugggcaggcucaggcuggccagagggaagcccucuccacauccagggugcaaaccugggagcccuggacugccgcacucaucccugccccagcuugcucuccugggagggugagaagccuccgacuguggcuggcugaccuaugggcucaggaccaggugcccggcauggcagcuuuggguccucccggcuaacggggcugugcucgcugcccccacaagucugaguccuucuggugaggcccaagcuagggagcucugggugggggugggggauacccaggcacuggaggcucugggggcccacucuuuucccuggugcuucaucccugggucaagcccugacacacagguuucucugcagcaggcagaggagggaaggagggagauggggcagacgcccgccucccaggguccagcccagcugagcgcugguggcccugcuccagguaggagcugcaggaccagggguuggugguggugucaggagaagaagccccccagaaagaggugcagagugggccaggcucuuggagagccaguguccuccggcguggggggcccugaagaaaaggggguaggggugaggauggggauggccccgcccaccagggcuuaugggugaggggcacacacaggacaccacacacaaggauugggcuccauggaggggagagggugcgauugccaaagaaagggugggguccggggacggugagagaugacgggacucccuggaggggggguggggaggaagagggggccggagcccugcugggcgcugggcaggcgcgguacauacacugagguuauucccacguggccggccccuucuccucugucacagccccaugggauggugcacacagaaaaaacagaaagaagaaaauaaauauaaaaggcaagagggagagugaggagguggugcauggagaagaagccaaggaggggaguggcacuggcaucaagagaaaucggagggagaaggcagggaggaaaagaaaaguuaaaguccuggcgggugggugucccaggcccccggggcugggcguccucuauucccauggguacagaggagacagacaggagaugcagacagacaaauggcagaggcaugggaccgaaagacaggacggcgcagccucgagccccuggcccugggcucugccucaugcgaugcacaccccaaccccuggcuccggccgaugcucaaagcuuccaugugguggccgucagcugggcuugucccaacccucuccuggggcccagcagcucgguccugagggagcagcagcaugcacgcugggugcuccccaacccacguucccagcagccagaggccaggcccucaggugacccugguccagccaggcacagcacagccuccugccccgugcagacgccacacacggcacacggaaagcucgccacagccacacaugccacgcacccgggccaggcucucacagccaugcccuguucuccuccagaggcgggcugcgugcaugggcccccgcuguucaggccgggugggcagccagcuaugccucugggcccucugucccaugaguccaaggcaacgggaucaccugcaggugggccuggcagcugggugaagcggccacacacagacacacaucaagcacacaccccugugccccccaaugacucccacagagaccagacagaaaauacgagcccagcugcccccagacccaccccagacucugcuacuguauccuaggaccugccaaguucccauaugcagacacgugugcacguacaugugugcaugugugaguacaugugcaguguguauaugcccacgugcacacacguguguguaugcaagcaucugaguaggcgcacagcugcacaugugugugcauguauguugagcauguguguguguguuuguguaggggugaucuucguggcaggucucagcuggcccuguugaacccugcugcacccacaaaucuuccacaaccuccccugucugcagccuccaaccagggcagccagagaccauuuugcaguggccacugcccucugccccagggggagcacuuuccucucuguccucugugagggaggagggucugcaggugcuccaggugugaccaggugguggguggggccugcagacugcuucagagacugaaggagucccuacccaggccugaguccggcagggaggggaugcacugggcugcuugugggggggccuggcccuacccagugcagagugagggguccagccccagggcaguggugaaagcccucaccugguucucugcagggaggcggggcauggaggcagcccggcccuggccuuccauggggagguagugcucgcugucggaguagccaucucugcccaucucucgcaucuccacggacugcggagcagauggcaaagccagaugagcucuggggccugaccuccagaucccuggugucugcagagggagggagcugcagguguguguguguggggggcccagaucccuuccaccugaaccacccgggcccugggagccauuggggaguugggggacagaggcaccugagaguuaggcuggcuguugggcaugucgguaggggggccuuguuccggacuccaugugcccgucuucuggaacaucuccugggcacgcugggucacccaggacgggcucuccuugaggccgcuuucgugagccauccugcaugggggacagaggccgggguagcagugggcgcuugggcagcuuccagaacguggggaccacggcacccccacacuccaccucccuggcaggggugacacucacagggcuccuccuggguccagcuggguggaggggagggcguucuggccaggucccccuuccugcguuggggacgggggcuccaugcgcuggaacaugagggguguccgguccuggggaauggggcagagagcaguguguggacaagggugggguggugggacggugguacccagaaggcauugcgacauccccaguauacacacacacacacacacacacucucucaggucucauccaucuagacccuuccaauuccacgcagaacuggaccacuucucacuccuccacccaagucauagccccagccuggucccacguccucaucucucacugcaggcaccuucucccaggucucccgcuccuaccuucaaccccacuguuccacaagagccaccagagggcgcccaugagcacuugagucagguccuaucccuccuuugcuuagaacccuccauggcucccacuugcuuggggaaaaagccagaguccuuccugcagcucccauggcccugaaggaucugcccugucaccuccuugcccuugucuccucccugcucuuuuccaccacacuggccucuuugcuguuacccaaacaacccaggcacgguccagccucagagccuuugcacuggcuguuuccucugccuggaacacccuuccagguauugcuuagcucacucccucuccccuuuuccuucaagccuuugcucacaugucacuuucucagggaggcuccccaacuacccauuucccaccgcauccccuccuccccuggauacuccuaucuucuggauucuucuccacuuucccccacgacacuuucuuucucuuugcuggauguugcacgauucagucauuugcuaccauuggcauuuccccacuuggaaugucugcucccugagggcagggauucuggccuauuuuccccaugggugcauccccgaggacugagaacagcgcccugcacacaguaauacucaauaaguguugguggagcagcugaaugaagaaugaauccacaugauguguccuuggcaagaacuuuuuuuuuuuuuuuuuuuuuuuuuuuugagauagaguccugcucuuaucacccgggcuggagugcaguggcuugaucuuggcuugcugcaaccuccaccucccagguucaagugauucuccugccucagccucccaaguagcugggaccacaggugcauggcgccacaugcagcuaauuuuauuuuuuuuuuguagagauaugggucuuucuauguugcccagacuggucucccacuccuggccucaagugauccucccaucuuggccuccuaaauagcugggacuacaggugugcaccaccaugccuggcuaauguuuuauuuuguagagauggagucucacuguguugcccaggguggucucauccuggucucaaacgaucccucugcccuggccucucaaagcacugagauugcaggugugagcugcugugcacagccccuacuuuucagggaccugcccuggggcucagccacccucauauuccaguugguucccguggugacaugcaagccacuguccccagcccagauguccccagagcggcgaacagcgcaccugcuccucgcgcauggccugcagcuucuuggccuugcucugccgguaguacuccaugaucaucauggcugcguagaucuuccccacggugagguccguggcugggggcacacacacggugagcucaccaagggcaggccucuuuggggcccuuguccugggucccuguguauaccagcccaggccaacacucuccccaggccuccccuuucccucccccuccaucuguccugguggauuggaucccagggcugggcucagcucuuacacuugugaggugugaccagcaggucuagcgucuucugggacagauugggccaaaucgccaucaucuccuuccgcagcucagcguccaucugcuguuugucggcuccuccugcaauggggguguagacagacccugacugccugccugggugucagcuggacucugggucagcugcaaagccauaggcucccgagaacgagaccccaaucuuucugguccccauggggucuccaguuccccaacggccuggcccagaggaggcccugggcagugcugcuggaaugaccuugugggcucugguuuucgguggggccaggaccauggagcagcugugcaggagacagcccggcauggagaacagcugggcgaccugggucccaaucuugucucccaguuaucggcugcaugacuuagguuacucuaccacuuaguaacucaguuucuccaucugugaaauggagaugauagcaagaguacuugccucaccugguuguuguguguguguguguguguuuuuuuuuuuuuuuuagacagagucuugcucuguugcccaggcuggagugcaguggcacgagcuuggcucacugcaaccuccgacuccuggguucaagcaauucuccugucucagcuucccgaguagcugggauuacagacaugcaccaccaugccuggcuaauuuuuuguauuuuuaguagagacggaguuucaccauguuggucaagcuggucucgaacuccuaaccucgggugauccacacgccucggccucccaaagugcugggauuacaggcguaagccaccgcgccuggcugguuguuuuuuuuuuguuuuuuuuuugagauggaguuucacucuuguugcccaggcuggagugcaauggugcaaucucagcucacugcaaccucugccuccuggguucaagcgauucuccugccucagccucccgaguagcugggauuacaggugugcaccaccacgcccaacuaauuuuguauuuuuaguagagacgggguuucaccauguuggccaggcuggucucaaacuccugaccucaggugauccacccuccucagccucccaaagugcuggcgauuacaugcgugagccaccgcgucuggccuguuuuuuuuuuuuuuuugacagagucucucucuguucccaggcugaagugcagucaugugaucucgacucacuguuaccuccgccucccagguucaagagauucucccgcuucagcuuccugaguagcugggacuacaggcacgcaccaccaugccuggcuaucaccugguuguuugaugaucaaaguaacgugcgugcagccuugggacagugucugccauaggauuauuacugcagugacccaucuguucaaggcugggacgcccuggagcauccccaacagaggaaguuuugguuuugguuuuauuuugauuuuugagacaggguuuugcucugucgcccaggcuagagugccguggcacaaacauagcucacugcagucucgaccuccugggcucaagauccucccaccucagccucccaaagugcuggaauuacagaugaaagccacugugcguggcucagaggaggucuuuuccccuuucccaagucuccacugccacggacaugcccuuggccugcagccagucccucgucccucaccccagucauggggugagucauuaaagcucucugacgguguuuccuggcccuccuaccugaguacauggggggguuccuccugugguuggcagggccaugugaugaguccuugcuaauggggugugcaccauguaaugugccacuuuggggccagagcauuuauuauuauuuuuauuauuguuauuauuuuugagauggagucucgcucugucacucaggcuggagugcaauggcaugaucucggcucacugcaaccuccaccuucagaguucaagcgauucuccuaccucagccuccugaguagcugggauuacagacaucugccuggcuauuuuuauauuuuuguagagacaggguuucaccauguuggccaggcuggucucgaacuccugaccucaggugaucugccugccucggccucccaaagugcugggauuacaggcaugagccacugugccuggccuauuauuuuuuuuaaaaauuuaucuaucuaucuaucuaucuaucuaucuaucuaucuaucuaucuaucuaucaucuaucuaucgaucgacagggacuuacucuguugcccaggcuguggcacaaucuuuguucaccgaagccuugagcuccugggcucaagcaauccacauucugacagucagaaugucacugugggcugcuauuuggauaugcuaacuggguuuacguuuaauaugcuaauugguucaggcagguaguuggcucugcccucaaugccugggguggggggcuugaaagaggauaggguccagccuggucaacauggugaaaccagucucuaguaaaaaugcaaaaauuagcugggcgugguggcgugcgccuguaaucccaacuacucgggaggcugaggcaugagaaucgcuugaaccugggagguggaggcugcaguggugaguugagacugcgccacugcacuccagccugggcgacagaacgagacuccgucucaaaacaauacaaaacaaacaaaaccaaaaccaaaauagagauucuucugggcagagagaacagaggggugggugggagagagaaacagauggacagggaagagagagagagagacagagacagagagaaugagauggacuugcccccuuucucccagucuccagcaaugaauggugacaccauuuuugagaaucugaagaaugagguuaaucuguacccccuuugcagccccuuagccugcuggaaaggaagcucagugugcuuagaaagugagcugaacuaugaaaagaaagcgcguuauguucuccugagacccgcaucugcucaaagggcugccacuguuaucacucuuccauuguuguccccacacccucuugaccuuccguaaccccgagagccuggcucagcuguggaacuccaggaugaggccuggcacccacugaggacaagagguggaggggcuccuggcugagaaaucugggggaucauugucuucagggaacugaguggcaucugggguacaaguaacaacugugacagccaaauucagagacaucuccaggagucuuugaaacccucaggaagggaauccaguaggugucauagaagcuggggugcuaagcaguaaggacuagcucaguaggcuaguguuguccaaacccugcacauuccgaugaaaggacuggcccauugacuugcuccugggaggugaucucuaagccuuugaaauguccugccugaagagugucuuuauuuagcagggggccuugggccacacuguauaguucauucuuuuuuuuuuuuuuuuuuuuuuuuaaaaaaaagagauagggucucacuauguugccuaggcuggucucgaacuccuggccucaaacgauccuccagccucagccucccaaagugcugggauuauaggcaugagucacuguacccggccaauacaguucauucuauuuauuuauuuauuuugagaugguguuuuugcucuauugcccaggcuggagugcaauggugcgaucuuggcucacugcaaccucggccuccuaguuucaagugauucuccugccucagcuuccccaguagcugggauuacagccgcccgccgccacgccuggauaauuuuccauacaguucauucuaacaaugcgauuuaucguuggggucuugggccacgugguaucaguuugaccucuggagggacuggagacugaguaacuacgucagcccugccuauaugacaaacccucaauaaaaacccuggggcaccaaggcucaggugagcuucccugguuggcaguacacggugcguguugucacacacugcagggagaauuaagcguugucugugcaacuccacuggaggcagacaacuggaagcucgcaccuggugucuccuggacccuuccccagaugcccuuccuuugcgcauuuuauguuuuuggaauuuguuuguuuguuugagacagagucuugcucuguugcccaggcuggagugcaguggcgugaucuuggcuuaauguagcucuaucuccuggguugaaaggauucuugugccucagccucuggaguagcugggacuacagguguaugccaccacaccuggcuaauuuucuuuuuggacagaguuuugaucuugucacacaggcuggagugcaauggcacagucucagcucacugcaaccucugccucccagggucaagcgauucuccugccucagccuccugaguaguugggauuacaggggucuggcaccaugccuaauuuuuguauuuuugguagagacgggguuucgccauguuggccaggcuggucucaaacuugugaccucaagugaucugcccgccuugcccucccaaagugccaggauuacaggcguaagccaccaugccaggcccuuugcagauuuuuuuuuuuuuuuuuuuucuaauagagucucacucuguccagccuggagugaaguggcgggaucucggcucacugcaaccucugccuccugggcucaagugauucuccuaccuuagccuuccaaguagcugggauuacuggcgccagccaccacgccuggcuaauuuuuguauuuuuaguagagacaggguuucaccauguuggucaggcuggucuugaacucgugaccucaagugaucugccuaccucgcccucccaaagugcugggauuacaggcgugagccaccgugcccggcccuuugcagauuuuaaucuauauucuuucacuguaauaaacugugaguauaaaaacuuuucucaguucugaguucuuccagggaaucacugaaccugugggugguuuugggaccccugaacacagauucucagagugccacagaagcugaguuacgauggcauuacauacaaagaguggggguguuguuagacccguuguacaaacgaaggaacugugguaggcagaauucaaaagcugcccuucugccaagauucuguuuauucaaacacuaaucuagggaccauugcccaggcuaugaagggacuuugcagauauaauuaaaauaccggaggcccggugcgguggcucacgccuguaaucccagcacuuugggaggccgaggugggcagaucacgagguugggagaucgagaccauccugcuaucauggugaaaccccguuucuacuaaaaauacaaaaaauuauccgggcgugguggcacgcaucuguagucccaccuacuugggaggcugaggcagaaucacuugaacccgggagauggagguugcagugagccgagauugcgccacugcacuccagccugggugacagaacaagacuccguuucaaaaaaaaaaaaaaaaagaaagaaaaugcugggcaugguggcucacuccuguaaucccagcacuuugggaggcugaggcggguggaucaccugaggucaggaguucaaaaccagccuggccaaccuugugaaaccccaucucuacuaaaaauacaaaaaaauuuagcugggcgugguggugggcaccuguaaucucagcuacucaggaggcugaggcaggagaauugcuugaaccugggaggcggagauugcagugaacugagaucacacuauuauacuccagccuuggcaacaagagugaaauucugucucaagaaaaaaaaaaaauaucaagucagcugaccucaaaauacagagaugaucaggguaggccugccccaaucaggugagcccuugaaaagcacaguauugucucugcuggguggcagauggggaagucagagagaaugagagcacauggaggauuacaugcacuuccaggagcaaaaagcuaaaaagccagugauaaaacaagaccucaguccuacagccacaaggacuucaauucugccaacaccugaaugaaccuggaaguagauucucccccagauccuccagagaggagcccagcuuggcugacaccuugauuucagccucgugagacccucagcagacagcccaguccagcuuuuuggacuucugaccuacaggacugugagcugacaaauaggugugucuuaagcugcuaugucuguggucaucauauagcucacugcagccuugacaucccaguccccagugauccucccacuccagccucccaaguaguugggacuacaggugcacaucaccacaccuggcuaauuuuaaaauuuucuguagagauggggucucucuguguuggccaggcugaucuugaacuccuggccucaagugauccuccugccuuggcuucccaaagugcugggauuacaggugugagccacugcucccaacuuccuugugcucucuuuaccuucacuuuguuccuggcauuaacaauaucuguccuccaccccuccagucccccaccuucccugccacuuccuccuugagucuugccacguggccuuggcucuuccucccuucuuucccucaagacccuggaaggcacauaugucucgaggcucagucuucccuccuccugacuuacuagugguuucagcugggcucagcaccuucccaugugugggacuauccaccugcuccucucccacccacuccuuuuuucuggucccauuuguuuuuucuuuucuuucuuucuuucuuuuuuuuuuuuuuuuugagacagagucuugcugugucccccaggcuggagugcaaugguuugaucucggcucacugcaaccucugccucccagguucaaguaauucuugugcucagcuucccaaguuguugggauuauaggugugcaccaccaugccuggcuaauuuuuguauuuuuaguggagaugggguuucgccauguuggccaggcuggucucaaauuccuggccucaagugauccaccuuccucagccucccaaagugcugggauuacaggcgugagccucagguccccguuucuucuggcaauugugcgccugucucucugcccugcuguccuuaaucagcugccaaaucacaucacauccccuuucgggccuccgaaaugcacuccagacaggggaccccugaccccuccgccaaagcugcacuggucaaagugaccaugaugaccagucacuugugauccuugucauccuuggucucugggcagugccugacacgguugguccccuuccuccugaagccgcccuuuuaaacauagaagcugccuccaggagcccacacugcccuggucucugcccgccucccuggccuccucuucuucuuucccccuaaugauggagagugagcccugagcuaggucuuugggggaauuucucgguauuuuuuauuuuuauuuuuauuuuugagauggagucuugcucugucgcccaggcuaaagugcagugaugugaucucggcucacugcaaucucugccucccggguucaagugauucuucugccucagccucccuaguaacugggauuacagguacccgccaccacaccuggcuaauuuuuguauuuuuaguagagacaggguuuugccauguugaccaggcuggucuugaacuccugaccucaagugauccacccgcuucagccucccaaagugcugggauuacaggcacacgccacgacacccggcuaauuuuuguauuuuuaguagagacaggguuuugccacguuggccaggcugaucucgaacuccugaccucaaaugauccacccaccucggccucccagcgugcucagauuacaggcgugaaccacugugccuggccucaacaaaaugcugagauuacaggugugagccaccauguccagccuucucggcuuuuuuuuuuuuuuuuuuucagaugaagucucacucugucacccaggcuggagugcaguggcacaagcucggcucgcugcaaccucugccucucggguucaagcaauucuccugccucagccuucugaguagcagggacuacaggugcgugccaccacacccagcuaauuuuuuguauuuuuaguagagaagggguuucaccguguuacccaggauggucucgauuucuugaccucaugaucugcccgccucggccucccaaagugcugcuauuacaggcgugagccagcgugcccggccucagcuuuuuuuuuuuuugagacagcgucuugcucugucauccaggcuggaguucaguggcgcgaucuuggcucacugcaaccucugucucccagguucaagugauucuccugccucagccuccggaguagcugggguuacaggcgcccaccaugacacccggcuacuuuuuguauuuuugguagagaugggguuucaccauguuggccaggcuggucuugaacuccugaccucgugauccacccaccuuggccucccaaagugcugggauuacaggcguaagccacugcgcccagccccuucucagcuuuaaaaaaaauguuuuuuucuuuuucuuucuguuguuuugagcuaggaucucguucugucgcccaggcuggagugcaguggugcgaucaugacucacugcagccucaaacuccuggcuucaagcaauacucucaucucugccuccugaguagcugggaccacaggcauaugccaccauguccaguuaauuuaauuuaauuuaauuuuugagacagagucuugcucugucacccaggcuguagugcaguggcgugaucucggcucacugcaaccuccgccucccagguucaagcgauucuucugccucauccucccuaguagcugggacuacaguacccaccaccacgucuggcuaaauuuuguauuuuuaguagagacggggguuucaccacauuggccaggcuggucauccugaccucaaguaauccacccaccuuggccucccaaagugcugagauuacaggcgugagccaccacgucgagccuaccccuagaucuaagcugccgcccugucuccacccagaugauaucagcagcccccacacuggccuccuuucggucucccauccccucaguggccggagggaaccuguucaaaugugaguugggucagguuccuccucugcucugaaccugcguggcgugcccucacucagaaggugagucagcucaaugccccggguguccuguguucaccccucugucagggccuuugccaguccuucugccuggagcaccuuccccccagggauccaugagacacugccuuaccuccucaguggcggccuccccauccaucuaaaguguaagcugcuggguccuccccugcuuggacgggucucuggcacauugaaggagugcacuaaauaucugccaaaugggccgggugugguggcucaugccuguaauaccagcauuuugggagaccaaggugggaggacugcuugagcccaggaguuugagaccagccugggcaaccugaugaaaccccaucucuauaaaaaauauaaaaaauuagguugggcaugguggcucacgccuguaauccagcacuuugagaggucgaggcagguggaucacuugaggucaggaguuugagaccagaggucaggaguucgagaccagccuggccaacauggugaaaccccaucucuacccaaaauauaaaaaauuagccgggugugcugguggguaccuauaaucccagcuacuugggaggcugaggcaggagaaucgcuugaacccgggaggcggagguagcaaugagccaagaucacaccacugcacuucagccugggugacagagggaaauugucacaccaaaaaaaaaaaaauuagccgaguaugguggugugugccuguagucccagcuacuggggaggcugagguggaaggaucacuugagccugggaggucaaggcugcagugacuugcgaucaugucaccgcacugcugccugggcaacagagcaagacucugucucaaaaaaaaaaaaaaaaaaacaccaaaaccccaaaccccaaaaaacccuguggaacgaaugaauggaagagugaaugaagauccggguggugacagcagauccucuaguuugggguagggagggagauccccgguuccacccugucacgccugucugugcccgccccugucccuuccuuacccuuggcaaucuugauguccagggcugugcggaucagagccaugaggguggaauugaaguggacgguguugucaucugcgacgggcagguccauccgcagaagccgcuacagaaaacccaaggcaagcgcagucauucccaggcaucccuccugggucucccgugagccgcgcccgccccuacccagggagucccaggaagaacucugaaagcuguggcggcugaggugucucuuacuuagguuaccugucccaguacucaguuucucuugguggcccgcagggagggcacaaaaggcucucuuguacuucugguccccugcccucuccuuuuuucccccaccugcuugaccugagagcuggcauuuccaggguuugccucaacccuugccccacccccgcccugccccagaguucuucuggauggccccguuucagucugaccccaaagaaaaagagcacaagcuggauuugagcagugcaugcaacagccaaggcugagggggccaggaccacagccgcugguggggggugccacuggcuccccacacccaaucccuggcuuggcccagaccaggacagagcagaugggcacagaccacaucauuccucugagaagcagcaggcaggcagccccccacugacggggcaggccccucgcaggcaugcagcgaggcugugacacagaacagcacagacaggggcgcaugcagacggaaucucgagacucauucauagcuccgugggaaguguaucucaggggcauguccagaucuuggcucucugugcaauggcagggggaaggggugaggggcacucccuuccagcccagggaagaaaagauuccccaugucccaggcaggggcucuguccaccaugcuugguggcaugggagaggaugcugggcuggugugcaccagcccaggcugaaguggcacagagaaggggggugagggcaacuuggguggggauucagacacaagugggcaggaaacacagaguugaagauggggagggguaugguaaauccagagcaggacacuggaggggacacuggggguaggguggggaaggaggugggaaauagagaaacacacauagacugggccacugugcacaguugugcagguuguacaccgcacaaagggcucccaucuuggaaaugauagauuuauguacuuauuuauuaauuaaaauauuuuuucuuuuuguagagauggggucucgcuauguugcccaggcuagucucgaacugggcucaagugauccucccgucucagccucccaaagcacuaggauuacaggcaugagccaccacgcccagcccccgauuuguauauuaaauauaacagcuucccaggugauagaaaaaaagugucuuguucucaccacauugguagauugcaacaauuuuccaacaggcauguucuguggaaagggugccuuuuucaaauuugcacaaaguugucuuauggacccauggugguccugcacaaagaccaggagaggaagggcucgcccucccucucuugcacaugcgcacacauucaucuaagcagagacugagagaagcgacuugaggaaaaccgggggggggggggggggcggcagggaggggcacagagcgacaggugccaggagaggcucauugucugagaugcuggugggacaaccuuguccccggcuuugauugagaaggaggggagacauauagguuaggugaggaggggugcacagaggaaggaaaggaaugagguggcaacacggggcagguacaaauagcauugauggauagggacgcagggaagaucaagguggaugggagaauaggaugaugggguaauacuuuuuggguggggagaaucuuuaaaggucaucccugaacuucuuguggaugaauggagggaacagagcaucuguccuugggcaccaagggagauuccaggacagggaucuggagggguggcccgggccagccgcuuggcggcaggacgcucgcucucucagccagcaugcaccaccccccgucggccauggugccugcccgccccaggccccgccaaggcagcgugcauggccugcaucagugugccaccguccagggguccagcugcggccgccugcccacucuggaacaauggagaggcauguuggggugucuuggggggauuagggacgggggcuggggacgaaacuccaggggaaggaagggaggggaagagagguucuuggugcuccuuggaaggucucgaauccccaaggcccuaggucagagaucagcuucaggugugcguggcaggggcggggacccgggaccucgccugcuuucgggggcuaaagccccucucugcaaggcgccugccccagccugggcaugggggccgcucugggugggcagaagugggaagcauggguuuugacucccugaagaagcguguuuguuuccaauuugguaccugggagaccaggugcaaggggaccugggcgcuccccucccccuccccccggcaugucggccauaauggagucucaaaacacgaagacacucaucagaaaggacggacacagugugcugcuuagaaucaagggauggucaugaucaguugacucgagaaaagaaaaaaaagaaucaaaaacaaaaaagaagagaaacguuggaaaaagagagucggccggguguuucuggucagcacuaaaaaaaaagaagaagaagaagaaaaaaaaacccagugccuggacgucgguggucggcaaggguagucuaccuuguaagccacucuggccggacacuucuuccccagacccaggggcggagacaugugucucagcaucugauacauguccagguaaggcaugcggccccuggcagcaccgaaaaugaaaaaaacaaaaacaaaaacaaaaaaacaaaacgggaaugggaacagagaaccaaaggaagagagguggggagaaacagaagaaagaaaaaagaaauccacacgagccgaaaaaauagagagagaaagaugcagagaaugauaaaauagauauuucaaaucaauggaaaagaggaggaaaaaaaauggaagaaaaggucaguaaaaaaagauuacuucacugcucgggagcagggagagagagagaaaagagaaaagucagauucagcgugggcucugagcuacaguucuggagggaugcggaggggagggagaauucucacuuuggaagacguagagccaugcuuuuguucauugccuuuuuuuuuuuuuuuuuuuuuuuuuaaagagacagggucucucucugucgccuggguuggagugcaguggugugaucauagcucacugcagccuccaccuccugggcucaagcaauccuucugccucagccucccaaguagcugggacuacaggcaugcgccacaaugccuggcuaauuuuuuauagagaaggggguucuugcuauguugcccaggcuggucucaaacuccugggcucaagcgauccuccugcuuuggccucccaaagugcugggauuacaggcaugagccacugcgcccggccaucacuguuauuucuacaguugggucacguucucugguuuggcugaggcuggucucugagggggccuagguggggagcaggggccagugccagggaggggaggagggcuaggggcuuugggaggugagggguggagggggagagaguggaggugaugguugggggagaaaugcaaaguuacaaucccccaggggauguaucugauuuggggugccguggagaccccaggaugggcagcuucagcuaagagcaagcaaagauggcugaaggcugaagggaaggaggaaauauguuccaugcuuuaucgagucuacaugacugcauucuguuggcuaagagaguuuucuaguuuaaugcaagaaagagagauggcucuguuuuuuuagagagagagagagauauauauauauauauauaugaaauauauauauugaagaaccccaagccacacucauuccauggaugcuagcagguuuuaguggaagucaaaccuugcaagcaacccuaugaggacauuucuugccuaagccgagagggggagauauuacucguaauaaacuguacauauccuuauaaugaauccgaccgcugaaaggagaagaaaggggguuagugcaggcaauggguucacacgggcucccugggcacacagcgaggucaugaugcccgaggcuggggugucccuggcuugaaggagugggagagacuggggacaagugaagguccccaguacauucccagacacuggggagacccagggguguaggaugucagucgaguucgggacugcagggcaccuccccuggggcucucucugcaucugccuccuccacagucuacaugggcuacaggggugggggggggcuuguggaauagaggccuuggggacagcauccaauugcugugaccuaaaaucaaaagaggaagaguuaggaaccagccaaagcccagccccagacccacggcucuccccagccucucggucucauggaguacuuguuugaggcuaugggaauagccaagaccaccuccugcccaccuuccucgugacggccuccucucuggugcugaggccagaggaagauggggcuuaggcugcugagggccccccaguaaugcuucuucaggccccaagaccagccugaacuaaauccucaguuaguggcugguggguuccagguauucagauaaagccucugaguguccuucaaggcuugguguugggugggcacucaauacacgugcacaagguggaacccacccucugaaaccauugcccgucaguggagagggaccccucuggugucuacccagaugggagcgcccacucccuuuguggccacaaagaugcaugggccccugaggcucugcguccuccccuggccuguauguccucucacucccagguucacgggucccagugggagcugaguucugcuacucugauguugcugccaauccugucugccaaggguaggccagcccuccuccccacacucucaagagaacugaggcugggaugcuguugguuuucucccuggagccuggcuaaugcauccucaccaucuggagacuucacagugagagacaggagagacucguaggaggagagggcucuucaggacaucucaugguugacgcccucccucauuucccagaaaguccaggguuugggcaggguuggcacccuacguguuuaaucugggguaugcaagggugaugauucuuauaucuucucuccugacugaaccugugagaccccugcuaggaccccaggaguucagugcuccagagucuggggccugaccuagcccguguuccaguuccagggagaggugaguauuguggcuggaggauucggggugacuucuuaccaagcugcggggucauacucggcccagacacgcacguacucauccagguggugggggcccaggauggaggagucucgggugagguacucaaaguuguccaugaugacggcgacaaagagauucagcaucuguggggaccccggggaccaagagagaaugggggcagagaccgagggaaugaaugagugagugagaaggauacagacagacagacggacagacagacccaaagacauguacacagaggcccagauggagagagggauagagagaagauggggaaaggaaaugagacagagacagaaagagacuggggaauggagaggugaugcucacucacacaaggagguccagugagagagagaucaaguggagagauggggaagaggaagagagaaacagagagagauggagagagagagauacaaagagacaaagacuggccgggcacgguggaucacgccuguaaucccagcacuuugggaggccgagguggacagaucacuugaggucaggaguuugagaccagccuggucaacauggugaaacacugucucuacuaaaaauacaaaaauuagcugggugugguggcaugugcaccuguaaucccagcuacuugggagguugaagcugaagaaucgguugaaccugggagguggaggcugcagugagcugaggucucgccacugcacuuuagccugggcaacagagugagacuccauuucaaagaaaaaaaaaaaagagagagagagacaaagaccaagaaugauggaaagaaacagagucagugagagggaggggaggcuucugaaacagggaccaacaccaagagaaccacugugaccccaaauccucccacaucugcccccaacaaggccaaagugagguauuucuucccucgcaauguuuuuuuuuuuuuuguuuguuuuuguuuguuuuugagacaggaucucauucugucgcccuggcuggggugcaguggugugaucauggcucacugcagccucgaccuccaaggcucaagugauccucccaccucagccuccugaguagcugggacugcaggugcacagcaccacgugugcagcuaauucaauuuuuuuuuuuuuuuuuaaagagauggguuucacaccaugcuguccaggcuggucuuguauuccugggcucaagugacccucccaccucagccucccgaaguguugggauuacaggcaucggccacuacgcccagcugaaauauuucauugagucucaaaugggggaauucuggcccccacucccaaccccacccccacccccugggggcaccuggcaauguccggagacauuuuugguugucacaacaggaggaacggguggcgugugcugccagcaucugguggggggaggacagggaugcugccauacacugcagugcacaugauggccccaccccaaagaaucagccacccccaaaugucaacagugcugaguuugagacgcucagggucaccugaucccaggcugguucagagaagccuuggagggaacaagccuucgacacagccacauuccacagaaacccacuccccugaaaggaagccaggcuuagggagcccagacggcccucacaguguccacagacucaccagaaacgagcagaggaagaugaaggaaacaaaguaaaaauaagcaaauucauugccacacucucgagucaggaugccagaguucuuaucacacgguuucccgcugaggcaggaaagcaugauguugugccaagcuuccccgguggcacuccugaggacagggagaaaucagagacucggacacccagcccugacuggguaccaacgccuccccaggagguggagcacacacguugagcacuugggcucuggagcuggccaggcaagccccagguggaccaccuccuuuuacugggagcugagagaagggaauucacauucuuggcugugcacugaaguccacagagagcuuugaaaaaauaccaaugcccgugccccaccccagcagacuuggauucaguuggucuagggugggauuugaggacacugauauguuuuuuucuuuucuuuuccuucucucucucuuucuuuuccuuucuuuucucucucucucucuuuuuuuuuuuugacagggucuugcucuguuacccagguuggaguguaguggcacaaucacugcucacugcagccucaacuucccaggcucaggugauccucccgccucggccuccugaguagcuggggacuacaggcacacgccaccacuccuggcuaauuuuuaaacuauuuuuuuuuguagagaugggguuucacugcauugcucaggcuggucacuguuaugcuuuaaaagcuccccucuuggcugggcgcgguggcucacaccuguaaucccagcacuuugggaggcugagguggguggaucacgaggucaggagauugagaccauccuggcuaacauggugaaacccuaucucuacuaaaaauaccaaaaauuugcucggugugguggcgcucaccuguagucucagcuacuugggaggcugaggcaggaaaaucgcuugaacccaggaggcggagguugcagugagcugagaucgcgccacugcacuccagccugggugacaaagagggagauucugucucaaaaaaaagcaaaaaaaaaaaaaagcucccuucaggccgggugcaguggcucaugccuguaaucccagcacuuuggguggcugaggcggguggaucaccugaggucaggaguuugagaacggccugaccaacauggcaaaaccccgucucuacuaaaaauacaaaaauuagcugggcguggugacgggcaccuauaaucucagcuacucgggaggcugaggcaggagaacugcuugaaccugggaggcagaaguugcgccgagccgagaucgcaccacugcacuccagccugggcaacaagaccgaaacucugucucagauuaaaaaaaaaaaaaagcuccccuccaugaaggugacagucaucucauacuauauucucccuagaucacucuguucuagguaugcugggcuccucacaguccucaaacaugccagccauacuccugccucagggccuuuacacaggcaguccccucggcuuggccugcccuuccccauauacccacugacucccucccuugccaauuucucucaaaugucacacuuucagagaggcauaaccugccggcccucuauucuuuuuuuguuguuagauuaaaaacauuauuauuuuuuacuguggcaaaauacacacagcaugaaguuuaucaauuuaaccauuuugaaguguacaauucaguagcauuaaguaagcucacauuauuaugcaacuaucaccacuaucuaccucuguaacuuuuuuuaaaaauuaaaaaaauauauuuuucuuuuuagagacagagucucgcucuguugccgaggcuggagugcaguggcacaaucauagcuuacuguagccuggaacuccugggcucgagcaauccuccugccucagccucccaaguagcugggacuacagguguguggcacuaugcccaguuaauuaaaaacaauuuuuuuguagagacggggucucacuauguugcccaggcuggucucaaacuccugggcuaaagcgauccucccaccucggccucccaaaaugcuaggauuacaggcacgagucacugcaccuggcccuauuccccuuuauucuugaauuuuaucuuuuuccagcauccucuauaauuuguuuccugauuauucgucuuccccauggggauguuagcuuccaaagugcuuaaaaugucucuuuucucuauuuccuggugcauccucguuuuucagcccugccuggcaugcuguaggugcucaauacaccuccacaagaggagcuugcagugagccgagauggcgccacugcacuccagccugggcaacagagagagacuccaucuaaaaaaaaaaaaaaaaaagggcugggcacgguggcucacgccuguaaucccagcacuuugggaggccgaggcgggcggaucacgaggucaggagaucgagaccauccuggcuaacauggugaaaccccgacucuacuaaaaauacaaaaaaauuaucugggcgugguggcgggcgccuguagucccagcuacucgggaggcugaggcaggagaauggcgugaacccgggaggcggagcuugcagugagccgagaucgcgccacuguacuccagccuggggaacagagcgagacuccaucuccaaaaaaaaaaaaaaaaaaaaaaaaagcccccccaaaaaaccuacacugaacgagugaaggaacuuuugugugcagccaagaugaugaaccaaagaaucaagccucacggucuguaagccuguuuucuuauuugucggauagggcugccaagaaucccuuccucacaggguggucaggaagauucagagauaaugccuggaaaaugaccuugaugacuaugucccagggcccucugcuucugcccugcuaggauuccugggccccccacgacacccauuuccagccucacgggaaaagaaggauaagagcacaucuggccacccccacaccagaaaaggaggaggagggcacgcccccuaucggaagagaaggccggcacguccccuaccggaagagaagggcacgcccccuaccggaaaagaagggugagggcgcgccccugccagaagagaaggaggagggcacgucuugcauuggaagaggaggguacauccucuaugggaacagaaggaugaaggcaggcaccccaccccacggaaacagaauuaucagagcagguccccuucucaccggaagagaagcaugagggccuggaagaagguccggaaguuauugugcucagugauuuggaacucaucuucaucacuguccucguccuccacgucgaugccaauguuaccaaacaccuguggaauuggagggugacgaccaggggcugccauuccuccaguggcuucugggaaacccagcucaaccuccauggcugcuucugugaaccaggcuccucugacccaccccuuucuaaggguggcugcccuccuugggaggcucugggaaccuuagggacacgacacucaccugcaucccaaugauggcauagaugaagaagagcauggcgaucagcagacagacauaaggcagggccuggugggaaaaaaggcaaugaagaagagugcugggggucccucagccgcacugucuuccucccuugucccagugcucugccccacuggguuggguggccauaugccacgugccagaguccuuccagggcuggugggcaucucugggggcucuaggaugaggcccuuacagcucugaagacacaccagggacaggaaguuugacaacagccuuggagauaacagauucucugcacgacuacaucacagaggcacuuccaaucugacuucuacauucagccagagcaugagggucaccugucuucucagcccugggccagcagcagggacgaggacucaccuugaaggacugcacaaagguccagagaagaaugcggaugguguaacccugacggagaaguuugaugagccgggcagcucggaagaggcggagaaagcucagguugaugaaguuauucuggggagauggaggaagaggggugaccauccacccaccccaaaaggcucagagcugucaccacucacagaggccccuacaugaagccaaccaacaggaaaaaagcaagccagaccccaaauaaggagggagagagaaagcacuauuaaugcaaugaugcagaggaaaaacucgaaaaaggaauaauguugggagagagagggugggagggaggaaaaggcaucaacucaaaagcauaagcccucccugccagccccacccacaauggggaaaagaaaagaaaaagaaaggaggaaaaaggaacggggauggggaagaaauaacaaaagaacaagaaaaagaaaauauauccgaaucauccaaucaggaaaaaaaucgagaugguuuuuguuucucccaacaaccaaaugcacugagacgaaaggacacaagccggucaaguugcggaaucuaucauacguguacgaugcacaaacaccagggcggggguggggguggaggucgccagcacagucaggccugguggacaugugcggguuccgagggcauguuacgcuccgggccagaaaugcaucugucacgggacucaccgggcacccugcccugcccugcccugccgagcugcccacccgcuccugcccgcccugaccucaccccacggccaagaggagcagcggcucgagccaauugggagaagcggaagagcaucuuuucuuacccccuuggcgagcgggaauggggaggacgggagggagcugggacuguucggcugcagggugaguccucgcugcccgcugagucggagaagaugcauuuggggcccuuuuccccccucucagggauggcuucucagcuucuggggcuggguggaguagcacgggaccaggccugcaggaagcaggaagcacucagcucccaugggugggugagcucagaaaucagcccgggcccaccaaggggcgggugcugggggccgggagguggggccaucccugcccccaggaccucccuggguggccacugccucugcucaaaaacccccugucuagucacugccucugccuccucccacccaagcuagaagaaccagggggccagagaguuggagagucagggaggagaccagcuagaguuaaguggccauuguggggcuucaagggaccuugguggggggggugggacucucgaagucacgagugggccaaaucuagcuaauaaaacuguuuuguugggcccgagcaguguuuuuucauuuguccuuguuuuuaauuaaaaauuauugccauuguuuaaaaaucaagagauuuugcccaccaaucuggcuuucuggcaaccccaggccugcugcgauugcucccuggaagcaggccacaugaucuccaguuuuccaggguccucacguuuuagaaauggcacuugcuuuccugguugacuggugucugccuggcccccagaggcauuugaguuugagaccccagccucaggcagacauggaaacccuccuucgcuggccaguacccagcagggugaaggcaggaggaguagagggucucuccacacuaagggaaggggcuuaaucagacuuguucuaugggauuuguaggauuugcuacaggccacguagcaagauuuaacuuggucuaaccuucaccccccaaauggcacagggugaccauacagucacagccucccuccuguuucaaaaguguccuaguuugggugacaugggcauccuacuugguggcuuccagagggcuuucuggcugccagaucugugucuugugcuggcuuuggccugggagcugagaggcaaggacuggaguucaaggaauuucugaggccucuggguuugauggcaaugucuaggaugcucucugggacacaucagugcguccuuaggccucuaggauggggaagggggcugggggauccuacccugaccacacugggcucaagugcugugagaaugucuccagugccucgaacaagccccaaacccagcuuggcuaacagagucacucucugugcccugcugcccugacccccaucccugccuggccacccagcuccaccuggggauggggccgauggcucagguauccccagcccccucccguucaaccccagaguacaagccaucccuuucauggggcggaucauaacauguggacucggccaggcaugcgaaggcaggcggacccuggaagcagccucaggagggggguuuggaggagagcaggggaagcuugcaaccaugcaaaaaagccagggaucuggcagggagaugcgugcagaaaacaugcuucccuucuuggagccaagugggggaggagacacaugaggcagguagggguggagacgggaaggguuuggggcagugggggaaggguacuagucugcccucauccacccuccaucucuuccugcaucaguaccaauucuuuccacugcccccagaacuucugacaaguucccucuuccugccuuccacauuucaauccauggcuugggaggugcagcuuccucucuucaacaccuccccugaacuuccuggcuagaaugugaugggggugggacacagccccuggaagacaugaggacagcguccuuguggucuuuucuuuuccagugcugugcucagauguuccucaagugcucagaaggauauggagaccacccaccuaagggcuccagaaaaguccuacuacuuguagaccucagcuccaagcugcagcccccacaacaccugccuaucugacuuauuucgggauguccuaaaggcaccucaaacuugcuaugcccacaccuauucucuucccccaaccugguccuuuccuugcacucgcucaccucuaucacccaguauuuuuuuuuuaagagagucucacucuguugcccaggcuggagugcaauggcacgaccucggcucacugcaaccuccaccucccagguuuaagugauucuccugucucggccuccugaggaucugggauuacaggcaccugccaccacgccuggcuaauuuuuguauuuuuuaggagagaugggguuucaccauguuggucaggcuggucucgaacuccugaccucaggugaucuuccugccucagccucccaaagugcugggauuagaggcuugagucaccgugcucagccuaucucccaguuuuaagccagacccgacugcucccaggcaccucaucucaguucagaccugaucuuucccuggguccugcagaggacaacccucccacuguucucucuccuccacugucaucucuugcugcgauuccuggugcccaccuccagcccagccuccugucaagcuguucccugcccugcaaccagagcgagcuugucuagucacaugaccagucgcgccuccccugcuuccuauccucccaggcccuuccuggugcuuaggagaaagcccauauuccacaauauagccccgcccuccccagccccggguccuguccccuucugccuucuucggcugucuccaggccagccuuucucggcugucuuugcaucagccacauucccucgcuugcagauccugaccccucacagguuccgucccaccacagggccuuugcaugugcuguccugggccuggaaugcucugugcaucucucucugccuuguuaaugcugcucauccuucagcucgcagugcagguauaauuuuaaguggagucaagggguuauuugaccgaugccugccucccccaccugacuguaugugguaagaggggacaguaauggugucugcuucugcccauaauuccaucuguggcaccaaauaggggcucauuaaauguuuggugggugaaugcauguguauugccagcagggaagggaugauuccagggcaaagaugccauuggggcgucccucuaagggccucauugguggguaggagaggggcagaggcaguugagauuuaacagaacaaggggugugcaaggggcugagaagugggggagggagagagaugugugcaguauguacuggaguggggguacaggguggguagauguagcagagagggccagugugugugugugugcaugcgugcaugcaugcaugacuguaugugagagacacagagacaggaacagugaaugaggauuagaggccagguguaguggcucacaccuguaaucccaacacuuugggaggcugaggcgggugcaucacuugaggucaggaguucgagaccagccuggccaacauggugaaacccugucucuacuaaaaauacaagaaguggccuggcguggugguacaugcuuguaaucccagguacucaggaggcugaggcaucauaauugcuugaaacggggaggcagagguugcaguuagcugacauugugccacugcacgccagccugggugacagagcgagacucugucuaaaaaaaaaaaaaaaaaagagcgagagagagagagaauuggagaaugagugagaaaaagagaagaggucaugacuaugugcagugucuguacaugcagugacuguguguucagugugugggugcauagacugugugugcagugacuguguguguauagcgacuguguguucaaugugugaaugcagacugugugugcaugcauaguggcucugugugcagugacugugugugcagugugugugcauagugacugugugcagugacuguguuugcauagugacagugugugcaguguaugugugcacagugacugugcaguguguguccauagugacuacaugcagugccaguguguguacauagugacugugcacagugugugugcauaguggugugugcagugugugcauagugacuguguguccaguuucugcgugcagugacugugugugcgcagugauugugugugugcagugugugugcagugucugcgcagugacuguguguguggauagugacugugugugcagugucugugugcagugacugugugugcauagugacugugugcagugacugcagugacugcgugcagcgucugugugcagugacugugugcacagugugugcgcagugacugagugugugcacagugacugugugugcagugucugugugcagugacugugugacugcgugugcacguacaguucaaggcuccaggagagggccucagugggccagccccacaugaagcuaccagauccaagucuggcacuucugaguuccucugccugagagucuuugccggcacacugccuggccuucaggucuccuuuaucagacuuggagagucaagucucugcuggucaaggccaaagaucuugugggcuugagauggaggauuggggacagcaggauggagagagcuggaggggcgaggagacaguuggcagcuuuccuggggccugggguccauggagcugaaugggggacaggaguggugagagguggcugggaguggauuugccucuauugucucugaguguaggggaugugugugcgggauggggcaagagagaggugcugcgcugggaaaacccaucccuuucucugcaaaagacgcaaaccaccccaaacagaaaacccccauucagaacccgauaaaaacagagagacagagucuacaggaagugggaggcacaggggcugggggcgggaggacagacagacagaggagagcggaggguugaggagagcgucaggcaucccacguuggagaggcaggguguggcaugcaaugccgacgcgaggagaugcguucacaguuaauguaaggcauuuagacuucagaaagaaguaagaccaaccggauucuagaugcagauguugaagaugagggggagcgggcgggcgggggcaguuggggaggcguguucagcauuuuuuagguugauuuguaaccagugccaaaaaaccaauggguuucgguucccgggcggggaguggggguggugguggcgguggguugggagauaagucauugguguaugaacacacagaccaugucauggaugaacaaaugaauuucauagugcauuuugauuggaugaguuuuucagacggcguugcgccaauauacaguuuuaagagcaggcaugaaaagagacaagacaagaaacacagucauuauccauugcacacagggcaaacccacaucaccccagccacuugggggcagcagcugagacagcacugguuaguacugccgcaugcccucugcccccuaaaccccagggaccugcccgcccaagcaucuggcauuuccugucucagccuggccaagcccuggccucagaacuagugggcuuaccugggaggcagaaaggggcaacugagaccuccuugccugccaggacaugccucucccuacuccagguugggaguuaauugucccagaaggacccaaacacccacccccuaucuuucccucaaauugacuguaacucagggcuggcuaacaaaacuacacacccauucacaauaacaauaacaacagcaguaauaguuaacaaccaccauuuucaaacuccugguuuccuggcagguucugugccaagcacuucacguuucuuucuuucuuuuucuuccuuuucuuuuugagacagaguuucacucugucgcccaggcuggagggcaguggcacaaucuuggcuuacuacaaccucucgccuccugagaaucaagugauucucuugccucagccuccugaguagcugggauuacaggcaccugccaccgugcccggcuaauuuuuguauuuuuaguagggacagaguuucaccauguuggccaggcuggucucgaacuccugaccucaagugauccaccugccuuggucucccaaagugcugagauuacaggcgugagccaccaugcccggccuguugaugcuuuuacuuguaaaaaguucccgucucucuccuuagaaugucagcucuaugggagcagacacucuguauucuuggucuguuuuguuuggcaccccuccuucucguucugucuccagcacuuauaaucacaccaggcacacaguaggugcucaaugaaugucuuuugagugcaugcaucacugugagucuugcaagugucugagguugguugcaaugguuagccccacucuacaugagaagagauagcgcaaguuguccaagaucaaacagcugguagggagggcugggggcuguuuggcuacugcaaggguccugaugucccaugaacaccccaugccccaucuuccugccagccaggagaacaggcuguuggagucugucccuacagcucucuuacuggugauugaagguuucagcuaacuuccuccaccccaccugcccuucuggggagcuggaccauccuucuaaccucuugacccaaagggacauugguucaaggcugucuuguauguagccggauggcaagauauuuugauugccagcuggagcuccagcccucucuagaaacucaggacaggggagaaugaccaggugggggcaccccaguggagagagcccccaugugggcaagaacccucuagaggaagguuucagggauagggugaggggaaggggaaaauucuggcucacuggagcugaaggcaaauaaguguguaucacuugggugcgggugccguaggacauaucaaagaauggcccccucuuuuguguaguuccccagccccuccuggccuucuaggacggaagagcaggcaaacagauccuuuucuguagggggaucugacugggacaccccaggagcugucaguguacucucaggagucacccaggccuggcuuugugaccuugggagugucucucacuuccccaggcauugaagaucaguuuucuuucuuucuuuuuuuuuuugagauggaguuuucgcucuugucacccaggcuggagugcaaugguaugaccgucgcucacugcaaccuccgccuuccggguucaagcaauuuuccugccucagccucccgaguagcugggauuacaggcaugcaccaccacaccuggcuaauuuuuuuguauugucaguagagaugggguuucaccauguuggccaggcuggucuugaacuccuggccucaggugauccgccggcuucggccucccaaagugcugggauuacaggcaugagccaccgugcccagcugaggucaguuuucccaucugugaaaugaggcaacacccucuuccucaggcccgaccacacccagaucuauucuccugacuucccugccugcucugagcaucauauucagcuugcuuccgguuuacuuugggccaugggaggcucuggcaggagauaagggaugaggggagagaaagguugggguguuucuccccuauugcucucugccugcuugggcccuggucucugucucuccacauugacaggacagcucccacuugguggcuucuccuggccuccggcucagguucccuccccacuucagcaccugggcaggugacagcuccccacgguggguggucgcuggacaccuugccacccuuguggguacccuucccuuccccuccaccagugaggucugcauuugggugccuucaguugaacccuccgagggaauucucuuacgagcugagaccaagaccucuacccugagccaauccacguaaaccacuuggcacaguucccuggcacacagcaaggcugcgauucucgugagcuauuguuauuuuuauuguuaguaagaugacauugguaucacccuugacccuuggcuuugacacccuuuuuugaccauugcuucccccugcaaggaucuucuacccuccccccaaucuccugagggaccccaagccugggcucauuggcagauggccaaggagagggucuaggacaggaccucuggggcccugagucuuccagaaaaggagaagggcaauguggccuguggggccaccacagagagguccagagacucccauguugagagucucccaggcccggggcuagaggagggaagacacccuggggaccccucuauggcccugggagugguguccccacacuggccugagggcuguggcucucuccugcccacuaacuaggagaggguugguucaaacagaauugacuugaaacccauucuuucugggcuccugacauagggugguguuugggagccggcucagcuuucagagcuuuugagugucucaguucccucaguguacucaucugcauuauuaauuccuaggccaggaugcaggaaagcccaccccucagugcuggcccuacagccaagcuuugguuacccccaucuccccacaaugcccuccugaggggcugcccuuguccccggggccccaguucucccucucuggucauggccaagugcuggcucaagcagcuauggcuuccgggacacacugccucugggaccgcucccccgcccccugccgccugccucguccagcccagagucacccagagagaagcuggagggagacuuaccccaaacucagucacgaggauaucggugaugcugcccagaacagucacaaagucgaagauguuccaggcaucgcggaaauaauucuagaauggggacccacaagacagagaugccaacagagggcuugguucccggcccccuaggcuggccgggugcauguuagaggcacaguugcccaucagcggagugcccgggacaguuaugguuguucgaagggcugcgguaaaggcuguucgacaucaucugugcugagucucccucccugggaacuccugggggccuucccaugauuggccuggccccagagggggccuccagacccugcuucagcuccacagggcuggggcugcucuucagagcuguggccugucucuccagcauuuuugagggcucccgagaccccaggggcuuuauaaaugacaucacugagcuccucaugaagauccuggagggaaggguuaucacccauuuucuuuuucuuucuuucucuuuuuuuuuuuuuuuuuugagauggagucucgcucagucauccaggcuggagugcaguggcacgaucucggcucacuguaaccucugccuccuggguucaagcgauucuccugccucagccucccaaguagguaggaccacaggugcaugccaccacacccagcuaauuuuuguauuuuuaguagagacgggguuucaccauguuggucaggcuggucucgaacuucugaccucaagugaucugcucacuuuggccuuccaaaguguugggauuauaggcgugagccaccacucccagguauacccauuuucuaggagguaaccaagccacucaucugccugaggcuagcagcacagagauguaaagccaggauuugaacccaggccucagagagcccacagucuguguucagguccccacuagguuggcagcauacucgcaaagaaaggagacucuggguucaaaucccagcucugcuaccacagcuguguggcuaugggcaaguggcuuaaccucucugggccuccauuuccugaucuggaggcggacaguaacagggugcagaacaggcacuggacggggcuuuggggccuuucaggcacacgcacuuccugguccccuuguguuuagauggggccaugugugucuaggugcagugaugugcuguguguggaagcaguguggucacuuucuggucaguguuggacucucuagccucucaacccugggcuuggcgaccaguaacauuuugaauggcagcuacucugugagccugggucccuggguaacuaugaggcaaacagcuucccugcugaauguaaaaaacccuucccaucaauuuaagucacugagaugugggggcuguuuguuacugcagcuucacuugaucuauccugacugcugcauuccugggcugggugcuggcucaaggggaaacacaagcauaaccucucuguuuguuuuuuuuuuuugagacagagucucacucugucgcccaggcuggagugcaguggcacguucucggcucacuacaagcucugccucccggguucacaccauucuccugcuucagucuccugaguagcugggacuacaggcgcccaccaccacgccuggcuaauuuuuuguauuuuuuaguagagacgggguuucaccauguuagccaggaugaucuugaucuccugacguugugauccauccgccucggccucccaaagugcugggauuacaggcgugagccaccacgccuggccucucuuuuguuaaaauauggaaauacuccacauuguuuggagaacagucacagccucaagucccacaaggucuccugcuaucucugacuccccucaaccggguacugacauggugauggguggcaccccaguuuggauccaagagucugggucaaagagauggcccuccccucuggggucagugggacccaaaacacaaaacacagggccuucucagcaucuucgcagaagcagaggccaggucagggguuggggcggucagugugacccugaaguagccccucuaccuuacagagaaggagccugaccuuagagcugugcuucccuccuaggcgaagugccuggggccucugcgcccuucucuggaaggcagugguaacacagcaaucagacaaugaaugugcgucgcugagcauggaauauacaguaggugcccaacagaugggauguuguuguuucacaacugccuaaaaaaggaauucagggggccgggcgcgguggcucacgccugcaaucccagcacuuugggaggccgaugugggcggaucacgaggucaggagaucaagaccauccuggauaacauggugaauccccaucucuacuaaaaauacacgcacacaaaaaucaggcaggcgugguggugcgcgccuguagucccagcuacuccggaggcugaggcaggagaauggcgugaaccugggaggcagagcuugcagugagcagagauugcaccacugcacuccagccugggccacagagcgagacuccgucaaaaauaaauaaauaaaaauaaauaaauaaauaaauaaauaaauaaaaaggaauucaggucccacuggcacuuuuggcauuuuggcagguguugcuggggcccugcccauagcucaacuacacaccugagguacacuacuuugcccagggucucucuguggcugcacaaguguuagggaauuaauagcuccccugggaguggccugugauuaugucugaugggcacuggaggauaaauacuccaauucccucccugugaggugggaugacucugugguaugugcucucuguugccuccuggagguauccacugaaacugagccccauuuguucacagcaggaacuggcuuaauaauacacucuuuccugguugccuuucugucccugugucacuuccucucucccuuacugcccugcaucccagauaaauuccuugcacucaauccuugucucaggcucugcuucugggggaguccaaacaaagacaacuuuauaggcguuuggucacagaccucaaccccuaggcuagagagcuccccucuaucucccaaauguuauacagggaacuuguggcuucauuuaaaacugaaaggggagaccaggcgugguggcucaugccuauaauuccagcacuuugggaggccaaggagggagaacugcuugaggccacgaguucaagaacaggcugggcaacagaguaagaucccaucucaaaaaaaaaaaaaaaaaaaaaaaagagaaagcagaggggaagcucagugcuggcucuugcaggauuggcagggugagggagaugcagcuccaggccccaguggaagacucacuucaccagcagaagaucaacucagaauaaaauaacugcaggcuagguacgguggcucaugccuauaaucccagcacuuugggaggccgaggcaggcggaucaccugaggucaggaguuggagaccaaccuggcugacguggugaauccccgucucugcuaaaaauacaaaaauuagccgggcgugauggugggcgccuguaaucccaacuagucgggaggcugaggcaggacaauugcuugaacccgggaagcagagguugcagugagccaagauugcaccacugcacuccagccugggcaacagagugagaauccaucucaaaaaaaaaaaaauaauaauaaauuacagauucagugauucccucccaccucaccaaaccaaaugaaucagaacaucuagggguuugcucaggguaucauuuaauuuuaagaaauuucccuaagugcuucuuuuuugauuuuuagaguccgggucuuguguuguugcucaggcuggagggcagugaugugaucgcagcucacugcagccuugaacuccugagcucaaguaauccuccugccuucgccuaaguaguuaggacaacagucaugugccacuaugcuggcuaauuuuucaauguuuucuagagaugaggucuugcuauguugcccaggcuggucugaaacgccuggguucaagcaauucuucugccuuggcagaagucccaaagugcugggacuacaggcaugagccaccacaccuggccucaagugcuucuaauaaguagcaucuccaccaaaugaaagccacuguuuuggaggaaaaagguccauuaguaggaucccuuuccuagcauuuauuuauuuauuuugauacagggucuugcucugucacccaggguggggugcagcggcucaaucacgacucacugcagcccugacauccugggcugaauccauccucucaccucagccuccuaaguagaugggacugcaggugcacgccaccacaccaggcuaauuuuguacuuuuuguagagacagaaucucacuauguuguccagguuggucucagacuccugggcucaagcgauccaccugccucagccucccaaagugcugcgauuacaggugucagccaccgugccuggccccuagcauuuauugagugcccaugccaggccaggcuucauccucaacccucuagaugcacguuaguccauuugcuguuuaccagggcucugcugagguggagggggaggauggcuccuuuuaaugauggggaggugacaaagcuuauauaggacgaggcaagaucugaacucuggugcuaaagcugaugccccuaaccaccuccgugagccaaggugggaaccugguuuccugagacccuggcugagacccagacuguaggucacucucuucaaagggauggacuaagcugguggucaagagaacagauguccugguucaagucccaccuuggccacucacuggggaccuucaagaauucacuucacuucaagucccagcccacuaguauaagccuucuucaccuuaauuuuuuuuuuuuuuugagacaaagucucacucugucacccaggcuggagugcacuggugccaucuuggcucacugcaaccuccgccucacagguucaagcgaugcuugggccucagccucacgaguagcugggauuacaggcacacgccaccaugccuggcuaauuuuuguauuuuuaguagagacgggguuucaccauguuguccaggcuggucuugaacuccugaccucaagggaucugcccuccucaagcucccaaacugccgggauuacaggugugagccaucacacucagcccccaauuuuuuaaaaaauaauuuuaauuuaauuuaauuuaauuuauuuauuuauugagauggagucucacucugucacccaggcuggagugcaguggcaagaucucggcucacugcaaccuccgccucccacguucaaaugauucuccugccucagccucccgaguagcugagacuacaggcaugcgccaccacacccagcuaauuuuuguacuuuuuaguagagaugggguuucaccauguuggcaaggguggucuggaucucuugaccucaugauccacccaccucugucucccaaaguguugggauuacaggugugagccaccgcacucagccaacuauacuuuugugugugugcuaugaaccuuggccaugugagaauagugcuggcuauuuuauuuuaugcauaaaggcuuguaaaugcauaacaaaauagcaagggcuucaagguuaccuuuuguaauaaaauagcuaucaaaauauuuuuuaaggcuaggcacagugucucaugccuguaaucccagcauuuugggaggcugaagcaggcagauugcuugaugccaggaguucgagaccagccuggccaacauggugaaaccccgucucuacuaaaaauauaaaaauuagccuggcaugcuggugugcaucuguagucccagcuacucagaaggcugagaugggagaaucgcuugaacccaggagguggagguuucagugagccaagauugugccacgguacuccagcuugggcaacagagcaagacugugucucaaaaaaaaaaaaaaaguuuuaaaaauggcgaucuaacaaugaauauacuucuccauuaacacacugaguaggccgggugcgguggcucccgccuguaaucccagcacuuugggaggccgaggcgggcggaucaugaggucaggaaaucaagaccauccuggccaacauggugaaaccccaucucuacuaaaaauacaaacaauuagccaggugugguggcaggcaccuguagucccagcuacucgggaggcugaggcaggagaauggcgugaacccaggggguggagcuuucagugagccgagauugcgccacugcacuccagccugggcaacagcgagacugucucaaacaaaacaaaacagaacaacaacaaaaaaacacugaguaacaaauucuagcuguagguuuaaucacaagcaacauuuuaaagcaaugaugaaugcaaauuaaauguuaagguaucugcagcucuuauaaugcaguaugaaaauaucugauguuuauaagugacacaggucauguugauaauauuaaggguugauaauacuaauacuaaggguuuguuaucucccuuuaagauggaaggaaauguuaaaauuuaguuaguggcuggugaaaaauaaagacauauuuauuuuuauuauuauuauuuuuuugagacuugcucuguugcucaggcuggagugcaguggugugaucucagcucacuguaaccuccacuuuguggguucaagcgauucuccugccucagccuccugaguagcugggaucaugggcacccacaagcacgccaggcuaauuuuuuguaguuuuaguagagaugggguuuugccauguuggccaggguggucucgaacuccuaggcucaagugauuugccugccucugccucccaaagugcugggauuacaggugugagucacugugccugaccucuguguuuguuuuuuaaagauggagucuugcuguugcccaggcuggggugcaguggcaugaucauagcucacugcaaccuccaccuccugggcucaaaauaucuucccaccucagccuccugaguaacuggcacuacaggcacgaguuaccaugccuggcuaauuaaaaaaaaauuuuuuuuuuuuuuguagggacaggggcuugcuuugcugcccaggcugguugagaacuccuagcuucaagcgauccuccugccuuggccuccugaagugcuaggauuacaggcaugagccacugugcucagccugauuucaguuuucuuucuuucuuucuuuuuuuugagacagaguuucacucuuguugcccaggcuggagugcagugaugugaucucggcucaccacaaccucugccucccagguucaagcgauucuccugccucagccucccgaguagcugggauuacaggcaugcgccaccacacccggcuaauuuuguauuuuuaguagagacagaguuucuccauguuggucaggcuggucucgaacucccgaccucaggugauccgcccaccuuggccucccaaagugcuggaauuacagccaugagacaccucgcccagccugauuucaguuuucuuaucucuaaaauggaugcuaaagacucccagccaugaugacucccaucauuuugaggaacuggauacauaagcagccauaugguaacacucacagguugggucucccugggacuccuuggcaaacacaagaaugccuaaguaggaucuguggccacuggcaggauacugaagccacccuugagguugggguucuuggggccacguugggagaccaucauccaggacccauuguucccccuugggcuucucccaagcccauagcuguagccccaaggugguacuuaccagaaucccaaaagccaugacuuucagcacacauuccagagagaagagggaggugaagacgauguugaacacccgcagggcauuuucauaagcaacagaagccccauagaacuaggggaaagaagcaggaguagcaggggucagcgagcaggggugggaagugggaaguggggaggcagcuucauggcuguucuccaggcaacacuccagccccaggcaaggucugagcaaccucacugguaggaggcacaguucaggaaagccccgcucuccgccggacuaggcucuucuuuucacauccaaaaaaacaaaaaccucccccaaccuuuuuuuuuuuuuuuugguagacggggucuuccuauuuugcccaggcugggcuugaacucacaauccuaccuuagccuccugauagucgggacuauaggcauacgccauugugcuuggcugaauuauacuuuuuuuuuuuuuuuuuuuuugaggagucucacucugucacccgggcuggagugcaguggcgcgaucucggcucacugcaagcuccaccuccuggguucaugccauuccccugccucagccucccaaguagcugggacuacaggugcccaccaccaugcccagcuaacuuuuuguauuuuuaguagagacagcguuucaccguguuagccaggauggucuugaucuccuaaccuugugaucgcccuccucggccucccaaagugcugggauuacaggcgugagccaccguccccggcuuccuuauuuuuuuugagacggagucucacucuguuacccaggcuggagugcaguggugugaucucagcucacugcaacuuccgcccccuggguucaagcgauucucaugccucagccucucacgcagcugguauuauaggcaugcgccaccacgcccagcuaauuuuuguauuuuuaguagagacgggauuucaccauguuggccaguuggucccgaacaccuggccucaagugauccgccugccucgaccucccaaagugcugggauuacaggugugagccaccuugcccggccacuauugaucguuuuugaagugccgagaaggagcuaagguccuugcaugaacuuucucauucaauccucucaccuccucuggagggggcaaaugugcucuuauuaucauucccauuuuauugacagggaaacugaguccccagaaagucacugguugcuuguacaaagguaaaugaauuaaauggaagagcugggcuugaauccacgcuuuggaguccaaagcacagggugaaagguuuucagaguuuuuuuuuggaagccgcuccuuagcccuggggauuuuaggguccucaccuaccccuucucccucauuucuuucuuuuucuuuucuuuuuuuuuuugagauggagucuugcucuuguugcccaggcuagagugcaauugcgcuaucucggcucauggcaaccuccgccucccggguucaagcaauucuccugccucagccucccgaguagcugggauuacagaugcgcaccaccacgccuggcuaauuuuguauuuuuaguagagaugcgguuucuccguguuggucaggcuggucucgaacucgugaccucaggugauccgcccgccucggccucccaaaguucugggauuacaggcaugagccaccgcgcccagcccccucauuucauuaaucaaacauuuauagagagcuucuuguuccgucugagccagauccuuguuggccucuaggaauucagggcugaggucaucauaaaugggugggggacacugucaugcaaccugacgcagauuuuuguggcaggcgacauaaagauaggaugccugcuaagaugggcaccucaagcagucuuggguggucagggaaggcuuucuggaggaagaggucugcagguacagcugggaagaagaagcuggccgggggaguggugggaacagugugucagguagagggaacagcaggaacaaaaucucagaggugauccagaguguggucugucugggaaacugcagaugguuucauuuuaucaggguagaggcaggaacgagguggggguuaaguagugcugggggcugguguggggcacuuaccuucaucauaagcacgaugguguugagggcgaucauggccaugaucguguacucgaaaggcggagacaccacgaacugccacaugcgguacuggaagcucugcuuguucugcggcaugugucgggucagcggcuuggcgcugauggcgaaaucaaugcaggcccucugcgggagagaggccaguggugagagcggcagaggcaggaggaagguggcuguacaccgggcacccucugucuaacucgucgcgguucucaagugcuucugcuugagucucugccucucuugcccccagccaggauuccugggcucucucuuccuucucaccauugcuuucuuaucccaacagcuacaguugcuugagaugucaccaacugccaaaacuugcacugacauuuccccauuauugcauggcuaauacaaacaugggaaguggguacuaucaauggccucacuuugcagaucaccaaaauagaggcuuagaaagguuaaaccacuugccugaggugacacagcuaccgagugugccaaaucaaauugaagccuaauccuucuuccccuuccucccucccucgcucccucccuccuuccuuccuuccucccuccuuccuucccucccucccuccuucucucccucccuccuucccucccucccuccuucccucccuccuucccucccuccuuuccuuccuuccucccucccuccuucacuuuccuuuuuccuuccuucccuucauuccuuccacccuuuccccuuucuccuuuccuuucucucuucuuccuucuuuccuucgcucccuuucuuucuucuucauuccuucuucccuaucuccuuccuucccucccuccuuucuuucucucucucauuuccuuccuucccucccucccucccuccuuccuuuuuuuuuuuuuuucuuugacacgggcuugcuuugucacccaggcuggagugcagugcaaucacagcucacugcagccuugaccuccuggacucaagugauccucccgcuucagccuccugaguagcugggacuacaggcgugcaccaccacacccagcuaauuaaaacuuuuuuuuuuuaaucauagagauggggucucacuauguugcucaggcuggucuugaacuuccgggcucaagcaauccuccugccuuggccuccuaaaguguuaagauuacaggcgugagccacugcgcccagcccauucuuucuuacugaauacuuugcugcgucuucuccuucucuuugagggagagagaaggaggaauagugguuauuaagucuuaagggucaagggagcagaggauauauucuagguccucuauuuagcuuggaugaugccagagaggcaaagagucaugucuauacucucugguagacaggggacuggauuuucuuuccuuuucuuuuuuugagagagggucuugcucuguugcccaggcuguagugcaguggcauaaugauagcucacugcagccucgaacucccaagcucaagcauccucccaccucagccucccauguuacuggggcuaaaggugugcaccauccugccuggcuaauuuuuuugauuuguaguagagauggggucuugcuauguuggccaggcuggucucaaacuccugagcucaagugauccuccugccucagcuucccaaaauguugggauuacaggugugagccaccacaccuggcuuggcuuuucauucauaaauauucaccacccuucgcuaggggagauuguauuugcccacuccacugaugucagaauggaugugugacuugcuuuggcugaugaaaugugagcagaagugacauguguaauuuuugagcacaagccugaagaacugaaccucagucugacauacucucuuuuucaucuggagcaucucagagggaggcugcucugcugcucugccagccugggaaccagaauaaagauggcaagauccacaacugauguugacaugcagugugagcaaaaaauaagucccuuuguggauauuuggcaaugaaaucugggguugcuuguuacugcggcauaaccuagucuaaacugacugauacauacacuauaugauguguuuccucuggaaacuccaugaagggcugcccugaagacuggauucgguugggacaaugcuucuguucccucccccagguaccccuagaaagggguuccuggguguuguguguguuuuaaaguuuguguguguccccaguuuuuaaaggacagauggaauuggaaguggcaccucauuuuucuccaggcuguauuccuccaucaucuuguccccuugcuccuggaaggugaugaugaucaaggccacaaagauauugacaaagaagaaggggaacaccacaaaguagacgacguagaaaauggacaucuccaugcgguacccggggcuggggcccugguucucaaagguggcguccaccgaaugcuugaggacccugcaaggaauggggcagggagagggaaggggcaggaaggagagagacagggacccaaggggugaugaggaagguggagagaggguggaagugagauggcagaacaggaacagagggaaaugaaaaagaaauuuaaguagucgcuguuuuuugaaaggcugacaacaaugucaguuauuucuuaauuuuaauuuuaauuuuuugagauggaguuucgcucucguugcccaggcuggagugcaacggcgugaucuugggucacuacaaccuccgccucccggguucaaaugauucuccugccucagccucccaaguagcugggauuacagacaugcgccaccaagccuggcuaauuuuuuuguauuuuuaguagagacgggguuucaccauguuggccaggcuggucuugaacuccugaccucaggugauccaccugccucggucucccaaacuguugagauuacaggugugagccaccacgccuggccaaugucagucauuucuacugcugugcaugaagggcuugcugugugcuggaaacaauauucaacaauucauccccaccggcucagcaacccucccagggagguuauuacuggcuccacuuugcacaugaggaacuugagguucagcaauuuaaagggacgugcugaagaccacccacuuauaaguggccaaguugggauuuaaagacagguuguggcaauggagggaguagagguggguguaugcauguagaguggguauuugagcacagguggugcugggugcucaggagguacaauggggauauauaugagaguggguaagugcacagcagcucuguacaguagugcagguugcacacugcucaaaggcucugugucuaagcgauaccuucacaugauaggcaugauagauuuguguauucaugaugacaauuuuuuggcaggugguccuucagugccuuguuugaacaaaaucauuuaagucuauugcgaugauuuucagacagauggaaaugaagucuguugagaaagguguuuaaaaaaacuuugcucaaaggugccuuguggguuagcauuauucccacaugugugaguacuggaugugucugagaguggguaguagggcauguucagguuggcauauuugcugagagagggagggaggugaggaugcugagggcacaugcuggaaucuaccaagcuuccagccuggcauuuccaagaccucugagagaaagaccauuacuuggacgaggugagggagggaggcauuuguuuugggugcaaauuaaggggguacugaaaaucucaguaaucaagauaaucuuuugcuccaauauuuuaaaaaaucaaaauuaaugcaaaaaguccaugaugaacaaauaucaauuucuucuucuuuuuuuuuuucagggauaggggucuccuucuguugucuaggcuggaguacaauggcauaaucacagcucacugcagccuugaacucuugggcucaagcgauccucccaccucagccuccugaguagcugggauaacagguaugagccaccacaaguggcucaaaauuuuaaauaaagacuaaguccaugauucagccucacuuuuuuuuuuuuuugaaggcggggaggccauagucuugcucugucacucaggaugaagugcaguggugcaaucucggcucacugcaaccucugccuccuggguucaagugauucucgugucucagccuccugaguagccgggaccacaggugugagccaccaugccuggcagcuuuuuuuuuuuuuuuuuuuuuuuuuuuuuugggauuuuuaguagaaauggaguuuugccaugauggccaggcugaucucaaacuccuggccucaagugauacaucugccuuggccuccuaaaguguugggauuacaggcgugagccaccaugcccggccuccaagaccuuucuuauugcuaagcucucaggcccuuuauccuccugcuccccagggcuccuccuggauagauuuccagucgggccacuuacuguggccagccuucucccguggacacggugaagagggucagcagagcccacagcacauugucguaauggaauucauacuucuuccacucccggucucgcgccuucaccucauucuucucguagaggagguauuugccucugccacagagaguggggacuguuaguaaaugggaaagaggggcugucuugcacuugucuuugguuaucagagacagggggagggaaaggaagagugguccaccagccuagacugcuugggaagcagugacuccccauccugccaccauguguuccugugcuucauaggggaugacgugugcaucuacuuugagauaaauccaugggugauggcacaaccuuacuccuggugggagagcugacccaggguccagcacccucuuccaacgugauaacuucuaguccucagggugagagccucaggcuugcugggggugggguggagggaguuuaggaggaggcagagagacauaggggacauuuagagguucaucaggcuaagggagguugcuacuccuuuucaaggcaggaaacaaggguuaguuccagacuccuauccagacaucuggcauccuccuaauuucaauaaauagccaucaagauaacaacaggcuaccauguguugcaaaaugccacuuuacacugguaacaauaucacuauauauacacauacauauauauacacacacacauauaauacauaugugugugugcguguacauauauauauauacauauauauauauauauauuuuuguuguuguuguuuguuuguuuguuuguuugagauggagucuggcucuguugcccagacuggaguacaguggcccaaucugggcucacugcaagcuccgccucccggguucacgccauucuccugucucagccucccaaguagcugggacuacaggcgucugccaccaugcccagcuagguuuuuguauuuuuaguagagacaggguuucaccguguuagccaggauggucucgaucuccugaccucaugauccgcccgccucggccuccuaaagugcugagauuauaagcaugagccacugcgcccggccuauauguauauauuuuugagaggcagggucucacucugucacgcaggcuggagugcagugguaccaucauagugcauugcagccuugaacuccuguguuuaaacaauccucccgccucagccucccggguagcugggacuacaggugugugcuaccaugccccgcuaacuuuuaaaauuuauuuuguaggaugggcucucauuauguugcccaaccuggucuccaacuccuggccucaagugauccucccaccucagccucccaaaguguuggaauuacaggugugagccacugcaccuggccucuuaccuaacuuauuugguaaugaaaccugaucugauuggacaugaagcucuuuauacuuguuauuuaccccauuugauguaaauaguuacacauuuuauggcagaaauauuguguuugauuauagggcugccuuagacccagcugagggugucaugucccacaugggaaucucaaaauauucucaacuuugaaacacaucugccuguaacgauuucaaguaaggaacuguggauguguauuaauaucccucacaugacaaaggcgguggcugaaaggucaaucaauuugcuuaugacucauucuguggcucuggguggugacucaaauucuaaaaccgguuuucuuucuacccaagauccaagcugguugcaacugagucacuuccaaggcucaucacuucuccagucucugagcccaaguggccaaugccucuagccacuuccccccugcccaccugcugguuccaaugggaaugugcuggaaaguggagacccaccgacaaucuuucucaaacucuuuggacucgucagugcaguggaagaauuuccccuugaagagcugcacagccaccacggcgaagaugaacaugaauagcauguagacgaugaggauguugaagacguuuuuaagugaguucaccacacagucaaacacagccugugggguggaguugacagagagcaugaggggcuggggaccugcccaaccuucugccuccaguggcccaucauaccaaaauacugccaugaucauucccauuuuacaggcaaggucauaagucaagucacuaggguaagguccccccagcuuucagaaauaagcguuggaggaguuggacucaauccuggcauucuauggaucuaaaacucccagaugggauaccagagaugcuuuuaagugauacaggagcccaacacagaaaaacaagguaacaaaguuacuuccuuuccaacucucucaauccuuuugagugaaggagaaauuuuuacuuaguugcuaccauguuaacaccuaccauugacauuuucccucuuuaaccaagaaagagcaguugucaaugcacaaagccuuaggcaggcagccauauuugguuagauuuccauaacaguaucuguuuucugucuuuaauuuuuaguagagacagagucuaacuauguugcccaggcuggucucauucuccugggcucaagcaacacuccugccuuggucuuucaaaaugcagggauuacgggugugacuugauuuaaagaaacauauuacauaagagauaauacuggggacccccaggugaagcauagagugaaagugggugcucuaaugacuggauuuuauuucccuuaauauauauauauguuuuugaaugacaggcuuuugggaaaugcugguucaugcuauuuuggaaugggagauacuagagccuagaauagguagaugaaaagucaaaauuuuauggaacaagaaaucuaguuccugcuucccagaucacgguuauacccuuuuaaauccauaugaugccuucaugcgaauuaggaaaaaggaucuuaaccccaagacacuucaucuaaagaaaaacugccauaauacacagauuauuuuaggucagcucacuuuacugccaucugcugggaaguuguaauaauacaaauauccauacacgauggcuaggauguuaucagcaccuccuuuaauguguuguccuugagcaguguacaaccugcucagcuguacaugauaacccugacagucccccccaccgcaccccaccaucucccaaucucaccuugagcuuuggcagccgcuugaugguuuuaagaggucguagcacccggaggacucggagggauuuaaucguguugaugucuuuuccuuugcuauugccacuguggaggaauguuuaggugggaagaagggaagagaggaagcagaggucagguuggguagggggcagcccacagcuccaugggacccuacccucccaggccuagaagucuggggugagcuuggcacagcccugcccuuccuggugaagagugguccauuucaccuguuaagcuugggcucgggagccaguaaguacguggcuuuuugugguucuggucccaggguugguugagggcccuuugccaucuggcugggccugagcagcuguauugggugucccugagacccagcacaaggggguuggcugauuccccacccccauuucugcacagcuuuucuuuuuucuuuuuugagacagggucuggcucugucaccaaggcuggagugcaguggcacgaucucggcucacugcaaccuccgccuccugggcuaaagccauccucccaccucagccucccaaguagcugggacuacaggcacacgccacugcgccuggcuaauuguuuugucuuuuuguagagaugagguuucaccauguugcccaggcugguuucaaacuccugagcucaagcaaucugcccuccucacccucucaaagugcugggauuacaggugugagccacuacaccuggucacagcuauuuucaaaaaagcccuuggucuaggaguuuagugguccccuauguauucuuuuuuuuuuuugagauggaguuucacucuuguugcccaggcuggagugcaaugguaugaucuuggcucacugcaaccuccaccucccagguucaagugauucucuugccucagccucuccaaguagcugggacuacaggugcgugccaccaugcccagcuaacuuuuguauuuuuaguagagauggggcuucaccauguuggccaggcuggucuugaacuccugaccucaggugauccacccaccuuggccucccaaaguguugggauuacaggugugagccacugcgccuggcccccuguguauucuuuuuaaaggugguaucagugggcucuuaaaaaaaugggauuuucucccccuuccaaugggauucuggaagauacuuaaaguggcccuuauaccaaaucuccccucccccaccauauucccugagucugaaggagggaaaauaaccgggugccgcuguuuucagaugcugauguggcugcugccauggucucugcugcauugcuccaagggucucugagcccaucuuugccagagaggacugcacagaaguucaguccaaggucuguuggaacugagcuuagcaaugcagaccccagagaugccaugacacccuuggccaaccaugacucaggccccccaagaggaggguauugagugggaccaugaauagcuugugguucauggcacucaugacccauccaguuguccacaccagaaaccugagagucauggucaacugccugcccucuauccccauccccauccccagugggucaccuuccuuaacaucccgccauccauuccugggugccauccccccucacccgucucccaacuugcuccucauucccugccuuuucuuccauguuuuaugcacacaguggcuaaagccaaugaccuugucacucuuucucuugcucagaauucuucuggagcacgugaauucucagaagagcaagugcaaacuucugggcauggcauucaaugcucuugaaaaucuaguccaacuuaccuucaccuuugcauucccauuuauggcuacauaucucaagccccagccacauucuuuugccucugucugcuuaugcauauacuguucccgcugcuagaaaugcccuuccuccacuucuccagucacagaacuacccgguccucaaagcccaaauuaccuguugcucccuccgacagcauuuccugacugccuaccucuggcuccugccagcuccuaugugcuauuucggaguuaaucuuuguuuguuucuucggucucugguuuuagacagaaaacucuucaaaggcuuacaguguaaucuacucuucucuguguucauuuucccuuuaaucuuuuuuuuuuuuuuugagauggagucuugcucuauugcccaggcuggagugcaguggcaugaucuuggcuuacugcaaccucugccuccuggguucaagugauucucccaccucagccucccgaauagcugggacuacaggcaugagucaccacaccuggcuaauuuuuguauuuucaguagagacaggguuucaccguguuggccaggcuggucucgaacucccgaccucaaguaauccacuggccuugacucccaaagugcugggauuacaggcaugagccaccgcaccuggccauuuccccuuuaaucuugauucuuguccuagccccuagccugcgccuggcguguggucucaggacacgugaaugccuccgguuggaguauuuggguggggaggucaccuagaaaacaucucccuacagugaccucccaggucaugagcagagcugccccagagacccccaucacgaugggucucaguauccagugcaaaaacaucauucuucacaccauuugcuuuuuaaaggacuccauuuuuuucauuuuucagggaacaaagacgauaauuguauuuuagccugcuaggcagagauauacuccaggauucagaacucugaaccuuuuuuuuucuuuuuaaaacuaacaucaucauuaucaucucaaggcugugcccccaagugugagacacacguuggacagucacugagauaauuuuaggcagaacaggggcacagauuaaauaauuggaucucagaggggcauaaucauuucuuuuucuuucuuucuuuuuuauuauacuuuaaguuucuuuuccacguaucuuucagacgcucugcuuuugcgagaaaggaagccucagguagaugcuaauaggccuuuaacaccucccuaacacuuaguaauuuuccuuuuaacaaagagcccagcuugaaggcaacaacauugucugguuucuguuagauuuacuuuuuuuuuuuuuuuuugagauggcauuucucucuuguuacccaggcuggagugaauggcgugaucucagcucacagcagucucugccucccggguucaagaaauucuuuugccucagccucccgaguagcugggauuacaggcaugugccaucacguccggcuaauuuuguauuuuuaguagagacgggguuucuccauguuggucaggcuggucucgaacucccgaccucaagugauccaccugccucggccucccaaagugcugggauuauaggugugagccaccaugucuggccuacauuuacuuuugcaguugcagauuuaucuuagguuagcaaugcugguuguaaguggauaauauaguuuccuuuuuuuuuauuuaaauuaaagagauggaaucucaggggggagugcaguggcacgaucauagcucaccgcagccuccaacuccugggcucaagugauccuucagucucagccucccaaauggcugggacugcaggcaugcaccacugcaccuggcuaaaguuuccuuuugaaauugaacuuuagaauacauguugauagaaaaaaagucaaggaacuguacauccagguugcacauggaacuggcuaaaaucuugaugucccaaacaagugacaauugggagcaugucuccaugggcauucugcaucuccucaucugaaaacgauuccauggccauuuuauuuuuuuauuguucaauuuauuuuauauauuuuuuugagacagagucucacucugucacccaggguggagugcaguggugcaaucucagcucacugcaaccuccaccucccagguuuaagugauucuccugccucagcuuccuauguagcugggauuacaggugugcaccaccaagcccagauaauuuuuugcauuuuuaguagagaugggguuucaccauguugaccaggcuggucugaaacuccugaccucaagugaucuacccgccucggccucccaaaaugcugggauuagaggcgugagccaccgugucuggcccacuuucauugcuucugauaacugcuccacccagcuugccuauugaaacugaaccucugccccuucuguucucugcaagaacugguggggcaugggcggaggcauuggcaagacccuuugggaugccuccuucgcagggagugaguucuggucauuugaagcgacaggacagcggcagcaaggacacaaggccacagaaacaggcccagaacuaacgaggcugcaccaggggacagaucacgagagacagaauaugagagagagagagagagaaagagagagagagagaaagauagagagagacuuuaccguguacugcuccuggugauguggcaucggagggagagacagaucguaaguggccucagaaaaaagaacacagaacacgcacguacacacacgcaccccugagcacccccgagucccgcccgggcagcaguugggggagccucaggcucauggcgcuggccgauguccauccuuccaucuggaagccgcccccaccuccauucagucccccgcccuuggcaggcaccuggcacugcccaagaaagcacuaagaaagccaaauuuccagguagcaggacagcugcaaagcugucaguuaccaaaggugaauucaccacggaaagucacugccaagagccggagaaaccccucuucuccaggcguuguggagcugcaagguuuuagaaugucuaaaagguugugagcuuugaaguugaggggaccuggguuugaauccugacucugccucucguuauccucaucugcaaaacaggcccagacugggugccguggcucacagcuauaaucccagcaccuugggaggacgaguugggaagauugcuugaggccagaaguucgagaccagccuggacaacauagggagacccugucucucuccuucucuccuuuuuuuuugaggcagggucucccucuguugcccaggcugcagugcaguagcgggaucuuggcucacuguagccucaaccuccagggcucaggugauucucccaccuuagccucccaaguagcuggaaauacaggcaaauuuuuccauuuuuuguagagacgggggucucauuauguugcucaggcuggucucaaacuccugggcucaagugauccuccugccuaggccucccagagcgcugggauuacaagugugagccacugcauccugggcaagacucugucucuuaaaacaaacaaccaaccaacucaggucuguggaauucugauguuugauuaacaaaagcuauggccuuggcuuugcucuuuaugaaggagggggucagcaaagaguucugacuugggauggaauuagaagcaacucugaagcccucugagcaaaugcgggccuggggaaagcuaucagcaccuagcagcugguccucucgugauucauuggaaucaggcuuggggcucauuaggcgccuucaacaaugacuggagauccagguuagaaagacuugaccgccaucagaauggcggaaacccugucgccaagcggacucuauggaauuuuccauccacgaccccucuggaaguuagugauuuuuuuuuuuuuuuuugaaacggagucucgcucugucgcccaggcuggagugcaguggcaagaucucggcucacugcaagcuccgccucccagguucacgccauucuccuuccucagccucccgagugcugggacuacaggcgcccaccaccacgcccagcuaauuuuuuuuguauuuuuaguagagaugggguuucaccguguuagccaggauggucuccaucucuugaccucgugauccgcccaccuuggccucccaaagugcuaggauuacaggugugagccaccgcgcccggcugugauauuuuuuaaaacacagaaugguuuaaaugucuacaaauauuccaaguggauucuccuccacacccccucaucuccuuuuccuguagucugacuugggguucucaaauucaguguaucuaggaauuauugcauacguagaaucauauagauucuacuuuuuuuuuuuuuuuuuuuuuuuuugauggauucucacucuguugccaggcugccucagccuuccaaagugcugggauuacaggcguaagccaccgcacccggcuuuauuuuauauuuuuagagacguggucuugcucugucgcccaggcuggagugcaguagcacaaucauagcuuaccgcagccuugaacucccuggcucaagugauucucccaccucagccucccaaguagcugggacuacaggugagagacaccacacccagcuucuuuacggaugauugagggaguuuucaaugacagugauuuuugccuaaucugcugacuuuagguuuaauaugggagucuucuggacaucacugcauuugccuaugggaagacagcaccauuaugaccauuuuccagaugaggaagcugaggccuagagaaaaagagugaccugcccaagggcaggcacacagcugggaagacagacuaagauucaaacccagguguggguaucucgcacucuaaucuucuuuccauuucaucauacacaagaaaaauaaugccuucaggggugggggcuguuuugaagaugaggaucaagagauagcagccugagggcuccaucuuuggcuuccugacaguuuggcuccuggguaugcaggagcagcuugaucaaggcgcucugccaguugcgguccugccuuugggggaagaacagccgcgccagauggacucuuggcggugagggcaggaucaugaucugccagcugcugagaaaugucaguuggccgcccugaugcaugggcacagagcgugauaccacgugugauggcucaugaaaugggguguuuaugguagacgcauggauacaagggacacagucagugaauugagcaggacacacacacacagauauuugggugaggugcaggagggguggacaucuucagaagagcuucaauacaucccuuggugggaccacagggauaguuuucucccauaucggagacgaggccacaaucacagcacugggggaagaauccuugcuuugaccccaacaggccagaauggcaagguuccuuucaacaaggaagggaauaaccuuaugcucccuuccccuauucccuuccccuggaucucgcagcccugccaggccucaaagaacccaggcuggccaggcugcugagcaucauucugcucacugugagccuccguauucagggcugggagauggguagcaucugacagcugaacccaaccucagugaucuugucggacuuacuucccuccacagucccucugggccgcaguuuccucaucuagaugggaaaaacugaggcacagagaggcuaaaggacuugcacaucuagagagaaaucaaacagaccuggagggacaauuucuuaaaacaauaaggucaaucuaauacuuguggggcucucagccuugucuaugaggggauaugcacagaggacagacaaagcaaguuaaaagaccagaaaggaaauaagcagaggacccuggggugggggguggggggcggguggagaguucagcgcucaggcugagaaccucagagcauccaugcuccuuccaaugugccaacuauccgauaacaaggaaagacaauaagcaaaguccucauagggugagagaccuucucaggcaaaagaggccagaaaccuguaacggggagaagauuccaaaacuuuuuagggaaaaaagcaguagcuccuauucugguuuucuagcaguuuggcucuuaggugugcaggaauggcuugaucaaggcaccuggccagcugugcugggccugcagcccugcccugggggaggaacagcaguaccagauggacucuugacagugggguggggagggugugguaggcgugagguuugagggucuccucucucaucccuucggccaugauauaaagaugcucccuguuggacucauguccgucggcucuuccaaaacccugggagagucccaggcacuugccaggauccuacuggcaaaaucucacaccucccaguuccugcaugaucuacaagccugccaggguugacaggauggccugaaaucccuauccagauccuuuucuugcauaagaauuaaaacaacaacauucaaaauggauuuucaagagugaaggguggcuuuaugccuguaccaauuucaugagaacaauguaaaagcuugacucugcaaacaggcugccaaauuccugugaguuguaggccaauuugaaugcccuuguauaacuugauauuuaaaaagaaaacucagaaauuaaaaaaaaagucaacuccccaaaagaaucauucugcuguuuuuuuuuuuuuuuuuuuuuuuugagauggagucuugcuccgucacccaggcuggagugcaguggcacaaucuuggcucacugcaaccuucaccuccuggguucaagcaauucuccugccucacccucccgaguagcugggacuacaggcccuccccaccacacccagcuaguuuuuguauuuuuaguagagaugggguuucaccauguuggccaugcuggucuuggaccccugaccucaagugauccaccugccucggccuccccaagugcugggauuacaggugugagccaucgcacccagcucauucugcuaauugaucucugguggaaaagaauuuuugguucgcuuuugcagauuagcuuuguuuaaaagaggaggcuaauuuuaccuccagagaaccuagaaacagcauguuguaaacgauggcccauaauggcaaaagcucaacaauugaaaggcuugcuucuggguccuuuguaggucauuccccucccuaaauugugauggucaacucggaggauggaggugggacagucaccuccucagcauuuuuuuuuuuuuuugagacagagucuugcucuguugcccaggcuggagugcaguggugcaaucuuggcucacugcaaccuccacuucccagguucaagcaauucuucugccucagccucccgaguagcugagauuacaggcgccugcuaucacgcuuggcuaauauuuguauuuuuaguagagacaggguuuuaccauguugccugggguuucaccauguugcccaggcuggucuugaacuccugaccccaggugauccaucugccuuggccuccgaaagagcuaggauuacaggcaugagccacugugcccggcccuccucagcauuacaguaugucagcuacaacagaggucugagaggaaagugacauuggagaccugaacagcuugggcuugguaccauuuaucugugccacacucagugguggucacugggaggauucacaggauaaaacccauuccccugggcacagguggccaagguaagcauuguguguggacagguggauaugagugacauauucaccccacugccugcccuagugcccugagcuaccugccaccucuugagcccuaggaaucuuggaggcugcugagcagaccuugccccagaggaaaggggcgggggucccugccugagcauguccuccuguguccugggaucugccuuugucugaauaccauuccucaucagaaugcaggguaggggggccaagucccuguugccagaccgaugacagagggucagcuuucuccaagcuacacgguccaggggaggcccacaucacccaaggacauaggucaucaacagugcagggagugagagagaaagagagggagagagagagagaaagaggaaaauaaaaagauagaaacugagaggggguaaaaggagaaagacgaacagaaagagacagagagagggaagaagagagagggaagagaggggaaaggaggaagagaaagagggagaaagaaaaggaggggagagggagggaaggggcugaaaggcagagagggguggagaaacccguagguuauuuccauaggagaaggauucauuccaggcugagggugguaaaacauucuggcuuuucaggauuuaaauuuucucauagcaugaugucuaccugacaacuugaaggaccugcuuaaauaggugauagagggggagaaaaguauauuuuauuauaauacauuccuuuuuuuauuuuugagacaaaaucuugcuuucucacccaggcuggagugcaguggcaugaucucggcucacugcagucuccaucuccuggguccaagcaauucuccugccuuacccaccugaguagcugggauuacaggcauccgccaccaugccuggcuaauuuuuguauuuuuuaguagagacaggguuuugucaugucggccaggcuggucucgaacugcugaccucaggugaucccccucccuuggccucccaaaaugcuaggguuacaggcgugagccacugugcccagccuauuauaauacauucuuauauaugcuguuuauuagcuaaaaaaaucauuuuuugugugugugugggggugcggcgggaacagugcuaacuugauagggaaugaauuguaucucguuuuuauuuuacauuucucugaauuccaaggguugauuuaccuccauuuuuacuaguugccagcauucuaucagauuucuguuuauguccuuugcccauuuauccauugagaaguaguguuucuuauugauuuguaacugcuuuucauauuuuaaagacauggacuccuugucuuauucgucacaaucuuuguccccuaauuugaugugcauuguauuuuguuuaauuaauuauuuauuuauuuacuuuuuaaccuacagaacagcuugcuaaaccuguuuuuuuuguacucaucacuauuaaaauuauucaguaaccauauaaagcauaauauucuaaauagcaaauucauugauuuuuaauuuuuuaaacuuuuuauuuuuuugagacaaguucuuccuguguuccccagacuggggugcaguggugcgauuucggcucacugcagccuugaaccuccugggcucaagcaauucucccaccucagccucccguguagcugcuagugcaggcauacuaccaugccuggcuaauuguuuuuuuuuuuuuuuagagauggggucucccuauguuacccaggcuggucuuggccuccugggcucaagcaaucugccugucucagccucccaaagugcugggauugcagguguaagccaccgugcauugcucuaguagucaaauagacacugaaaagcuuugaggagagggaaggauguggggagggagaggagaagagaaaaagaaaagaguaaacgaacaaaaagagaggagaaagaggaggaaggagugaaagagaaagagaaagaaguauaaucagccucccaaccuucaugauacaucuccagcucugaggcauccaaaaacucuggagauuuuuuguucuaacacaacuugaccucauuguguucccagagaagaaucuaaguguggccuacuuaacagcccuucuacuggaaaugggccacuauuuuggcccuccugacaaaccaaguccucauuguuuggugagggagaccauucaagggccccuccagauuggcucaggagggagccuagaggcagaggcacaggaggaagccccugauucucucacgaugggagugaaugugucaagauccuuucaaaaccugucagggaaucauucaccaugaugggcacagccaggguccccaagauuuguuucuugauuaaagacugauuagauauuuuucaucccgcuccaaaugucuacaacuucaggaauguacugcuaagucugcuaucagggcccuaagggcuaauggccacucaccuguuggguaccaucuugaaauagucacccagaacuugggggccauuuugaaaugguugcccuagaacuugggugccauuuuggaaugguuacccagaacuagggugccaccuugagauggcugcccagaacuugggggucaccuucgaguagccauccaagacuuggggaccgucuuggaauggcuacccagaacuugaaggccaccuuggaacucagggaccauguaagaauggccaccaagaauccagaggccaucuuagcaugguagcccagaaaucagaggccaucuuggaauagccacccagaacuuggaugccaccuuggaaugguugcccagaacuugggggccacccuggaacucaggggccaucuugcaauggcugccuagaacuuggggccaucuuggaauagccacccagagcuuggggaccauccuggaauggcuacccagaacuugaaggucaccuuggaacucagggaccaucuaagaaugaccaccccaaauucagaggccaucuuggaaugauagcucagaacucaggggccaucuuggaauggccacccagaacuuggaugccaucuugggaugacuacuaagagcuugggugccauccugaaauggcugccuacaacuggggcgccaucuuggagcugcaggaugacacauggccuuucagagggcagagaauccuaggacugccaggagaagugaaagacacacaaagggagucaccaggucuacaacuacggggccuucaggcauagggagggggucagaauucucaugcacauucguuuccugauugucucuuuagggacuuuccaaagagacagcgguuugggcggcgcuuguggaguaguagggggaugagauguuccggcgaggcuagucuacaggaagcugcacagcaaggggccagugauguggcugaggcccguugcugugugaggagguagaagguuggcaggagggggggucccuucuccuucuuccuccauggacaucaugcaaaaagccaucgaagcucuuccugguggcaugcugauaucucccacguccccggagcccacacaccccaucccuagacccugagaacauguccuguaauccgauguguggcccaggcuggggguugggggaaaagaggcaagaggaacccuugcgaggagacuuacgugaaggcaaaggcuaccagggccccacugaccacuaugaagucgagaauauuccagaggucacggaaguaggcacccugaugcaggacgagccccaggucaaucaucugugggggagaagagagggugcucagaacccccaccugauccccacccuggggugcugccacccacucucuagccucucggggagaggcagggaagccaaugaggccaccucaucuugcagggaugggcaguggccagaggacuccagggaggaguggggagccccugccccaugaggcggccccccuuugccugauggaagccagcucuggcuugccggcucuuagauccaaacuuugggauccucuuugaugccucuuugucccaaaucccucauugguggcucuaucagcaaaacucacuggcucuauuuccagaaccuuccaagaaucuguccacuucucaccucuucuuuggucaccagccugauccuguccccgucaucgcccauggggaccagugugaucaccugcucacagguccucuggcuucccacagaugccaaagggcaccugugaacaccuggaucaagucccuccucugcucagaacacucuauggcccucaccucacucaaaguaagagccgaagagcccucucugugauccccggcacaaggugcccccucaccuccccacucaucucucuguccuucguuuccccacuguucucucacuccgcccagccacaccagcuuccuugcugcucuucaaacacaccaggcauuucuaauccucugggagacucauccucucaaggggggcauucuuggaggcucaggaucuccuggaaucccagcucuuuuuuuuuuuuuuuuuuuugacagagucucgcugugucacccaggcuggaaugcaguggcaagaucucggcucacugcagccuccacaucggcucauugcagccuaggguucaagugauucuccugccucagccucccgaguagcugggauuacagacaugugccaccaugcccggcuaauuuuuguauuuuuaguagagaugggguuucaccauguuggccaggcuggccucaaccuccugaucucaagugaucugccugccucagccucccaaagugcugggauuacaggcaugauccacugugcccagcccugcacuugcuuaaaaaaaaaaauuaccguguguucucacuuauaaucugcacucaccuugaucaccaucucaaagguaaagacgccuguaaaaacguagucaaaguaucgcagcaccuguaagggauaaaagcaagagagcaguggaucacuggccuguuccagcagagccccgguaaaacuaacgaucgccuacuggggagcagaguuucuacccagaagaggaaacacagcugcuauauacaguugcgcagggcgugcacugcacaagggccccucccaucucuuuucauacugcagauuuguauguugugaaugaaauuguccagcagauggcagcaaauccuaacaaaaaaaucacuguacuaggccaguucgcuaacccacgggaaggguaccuuuuaaaauuugccccaagcccuguaguggauuagaagcggccccagagaaguucagggcugacuguauccuucuuggugauggaucuaaucccccaguacccuugcuuuccugggcauccugggcgagaaauaguugcuacgugguuuuuuuaaacacuggggccaacuuccugccacggcaucucuuccugcuucaaggccaggccccugccaggguagguugauuuuuccugugccccuccccaggccugauguuucugccuggacgagcaauguccucuggcccagccccuguccaggacacaccauagcacaccucuggugucacccaggccugaagaugagggugcgccggcacagugucuggcuggugcuagacaugggguggacaccggcugggcacgguggcucgagccuguaaucccagcacuuugggaggcugaggcaggcagaucacuugaggucaggaguucgagaccagccuaaccaaauggcaaaaccccgugucuacuaaaaauauaaaaaauuagcugggcaugguggcgugugccuguaauuccagcuacuugggaggccaaggcgugacagucacuugaacgugggaggcggagguugcagugagccgagaucgugccacugcacuccagccugggagacagagacugucuaaaaaaaaaaaaaaaaaaaaaaucagauccacccagaagcugcaagggcugagcauuacugaacauggccaccagagggcgcugugaacaccaaagaagucaggcacauccuuccccugcuuacaauccuccguggcucccaccucauucagggauaaaagucaaaguccuccccgaggcccucaagccccugcacgaucugaccauucagcucccugcccucacuuccucucauucucucccuugcucacuuccuuuuguuccccaagaugcuuccaccucagggccuuugcacaggcuguucugucucucuggaaugcuuucccccacaucccauuugauuccgucuuucuccuccuuuaugacuuagcucaaauaacacuuucccagugaggacuccccugaccggcuguuuaaauuccaucuccuggugcuugagauccucuuuacgaagucucuccuucccucugcccaccacacccccggccacuuaucacucccugaacauuuguuguaguuacugauaaucucauuguccaucucccccacccaaaugucagccccacaaggacagggaugucugucugucaccauggcgucuccagcuuauaauacagggucaggaauacaguaggugcucaagaaauguuuguugaaugaaugcaucaacaguuggggcuguacuggguccuggaggagcugggcucugugaucugugugguuauaacuuauauuccuguuauauguggugcuugaagaggaaucagagaccagagugccuggggucagggugaggugacuuccuggagggaggggcuggugcaaggggauuggcuugaaagaccugggugggcagaggggaugguggugggagaguauuucaggugcacgaggcagugggcacagccuggucaaaggccuggugguuugugggcucugggagugcagggaccaucucauacccugucaauccucccuggcucgcucaguaccuggcacauaguaguugcuuaucaaauacuuacuaaaggaaugaauggaaggaaagaaggaagagagggagcugggaaagggcaggccgugggggucaggugaaucuaauucuggagcucuuaauaagcugugcaagaggaaaucaaaagaccaauaaauuagguucaaguauuccuaauacuuagaucuuuuucaucuauuugaaaauguuauuuccuguggcucagucuaauccaaaaaagugcuugaucucauucauuacagggaaaugccaagcacaaccccaauaagaucucacuccacacccagcagaucggccaaaugaaacagucgacaguaccaaguguugacaaggauguggaagaacaggaguucccaugagcuacuggugcaagggccacugcguucauuuauuuuuuaauuuuuuuuugagauggugucucacucugucacccaggcuggagugcaguggcacaaucuuggcucacuggaaccucugccucccggguucaagcaauucuucugccucagccuccaagugucugggauuacaggcgcaugcuaccacgcccggcuaauuuuuguauuuuuaguagagaccagguuuuaccauauuggccagucuggucucgaacuccugaccucacgugaucuacccaccuuggccucccaaagugcugggauuacaggugcgagcccggcccacugugcccggcccacuguguuuauuuuuauuuauuuauauauauuuuggagacagggucucgcucugucgccaaggcuagagugcagugacgccaucuuggcucacugcaaccuccaccuccuggguucaagugauucuugugcuucagccucccgaguagcugggauuacaguuguguguuaccacgcccagauaauuuuuguauuuuugguagagacgggguuucaccauguuggccaggcuggucucaaacuccugaccucaggugauccacccgccuuggccucccaaagggucacuguguuuauuguccaauaaacauucaagcugcauuuacugaggccaaccacuugcaaauuauaugcucuagaaacuucgcuuuugguuuauacccuggaggaauucuuauuuauugagacagggucucgcucugucacccagguuggagugcagugguaugaacauggaucacuacagccuugaccuuccagacccaagugauccucccaccucagccucccaaguggcugggaccacaggugugcaccaccacgcucgguuaauuaaaaaaaaaaaaauuuuuuuuuuuuuugguagaggugggggucucacuauguugcccaagcuggucuugaacuccuggccucaagcauugcucccaccuuggccucucgaagugcugggauuauaggcgugagccacugcaucuggccuccuggagaaauuacuguccaggugacucaggaaacauguugaggggcguggcauggggacaguauucacacuuagaaacaacccaaacaucugucaacaggggauggauaacacaucccaugccacacaguaaaucucaaaacagcaucauaaagaaugcucauugaccgggcgugguggcucacgccuguaaucccagcacuuugggaggccaaggcgggcggaucacuugaggucaggaguuugagaccagucuggcugauagugugaaaccccgucucuacuaaaaauacaaaaauuagccgggugugguggcgccugccuguagucccagcuacucuggaggcugaggcaggagaaucgcuuaaacccgggaggcggagguugcagugagccaagauugcaccacugcacuccagccugggugacagagcaagacuccaucucaaaaaaaaaaaaaaaaaaaagaaugcccaucaauccugcaaaagcaacauguacucauuuaaugcgaagcauagaagugucucauuuauugaauguuacagaagagcaaacauaaauucaguuuuuaagaauuggccaguguuggccaauuacaggcauguaagaauuggaauuacaugccuguaauuccagagcucugggaaucugaggagggaggauugcuugaggucaagaguucgagaccagccuggcaacauagcgaggcccguuucuacaagcauuuaaaaauuagcugggugugguggugcaugccugugguccuagcuaccuggggggcugaggugggaggaucacuugagcccgggacguugaggcugcagugagccaugaucacguuacugcaccccaaccugggcgacagagagagacauugucucuuaaaaaaaaaaaaaaaaaaagccugugcaggugggaaaaagagagaagccaaaaacgcucauuccagaagcuggggucgugguuaccgguaaggcaggguuucucaagcugggcucuguggacauuugggucuggaucauccucuagagugggggcuguccugggcaucggcgggugcugagcaacaucccuggccuccacccaccagaugccaggagcaccuccccccuccugucgugacaaccaaaaaugucuccagacaguguccccagcagcucuagagggaaagaaggcggugggggugggggaucgaggaggcacaugccgcguggggcguuuuuguucuauuucuugcccuggauggugguuacguggugugaacguuauggggccacaguguucuuguagagaaguuucgacugcgagauggacgagggagggggccggggagcugaacgcucuuugcaaacagucccuggggccuggucugagcacugccuagauucccuucagcccugggagcugccgugcccccuggaucauccaugccugugcccucccugccgaaggcaacgccuucuucagcauccucgcgucagcaggggguuuguggaccccuccagggacaccuccuccccacgccuggcuccuggaggccccugggggaaaccaggcugcgggaagcaacuaagcggacugugaggaggcugagcacuggcucuagcuuccuccaggagcugcguucuaauuauuuccuuccaucucccccaucagguccccaggggggccugccaggccugggaaggaagggaaagugcaugguaagcugugggcgggcuugagggauggggcucgccagcuuugccuggguccuaaccuacuuagccagggcagcagagccuuggaccagcagaaaacacacuuuuuuggcucuggguugggagggaaggguugggggagggagcuggggagggaaacaggagccaccaguccacccucuaccaggcccuggggucaagccucugcccgcagcccaugacugaggcacgcccuugccuguuggugccucgguuuccccaucucaaccacaagcaugcacucauuccugcuugucaggacucaaaggggcuaugcacacccauccguagcauacaguaggugauuaguaaaugcagacaguugggggaagcagugggagcuuugggggaugcagaguuggaauucugcugugugacccuggacaggccacuuaccacucucucauuccccugagccucaguuuucccaucugucaaauggggaugccugggcgggggguugggggggcgcauugugaggauuaaaugagauacugcaugcugaguuucuuccugggacacagcaagugcucaauuaacagggguugucaacagacccaccauccgcaaaggggcuugcuuucauaaaaaccaaaagcuuaggcuguguuucugagccaaauaguuguuucuuucaaagcuucguguacaaagggaaaugucuacugcggaggggaccaccucugagcaccgccccugccccaguaaccccccuauuccauguagagaaugugcaacauccauauccugcuagucucacgccuccauuagagaauccagcaauuuucagccccagucacucugggccaccuccaccccaccaggcucacagagaaacugccucaaggaaugucuugcucccaagagcauccccaaggaaucagagcuuccccucucaaccagcagccauaagggcuaugccuaggggugaccccaacaucccacccuaccuaugagcauuuuggaugcaggagaaaguggccugaggcagagcagccaggcuaggaaggggugugcucugugggacucacguuguuccgaggugcguugggcugcacaggguccucggcggccagggcgaugcugcucauggcaaugaccaugaggaugcacaucucaaaguagcgcagguucaggauguaauggcacaggcggcgaaggcuguuggagacagaugggcgugcagagguccacucagaccacaggcucacaaacccuuuucuuccauaaucucauguuaccuaccacuacugagaucuccaacccccaaggccuccuacacaacaaacuauuaaacuccuccaggugggggcccucucuggguccuggaaccccaagaaggcagaggggaccucggugagagaagacauucacaugcccuguuuagcaaaguuccuaucacucccaaacgacccucuugaaguaucuugauccccaagcuagguugaagaaauacgguccuuaauucuguaggagauaaaaaggcuuuucgauauuaaaugucccagggccaaacaauauugugaaucuauggguuaaguagauuucuuucuuucuuuuuaaaaauuagcugugugaccuugggcaaguuacuuguccccucugugccuuggugcccucaucuguaaaauagccguaauacuagugcuuacuucacaaaaucaugagacccaagacuuaauuuaugccuggcucaugauaggggcuccaaaaaguuaguuauugaaauuaugaauugcaggccuuaucagagccuugaaugugccaaugggaugugccaguuaaccucuuaauaaguggagccaauaauaaauaguucauaagguugugugaauggcagcagagcugagugguuaagaacaaggaggcuagagccagugucugggcucaaacuccagcucucccacuggcuugcugugugaccuugggcaggugaauucacgucucuggaccucaguuuuuucaucugucaaauggagcuaagcauaguaacaaccucagagaaauuaaaaaaaauuuuaaggcacucagaacagugccuggcacugaguagauaccacauaaguguuuccuuaguaaaaucgauaagucaacuaaauaaaaaaguacuuuaaagguacuuuuauuuauuacuacccagggugaguugccaagaggcagauuauagaaagcagcuucucccccaucuuaucugacaugauccuucauugucaagaagcauuuugagcggucaggcuuucaagaaauaucccugggagacauucaauucuaaaacaaccuccgagccacuacgacauucaugggauaaauuucuccccuaaauagucuauccauuucaaagaugcccaagacagaaggccauggaacucagacacuauccgcccagaaucuaaacccuuacagagucuagguuagaaacagaguucagguccuagggcugccacgugcaguuguucaggcuguguacugcacaaggcagccauuucuaagggggugccucuuacaucacagugaagauuuguuuauuuaugacaaauuuauuuguuguuuaggacaaauuuauuuguuuauuuaugacaaauuuguuuauuuauugucauaaauaacaaugauuuucuaguggauggcaggacaggggucucuuccaacaaaguauauugugacaaaucaucuuaccugacuuacggaaggagcauccauuuucaacuuguucaaagguaucccuggacucaugguggucaacacucacucauugcccucuaucuggccugacuuccgccacccuggugggagccccaggcccccccugcccuugcugggggccauacucacggguuggucguggacaggaugaacauggagcuauagggaggcauuggcuuagggccgucuuccccacggucgucuuccuccuccuccuucuucucuuccucuuuuuuuggcagugggucuggguuggcguuuuuguucacuguugggacaagaaccaacacagggcucccuccacaauuucccacaagucucugggaacuccuguguacucccagggcaggcaagaagcggcugacauuucuaaagugccugcuguauauaccaggcaucuuaugacaucacugaacccuuguauagcccugagguugauauauucugaucuccuguuuacagaugaggaaauugaggcacagagaaguaaagugacuugucuaaggucacacagcaggaaguggcagagcuggcauuuggaacccaggcggccuggcccccgagagccugcucucaaccacucuauagccuugagugcgguggggcccucaugggauauuaacacagaccugccccuauccucguuggaccuucacacccucacuugcaggcagguagggagagugccaagagacccacugaacagauagaaauacugagaccucccauaaacugcauggcaugcccccauuagcaccccucucuugacucagggggaggagccaucagccucuggagcuuccauucugcagcccagccugcuuaugugcccacgggcaggcugagccucucugagccucagucccuacaucuauaaaaugggcacagugacaagaccuuaggaucuuaggucucaggaccauggaaagccuuuauccagcaaacucaugaaaaucucucacauagaacugacacuagaugaacuuaagacauaauccacccagcaguucaccauuuuuuuuuuuuuuuuuuuuuuuugagacagucucgcuuugucacccaggcugcaguacagaggugccaucuuggcucacucuaccucggccuccugaaguacugggauuacaggcaugagccaguacaucuggccccuuuuuuaauguggcgacuagagaguuuaaacugacauuugcauguggccuguguuacauuucuuuuggacagugcugggccgagagaaucaaucaucugacccccucaagcuuccaucagaggacccuauugcuccucaaaugggguggcuuccuggcuccccuugggaaggaaggacguagaagauauugcuaacccgacugaacacaaccccgugccaggcacugugcacaaauuaucucacugaacccuccacagcccugugggguaggaaacuacgccuaugcccauuuuccaggggaggagacugaggccagagagauggggucacaguccagggucacucagcagagccucuggcuccagggacgccagguccccugcccagugaugugagagcagagggucucaccuuguacgacggugugguugagggggggugggcaggcuggggggauguccacugugguguggucggguuuccuggcagucuuagcugaauuggucugggugccgcugggguuggugacgauaaggcuauucucgggggucuugggggggccgggauuggauggguuccccggguuguugggcguccggcggcuggcggcguucuggggguugguggccauggcagggauggccagcauggggccggggucggugcuguuucccaucuuggcugggcucuggggcaggccggcguggccaaggcugccguggggagcggccgacuccgcgguggccagcuuguuguucuucauguugucaauauccucugccaggggugggucuuggcggcccagguccugcuggauuggccgggugguugacagguuggggcccgacacagggaccccggagcccugguucucucugaggaaggcaagugaaugaaaaagaaccaacaacugauuuaggauaaaaggcaacaguucaggauccuagcuaagauuccaucuuucaagaguacaauuugggcugggcgcaguggcucacgccuguaaucccagcacuuugggaagcggaggcaggaggauugcuuaaggccaggaguucaagaccagcuugggcaacauagugagacccuauuucuacaaaaaauguguaaauugacgggcguggcgcugugugccuguaguucuagcuacuugggaggccgaagugggaggauugcuugagccugggagguugaggcugcagugagccgugaucgccccacugcacuccagucugggugacagagugagacccugucaccaaaaaaacaaaaaagaaaaggaaaggguacaguuuggucauggagaagucaugucccagaucccugcagugccuggaauugagaggagccuguucacuucuuggucagaggucaagaccuucacgugcccauggacagguuuccacaacuccccaucaucuuauuucuuuucuuucuuucuuucuuuuuucuugcucugucguacaguggcgugaucucggcucacugcaaccucuggcucccagguucaagcgauucucuugccucagccuccugaguagcugggauuacaggugcccaccacuacgaccggcuaauuuuuuguauuucaguagagaugggguuucaccauuuuggccaggcuggucucgaauuccugaccucaagugauccacccaccucagccucccaaagugcugagauuacaggugugagccacugcaccuggccucuuuuuuuuuuuuuuuuucagacagggucuuacucuguugcccaggcuggagagcaguggcaggaucauagcuuacugcagccuugaacuucugggcuccagugauccucccaucucagccuccagguagcugaggcuacaggcucacgccaccaugucuggcuaauuuuacaauuuuuuguagagacuggcgucucacuauguugcccaggguggucucaaacuccuggccucaagugauucuuccuccucggccuccuaaaauguugggauuacaggcguaaaccacaaugcccagcuuguuuuuaacuuucuuauucuuagcugaguuuucacugccuaguacagggccucucacacagucaaugcuggguaaacuuacugucaaaugauaaaugaauacccccauuuucuuuuucuuucuuucuuuuucuuuuuucuuuuuuuuuuuaacugagacagagccucacucuguugcccaggcuggagugcaguggcaggaucuuggcucacugcaaccucugccucguggauucaagugauccucgugccucagccucccgaauagcugggauuaccagcgugcaccacaauacccagcuaguuuuucuauuuucaguagagacagggcuucgccauguugcccaggcugcuugaacucguggccuacagugauccacccaccucagccucccaaagugcugggauuauaggccucccuaagugcuggauauauagagccaccgugccuggccagaauguccccauuauccagaugaggauacugaggccccaggagagaucccacagccucaaaccucccaucaaccccugccucuccaagccauggacaccugggcccugccucuugccaucuacagguggacaaagacucacuuaguagcccaucugaugccuucuggacuacagaccccuggacaacacagcccugguuucccauaaaucuaucuagaaagaauaaauaaauaaauaaguaauaaauaaaaggcuggcuuuccccagagggcuucccacuggcuaaacuaccagcaccauucuccucauuuuauuuuugcauuuuaacuugcaaaaacccacgguguuuuuaguaaguggaagagagacaagcuaauuuauuuucagaccaaaguagguaagugggaugcuucuaugaauacuucccggaaggagaaaccgaggcaguuccacuguuucucugagacugcacaggggaaauagacagguccaagcaacuuucugccuucucaguuuugugagugggucauagagggacauuucagaagacaggcugaccuggguuugaaucucggcaaugucuuuuuuuuuuuuuuuuuuugagacagggucucacucugucgcccagguuguagugcaguggcgcgaucucagcucacuguaaucgccaccucccaggcucaggcaauccucccaccucagccuucccaguagcugggacuucaggugccugccaccacgccuggcuaacuuuuuaauuuuucuuuuuguagagaugaggucucacuauauugcccaggcuggucucaaacuccugggaucaagcgacccucuugccucagccucccaaaaugcugggauuauaggcaugagccacuacacacagggaaaucucagcaacaucacuagcugugcaacccugugugauuugcuuaaccucucugagccuuaguucccacauuuuaaaauuugggauaacaggaguagaaccuuccccauauccuggagacugaagcaaugauccuggaccuucuuuaccacauaaucuccagugaguuacuuagccucaguuccugacccauaacaugcgggccguaaccucauugagucuggcucugagaacuaaguauguuaaugagcugagagucaccgaggauuauucucaggccuugaaaccuaaugggauuugucuugcuggauuuagcacuugcuuaggacuggugaccucuuuaucccuuccaauuucucccuuuugcaaugggaacgucuauccuaugccugucccgcuguuauauucuggaaacauacaaagaucacuuguucuguaguuucuauauuauauauauaacauauauauuauauauauuuaucuuaucuaucuuauuuuuugagauggagucuugcucugucacccaggcugaaguguaaugcacgaucucggcucacugcaaccucugccucccagguucaagugauucuccugccucagccuccagaguagcugggacuacaggccugugccaccacacccggcuaauuuuuuuuuuuuuuucuguaguuuuaguagagacaggauuuugccauguuggccaggcuaaaacuccuggcuucaagagauccauuggccuuggccucccaaaguguuaggauuacaggcgugagccaccauuucuggccuaaaugagguaaauucuaaaccaauauuuccucaacaucuuggacaguccacaaagaaaucccuaauucuaaccugcuugugaugcuuuuugagaaguuguguaucaugaaaaccuggcugagaguauuuucucaucaucuguaaugugugugugugucugugugugucuguguguguauaauaauaauaauauauuuuuaagagacagggucuugcucuguugcccaggcugaagugcagugguaugaccauagcucacugcaacuuuuaacuccugggcucaagcgaucuucccacccuggguagcugggauugcaggcacacacugccaugccugguuauuuuuauuaauuuuuguagagacagggucucacuauguuguucaggcugguauugaacuccuggggcucaagagauccaccugccuuggccgcccaaagugcugggauuacaggugugagccaccacgccuggcccuguguauguauauguguauauauguguauauauauacauacacauauauauacacauuucagagagugauaucccugccauaaagcaggcccaguuaaguuauaauuucaaagagaaccuaaauccuuuggccaccagcucaagaagccauggagaaacucguggcggcauuuucuuagaggaauaccaucuaccaagagcagauggaaaagggucugccaauguguuuugucuuguuuuugcuuccuuguagagcgucuguuggcucuguuuguugggaaauuuuaacaagcucagccugcagaggccuaauaucaauuuccgggagguuucauuuccaaagugucuccaaggagaacucaaaaggggcagaaaacuuugaagcugcaccccuacccccuucucccuggggaucuggcauccucugccuggaauagguggccaguugcauaacaccugcugugcguggcguucuugugccagcugaucacuugggcauccuucugcagagggcuguggacaccuugccuggggcacacucagacccugagaucggauuaugugggggugauaauaacagcaguuccuguuuauugcuuaucucguguccccacccccuguccuaaggaccucacguauuaacucauuuaaucccugcaacuaccaccauccgagauggguauagugaucagccccauuucacacaggaggagacugagguucagagaggcaaaguuacccagaguuacccagcuggaaaacagcugagcugggcucucugguguucaaagcuuuaauggggcagcuugguacaguggcuuacgccuguaauccuagcacuuugggaggcugaggaaggaagaucgcuugagcccaggaguuugagaucagucuggggaacauagugagaccccaucucuaaaaaaaaaaaaaaaaaaaaaaaauuagcugggcguaguugcacgagacuguuguuccaguuacuugggaggcugaggugggaagaucauuugaguccaggaguuugaggcuacagugagcuaugauugugccacugcacuccagccuggguaacagagcaagacuguuuuuuuuuaaaaaaaccaacuugggcccauuggggguaccguaagaauuagagugcuaaguaauuaaccacucccuacccccaugcaggauaaacuguggagcucaaaaguccagcaucucucuuccuguuccuuuuggggagcagguugucauggugacagaugcagguggaauuaggaugcgaacagcagagauaagaauucuagaguggagcaggucuuggcaaaaguucccuuugcaagcagauaggccugggagaaggcacugccugguugcaagggagaggcagaagcucuguccuccauagauuuuuacugacagucugggaaaguuccacccucauuuuguccacccugcagggccacugggcucggccaccugguaugggggaucuggggccagcagccauugaauuauaugaaauagaaugugcgucaguccacuuuucacuggagugagccacugaaagacagaugaagguaggaaugaggagaagacaaagugaauaaaaaggaaaaaaauaugaucggccuggcaagguagcucgcuccuguaaucccagcacuuugggaggcugaggugggaggaucgcuugaacccaggaguuggagaccagccuuggcaauguggcaaaacccugugucuacaaaaaauacaaaagauuagcuaggcauggucaugcacaccuguagucccagcugcucgggaggcugaggugggagaaucaccugagcucaggaagucaaggcugcagugagccaugauuguaccacuguacuccggggccuggaugacaaagcgagaccaugucucaaaaaaaaaaaauuaucaauaugcuggagaaugaaaaacacaggguacguuugcaaaaagccucaaggaaugacugaagaagaggaaaaauguacaaggcagaccuccgaaggccacuggcuuugucacaacagagaacgaaaaugucuuuuuauuauuuuauauucucaaauaaaguuuuaucuuugccacuuuuuuuaaagcagaugaaugacugaucuugaauuuuuuucucuuaaagugcaugaaucuucaugaacuuuuauuuccaaagagccuuagaaccucuuuaucagccaaaugaauaaugucucucccggccagauuguuugaugugucuauuaauaauggaauuagcaguacuccccugguucagaaugggggucuggccagcugaggcuaugggggugaaaguggggagauaguuucuuccucugaagaagagagggagcaggaaccaucugugggauuugggcaagcuggguccuuauugcuuuuuauguuuauugaugagaguauuacuaacaguauuagcugacacuuccugagugcuuacuauuacugcuaaaaauagcauucauugaguacuuaauaauauucauauuaauaauagcuaacauggccaggcauggugucucaugucuguaaauccagcacuuugggaggccaaagugggagaauuucuugaggccaggaguuugacaccagccugggcaacauagugagaccccaaaaugcuacaaaaaauugcuaacauuuauugagcucuugguauaagccaggaaccacucaaagcauuuuacacguacuaacucaguuaaaucuuuuuuuuuuuuuuuuuuuuuuuugagauggagucucgcucugucuccccggcuggagugcaguggugcgaucucggcucacugcaagcuccgccucccggguuuuacaccauucuccuaccucagccucccgaguagcugggacuacaggcgugcaccaccuacgcccggcuaauuuuuuuuuuuuuugguauuuuuaguagagaugggguuucaccauauuagccaggauggucuugaacucaugaccuugugauccgcucaccucggccucccaaagugcugggauuacaggcaugagccaccgcgcccggcucaguuaaaucuuauacccagagaaggagguagcuacuauucuuaucuucauuuuauagaugaggaaauggaggcccagagaggagugaaauucugaaagucacacagccuggaagugauagggcaggaaugugacugccugccccaaaguccuugccuuucacaaccaggcuuugcugcucuuguaguuuccaauguuuacuguugucuuucaaaaacucuuccuggcauauuguuagggagagacauuuugucccugucacucugccuccuucaauaacaguagaucuguuaauaaggcugauaauaacaguaauauuaguaauaauagcaagaguaauuaauaaucauuggucuuucuuuuuuuuuuagacaugaggucuugcucaucucuaaaaugagcaaugcuacugcaauccaaccugggcaacagagcaagacccugccucaaaaaaaaaaaaaaaacaaacaaaacccuaaauaaaccaacaaacuaaaggcacagauaauuauaagcaagauuuuucaccugugugaggagcacuagaaagucaugaagaggaaaggauaauucuuuuccauaugagacugucuuguacaugguaggguauuuaguauacuggccucccauucucuaaaugcucaggcuggucucgaacuccugggcucaagcaauccuuugccucagccuccugaguagcugggauuacaggugcauaccacuguaccuggcuuuuuuuuuuuuuuuuuuuuuuugagacagagucuuguucuguugcccaggcuggagugcaguggugugaucucagcucacuguaaccucugccucgcaggacaauucuugugccucagccuccugaguagcugggauuauaggcguccaccaccacgccuggcuaauuuuuuguauuuuuaguagagacaggguuuugccauguuggccaagcugguucugaaccccugaccucaggugauccaccugucucugccucccaaagugcugggauuacaggcgugaaccaucacacuggccuguaccuggcucuucauuggucuuuacuauacagagagugcugugguaaacacuuuauuccaccuaaacucccguuuugaucucucauuccccugagugacugacagccccagagucucaucaaugcaccuucaauuucuuugucacuuucucgucacuagucauguccugcaaacuggccuccuucugguccaccccagggccuuugcacaugcuguuguuagacugaaacacucuacucccuucucagauugcuccucuggaaaccugcccugagacccugggagcaguuucuuggucguauuucucagaaugucucagaccacuucacuugcaguugugugacugaacucacagcaugagcuuagaauauaguaggcacuuaguaaauacuaacugaaugaaugcauaaacccauaggagaagauugaagcgaaagaaugaccuagaacaaugguuuucagaaaacuguuguagaacuacguggaaaccuaauaacauaaugauugaggggcacugcaggcacuuagagaaugguaggcaguuauacuaaauacccuaccauguacaugacagucccauaugggaaagacuuaucuuuuccucuucaugacuuucuaaugucccucaaagaggugaaaaaucuugcuuguaauuaccugugcuuuuaguuugcuuguuuguuuggguuuuuucuuucuuucuuucuuuuuuuuuuuuuugagacaaggacuuguucuguugcccagguuggaaugcaauggcauaaucauagcucacuguaaucuugaacuccugggcucaagcaauccuccugcuucagccuuccaaguagcuagaacuacaggcaccugccgccacaccuggcuaauuaaaaaacuucuuuuguagagaucgaggucuccuuaugucgcccagguuggucucgaacuccuggccucaagcgauucuccuuccucagccucccaaugcacugggauuacaggugggagccacugcaccugauccugugcuuuuaguuuaaaccuaacucuuuuacauaagaacacaacauauuuuuuguauguuuuuaauauacauugcauuuuccugcaaugcaacuauuaaauaaauggaagaaagacuagacucuuuuguauauggaacuuugccaagagguguucaacauuguggaacaucuugacacugcuggcaacuccccucaugugguuugaauuguccacacaacccagaguuagccaucauuugugccugucacuucauggugauuuuguguaugguguacauaucagaauuacuucacuauguccuccagagucucauuacucaaaauguggucccuggaccaguaguaucagccucaucugggagcucguugcaaaugcagaaucucaggcuccacugaguccuuagcccuacggaauuacaauuuguguuuuaacaagaucccuggggauucacauacacauuagauuuugagaagugcuggccuaccucauaugucauacaacaggaucacuuaaacccaucauuaaaaaaaucaauauuaugcccugaugguaauauaaaagaggacuaagagcagguuaauuuguaauaggacaaugucuacgaugucuauuuuaauggguaaguuguugagucccuauaugcagaaucacuauagcaucugcuagaaaguauuacaaaaugucguuaugaaaaagaggaugcugguucugaauggauaaguugcuggccuggaagaugccucaaaagcuuucuaacauuuuuauuuauuuuuaaaaggugaggucucacuauguugcgcaggcuggucuugaacuccggggcucaaguggauccucccaccuuggccucccaaagugcugggacuacaggcaugagccaccacaucccgcugcauccaaagcuuugaaacucugcucucccuucaauucuaacggcccaaagugccuuuucuuuuucuuuauuuuuuauuuuauuuuuugagacaaagccuugcucugucgcccaggcugaagugcaguggugcaaucauagcucaucauagccuagacauccugggcuccagugacccuccugccucagccucccaaguaguugggacugcaggugcaugccaccacaucuguuuaauuuuuuauauuuuauagagauggggucugccucuauugcccagacuggucuccaacuccugguaucaagugauccucccaccuuggccucccaacagaguggcuuuucaaacuuccaaagaauagcauuagguaaauagaguuggcugaaaauggccaaaaaugcucuaaauuuaccgagcacuuauuaugugucagcugcucuuccaggcccuuugcauacauuaccucauucaauccuggcaaugacccaauuagaucccacuauuuccauugugugaggcccagagauaugaagucacuuugcaaaagucacacagcaagaacacagaagacuauauaauucuggacgacaguggggcuucucuuaauaguuucccugaaaugcucaaggccucuggugccagagagccuggguucaaggacacugguuagaggaaugaccuugaggagcucacucaaucucucaguuuccccaucugugaagccucuaauccgaacacuuugggagacugaggugggaugauugcuugaggccaggaguuggggaccagccugggcaacagagccaggccucauuucuacuaaagguaaaaaaauuaggcugagugugguggcucaacccuguagucccagcacuuuagggaggcuaaggcaggcggaaugcuugaguucaggaguuugagaccagccugggaaacacagugaaacccugucucuacaaaacacugucucuacaaaaauuagccaggcauguggcacaugucuguggucccagcuacuugugaggcugaggcggauggcuugagcccgggagguagaggcugcacugagcuaugacugccacugcacuccagccugggcaacaggcgagacccugugucaaaaaaacaaaaacauacagcauuuuuuuuuuuuugagacagagucuugcucuguugcccaggcuggagugugauggcacgaucucagcucacugcaaccuaccuccaccucccagguucaacugauucucccgccucagccuccugaguagugggaauacaggugggcaccaccacuaauuuuuguauuuuuaguagagacgggguuucacuauguuggccagccuguucuccaacuccugaccucaagugauccgcccgccucggccucucaaagugcugggauuacaggcaugagccacugcuccuggccaaauacagcacuuuuuuuuuuuuuuugagacagagucucacucugucgcccaggcuggagugcgguggugugaucucggcucauugcaaccuccgcccccuguuuucaggcgauucuccugccucagccuccugaguagcuggggcuacaggcgccugccaccgugcccggcuaauuuuuguauuuuuauuagaggugggguuucaccaucuuggccaggcuggucuugaacuccugaccucgugauccauccgccucggccucccaaagugcugggauuacaggcgugagccacugcgccuggccaaauacagcauuuuauaauauauuuuuauaaacaaauacacagcacgugcuacuuuggcuguugucauuauuaauguuaccgucauucugcggauucgaggucaccuccacuuacuuccuccuccgaugccuccgcuccuuguccucccuccgcgcgucccccucguacguggcuggagcgccaugccggugccuucuccugcgcucgcccccgucggggcccucgcccucgcccucgccgccccgggccggccggcugcccucgcggugccgcgcccuccgcuccgccuuguccuccggacccuccuccccgggccugcggugcgcgcgaugacgucgaugcuccccguccgcgcccgugcgcggggacccgcugcggcucucccugcugccccccugccggugcacgugccuccgguggggguccccggccuugccucgcucggccucgcccucccagaacccggguugcuccaggcugcccucccgggcguggugguccgacucgcggccguagggucccucccggcucagcucggccuccuggcuucccgcccagggccuccgugcguccaggcccgccgagccgcuggggucccgggcccgaucgugguagcgggccuguuuccugaggaaguccucggcgcgcugcuggccgaggcgcugguccacggugggcucggccgcccggcucuuguugguguuguuguugcgguucuccugcggguccaccaccagcggccgguccaagugcgucuucaugucuggccgcaggugccgcguguaggcagccuuccagcgcucguccggguccauuucguuauacagggccucccggcuggccagcaaguucugcuuucgcaucucacugguccgcugcucccacacggacuuggcuggcuuuugauucuucuguugcucuuuccugcaguggcauggucacaggacuuagagcauugcuaggcacuguagcuuggauggaugacccaggcgaaccaacccacaucucagccucccacuccugcucuccacccucuacuccccacugaaugcuaggagucugugagcaucugagucaggucccagccuccucugcucaagaacccuccauggcucccaccuggcuaggggcaaaagcccaaguccuccccccugacccagaaggcccuguguaaucugcuugucaccuccuugccuucaccuccucacacuuacuauucgauucuagucacacaggccuccuucacaucaggcauguuccugccucagggccauugccuaugcuguucccucugccugggaugcccuuccccaggccccccaguggcuccucccucaccuccuucaggccauguaaccuucuaggugagcaguccccaaccuuuuuggcaccaggggccaguuuuguggaagacaguuuuuccacagaccuagguguggggggugguuuugggaugaaacuguuucaccugagaucaucaggcauucgauucuuaaaaggagcacgcaaccuagaucccucagaugcaccguucacaauaguguuuguguuccuaugagaaucuaaugcugccugcugaucugacggcagguggagcucaggcgguaaugcuugcuugcucacuguucaccuccugcugugcagccccguuccuaauaggccucggccugguaccaguccacagccccgggacuggggaccccuauucuaggugaugccuucccugacaacuucguuuaaaaucacaacucucuucacucccagcauuugcuauuucccuccccuacuuucucuguaguuccaucgccuucuaacacaauauauaauuuacuuauuuaucuaauuuauugacuccuucccuugcuagaauggcuacacacaggugggauuuuuuuuuuccuccuuguuaaugcuguauccccagaaguuagaacagugcuggguacauaacagcugcuaaccaaauauuuauugagugaaaguggguggaaggacaagaagugucucuuccuaaagcucaguucugucaaggaccacccccacugcuucccaaaucugugccugggauaguguggacguucaggagccaggguagcaucccagggauuaggggcacuuacacagcuauagacauguuggccgcggacagaggacucacuucugccaccuccuuggcuuucuguagggcaaguuucugguucgcugcuucuucuuccucuugcucguccuaaaaggcacguggaaucuuuguucacaaaacaugaacuaggccuuggggacucacuucugacccuguugcugaccaggggcaacauuugaaauauuucgaccaaucagaaccaaggcuccccaauuggaauggguaccugcuauugguuaaguguauugcuauccccucuguguauaaguuugacaucuaacucauuaugaagccuauuuuaacacacagccagauaacaaaaaauaaaaaugucccuucucuuccuacaaugaagacuuuccugcagccuauuuuuuuuucuuuuguuuguuuucagagacagagucucccuugguugcccagccuggagugcaguggcacaaucauagcucacuguaaccuugaacuccugggcucaagcaauccucccaccucagccucccaagcaacugggacuacaggugcaugccacuaugccuguauacauuuaauuuuuuuuuuuuuuuuguagagacagggucucacuauguugcccaggcuggucuugaacuucuggccucaaaugauccucccauuucggccucccaaagugcugggauuccaggcaugugccaccaugccuggccccugcauccugucuuaaugagcuggaaagcagugcaaagauuuuccucucacuaggcuuucugagccaugugaacucucugaaccaacuuucaaaaaacaccaacuacccucacacacagaagagccuggcauccgauggccccugccaugcacugucaacagcccccagaaggagaaugaggagaggaauuuauauucccagcccccaugacaggaaggcgguggggagaggagagcagggcacuugggcuacagccaacugcccagggugcugcugcucacuggugguuagguucagagaggaggagaaugggggaagagguuuuaaaaauacauacagaaaaagacguuuuuggacuuuaaauccuucuucagccuucaugcagggccucauucguaaaacagaaaagccaacaaagaaaaagcaaagaaaaggcaacgagaaagaaauggccagaaaugaacccgcccauaagaaaagucaugccauugcaggcagcucucccgcugugcuccgaaucacuggaacggggagcaaccuuaccaccuuggaaauggucagaucaggacacugucagagacaacauggagaugggaucuggcuggccacccugcucucauagggccacccccaccccuccuggcaccauucccagcauuuuucagagcuaggucucuggaccaucugccucagaaacaccuaaaaugcagauccucaggcuccccaaauaaucuauagaaccagugcugggcccuggaaucugcauuucccacagguucccaagugagcauaaaacaugcccaaauucaagcaacugguacacagcaguuaagagcacaagcugcagacccagacggccuggguucaaaucccagcuccacaacuuacugcuguguggccuugggcaagucucucaaccucucugugcgacacacaucucaucuaaaauuccaacucucccugacuuucccuacugaauuuuucucuguuguguuuaucaccaacugacaagcuacguauguuuacaaauuuaucuuguuucuugucugucuccccucuugaaucccugcuccacggaggcagggauuuuugccuuuuuuuguucacugcuuaaucccuaaguccuagaccagggccuuggucacacaguaggugcucauuaagugcuuacugaaugaugaaaucuguaaaauggggcucagagaacuuggcuccuaagguuuccaugaggacugaauaggauuaaaaacacguauuaaaugaccaagaaaugcuuguaggaucaaugaaagaaagaauguggaucuggagaggaauguccacaccucccaggagauaaacgaacuggccuuucucccuccccuucugcuacccuccugcaccagccccuaaggauggacucuuggaacuuggaugagcucauggcuggaucagcccucggcucagccaugccagccagcuccacaguggccaggcuuguggccgugugcuugggauggcagagacuuccgcuucccuccacugggagcuggggccgggaaacucucucucccuccugccagggccggcagauggagcguuggcaacgucugcuugguuugguucaauuucacaaacauguccugaauaccucgaggcacuggagguggggcugcaaugcugagggagaccccagggcugagaggaagacccuguaccuguuacauguaaucuuaacuuaauaggguccuuggggagaggcuuaggcuggacggaggcuagcucuuaacaugcugcguuuggcuaaggggaggcuccagcgggaagccagaggaagagagaagguggggacauuuauuggccacuccaucugugccuugccaugguucuggguucucuaaggucccagggcugguggcagcccuuuuuccuuggccccagcucugacuggguccccauaacagcacucccucucccauccacuagccugggggcuacaccauuccuuggaaacccugcuuacucccuguaaacggccuuuugguugaguuugccauccguuuccugcagcgaccucacugccuucccccuucccacccucuuggcuguagaauuugcuugaugagggacagucuguuucugggaguggggggagaggcgccuucucuuugcauggugcauccccggcaaaaguucuaacccuguucccaugcccccacccccacccccacccccacccccacccccguccugaucugccaugggcaggugguaacuuugccagagaaacauucucccaccgccuccaccuuggugagcuccugggcguuggccagauuguccacagcgauggccaagaacacauucaggagggugucugcaaaugucugagucaggaaaagcaaccacuggugggacaccacuugggcccuggguaucugggucucucaguacccucccuugagccccugcaaccucuccucugccagagguccaggccuguccccuucucucucuccaugaaggauacaguucccaaagagcgucaguacaaugaaauagauggagaacaccaugccgcccugcacgccccccugagacuugaucccgucguacaugaccucguuccagucuucgcccgucaggaucugaaaggggaggaagaaacacacagccaaccccccucucagccacgggccccuuggagaugcagcuguggagccggaauccgcccaccccauccccgagcccaggaggucuuuaacaauccugcccgguuugcagagccagacuccguguuggcuucuccuuggcuuuucucuuuguuugcgaguagaaagggccguuccugcgucguggggcucuuagccuggcuucuaggaaaaugggacccuggaggagucacagacccuccuguaacucugucuuacuugaugugauuaaggggauuuguuauggacuaaauugugcccgccuccaaauucaugaguugaagcccuaaccuaugaugggaugguauuuggagauggggccuuuaagagguaacuaggguuagaugaggucaugggggacuucaugaugguauuagugcccuuauaagaacaggaagagaccgcaugccauggcucaugccuguaaucccagcacuuugggaggccaaggugggaggaucacuugagcccaggaguucaagauuagccugggcaauauagcaagaccccaucuuuacaaaaaauuuaaaaaaauuagcuggugcccaucuguagucccagcuacucaaggggcugaggugggaggaucguuugaaccuaggaguuugaggcugcagugagcuaugauugugccacugcacuccaggcugggugacaaaaaaaugugauuugccuaaaaaaaaaauagauuuuuuuuugagauuuuugucucaaaaaaaaaaaaaaaaaaagaacaggaagaaacaucacaacucucucucucucucuuugacauaugaggacacagcaagaagguggcuaucugcaagcuaggaagagggcccucaccaggaacuaacuaacccugcuaacacuuugaucuuggacuucccggccuccagaacuaugagagaauaaauguuuccuguauaagccacccagugugugguauuuuguuauggcugccugagcagacuaagacaggauuuuaauauuuaccuguguuccucauguggucauggugaugauuaaacaagcuacuacguggauagcacaaauguagcacaaggacacguuuggggucccccugccugaggcagacccuggaacaaggguucgggugcaagugguuugucugggaggugaucucaggaagcaccaguaggggagaggagaagugagaaaagggaaaagaggguggaacguaaacaguaugugaucaagcgaguuuccacuguagguaaccggggcuuggucuugcuggggagcucuaggggucaucccaccugagggugagggagcugggguauuuauccaccaacggcugcuccuuuuaagguguggcacaaaaaauucacaguacugcuggacugcaguuccuugggggcagagcaggggaccagagaaagaccaaggcaaaggauuagguguugacagacgcaaguugugcugaugcauacugaaagaaccaaggggauauucaaacagcaccuacaugcuccuuuaaaaaagauccaacuuccuuccuucuauccauauccccaugaggauaaaguaaauguuaaagaacuccaaaaacaugaaucugcuaaaacaggguuucuaagccucagcacugcugauauuuggggccagauuauucuauuuggggcuguccugugcauuguaggauauugagcagcauuccuagucuccacccaccagaugccaguagcacccucucccuagcugugacaaccaacaaugcuugcagacauugcuacauguccuuggaggacagacuuguccuugggugagaaccucugagcuaaagauacaugacuagcgaucagugcuauuaauaaucgcuuaugggccaggugugguggcucaugccuguaaucccagcacuuugggaggccgaggcaggcagaucacgaggccaggaguucgagaccagccuggccaacauagugaaacccugucucuacuaaaaauacaaaaauuagccaggcaugguaguaugcaccuguagucucagcuacucgggaggcugaggcaggagaaucgcuugaacccaggaggcagagguuguagugagccaagaacgugccgucgcacuccagccugggcaacagagcgagacuccaucucaaaaaaaaaaaaaaaaucgcuuaugugggggcucagaacuucccuucauggaagguuuccucuucaacucccugucuuggggucucauuuagaaacuaccuccccaggagaaggagagagugaagucacauuuucuauacacucucagucccucaaagagaaagaauccaccaaagaugcucugaaggucccggcugggccagucccaagccucagggaaugcgcccacaugggugcagaaguugcuuuggguugaucacccuggaauaugagaccaagguaucuucagauuugauggguguauuagccauuuuuuuucucugccuuuuuuuuaagagacagggccuugcucuguggugcaggcuggagcucacggcagccuugaacuccugggcucaagcaauccucccgccuuggucucccaaagugcugagauuacaggcaugaaccaccucauuggccuggccacgcauuuuauuuucuuuauucugaugcaucuggggucuugcugacucuggagggacugcccgguccagcacuagccagucccuagagguaguaaacaauuuagcccugagcaggcuuuuuaaaagcaaaccaaacaauaucccaaccagcccauaucccaaccaccuccuuuaucuucccagcacuauccaccugcccuaaucaccccaaggccagguccuagacaaguaggaacagcuccucugccccagagcccacugaaaugauccaaacuagccagucucgagcuguuuacucugccucacccauuccgucccauggaaaccacaaucaagccucuugcccacauuuuccuucucuuccugcuugacccuguugcuucucugcuugguccugcauggugugcuccuucucugaggaucugugaguauaacaaacuuucuuuucguuuuugagacagggcuuugcucucucgcccaggcuggaguauaguggugugauuguagcuuacugcagccucaaccuccugggcucaagcaauccuuccacuucagcugcccuaguagcuaggagguauguaucaccaugcccagcuaauuauuauuauuauuuuuuugcagagacggagucucacuauguugcccagacuugucucaaacuccuggccucaaguaguccucccaucuugaccucccaaagugguuuuuuuuuucuuuuucuuuuuugagauggagucucacucuguugcccaggcuggagugcaguggcgcgaucuuggcucacugcaaccucugccucccagguucaagcaauucuugugccucaucucccgaguagcugggauuacaggcaugugcuaccacgcccggcuaauuuuuguauuuuuaguagagaugggguuucaccauguuggccaggcuggucucgaauuccugaucucaagugauccgcccaccugggcuucccaaagcguugggauuacaggugugagccaccguaccuggccaaagugcugggauuaugggugugagccaccgugcccagccacaaacuaucuuuccaaugacauucaucuccugaucuguuggccucaccauaauugaauaaugauaaccauaaaaucuguguuucaaaguggugugaaaaggccagguagagaaggaggaguucagggaagccccuuggauguggagcaggcacuuucaucugugacacugagagguguuggcccguggggccagguggaggcuguaccugaaacaccgucauuauugcugcuggaaaaguaucgaaguuggugggaggagucccuucaucgaaauuaaaccugcagggaggacacagacauuucacguuggccccacccggggugcucugaggguguggcucaguaucucaucuccaaggaaacgaacgucuccaucaucucuguccccaggaaacccugagugguacccagggcccugcccauuugggugaccgcaaugggugucugggcuacgaggaaggcagccugcacgguggaggggacuguguguucccugagccugaccccagggaaccaggaguuggaauuccugugaaggacuuacuggccgccgaagaguugcauucccaaaagggcgaagacgacaaugaacaggaaaaggagaaacaacaggcugaugauggacuucauggaguugaggagagagacgaccagguuucugagagaugcccaguaccugccgacagaggccaggcgaggacucaggccaggcgggggaggcagggccccggagucagcccucgaaacacgaggcucacuuucccaacuuucuggaggcggccccaccaugucccccauccccacccccuguacaaauguccaggaaccccaaagacuuacuuugugacuuugaaaauacgcaauaaccugagggcucguaacacgcugauuccaaaggaugugccagguuuuaugacagcccagaugaccucgaagaugcucccaaugauaaccuagggcagagaaccuggucucauguccagggacagugucugggcuccagaacuggcaagcauuuccuagguaccaaccuugcaagaacucaaccaaacuccucccuccaaauggaagccgggugaggauccuugacccccucauucauccauucauuuaucuauagagaccgggucucacugugucacccaggcuggagugcaguggcgcaaucauagcucacugcagcacuguccuccugggcuuaagugauccucccaccucagccucuugaguagcugggauuacaggugugccccaccacaucuggcuaauuuuaaaacauuuuuauagagauagugucucgcuaguauugcccaggcuggccucaaacuucugggcugaagccauccuccugcuuuggucucuccaacuguuggccuccacuuuccaaagcauugagccacugcacccggccucuuauuuauuuauuuauuuuuauuuauucauuuauuuugagauggagucuugcucuuaucacccaggcuggugugcaguggcgcgaucucagcuuacugcaaccuccgccucccagguucaagcgauucuccugccucagccucccaaguaacugggauuacaggcacccgccaccacgcccggcuaauuuuuuguauuuuuaguagagacgggguuucacuguguuggccaggcuagucucgaacuccugaccucgugauccgccugccucggccucccaaagugcugggauuacaggcgugagccaccacaccuggccucuuuuuuauuuauuaagagcucccacaggccugagaauuccugaaacacauaauuacaaagugaaugucaugcaacuacuaccuaugucaacaauuaggagaaggcuagggcaguggcucaugccuguaauucuggaacuuugggaggccgaggugggcagaucacuugagcccaggaguucaagaccagccuggguaacacagggaaacccugacuuuacaaaaaaaaaaaaaauuagucaagcaugguggcaugugccuauagucccagcuacuuaggaggcugaggagggaggauagcuugagccuaggaauuugagacaggagagggucaugauccugccacugcacucuagccugggcaacagagcaagacccuaucucaaauaaaauaaaaaauaaaauaaaauaaaaagggacauguggauacccuggaaguuuccagagacacugugauauaacuaccauccugaauuuuguaauaaccauuuucuuaccuuaaaaaaaacugaggugaaauucacauaacauaaaauucacacuuugaauuacacaauucagugccuuuagguacaugcacaauauucugcaacuaucaccucuaucaaguuccaaaacauuuucaucacccccaaaggaggcccuguccccaugagcaguuacuccccacucucccucacccagacccuagcaaccacuaaucuacuuucugucucuauggauuugccugcucuggacauuucauacaaauggaauuaugcaauacuugaccuuuuguguuugguuucuuuuaccgagcguuguguuuucaagguccucgccuuuuuaacguauucaaguaucauccuuaaaaaauacaguuuaaggcggggcgugguggcucacgcuuguaaucccagcacuuugggaggccagggcagguggaucaccugagaucaggauuucgagaccagccugggcaaauugcugaaucccggucucuacaaaaaauacaaaauuagccgggggugguggugcaugccucuaaucccagcuacuugggaggcugaggcgggagaauggcuugaacccgggagguggagguuguagugagccaagauugcgccacugcacuccagccugggcaauagagugagacucugucucaaaaaaaaaaaaaaaaaaaaaaaaaaaaaaaaaaaauauauauauauauauauauauauguagagagagagagagaguuuaauuuuguccacuugaacuuugcaugaacuguauggacuuacguugcuagcuccugccuccuucugugccauguuacaugggugagauucauuccuguuguugggcauguggcugcuguugguggacuuugauugucacagaguauuucauuauauagauaugccacaaaauauuuaucuguucuacagcaaagggauacacggauauugagacuuggaacuauuacaaacaagguugcucaggacauuuuaaaauuuuucuuuuuuuuuuuuugagacggagucucauucugucacccaggcuggagugcaguggugcaaucucagcuuacugcaaccucugccuccccaguucaagugauucuccuuccucagccucccaaguagcugggauuacaggcaugugccacgacgccuggcuaauuuuuguauuuuuuuaguauagacgggguuucgccauguuggccaggcuggucuugaacuccugacuucaggugauccaccugccuccgccucucaaagugcugggauuauaggugugagccacugugccuggccuacuuuuauuucuuagagauggggucucacucucuuguccaggcuggagggcaguggugugaucauagcucacugcagccucaaacugcugggcucaagcaauccucccaccuuagccuucugaguagcuggggcuacaggugugcaccaccacaccuggcuaauuauuauuaauuuuuguagagacagggucuugcuauguugccugggcugguuuucaacuccugggcucaagcaauucugcugccucagccuccugaauagcugaggcuauaggcaugaggcaucacacccggcuuucuuuucuuuuuaauggaaagaaauugguuuuauucuuuaacuacuugggucauuuauguagggaagguuugcuuguuuguauguauuuuguuuucuccaacaacauaauuuucuauaauggcagaaaacaguacaacauucaguuauuauaaauuauuaagcuggcugggugugguggcucacgccuguaaucccagcacuuugggaggccaaggcggguggaucacgaggucaggagaucaagaccauccuggcuaacacggugaaaccccaucucuacuaaaaauacaaaaaauuagccagguaugauggcgggcaccuguagucccagcuacucgggaggcugaggcaggagaauggagugaaccugggaggcggagcuugcagugagccgagauggcgccaccgcacuccagccugggugacagaacgagacuccaucucaaaaacaaaaaauaaaaacaaaaaauaaaaaaaaauaaauaaauuauuaagccuuucugagaccaacaggacuaugguaaaugauuagggcugcccugggccaggcauucuccacuuauuugcgaacaaccuuaauuucacuuccagcugcagggacauucuggccugugucuccuagguaucugggugagauuuucuaggaugaauuccuagcaauggaaugcugggucauaucuccaucuuguaguuuuugcccugguucgaugagaaggauuggacguagauuauucuccaggacuuagguuuuguguggacuaguggguuacuggguguuaaucacauuuaaaaaauaaauuaauuaacugaguaauucacaaaauaacaaaggaccauaauggcuccauaaugccaggguguuguaaucuaacaauuauacuucaucuaccuccacaugacugagcuacaaaggaaaagaagaaauagaaaucauauugauguccuguuuguaauccugaaguuggguacuuaguuggagcgacacaggcaacccaccuaaggcauggcuuuucucccaacuuggaaaacuugucuuaugucccccacuuagcuuuccaaagggggucuauacguuuuccucccacuggcggugguugaggguucuggguacacuguauccuugccaguguuugggauuguuuucucauuccuucugcauccaucugagucucucauauucaggggugacuuuaccuuucucccuuuaauguguccagguaucugucauuccaggcaagagcuggagaaaugaacucuuagaaacaagagcacuuaccccacagucaaagcaguugaaggaagaguggaaguaaggccgcgucccaagcccguacauuuuuauaaacauuucggacauaaagaguccuaagaaaaugaauucugcauagucuagaagggagaaggaggaaacagagaggagguuaggcuugcugaggguagggguuccagguggcucugacuuuccuuuuauuaucauuuuuaaacuuuuuauuuuuuguagagaugaggucuugcuaugcuguuaggcugguuucaaacuccuggccucaaacaguuucccugauuuggccuccaacaugcuagaacuacaggcaugugucaccacacccaacuucugacuuaucuuuuuucuuuuuaaaauuuuuauguggagaugggggucucacuauguugcccuggcuggucuugaacuccuggccucaagugauccucccagcacagccucccaaagugcugggauuauauacaugacccacuguggccacgcccuguccaagguguccuucccaugggccucaguuuccccucuguuaaaaaggaagagcuggcugggcaugguggcucacgucuguaaucccagcacuuugggaggccuaggcggucagaucaacugaggucaggaguuugagaccagccuggcuaacauggcaaaccccgccucuacuaaaaauacaaaaauuagccaguguggugacacaugccuguaaacccagcuacuugggaggcugaggcaugagaaucacuuaaaccugggagguggagguugcagugagccaagauugggccacccuacuguagccugggugacagagcaagaccuugucuaaaaaaaaaaaaaaaaaaaaaaagcaacaauuaugcccuacccuccaaccaacaagcuaaccaaccuuaggccgauuuuaaaaggaaugagaaaaauaucagugggucuccaucuuguaguuuuugcccugguucgaugagaaggaucggauauagauuauugccaaggacuuuuguguugacugguggguuccuggguguuuaucacauuuaaaaaauaaacuaauuaacugaauaauucacauaauaacaauggaccauaacggccccauaaugccagggugcugugaucuaacaauuauauuuaaucuacuucuacgugacugagcuccaaaggauaaaaggaaauagaaaucauaaugauauccuauuuguaauccugaaguuaaguacuuaguuggagcgacacaggcaacccaccuaagguauggcuuuucuccuaacucagaaaacuugucuuauguccccuagaaauccuguguugugagugaccuaaaaagucuugaguaagacaaagccuuuuguucuuugaugagcaagcauaaaauugcaaaugccucagggagggguaaaacauggauaugcauuugcuccagcaaauaaauggcugacaucagauccuuuucugagagggcuuucuugguaggguaggaagaugaggaguuaggaagggcguggguacuuaauggauagaaaggagagaugaggaggguuucugaggagcagaaagcauacagaaaggaaagagacagaggacugaaacuaacuuccaugaauuucauauagcuaauuaaggccacaaagcuaauuguguuuggugguugugaugguuuaaauguuuguguccccuccaaaauucacguugaaacuuaauugccaauguaacaguauuaagagguggggccuucaggaggugauuaagucauuacgguagagcucucaugaaugggauuaggugcccuuauaaaagagguugacagaggaaguuugucccucuugcuccuccaccuucugccauguaaggacccaguguuccucccuuccagaggauacaguguucaaggugcaaucuuggaagcagagaguagcuuucgccagacagggaaaccugccaaugccuugaucuugggcuucccagccuccagaacugugagaaaauaaauuucuguucuuaucaaauuacccagucucggguaauuuguuauagcaguacaaaugaacuaagauauuugccaaggguguuugcuaugucaugcuuuuaagagguguuuugaacugaccgucaaaguccuucacaguauuuaucaccaaaauuucuccuuauuuauaggacgcuaaggagaucuuagugucugaggggaacucuaggguuccuaggaccaaaauaucagcagaggaagucuguuuguaacaucugacacauuccuagacccaccagaaguaacucugggaggacugaagaguuucugagaucuuguuccucaguuaccauggaaacaugauagcaggugaugcacaagacuugaaagaauuacuuauccuuagcauuguugcaucuggaagaacuuucaggaccaucaaauccgguuucuaccacauagauguggagucugagauccagagaaacaacuacacuucacugaugccaagauauacauuuuuguuuauauuuugacaucucugaaauuaauguguaucuuuuuuuuuuuuuuuuuuuuuuugagauggcgucuagcucuguugcccaggcuagagugcaguggcaugaucugggcucacugcaaccucugccucccagguucaagcgauucuccugccucagccucccaaguagcugggauuacaggcgcccgccaucaugccaagcuaaugugugauccugggcaaucuacuuaaccucucugugucucaguuuucucaaagggaaagugggaaugaguaaaggaccuuuauagacacugaggacccaggcaggaagucucagucccuuguuccugaaccaggacagacuguacaagaugauuaguagagagaauauaggagauuaaaaauagaguauuagaggaaguuaaaacacgaaguagaguccucauuuauaagagacuccagagggacuaaaaacaauuacuaaguuugaaacuaggucagggcccugggaaggagaacugguuccugagggguguccuggggggucagccaacgugacugggaacaaggaggguuauaagaagacaauggccuggacuaggcucacgggccuuucuaggucaaagacuagacugucucuucuugcuguccuaagucaauucugaaccaggucagaaggucagugaauaaauuagacagccaguaggcaaaagacguuuugagaaguccuuacuuggggccugugagccaaagccagggcauccaccugccccccucacugcccaaucacuacucuuuauuuuauuuuauuuuauuuuacuuuauuuuuugagacagacacucucucuguugcucaggcuggagugcaguggcaugaucuuggcucacugcaaccucugccuccuggauucaagcaguucuagugccucagccuccugaguagcugggauuacaggugugcaccaucacaucuggcuaauuuuuguauuuuuuguaaagacaggguuucaccauauuggccaggcuggucuugaacuccuggccucaagugauccacccaccucagccucccaaaaugcugggauuacaggugugagccaccaugccuggccccagucgcugcucuuguugauuccucgagcucuuuacuuuuuaaauccugcucagacaucuccccaucuuuugcugcuuuuccucacccucacuuggcccucaauuuugauacuaucucaugcuaacucacauagaaucugggaauaggcccagagggcaaagccuuagugggccuuguaccuugagggagcaaaacgcucucgcagauacuggaggggauguucuaugaaugaauaaggaagccaaaaagggcaggggaggaaguauuagguuggugcaaaaguaacugugguuaaaaaaaaaaaaaaaaaaggcaaaaaacgcaauuaauuuugcaccaaccuaacaggaaagaagcagaagguuugaaagaagagagaaguagagucagaaauaaguagagaaaaugagggcaacauauaagccacuccuuauuucuaaggcauccucucuuaaccauaaguuaugaacauuuccagagauguacauaaaaauuauuaauacauguauguuucuguuucuaucugucuaucuuaugagcuccgucuuucucugucucucuuccaacauccccuucaccagcaccccucugucccucucucuuagaaaggaaucacaggagcauuuguuggucugaauuccagcuuccagcucucaggucuaagggagauggguuccauugucauagcaacaguaacauuggccccagugacaguuauagaaauggcuaaaggaaagggcagauucaaugaggaccaaagaagauacacauacuaccagagaaagagaaguggaaaaagggugugagggagggaucagggaguuggcagggguggggcugggugauacucacaaaggaagucggagagccacucgggcugguuguagugaacaauagcaacacacagcguguugagagcuaccaaacugaguacaguccaguagaaggccugaguuuugaccaugcggcggauguagaaacgcauccuccucuccuuuuugugaaaaaaggucgaguucuccagcuuggcacuuuuaaugcuggcucgggcgaagggagaaccugccagggaaaagauggagaaugucaggcucaggcuguuccuucagaagaaauuaaccaaugugcagcccaagcacagauuuuagccaggggauccauuagucucuccagcaagccucuggccugagggaaccaucaugacccaugggcuuaguuuugcauagauggagcuuaugagaagacagugccccugaaaaauaacagaauuagaaguaaccaauugaugggaaggcugauaguucucuguugcaggagccaauuuuccaugucucccacucccagccacaucugaugccucugggagucacaccacagggcaggauaaagcagagccuccauucccugaugcaggggcaggcaacagagcugcauggagcacgcuuggaaggccuccagaaagagauguggaugagacuguuuuccauggacauuuaacuuuagaagugaucacugaggaauaagcuggguguguccucugccuacauauaguuuugcucuuaugcauuuauugaguaccuauuuugugccaggcucuguuccaggggcucaggauacauuaggcaacagagccuggacuuccggggucugacccucuaaggggaggagacagacaguggacguaauaaguaaauuaacagugggauggaaaaugaaaagugcuaugggaaaaaaaaaguugggaugggugcaguggcacaugccucuaaucccaguacuuugggaagcuggaaugggaggacuguaugaggccaggaguuugacaccagccugggcaacacagcgagacaaguucuuuuaaauaacaauuuuuuuuuuaagagaaaaaguaaagcaucacagagggacugggagcccuuggagaguccacaggguaggcugcaacauuaaauugcauggucaaggugaguguguugacuugucacuuuaguaucuuagguagaggaaacagcaaauuuaagguccugaagcaugaaugugucugcccgacauuuuuggggaagagcacaaggaagucaguguggcuggaguggagugguugaggggaaaagaggaagguggugaaggcagggaggugacaggcagaucaugcauggccugguggaccacaaggaggacuuuggcuuuuacccugagugaggggggagccguggaggguucugaguagaggagggauggaaccugauuuggguguucacaggcacccucuggcugccgagugggagaguagacagugagaggugaggacgggagcugggagaccaggcuggaggugacugaacccauccaggcaagugaugaugaugauggaugggggcuggaguugggugguaguuaagcggggaggauuugggaugaaucauuuaagacagauucaacauuugcugauggaacgguguggauguaagagagagggaugagccaaggugaaugaaugauguacauacaaaggaauggaugaauuggugaaccccuuaagggauggagcucucauccacugaaugggcacagguuuaggggaaggucagagcucaguuuuggacagauugaauuuaccuucuaaaauacaucuuuuuuuuuuuuuuuugagacaggaucuugcuuuguugcccaggcuggaaugcaguggcuugauccuagcucacugcagccuugaacuccuggguucaagcgauccucccaccucagccucccaaguagcuaugacuacaggcacguaccaccaugcccgcuuaauuaaaacaauuuuguuuuugguagcaaugaggucucccuguguugcccaggcuggucuugaacuccuggguucaagcgauccucccgccucagcgucccuaagcauugggauuccagcaugaauuaccaugcccaggcuuaagauaccuuuucuuauaaacccucaguugcauucauuuuuaaaugguucuucauugauugauucauucauuaguacauucauucauucuuucauccauccauuuguucauuuauucauucauucuuucaucauucuuaaauucauuagcacauucaucauuuauccauuccuuuguguguacaucauucauuugcucauccauucauccauccauucgcucauccauucauccauccauucauuauucauuugcucauuuguuucuccauucauuccuccauuuauccauucacccauacauccauccagcacguuuaucaaaaccaccccacuugccagacacaggacacagcaaacaccuccaaggaggccacuuccuaucagcaaaauucucaacagagauuuugaguuggcacccuaggggccauaccgacucauacuggguuugugaaagcugaaauuauugguccacauuuaaaaacugggagauuuuccaugaaaauauggauuucagcuuccccugaaugaaaauaacagcugacguuuauggaacauuuagcaggcaccaggcacugcagggaacauguuuuauacgacaagcuacuuacuccugcucagagcccuaggaaguagggaccagcgucauccccauuuuacagccaaggaaacaggcugaggggggucuaguaaccagugaagaugugucaagaugguucagagugugugcucugggccgccacauugcacaccuggggcauauggucauggggcaggggcacauuccacucggcugcaguuggccaggcccaguggcugugaccugcuuacagggacgccucuccuuucugcaaagacccuuccccucauguccaucaccuucucaaccccaguggcagcuccucaugacccugcccagcauuucuggcccuaguuccugaaacucucaaagauguguccagaucugcaggucuccaaagggcuuggccaaaagaaauaagacccuugggaccuugggggacaggggggauguuccacagaucgagagagagagagagagagagagagagagagagagagaaaccacagcagguagaagguccccagcccccacuccugcuggagccacacugaaaaccuggcuuaaucaccaaccagcagaugaccuugggcaagccaccuugguaaacuggagacaaccacacuuccuaccucaaagggccauccaaaggcauaaaugaauuaauacaucuuagcgugaugcuaagugguaccuuacgauuauuggauauaaaucuucuaguacaaccucaagagcugaaaucaugacuagguucacgugccagccauugagaaaguccuuccugaucacucagccugaagacacauuccccacgacaggcauacccuucacugguaagggagagggaaaugaauauuaauugaacaccuacuaagugcuggaccccaugcuaggcacugucacuucuguuaguugaauuucauacucacuuugucccacguucccuuuuucuauacauuccugucucucguuuuucucuguggucuggaauuauaauugcagacaauuucuagauuuuuaaaaaucacuuucaugagauguuuuauucaacccaauacauccaaaauauuaccauuucaacauggaaucaauaucaagguggauucaaaagauauuuuauacucuuucuuuuguacuaaguauucccagccggacguguuauuaugaaguacauccuaguucagggucagccacauucaagggaucaagagccgguguaacugguaccagucugaaauguucuuuuccuuuuuuuuuuuuuuucuuuuuuuuuugagauagagucucauucugucacccgggcuggagugcaguggcacgaucuuggcucauugcaaccucugccucccaaguucaagugacucuccugccucagccucccaaguagcuggaacuacaggugcccacuaccacguccgaauaauuuuuguauuuuuaguaaagaugguguuuugccauguuggucaggcuggucucgaacuccuaaccucaagugaucugcccgcugcagccucccaaagugcuggcauuacaggcaugagauacugggcguccgggccagucugcaauguucuauggugggggaagggguaugucaccgccaaggauucaucuggugauuucuggcaauuuauauacgcuuaaaauuauauguaaauuguaauacagccauguguggcuuaaugagggagacguguucugagaaaugcauuguuaggcaauuuuguccuugugugagcaucuuaaagugaacuuacauaaaccuagauguuguagccuacuccacacccaggcuacgugguuuguagcuccucggcuacaaaccugcccagcauguuacuguacuuaauacuguaggcaacuguaacaucauaguauuugugugucugaacauaucuaaacauagaaaagguacaguaaaaacacaguauaaaagagaaaaggugguucagcugcauaggguacuuggcaugaauggagcuugcaggacuggaaguugcucuuggugagggagugaguugaguggugagugaaugugaaggccuaggauauuauuguacacuccuguauauauuauaaacacuguaugcucaggcuacaugaaauuuacaaaaaaaaauuuacaaaaaaauaaaguaauuagggccaggugcggugggcucgugcccguaaucccaacacuuugggaggccgagaugggcagaucguaaggucaggaguucgagaccagccuggccaacauggugaaaccccguaucuacuaaaaauacaaaaauuagccgggcaugguggcacacgccuguaaucccagcuacucgggaggcugaggugggaggacggcaugagccugugagguugggguuguagugagcugugaucgugccauugcacuccagccugggugauggagugagacuugucucagaaaaaaaaaaaaaaaaaagaaaucgcauacagaaacacagaaagaagaccauaugacaacagaggcagagacuggaauuaugcaucuaugaacugaggaacaccaaguaucgcuggcagcaccagaaacuaagaaaauaccauggaacagauucuccccuaaaaccuucugagggaacgugguggcucugcugacaccuugauuucaguuuggacuucuggccucuagaacugugagagaagaaauuucuguuguuuuaagccacuggguuugugacauuuuguaauggcaacucugggaacucaauaccacccauauagagccuguguuauuaaaaugauguaaauggauccccguuuccccacauccuugccagcacuuguuaugauuugucuuuuuuuuuuuucuuguaagauggagucucacucugucacccaggcuggagugcaguggcaugacgucugcucacugcaaccuccaccuccuggguuuaagcaauucuccugccucagccuccugaguagcugggacuacaggugugcacuacugcacccagcuaauuuuuguauuuuuaguagagaugggguuucaccauguuggucagccugcuucuccucuuauaaagacagcagucauuggauuuaggacccacccuaauuaaguuugaucucaucuuaacuugauuaccaccugcaaagacccuauuuucauguaaggccacauuugcagguaccagggguuagaacuucaacaaaccucauuugucuuuuugauaauagcuacucuaggcugggcacagugucucacaccuguaaucccagcacuuugggaggccaaggagggcagaucauuugaggucaggaauucaagaccagccugaccaacauagugaaacuaaauacaaaaguuagcugggcaugguggcgugugccuguaauuucaguuacucgggaggcugaggcaggagaaucccuugaacccaggaggcagagguugcagugagcugagaucacaacacugcgcuccagcuugggugacagagugagacucccucucaaaaacaaaacaaaaaacaaaaaacaaacaaacaaacaaaaagauaauagcuacucuaacaggugugaggugauagcuaauggugguuuugauuugcauuucccugaugaugagugauguucagcauuuuauucauauaccuguuggccacuuguaugucuuuucuuuugggauauguauguucagauccuuugcacauuuuuauuuuuuauuuugagacagggucucggucuccuucugucgcccaggguggagugcagugaugcaaugucagcucacugcaaccuccuccucccgggcucaagggaucgucacaucuuagccucccgaguagcugucuuugcccauuuuuaauuggguuguuuucuugcuguugaguuguuugaguuccuuauauauuuuggauauuagcuccuuaucagauguauuguuugcaaacguuuucucacauuccuuagguugucucuuuccucugcugaacgcuuccuuugcugugcacaaauuuuuuaguuugauacgaucccauuuguccauuuuggcuucuguugccugugcuuuugagguccuguccaaaaaaucauucccgagaccaaugccauggagcuuucuccuuauguuuucuuggagcaucuuuaccauuucaggucugacauuuaagucuuuucagaacaucugcacucccacguucacuucagcauuauucacaauagccaaaauauggaagcaaacuaagugucccacaauggaugaauggauaaagaaaaugugguauguauacaaauagaauacuauacagcccuaaaagaaagaaauucuguaaugugugacaacagggacagaacuggaggacauuauacugaguaaaauaagcuggcacagaaagacaauuacaguaugaucucacaugugggagcuuaaaacuaaaaaaaauugaucucauagaaagagcaggaaggugguuccuggaggcugcaggggaggaggagggauugagaaggagaagauguugaucaaaggguauaaguugcaguuagacuggaggaguaaguuuuagugaucuauugcauugcauugcauugcaucgcauuuagugaugcauuaauacauuauuguguauuuauauugcauuauuaauaaauaguaauguguugcauauuucaaaauugcuaagagauuuuuaaugccuuccccacacacaaaaaacggugagguggugaggcgauggauguguuaauuagcaugacugaaucauucuaugauguauacauagauuaaaacaucacacugcacuccauaaacauacacaauuaccauuugucagcugcaaauaaauuaauaaaaaaucaugccuguaaucccagaacuuugggaagccagggcaggaggaucacuugaggccaggaguuugagaccagccugggcaacauagccagaccccaucucaacaacaacaucaacaacaacaacaaauuagcugggugugguggugccuguagucccagcuacuugggaggcuaagcugggaggaucgccugagcccaggagcuccaggcugcagagagcuaugaucauaucacugcacuccagccugagugacagagcaagaaccugccuuuaaaaacaaauaaaaucaucuaaauggggucugguuuuccuaaaaaagcagaguuacaauggcagcuuccauucauaauggaucaacuuuuuuuuguuuuguuuucauaugcuccacauuuuacuuauuuaucauugugcuucuucuucgucuucuucuuccucuucuucuuccucuuccccuuccccuuccuccuccucuucuucuuccccuuccccuuccuccucuucuucuuccccuuccccuucccauuccuccuccuccuccucuucuucuucuuccuucuuccuucuucuucuuuccuccucuucuucuucuucuucuuuuuuuuuuuuuuaauacaggccagguacagugucucacaccuguaaucacaacacucugggaggccaaggugggaggcucauuugaagccaggguuuugagaccagccugggcaacauagcgagaccgugucucuaucaaguauuagcugggcacuguggcaugcgccuguagccucaaaugauccucucaccuuggccuuccaaaacauugggauuauaggcaugagccaccgcaccaggccuguauuauugcauucuuuacagaaauaaauaaaggcucacucuaucacccaggcuggagugcagaucuuggcucacugcaaccuccaucucccagguuaagugaugccucugccucccaaguaguugggauuacaggcgcccgccuccaugcccagccgauuuuuguauauuuauuagagacaaaguuucgccauguuggccaggcuggucucaaacuccuggccucaagccugucuuggcaucccaaagugcugggauuacaggugugagccaccgugcccagccauacuguuauuuuucuuuuuaaaguuauuauucauuuauuuuaaauugacagauacaggcuguaucuauuuauagugcauaacaugauauuuugaccauauguauacacuauggaguggcucaguugagcuaguuaacauaugcauuauuacauaugcuuaucacuuuucucacggugagaaugcuuaaaaccuacucucugagcaauuuucaaguauauaauacauuguuauuaauacagucgccaggcuguacaaaauagaucucuugaacguauuccugcagucuaaaugaaauuugauauccugucaggcgcgguggcuaacaccuguaaucccagcacuuucggaggcugaggugggcagaucacuugaggucaggaguuugagaccagccuggccaacauggugaaaccccaucucuacuaacaguacaaaaauuggcagggcgugguggugugcaccuguagucccagcuacuuggaggcugaggugggagaaucgcuugaaccuggaagguggagguugcagugagccgagaucgcaccacugcacucccaccugggcgacagaguaagacuccaucucaaaaaaaaagaaaaaaaagaaaaaaaaauugauauccuuucagcaacauggcucaacuuuucauguaaaugauucaaguuccuuauuucagcaguaaguucaucaauuaggaaugaaccugcuuuauagugcguuuaucaacugauucaacagcgcaguagaaucaccaauuauauaagacugcaugugggccaggugugguggcucacgccuguaaucccacugcuuugggagguggagguaggaggauuguuugaggccaggaguuugagaccagccuaggcaacauauugagaucccaucucuaguaaaaaauauaaaaaacuuagcugaguguagcaguguacaccuauagucccagcuacuugggaggcugaggugggaggaucacuugaguccagggguuugaggcugcagugagcuaugccugcaccacugcacuccagccugaacaucagagcaagacacugucucaaaaaaaaaaaaaaaaggacugugcauacugugguauaaugugaacgugaacgcaaauaccacauagcucccaccuuacuuugaaauaugcauuacuguauuauuacuuuuuuuuguuuuuuuuuuugagaugaagucucugucacgcaggcuggagugcaggggcaugcuguggcucaccgcagccuugaccuccugggcucaggugauccaccucagccucacgaguagcugggacuacuggcgugugccacaaugcccagcuaauauuugauagagacagggucucacuauguugccuaggcuggucugaaacuccugaccucaaacgauccucccaccucagcuucccaaaauguugggauuacaggcgugagccaccacacccagccuguauuguugcauucuuuacauaaauaaauaaagcuaaaugugauuccuugccagaauccuggaauuccagagaucucuuuugggguggucuagaaaaccacuggcuagauugggggcuccuuucuuugucuuuuugaguaaucaggcugaugagguggguuuugguggauuugccuguagcaaacguggcuaugaaagaacaagccacuggccuggguuuugggucuguuuagaaagcugcaaugucaccugccuuguuaacagaggcggaggcugcagugagccgagauggcaccauugcucuccagccugggugcuagagcaagacuccaucucagaaaaaaaaaaaaaaauuaaaaaaauuaaaaauauauauacauauauauguauaugcagauuuuuuauuuuuuugauggaguuucacucuugaugcccaggcuggagggcaauggcgccaucucagcucacugcagccuccgccucccggguucaagugauuuugugccucagccuccugaguagcugggauuacaggcucacgccaccacacccagcuaauuguugaauuuuuaguacagacacgguuucaccauguuggccaggcuggucuccuacuccugaccuuaagcgaucuacccgccucagccucccaaagugcugggauuacaggcgugagccaccgcgcccggccagcaaaguagauuuuuaagaauguauguuauuuuauuuuuuuaagagacagguucucacucuguugcccacguugcagugcaguggcacaaucauagcucacugcaaccuugaauuccuggguucaagaaauccuccugccuuagcuuccuaaauagaugggacuauaggugugugccauaaugccuggcuaaguuuuucaacauuuuguuuuucagagauggagccuuguuauguugcccaggcuggucuugaacggcugaucuuaggagauccuccugcacuggccucccaaagcagugggauuacaggcgugaaccacuguaccucgucauaaaacagauuuuaaacaauggagguaacguaacacgugagacagacauaauugaucaaauacucaagacaccuacugagcgcuccaauucuugacauuugcuuacaggaaauuaaacagaugcacacacgaguggaagcagaaugaguucuccauuacaaagaaaagcguguuuuggcuggaaauuaaaaaugcaaaugaaaacaagcuuuaagguuucauuacaaacccacuuaacugggaaaggaaauuaaauugguaauauucgauggccuggguggggaauccaugaacauaugcauacuuggcagguuuauaaauggguuccauguuuuugaaacucagaauggcucuuugaauaaugaguugaaaagcuguuaauaucuuugauccuauaauuauccccaaggaaauacgcccaaaggguggggggagucauuguacguaaaugugcacagcaguguucuucguaagagaaauuauuggaaacaacucaaacacccuauaauagagcuauggcuaaacaaaccauaguguauccacccuacgagauaugugaucgcaauggaaauuaugccuaaacucagcaauaagguuauaaacuaggggcgagcgauaaaaggggaauacgaaauaguggaucagaaacuauggaucagaaacacauggauguacuaacuucccuccuuccuucacuucucucccuccuucucuuccucccuuccucuuucucuugccauccuuucuuccucuaaacugcggccacacaguuucccaagcagccuaaauuccuucuccccucaaucuuauuccagucuuauuuccucugccuggaugcucuuccuuccauuaaaaacaaaaacccauuaaagaacaacaacaacaauaacaauacauucucacuuuagaaggucaaaaucaacaucaucacagccaaugaaucaauaggacagaggagugagaagggaaagaauaaauguucccuccucccucgaacucuggcccuugugguggcaaaggucugagcccugccucucacacuguuccuucugcuaucaccaccacagugaucuccuacccauccuucaguucccagcuuaaccgucacuuccuccagguagccuucccugacugcuccccauccuucuagagcaagcuaagcccagagccucucccugaagugccauuaccauuacagguuuauuuguguaauucucuguuuaauuucuauuuccugcacuggacugugagcuccauguagguagggauuugguuugugucuuuuuuuuuuuuuuuuuuuugagacaggaucuugcucuguugcccaggcuggagggcagugaugagaucucagcucacugcaaccucugcuucccagguucaagugaugcucccgccucagccuccagaguagcuggaacuacaggcuaauuuuuuucguauuuuuaguagagccaggguuucaccauguuggccaggcuggucucgaacucccgacaucaggugauccgcucaucucagcuucccaaaguguugggauuacaggcgugagccacugugccuggcucaguuugugucuuuuuuuuuuuuucugugcccaggcuggagugcaguaacacaauaauggcuuauugcagccuccacuucccaggcucaagugauccucccagcucagccucgugacugccuugucuuguuugcaaccaagcaccuaauauaagcaggucccccaugaauacuucccgaaugagucacaaacauucaccaacuugacugggagcuucgucccugccaggugcugguuugccaugcuucauggggaucauuuaguugaauucccacaaaauaaugagaagcuaggcacggauguuauucccauaaugauguaaucugcccaggacacacgcacaggugggaaaggguggagcugagacccaaauccaggcagcacgguuugcaagcccucugcccccaccccaccaugucucuugggcgauaggugaugaacaacugauagguggcagaggaagggacucacccacagaggcuauaucagccagcugauccucagccucuucgggguugagcaaaucugucuugcuuuucuuuauggugguucuccgcagagcuccaacaauggaaacauggcaagagaaaaagacguuacccuuuuugcaacacagaccauauggacacaguguguccuuggauuuaacucucacggcaacuguucucacgggaacuaauaguauacccauuuuucagauguguaaacugagguucaagguggcacuaucacuuugcuuaaagggguaaagacaagaaucaagucggguucaguccgacuccaggucugggcccucagccacuauuuuccuucugguuuauuuauuuauuuguuuauuuauuuugagacagaaucuugcucugucacccagagaguggugugaucuuggcuuacugcaaccucugccuccugaguucaagcgauucuccucccucagccuccugaguagcugagacuacaggcaugcaccaccacgccuggcuaauuuuuguauuauuaguagagaugggguuuugccauguuggccaggcuggucaaacucuugaccucaagugauuugccugccuuggccuccaaaagugcuaggauuacaggcgugagccgccccacucagccucuauuuuuaaauucuaagaaaccucacuuucuuaugaaaacaguccaccccuugaccuguagcauacucgcuaggcaggcugcaauuuugggauucugcccccauauucaagcuauacaccccaggggcuccacagcagacaaguucagguguagacuuccaauaaaaagauuuagguacccuaaaugaguuagauuaccuaacucauuuaggggaguuagguaaucuccccuccccaacuaagauaauaaaauucauuuuauaaccuucugggacgcagugccaguucuuuuauuucccucaaaucucucagauuuuuaaucaaaagucaucacccugucuaaccagcuuucuuucuuuuuuuugagacagagucuugcucugucgccuaggcuggagugcaguggugugaucucggcucaccgcaacuuccgucucccagguucaagcaauucucguaguuuagccuccugaguagcugggauuacaggcgugugccaugacaccuagcuaauuuuuguauuuuuaguagagaugggguuucgccaugauggccaggccggucuugaacuccuggccucaagugauccacccgccuuggccucccaaagugcugggauuacaggcaugagccaccacgcccagccccugucuaaccaguuuucuaaaguaugagaagauaaaucucaagcaagaaguugcauuuuucagggaguacuauuauuuuucuuauugcuguuauuauuauauugcagacauauuauucuggccuaucucuaaauucuuuuuuuuucuuuugaaacagggucucacucugucacccaggcuggaguggaguggugcccacugcaaccucgaccucuugggcucaagugauccucccaccucagccuccugaguagcugggaccauaggugcgugugcccccacaucuggcuaaguuuauuuuuuguagagacggaaccucauuauguugcccaggcuggucuugaacucccaggcucaaguguuccuccugucuuggccucccaaaguguugggauuacagaugugagccacagacagaccgcauccaacccuaucucuaaauucuaggaaacuuuacuuucaugaagccucagguuggauacacagugacucuuacagucuguccccugacucccagcuaugcuggggagguugggcuuuuggacaccuuuuuaauggucccuccuuucauauucagguuuccaggggaccaugaauugacaucuacacucccagcauuuugggaggccaaggugugcagaucauuugaggcaaggaguucaagaccagcccggccaacauggcgaaaccccaucucuaucaacaauauaaaaauuagccaggcaugguggcucaugcuuguaaucucagcuucucaugaggcugaggcagagaauugcuugaaccugggagccagagguugcagugaggugagaucgugugacugcacuccagccugggugacagagcgagacucugucucaauuaaaaaaaaaagaaaagaaagaaagucaugguucugucucguuaaguuucuaacaugggagacagcagccguucacaguaaacuggauuauugguggaauuauuacuuauuuagcaaacagaaacgugcugaccccaugccaggcacuaucccagguguucuauuugccauaacgaauaucauucugagaaacaaucucgugagcuaggguauuguuuauaucauacccauuuugcagaugagaaaaaccaaggcacaaagcagaaaaaaccagguccaugguuaaaacaaaaaaguggaggccagaauagggaaacucugcauggaaguccuaaaauuccuccaagaggaacgucuacccucugcaagauccuuagaaccagucaccugcucucccccgacuccccaccacagcuucucccuucuccccugggacccaccccugagguggguuuagagcaguuaccaucaaagggaugccucugcuccccgucaguuucauccucggcgaggaucaccucuucugaagaggaagagcacagaguuaagcuccugcauuuggaggaugaguucucccuuggaccaggaagaagggucugcccggccacccccauucucugcugacugauggugacagcucaaccgaccaaaaaacaugcugcugggugguuugugacuucaagccccaccuccgcaacaguagcaauagccaacauucuccccaccucgcgcaaaauaaaaaccaauguccacaccacagccuauaagccccugcuugaucugaucuccaucaccuuccugucuuccucuccuccagcuguccccaccucucacucuguuucagcugcacuggcuuccuugcugugucucaaauacguuccuagcucagggccuuugcacuugcugucucugccuggaaugccccuucccuugacauccccacagcuuccuucuucacguccuucaggucucucugcucagaggguacuuccuuagagaagccuucccugaccacccugccucuaacuuccuacucuuuuuuuuuucucugacacagagucucacucuguugcccaggcuggagugcaguggugcgaccucagcucacuguaaccucugccuccuggguucaagcaauucuccugccucagccucccgaguagcugggauuacaggcgugcgccaccaugccuggcuaauuuuuguauuuuuaguagagacaggguuucaccauguuggccaggcuggucucgaaugccugaccucaggaaaucugcccgccuuagccucccaaagugcugggauuacaggcgugagccaccgcgcccggccaacuuccuacucuguuuuaucuuccuagucuguuuuaucuuccuucucugaauuugggaguucccaacaugacauguauuuguuugcuuuaucucucucauuagaauaucagagcucugagggcagggauuugguguguauuguuuacucccauauccucagugcuuagaucagugccuggcacacagcaggugcucccuaaauguuuguuaaauggcugaacaaauaaauaugugccuaccguguaucaggcacuucucuccccaagugacucagcugagauuauuuuacuaaauacuccaauaguacuaugacuuaggcacuaccaucgccuccauguaacagcugaggaaacggagguacagggauguguggugcauggguaaaaaguggcagggccgggauguaaaccagcgucugauuucagaauucaaguuacgugaugucagauccuggcuucaucuuagacuucuucauaucagacucuggauucuuguugauaaaauuugggacuaccaauucagguucucuuucuccucccaucauaacccucccagcuuagccuucuccaaacugcaugacucucuuuguacuccguggccugggaucuccaucccugggccccaggaugaaagggccucaccugcuuuugagauccacuccauguacccauugagcucacguucaaucuguuguugccgccucagcuucagaaaagcccgccgguucuccacccguucccuuucuuuggcaaacucccuggagaagcauagaaaagccagaguauggcuguuuugaaaauguuaggaaacguuuguguguguguuuguguguguguguguguguguguguguguguuuguguguguguguguguuuggggauucagaagucccuggaggucaggaguuuucaacaggaggagucaggacuucugggaaaagacugggauauuauagugaugggugcuucugccagcuucacacauuucccgacaacugugccuagguaaagaaaaaggccaggcacaguggcucaugucuguaaucccagcacuuugugaggcugagaugggaguaucauuuaaggccaggaauuugagaccagccuggacaacacagugggccccaucucuaugaaaaauaaaaaauguagcugggcaugguggcauacacuuguugccuuagcuacucaggaggcugaggcaggaggaucgcuugugccuaggaguucuagguuacagugagcuaugaucgcccccuacacuccagucuggguaauaaagcuagacaccgucucaaaaaaaaacaauaaaaaagaaaaaaaccgaaaggauaaaaccaugccaugccaaccaccacuggcugcauaccucauucucauucucuucauacuuuuggcuaauaauuauuucagcccucuuuuaaguuagaccaauaagccaugaaugaaagauuucugcagcagguuggcuucucugccauaggucccaccucuuccuguuucccuucuuccuuuuccuguuuggaacaugaaguggccauccggagggcgugaggcagccaucuuaagaccaugagguauccacgagauuggaagccucugguaaagaugucagaauggaaagcuggaagaaucugggguugcugauggugccauagagccaccauacaagugcccagacuucuuaugguaagaaaaaugaagcccauuuaugauuaagccaaaaaaaucuuggggauagaggacaauaugggucaggaaaauacaccguuagagcauaugcuaugauuuuauauuuggaaaaugggggagaaguaaacccaaacuauugguuuuuaaaaaaaauguaaagaaaguaaagcccauaugaacccucucacuggguaccccuagcaguacacaaccucugcaccugugcauggcuugcuaauaacagucugguaacccaaacaagggaagaagccuuuucucugucuagugaaugaaaacaaagcuucaauggccucuacuuggaaagaaguuagcaaagaggagugagugggaugggguggggaguagcagaaacuuacccugacagcacacccagcacaagguucagcauaaaaaaggagccgaugaugaugagggggaugaaguacaaccaguuccaaguguucccugaggcaucguugcucuguagggugugaggagggaaagcaggugagaguugacugggacucagauagaaccugacaggugagggaaggggaagcucgguucucuuguggcucugucuuaaauguucuuggcuuguggaguucuggggcucuggcaucccagagggggaaauggaggaacguuuucugaagaaaacauccaaaggguaaagcucucucuuaauuauguucuccucacauaacauaauugaccugggaauggaguaagaaacacaagaggacuucccagaccacaguccagaaggagaaggaaaaaguaaaccaaacaaaacacaaaaccuauugaaauggauuaauuaaucccugguuccuucucuucucccaacacagucauagacuccccuuagaggagaugcaugaccacagagucugauggccuggugaaaucaccaagccagacagaugguccaugagcccuuuccucaagugucucccugcuccauucccugcagccuuaaugccaaucacaaaaaauucucagaaguuucagcucaauuuucaagaggaaaaaaguccacaaauagaauacucucugaaacagaaaauagaacacuauagcaagaaggaaguaagaugaggggaagaaaaucaaggagaggagguugggggguggagagagaaagagagacagagagagagagggagagagagagagagagagagagagagagagagagagagagagagaaaagaaugauaaaagccagcacuuacagaguauuuauggugugcuggcaccuuccuaagcacauuauguauguuagcucacuuagucauuuaauccucaugaugccucuauguuauaaugcccauguuacuauugaggaaacugaggcuuagaaagacaaaaucaucagcccaagaucacagaguuauucacuaguggacaugggauuugcacuaaccaccuggccccagaguccaugggcuuaaccucugugcugggaagccuugccuccagcugucagggcagggguagccuuugaauaguugaucacccugugacaccugcagaaugcagggcucucaaguguggcuuuaaaagcccaccuuuaaaagcauguaugacacugcugcugccuggaagaaaggcuaaaaugagaaagaaguuaagaugaggucauuacuaccaggugucugugaagcuguggagcaacuggaacccucauaaucugccaaugggagggcaccaugcuguauucaucuccuguggcugcuguaacaaggaaccacaaccuagguggcuuaaacaacaaagauuuauugucuuacaguuauagaggccaaaaauccaagcucaaggugucagaagggcugguuccuucugagagcugugagacagaaucuguuuuaugccucucuccuagcuucuggcgguuugcuggcaaucuuugcugauucuuggcuuguagaggcaucauccugagcucugccuuuguuuaaacauggcauucuuccugugagugugccugucucugugccaaaaucuccccuuuuuauauggacaccaucguauuagauuaggacccacccuaaugaucucaucuuaacugcuaugguuggugcaaaaauaacggcaguuuugccaauggcaaaaccuuuacaugugcaaugaaucuauuuccaaauaaggucacauucugagguacuggggguuaggacuucaacauaugaauuuuggggugagacaauaaaacccauaacacaugguacaacuacuugaaaaauugguugagaguuucuaugcuaaaauuaagucaugcuuaacaaugggcauacauucugaaaaaugugucacuaggucauuuuguugugcaaacaucauggaguguacuuacacaaaccuagaugguauagccuacuacacaccuaggcugcauggucucgccuauugcuccuaggcuacaaacccauacagcauguuauucuauggaauacuguaggcaauuguaacucuauaguguaucuaaaaauaucuaaaaacaggccgggugcgguggcucacgccugcaaucccagcacuuugggaggccgaggcgggcagaucaugaggucaggagaucgaggccauccuggcuaacauggugaaaccccgucucuacuaaaaauacaaaaaaaauuagccgggccuggugacgggcgccuguagcuaccugggaggcugaggcaggagaauggcgugaacccagaaggcggagcuugcagugagcggagaucacaccacugcacuccagccugggcaacagagcgagacuucgucucaaaaaaaaaagaaucuaaaaacagaaaagcuauaguaaaaauacuguaugauaaucacuguuauguauucgguccauuaugggaccacuguuacauauuugaucuguuguugaccaaaaugccauugugcaguguauaacuguauguaccuuugccaacacccaguaauucuuggauaguuacugauccaagaucacuacaauuagauaguaauuccgaaauaguaauucugaauaauuacacaacagaaagcacacacaagaacauucauagcaaugguauucaucauagcuccaaauugcaaacaauccacacuguuaucaauaggagagagaggauacaugcaaugaacaaugccacaggucacaugagaucuuaaaaaguuaacgucaagcaaaagaagccagacuucauuuaugcaaaauacaaaacaggcuaaacuggugaaugaugcucaaaguccugguagggguacccuugcggggagguagugacuaggaacaggauaugaggggggcuucuggggcugagaaguuucuguuuccucauuugugugcugguuacauggauguguuuaguuugugacaauuaaucaagcucuucacuuauaauccgcggauuuuucuguauguuuauucuacuucaauucuuaaaaaguuguuuuuuuuugagacggagucuuacucuguugccgaggcuggagugcaguggcaugaucucagcucacugcaaccucugccucccggguucaagcaauucucuugccucagccuccugaguaguugggauuacaggcgcccgccaccaugccuggcuaauuuuuguauuuuuaguagagaugggguuucaccauguuggucaggcuggucuugaacuccucaccuccugaucugccugccuuggccucccaaagugcuguaauuacaggcgugagccacugagcccggcagaaguuuuuuuuuaauagucaacuuuaccuuaaaaagaaagaaaaugcugauacgugcugcaacaugggugaaccuugagggcauuaugcuaugugaaauaaaccagucauaaaagggaaaauccuguaugauuccauuuauaggaggucccuagagucgucagauuuauaaaaacagaaaguagcauggugggugccaagggcugggggagggggaacagggaguucgcguuuaguggggacagaguuacauuuggaagauggaaaaguuugggagauggaugguggugacaguugcacaacaaugugaauguauuauacuuaauuucacgaaacuguauccuuaaaaaugguuaggaugacaacaauauauuaaugguuucaaauagcuagaaggaggagcuugaauguuccuaacagaaagaaacaauaaaggucugagaagauggauaugcuaauuacccugaucugagcacuacgcauuauaugcauugaaacgucacuauguaccccaugaauaaguacaauuacuugucaauuaaaaaauguuacaaaguuaaaaaaaauauuaggaugguaaauuuuaugucauguguguuuugccauggauuaaaaaaaaaaaaaagcacugaaaauaaaacuaacaaagucagcuuuaaucauggacacagacagguucuggggacaaugaaugugccagccaccagcccacauccuuguuuuaacgagcucagaaaugccaaugcuuugcuucuggaagguucuggaagaaagaaccgagucagcggaacauugcuggacagaaggcagcacuggcuuugugcuccucucuccaucacuuuggcggcugaggguucucguucccauuucucagggcuaaauauagcccagggaacgaaacucugcaccggccgccaguagggagacucugagccaucacgaggagcaggcucagaugacagggacaggguggaggaugggggagagggacaggacugaaagggaaaaacagccgaggcccuuccauaccaaggcagcccguccaucucaggugcugccaacaagacccgaaucugcccuugccuggguccucgacaagcuugggaaccucuggccacaggacaugcuacccagcaccacaacagacacacguggaggcuuggacuguuugagcucauuuaauccucucaugaaccccaggaguggguauauaauuauccccauccucccgggugagaaagcugaggcacagagaggucuauuuuuuuuuuuuuuuuuuuugagauggagucucacucugucacccaggcuggagugcaauggcacuaucuuggcucacugcaaccucuacauccuggguucaagcaauucuccugccucacccucccaaguaguugggauuacaggugcuugcuaccaugcccagcuaauuuuucuauuuuuaguagaggcgggguuugaccauguuggccaggcuggucucgaacucccgaccucaggcgauccacucaccucggccucccaaagugcugggauuacaggugugagccaucacgccuggccgagaggucaaguuacaugcccacaguucuguuguggguugcagugggucucuccaaaaagaugcauugaagaaguccuaaucccugguaccuaugaauuggaaauagggucuuugcagauggaaucaaguuaagaucaggucauuaggguggaaccucauccuaaaugacggguuuccuuauaaaaagaggacaucugggcagagcacaguggcucacaucugcagucccagcuacucaggaggcugagguaggaggauugcuugaggccaggaguuugaggcuguagugagcuaugaucgcaccacugcacuccagccugggagacagagcaagacccugugucuaaaauaaagaaacaaacaaacaaauaaguaaauaauaagaaaaggagaaaccugggcacagagacaaccuugcacagagggagaaggccaugugaaauggagaugaaggcgggaucagggugauacgucuacaagacaaggaccaccaagcacuguuggcaaaccaccagaagcuaggagggaggcaagaagggauuucagaccaagucucaggaggcaccauggcccagcugacaucuugauggucuguggcccagcugaccuugauggucuguggacuccuggccuccugaacugcgagagaauaaauaaauuucuguuguuuucagcuacucuauuugugguucuuugugguucaagcuacaggaaauaaaugaaguuacucaguuacugaauggcagagggggccuccaacccucccaucuccuugcuuuuaucuccuccccuuuucccucgcucauucgguuccagccaccuggcuuccuugcaguuucucaaccacgccaagcacaguccuaccucggcccuugcacaggcugucccucccugccuggaaugcucuuuccugagauugcuacaugguuuccccucaccuccuucagguuuuuuacucaaaugccaccuucugagggaggccuccccugauggcccuuuacaauugcaccccucauuucugguccccauuguuucuuuuuucccauuugcauuucaccgccuauauacuuuacuuauuucucuuguucucucgucuuccuggcuggaauguccauucgacaagagggaggggcuuuguccuuuuuguucccugcuguauuccuguauucccagcccccuaggacaacaucuggcacacagucggugcucaauaaguggugucuguugaaugacugauugagagguguguccaaguucccugcauagcucagaucgucaaccccaagccaagcucccuccugaacucucaucugcaccauccucucuggggagugggcuucugcugccugauuuuagagacacuuuuucucuuccaaacucauccaauuauucaauuccauacucuggaaucaacaauucccagggaagaaggugguggaaggcugggugcaguuuuggauuaggagaugagcuuucccugguuuggggguggggguggguggauuucguucaggagcaaaaugaaaaguacauuuuacaagcacaaggacuggagaugccauggcuguucugugguaguucaucagcaaagauggggucacagaucucuucuccugguucucaucucuucuuuggcaguucaaguuaagggagggauaugcacaagucugaauucgggaaggagagugggggaggauggcuugcucauuuguuaaauucauuaauauugggaaggaugugcucuagagaucgccuugucuuucuuccaagggcucaaagacuuccacugccuggaacacuguuccccauuaaugcugccaucaaauauuuccagcaauauggugggaugguccuuccugagucccuuugggguuggcugaggaccacaugcuaagugcuggccaaugaggagugaguggaaauagcugucauuuuggagccagagcauugaacuuucagugugggaccuucuagcauuccuuuuuuccuucuggaauagcaaguggcaauguucuaggugauuagcuaggucucaagugacugcacugaacagagcccccuucuuccccacugccaaccugcacuggacauguagcaugagcaggaaauacaucuguugucaaaagucauggaggcuuuggggauguuuguuacugcagcauaacuuggcugcccugaccaauacaucuuuuuaauuaaauuuuuauauuuuguagagagggggucucuguugcccaggcuggucucgaacuccugggcucaagugauccuccugcuucagccucccaaagugcugggauuucaggcaugagccaccacgcccagccagauugauacaguuugauaucucuguagcuugcuccuucaccucuuucuggucuuucuuucuuuuuuuucuuucuuuuuuuuuuugagauggggucuugcucuguugcccaggcuggagugcaauggugugaucucagcucacugcaaccuccaccuccuggguccaagugauucucugccucagccuccagaguagcugggauuacaggugcccgccaccacaccuagcuaauuuuuguauuuuuuaaaauagagacaagauuucaccuuguuggucaggcuggucuugaacuccugaccucaggugauccacccacuucagccucccaaagugcugggauuacaggcaugagccacugcacccagccuccuucuggucuuucuuaaaugccaacuucugauugacucuuuuauggaucccaugaggcaggugagaaagugucugucucuugcaugucugauggagaacauacauucuucucaucagcacauggacauucuccaagacagaccacauguuaggccacaaaacaacucucaacaaauuuuaaaauacuggaauucugucaagcaucuucucagacuaccgugggauaaaacuagaaaucaauaccaagaagaauuucagaaaugaugcaaauauauggauauuacgcaacaugcuccugaacaaccauugggucaaugcagaaauuaagauggagacuuaaaaaauuuuggaaaugaaugaaaauagagacacaacacaccaacaccugugagaugcagcagaagcagugcugagggaaguuuacacuugaccuuagcuaaagggccaagaagcaacuaagagggaaguuuauagcaucaaauaccuacaucacaaaaaacagaggccagaugugguggcucacgccucucaucccagcacuuuggggggcuaaggcaggaggaucgcuugagcuagggguuugagaccagccugggcaacacagugagaccccaucucuaaaaaauaaaaauaaaaaaauuagcuggguguggugcugugcaccaguagucccagcuacuggggaugcugaagugggagguucacuugagccuaggaggcagagguugcagugagucaagaucaugcugcuguacuccagccugggcaccacagugagacucugucucaaaaaagcaaaaaaaaaaaaaaaaaauuacaaauuaagaacccaacacguaccucaaggagccagaaaagcaagaacaaaccaaacccaaaguuagcagaagaaaagaaaggucaaguucaagaucacaaucagccaauuauuuccauucucugaaccuaugccuggagcaacucugccuuuaggucuuggcuuggccaauuucuucuuaucacucaaccuuagauccauugugcccccaucagagaagccuucuuggaccucucaaucaaaaggacuugccccuuccugcagcucagccagacaucucauucucuucccagcacguuccacugucugaaucaucuugucaacuuaugcauuucaagauugucaucuugaucaucagcuccuccaggguagagauuuuuccugucuaaaucccaguguccagaucagcaccagggacauaguaggugcucacuaagcauuaguugcauagucaauacaaauguuccugggguuccuguugguggaucauuuauuuuauuuauuuauuuauuuauuuauuuauuuauuuagggacagaaucucacucugucgcccagacuggagugugauggcacgaucuaggcucacugcaaccucugccucccagguucaagugauucuugugccucggccucccaaguagcugggauuacaggcacgcaccaccacgcucagcuaauuuuuuuguauuuuuuuaguaaagaugggguuucgccauguuggccaggcuggucuugaacuccugggcucaagcaauccgcccuccucagccucccaaagaguugggauuacaggggugagccaccaugcccagcuugguggaucauuuaaauaauaaacacaggaaauguguuuaucccaaauccaaaugauuaagcuauuuuucugggaaaggagaggcagaaggcagaauuauggucgcauuagccaagucuuuuugggcugaugaaauacuccccacaucuuccucgauucccgccaucucugugccugguggauggagaaacugaagcugagagaggcaacaugaugugccuggaucacacagggugcagauggcaugggugggacuagacccgucauucuggccuuuacaaccaacugauuuuuucccacuucaccccuucuccguacuugcauaguauuuuaaguaaauaacaaugggcccaagagagcuucaagggugagggauguuacugauucaucccaguaucgcugguggugccuggugcuuagaaagcgcuccauaaauacucaucaaacaaacuaauggcugagucccagcaaaauccuucagugccuucuguuuuaugguuuauuuuccucuaauuuuuuugagcaugguucauugagaaaaaguauacaggauguuaaaaaaacaaaaacaaaacaaaacaaaaggaaaaaaccccaaaacucagcucaggagaacacccguuucuccaguauaugggauaaacauggggguggauuugagugugaaaaagcugaagucugacagugaccgugagagaggcugugugucccacuuuauacccguuauagaucaugccaggccugcuaauuauuuuuucagugcucuuuuuccccuuucacucucaaaacuguccugguuuggaucauaaauuauauaggcugucuguucacgaagucuuuuuuuuuuuuuuuuuuuuuuugagacagagucucgcucugucaccuaggcuggagugcaguggggugaucucaacucacugcaaccuccaucuccuggguucaagcgauucucgagucucagucucccaaguagcugagaguacacgcgugcaugaccacgccuggcuaacuuuuuuguauuuuuuaguagagacgggguuucgccauguuggccaggcuggucuggaacucuugaccuugugauccacccgccuuggccucccaaagugcugggauuacaggcgggagccaccaugccuggcugauccaugaaguauuuuaucaucuuccuucaucagcuccuuccuucauccucacucacuccccacuggacaucugggcagcuacauguccucacaaaugccaggaacauccugccucaggaccuuugcacuggcuguuccaucuaccucggcugcuguucccugagauaucuccauggcucccuucaucuccuucaugucuuucaaaaagccucaagcaauugcuggccucaaacuauccucuccugccucagccucccaaagugcugggauuacaagugugagccaucacacccagccagggacauacauuaaugaucacuaacuaaacauaguuuuguugcuuuauuaauugacauucaccaagggagagaaggagagaaauguuuauuuauuaaggaaaauuuuuaauugauuauauauauauauauauauauauauauauauauauauauauauauauauauuuuuuuuuuuuuuuuuuuuuuuuuuuuuuugagacagagucuugcucuguuguccaggcuggagugcaguggcacgaucucggcuaacuguaaccucugucuccuggguucaagcaauucuugugccucagccucccaaguagcugggacuacaggcgccugccaccaugcccagcuaauuuuuuguauuuuaguagagacgggguuucaccauguagccuaggguggucuugcacuccugagcucaggcaaucugccugccuuggccucccaaugugcuaggauuacaggcaugagccaccgugccaggcugauagauguauauauuuuuuggauacaugugauacuuuaaugcauucauaugauuuguuccuucaggucuguuuuuuuuguuuuuuuguuuuuuuuuuuugagacaguucuugcucugucauccgggcuggagugcaguggcaugaucggcucacugcagccccaaccucccaggcucaagcaguccucccaucucagccucucaaguagcugggccuacaggcaugcuccaccauguccagcuaauuuuuaaauuuuuuuuuuuguagagauggggucucacuaugugccuaggcuggucuuaaacucuagggcucaagggauccuccugccucagccucccaaaguguuagaauuauagaucauaauggccacggugcccggccauucgggguguauaagaagaacugcaaccucucaucuugacaaugcacaaacucucuacuguuuuauucuaucccggaccucucaccacccucuaacacuaucucuaaggcagugauccacaaacuacagcccgcgggccagccaccuguuuuuauagguuaacguuuaauuggcccacagccaugcucauucacuuacgcgcuuuaucugucguuacuuucacgcuacaggagcagauugagucguugcgauggagaccaucuggcccacaaagccuaaacuauuuaaugucugcugucugcccuuuuuaucccaacugaucacuggcuuuccccaccaacacgucaacuccucuguguccagaagagugucugcauacaguaggcauucaaugaugguuguugaaugaaccagugauuuauaguccaaagucuaaugcuuugauuuuggucaagacaaacaucuaugaaugaaaaagggcaugggucaaaggugauuccaaacauuagcaaccacuggccaggggacacgcauuuauuuauuuauuuauuuuuaauuauuagguuuuuuuugagacagggucugguucugucacccaggcuggagugcagggguguaaucacagcucggugcagcuucaaacccuugggcucaggcaauccuccuuccucagccucccgaguagcugggacuacagguacacaccaccaugcccagcuaauuaauuauuuuucuuuuuuaaagauggggucuugcuuuuugaccaggcugguuuugaacucccggucucaagcaaucuuccugccucagcuucucaaagggcugggauuccaggcgugagccaccacgccuggccagggacaugcauuuaugaucacaaauuaaacgcaguuuuucugcuuuucuaauugacauucaccaaaggagagaaauagagaagaagagaaacucacagagaaaagcacaaagaagggugaggagaagggagagaaggagaaggagguggagaaagagaaggaagagagagagagaacacaagaauaaaagagacaaaggcugggcaugguggcucaugccuguaauaccagcacuuugggaggccaaggcaggcagaucacuugaggucaggagcucgagaccagcccggccaacauguugaaacccagucucuguuaaaaauacaaaaaauuggcaggcacaguggcucacgccuguaaucccggcacuuugggaggccaaggcgggcgaaucaugagcucaggagaucgagaccauccuggccaacauggugaaaccccgucuuuacuaaaauacaaaaaauuagcugggcguguuggugcaugccuguagucccagcuacucaggaggcugaggcaggggaaucacuugaaccugggagucagaggcugcagugagccgagaucacgccacuguacuccagccuggcgacagagcaagacuccaucucaaaacaaaacaaaaccccccaaaauuagcugggugugguggcacgcaccuguaaucccagcuacuugggagguugaggcacaagaaucgcuugaacccaggagauggagguuguagugagccgagauugcgccacugcacucuagccugggugacagagugagacgcugucucaaaaaaaaaaaaaaaaaaaaagagagacaaagagagagagggaaaaagaaagagucagagagagacggaugaagggugaugaauuguguccagagcugugugugaacccuggcuuugucacucuuggcuaggggaccuuggcaggucacgucacccugugggccuccguuuccucaucuggaagaugggguuaaaaauaucuuuccucacagggcuguuuuacggaucaagacacaauguaaagcugaugccaggcacacagaagcccucggcuaaaggcagccccaaauuaacucaagacacccugguccugccagguccccagccccuccacauccccuccuugggggcaaccaagagaggguagguccuguaccccaugaagugaccccaauuugccuuggcccagcuggcaaagagggggucagggaccuuccccugugagaguggagacaauuucuggcuuuucugagccacauggggcacauagggugagggggucccugugaaaugaggccaccugucacuagaacaacacagagccaccagcucuugucuccagcaaacaguuuuguugcaguacucaugggguuccccauucuauccccuugagcucagagaagcagcccucaauccuauuugcugugggaggcuauaaauggcagaaucugaggauguugacacugagugagacagagcugaauucugacucucaaucgcugugcacagcucugggacucaguuucuucaucuguaaaauggggauauuaaaggcccuagcucagagaguuuuauauuuuuaccaucaaggaaucccaggcugaugccuagggaaguagccaaaacaggguggcacagaggaaguggcugaucacccaucuugauuccacaaggcuacccagagccuucucuggcccaggaagguccagggaagaggcccgucuagugggcaugggagccauguggauaccuuggagcuuccaggucaagaacagagaugggcuauguugauggagguuuguuuuguagcaguuagaagugaguuggaccucacuuuuggcacagaauuuccaguaaaccugcauuuguaguccuuggguauggacagaaacucacgccaucccaaagcucuuaggggguagguucaucuugaggcccagccaguaccccaauccuccuuccucugagaggccuggccuccuagagcagagccucucaaccucaguacuacugacauuuugggcuggguaacugguugugaugggggcugagccagacacggauggugagaacuccaguuaccugcuaaacuaucaccucuucugagggguuuucuagccacagugacugcggaaggcacuggcaagauucucucaguuucaccuuggggaggaaacacuuaggggucuguggacagaauucaaggaguucgugaauuuagauagaaaauaauuaccccuuuacuuccucuuacuuucacuggaaguggaacauuuucuuccaugaugauuggagguggcaaaccgcagaaucagugacccccauuaccaacagaaaucacauauaguucacagauaucaugcaaagucuuuuaagcuuaauacucccaugaaaucccaagacuuauccaacccaucgcugggacuuguuguugauguguuaugaagaaucacaucucuuaaacgacaucacaacuccuuaaaaaaaaauucugggcuggucacaguggcucaugccuauaaucccagugacucuggaggcuggggugggaggaucacuagaggccaguagcucgaggacagcgugggcaaugugugagaacaugucucuaccaaaaaaauacaauuagcugggcaugaugguaugugcuuacagcccuagcuauucaggagguugaggugggaggaucgcuugagaccaggaguuugagcugcagugagcuaugauugcaucaucgcacuccagcuuagaagacagagcaaaaccccaaaaaacugggauuaggaguuuuugggaagaacgcuauauaggcauaaaaucaaggguuacauaauauccacaucccugggggauacuaaucuucaucauuugguuaaagugguaucuaucuguuccuccgcuauaaaacuucuauuuuccccuuuaccuacucuauucuucggaaaugagucacuaaauccagcccacucucaaaguaggggagauuagucuccaccuccuggggcaguggggagugaaguuuacauacuuuaaauggaauucuuuuguaagaaagauuugccuguuuuucauuuaucuuguguauuuaauaauaaaauaaaaaugaucauuuauuuacuuauguguuuauuuaagagauggggucuugcuguugcccaggcuggagugcaguggcgggaucauagcucacugcagccuugaacugcugggcucaagcaauccuccugccucagccucccaaguagcuggaacuacagacauggaccaccacacccggcuaauuaaaaaacauuuuuuuugagauguaguuuugcucuuguugcccaggcuggaguguaauggcgugaucucagcucacugcaaccucuguuucccagguucauaugauucuucugccucagccuccugcguagcugggacuacaggcgugugccaccacgccuggcuaauuuuuguauuuuuaguagagacgggguuucacccuguuggccaggcuggucucgaauuccugaccucgugauccacccgccucggccucccaaagugcugggauuacaggcgugagccaccgcaucuggcuaauuaaaaaaaaaaauuuuuuuaagaugagucuugcuguguuucccaggcuggucuugaacuccuugucucaaacaauccucccaccucagcuuccuaaguagcugggauuacagaugugagccaccaaggcuggccauuuauuauugauguaucaaucaaucaaucaaugauuuauuuuagugugacucucucgacagauuauguaagauaaggacaccuaggacacuguuugccuaagaaagguucauucuccucccuuucucccugccuccuggucuaggaaugacccgagaccuucuucuuucuccccgcuaaccauuuagcaagacaaguuuaauuggcucaagccaauuugggaggcugagguugguggaucacuugaacuuacgaguucgagaccagccuggccaacaugaugaaaccccauuuuuacuaaaaauacaaaaaauuagcugaccaugcuggugcaugccuauagucccagcuacuugggaggaagagguaggagaauugcuugaaccccagaggugagccaagugagccaagaucgcaccacugcacuccagccugggcaacagagugagacuccaucucaaaaaaaaaaaaaaaaaguaaacugugaucaucauagagaaauuugaagauacaaagaaguauugagaauaucaagauucccaaaucccaccacccgaaggucagcuugguacaguguccuccaguuuuucuuuacuuauauuuucauauuuguaccuuugagaucauaagguuuaccuccccuugauuccuuuuuaaaaacucauuuuccccucuuaucauuucuucuuuucuagacagggugagcugccacuguucuccaugcugggaaugcuguuuccaaaacaucugccuggcuuccuccuucucugcucaaacaucaccuccucuuaggaacccucccugauuggcugaccuagacuagggaaccaugcaucacuucuucucucgugcagcuuucgcucuguugcccaggcuggagugcaguggcaugaucacagcucacugcaaccuccaccuccugggcucaaucgauuuuccugccucagccucccaaguagcugggauuacaggcgcccgccaccaugccuggcuaauuuuuguauuuuuaguagagaugagguuucgccauguuggccaggcuggucucaaacuccugaccucaggugaucugccugccuuggccucccaaagugcugggauuauaggugugagccaccaugccuggccuccuugaucccuguuuaaaaacuuguuucucccacucaucauuuuuuuuguuuuguuuuuugacaggguuucacucuguugcccaggcuggagugcaguggcgugaucacggcuuauugccaccucugacuccagggcucaagugauccuauccuccugucucagccuccugaguagcugggacuacagauguacgccacuaugccuggcugauuuuuguauuuuuguuuuuuuuuuuuuguagagauuggguuucacuguguugcccaggcuggccucaaacucuugggcucaagugauccacccaucucagacucccaaauugcuggaauuacaggcaugaaccacugcgcccagcacccccacucaucauuauauggugagccuuuccccuguauccuuaauauucucccagcagacgauuuuuaaugaugacauaauaugccaucauacggaaggaccauacgguauuuaacugaucuccuauugucaggcuuucaauugcuuccaguuuuguucuaauuuuguaaauaacucugggaugcauauccugauauaaaccuucaacagcaucgcugauuaguugagcuuagauuucuucaaaaggcauuuaaaccaggaagccaagggagaaaaacaagaaacgaauacaaaaucuggaagggaaucaaacacauccuguaggugagcugccacuguucuccaugcugagaaugcuguuuccaaaacaucugccuggcucccuccuucucugcucaaacaucaccuccucugagaagcccucccugauugccugaccuagacuaaggaaccacccaucacuuguucucuuguguagcuuucguuccuauugggcuucccauaguacauacacauuugcuuagugucuccugcuuucugggugauugauuauuuaucauguuuaccauuugcaucugucucuccuaccaggguggagauuuuagucugucuucuucguugcagugucuccaaucaccuaaucauugccuggcacacaguaggugcucaauaaaugauuacuggauaacugaaaggauguuaagagaauaaauguggugccaggaucuuacaaagggcugccuacccaggugggaagccucugcgguacaccuguguccauggauuccaagaugcuuggagcgacugucuggacucuccguugaucucaacuacuagcuuguucagagcuggguaaauggaguuggcuggcaaggccacacccacuggcuucggcuccagcaccagucauggaggacaaagauuuccagacacucugcuugccuauggccaaacagaucgaggcucauucuaggauagacccagggcagggcuagcccaagggagauggcugggcacgaaggcagaacccaagagugcuccaacguagcagcuguguccuccucagcagaaacucaaagaugggcaccuuagccccugcacccuggcauugacagacgcuacucguuguuuuagggguagagagagggguuaucucacuuugggaagccccagacaagaguucacaugcaagucguuuuauuuaggaggaguuauaaauggaauuacguccuccugcuacacacacaaaaauguuuaaguccuaacccccugguaccucagaaugugaucuuauuuggaaauaggguaauugcagacguaauuaguuaaaauuagguuggacuggaguaggguagguucugauccaauacaacugauguccuucuaagaagaggagaacacacacagacacacgaagggaggaugcuuuucuuuuucuuuuuuuuuuuuuuuuuuuuuuugagacggagucucauucugucacccaggcuggagugcaguggcaugaucuuggcucacugcaaccuccaucucccggguucaagugauucuccugccucagccucccaaguggcugggauuacaggcacccgcccaccacgccuggcuaauuuuuguaucuuuaguagagaugggguuucaccauguuggccaggcuggucucaaacuccugaccucaagugaucugccugccucggccucccaaagugcugggauuacaggcgugagccacugugcccgggcugggaggaugcuauuagaugacagaagacuggaauggagaaugaaggcucuagaagccaaggaaucccaaagauugugggaaaccagcaaaagccaggaagaagcaaagaaggauccucccccggaggcuuuugaggggcguguugucagcucugcuaacaucuugggguuggacuucuggcuuccagaacugucagaccauaaauuccuguuguuuuaagcuacucagucuguggugcuucauuauagcagccccaggaaauaaaucuaaaaguucaucccaggaaauaccagacagggaagggaagguggcaagugaaggguguguacgugaccagguuaacccugcgggcaaccagagccugaucccacuggagagaugcagggcagagcaaaacgcccgacagggagggagcugggguauuuauccacugacuucuccaggcacuggaugggggcugcuccuagggguuguccaugcaggccaggugaucacagcagccccagagagaggcagagagugacagcugauugcaguauaaggcauccccguccucaaggaaccuuggucuucugacccaggguuuccugacagaaaccuuacugacauuugggccuggaucauucucuaugguggggcagaggugggggaugcugugcauuguagaauguugaguagcauccguggccuuuacccacuugaugccaauagcauccuccuucuucccauccaguugugacaaccaaaaaugucugcagccacugccaaguguccccugggggcagaaaucaucccugggcgagaagcuguguucuagguucacauuaaggccaaaucauugcaugggcugcuaaccaaaggacgagggugggauguaaauguguggaaagugcuagaaagcuacucugaguuagugguuaauagcagggccagcgaggggaauaaaguaagaccucucacaccucacuccacuuccucaggcacugcuggagcuguucuaaugaaaaauucaugcacauuucuaaaaggaacaccaugcaggguggggaauuugacuuacacggaggucaccccgggccaggaucaguucuaaacacuucaugcgaauccaccuuacuuaguccucgugccuugugaggugggacuaugcuucucuucguuuugcacauguggaaauaguggcacagagaggccaagcaccuugccgaaggcugcacagcaaggaaguggaagagucggaaggaacccagacaggcugacaccugagucucugcucuuaaccacucaguuuguguccccagagguggcuuagcucuaagcuuagaggcuuccaagggaaacacccauuggacaaugauguuuauaaccgagcccucuggaaauucaugcuuccugucccaccacugggcacgcccccagcaucuuaaucugaacccccagacgcuuucucuggucauccaacccugugacauaucccuuuuuuaugcucacaauuuuuuucagcucccauuccccacucccauucucucccugaguucccagccuucuccauuucccagucucuuucccucucaggaggguucauuuccugcuggaaccuccucucacaccagccuugcaaaguaaaaaccuagaacccacaaaaauuccccagugaguuuuggccaauugggcugacccuuuguccaagcuguuugcaggugacggccaagagagggccugagcucggaucugcugcauguucccagagaugcuacacucagacgagguuuucaugcaaauuagaacaccaugucccuuccccacauccuuuuuucugucaauaaauuaucaggauaacaguagaaaucguauguugucuaugauaugaaugacauucuugugcagugcgugacaggcgcaacuguucauguggcuccuuuugcugccuacucccaacuaaaacgggccuuuguugaucaggauuacaaggaugaguuuuugcaaaucucccuccacccacaaguggggaaauuccuuaacccauuuaugccggagguugcaauuuuugugugugugaaaaauccgaccuuagugaugaccuugagcagcaggauguaaauaacucccacaggauuagcauuccaauaauggaacacuaggcauaaauggguuguuaaggaacauacacuaggaccaagaggaaaguucagcuucucuauguacaggaggaggaagccagguauugcucccgggucaggccaaccgcuggccuaaacuucaaugguaauuucagcccuuagggcaggugaagaggagaccuccacuggucaacagagcuguguguauggagcagccccagggugcucuauggggucacuacaguuguggcauccuuguguuugauccugaauccuuggcucugccccacuccagcugcugacaagugaccugccuggggacugcuuaccugcauaguaggugagggaaggugaacuguggugaggacagagugggguuuaaaacuugcacaccuaaauaucuaucaaaauuauaaaugcauuuaggcugggugcaguggcucacaccuguaauccuagcacuuugggaggcugaggcaggaggauugcuugaggccaggagucugagagcagccugggaaacauagugagaccccaucucuauaaaauuguucuuaaaaauuagcuagguaugguggugugugccuguggucccagcuacucaggaggcuggggugggaggaucaccugagcccaggaguuuaaggcugcagugagcuaugauuacaccacugcgcuccagccuggacgacagagggagaccuugucuccaaaaaaacaaaacaaaaaucuuccccaaaaauaaaauuauaaaugcauuuagucuuugauccugcaaucccacuucugggaauggagacccuccaacccccuagcuauaucugcaaaaguaugaagagguacgugcaacaugcuccuggcagagcagcaucauguuccaugucaguggacaggaagccagucaagcauuucucuuaauggcaaacaaauaaaacuaugggcagccacacaauagaaugcuaugcagcugugcaaaagaauaaagaaggccaggcgugguggcucacgccuguaaucccagcacuuugggaggcagaggcgggaggauugcuugagcccaggaguuccagaccugccugggcaacacggaagaacccugucucuacaaaaauuagcugggcauacuagugugcacccgugaagagacuguccauguccugcaguggaaagaucucuagaacgugugguuaugagaaaacaaaaaucacagaauugaacagcauguauagaaugcuacuccuugggauaagaaagaggggggaggacauagauucgauuaugcuuauaauuauaauugcauaaauaaacauuggaaggauauucugaggaacuaaagggguugcauauugugggaagaggaaguagcaugcaagugggggcagggauacaucuuuccagaaacaucccuaacauuuuuaagaucuagggcaagaguacaaaagcagaccacauacuacggggaaauauugaaaagguaacuaaauaaaacaugcugugugcuucuacuuugcaaauauaccuuccuuuacacuuuggaaggucaggguggaauuuagaauccggauaucugcacugggucaagguguggggagagccagcccuguccugucccuuucucuucuuagucauggcucuguccugccagaggggcuccacacauaugugugggcauuccagcuuguacauccaagcucuggccacauuuguguuaacagccaccccucggauguccuuggcccucaguuggguuacgaacagauccauaugagaauugcacgcaaguucauggaaucuggccaugggcagggaauuccaggauccugguaacuuaaaacauggccuacaaaguggggcacaagcucuugguagacacauccccuuggcuccaggaacuucucaucccacggggagugguauggcuggagaaggacugggugagccucagggcagggaccccucgccuacguccaaagauauuacucuaucuuuuaucuguguugguuuuuggaucacauaaccuuuccguauucaaaaaucuaaaauuauaucuaaacacuugcacaaugaaaaaugauguugcaucugggggcccuccagacuucuaugcccuauaguuagaguucugcucaugagccccuguaaucuucaaaagccugagccucaggccagcuucaguggggcuguguuguccuugggcugccuuucccagcucagggucccuccauugcagccuuggagucucacuggucccaggaggccaccucccugagacucugauuguccacacacacugucccagcaucacuuacauuguagaggagaucaguccacccuuccaugguuaugcacuggaaaacagucagcacugcaaacaggauguugucgaacugagugaucccguuguugggcccuucccaguagggcugacauuuggucccauuggggcaggugcgggcgggcucuucugucccacauggagccggagacucacccugaaugucaucuacaaaagggaaggggagaaaagucaggggaaggagcagggaaaaccagcucugagaaauagggaccagugacucuauaaugcuguuggaacgaauaacuuuugggacaaacgugaucagucuucaaagagaucaauguuuggcuuugggggucuauuauugguuuucuauugauuaauuucuucucugagcuuuacuacuuuucucuuuauguuuuccaugaguuuuuuuuuuuuuucuauucuuuuccuaaacuuuugagauggauggauuaacugccuuuaaggcuauaaauugccuuuaaguguggcuuuaccugcaucucaacauuuugucaugcauuaucauuauuguucaaguaaaauauuuucuaauuuccauuauuauuucuucuuugaccuauggguaauuuagauguauuuguuuuuuaaaaaaacuuauuaggugucuguguguguguguguguauauauauauauauauauaugaagacagaggggagaggaagacagggagagaacggggggagagagagagcgagagagaaguauaaaacaauauaaugauucaccauguaccuaucaccaauuuagacacuuaccuauuuacuucuggcaaauuuuguuucaucuauuccucuguauccccuccaaacacuuugccuugccacuagaauuuuuuuuuuuuuuuuuuuuugagacggagucucauucugucacccaggcuggagugcaauggcaugaucucaccucacuacaaucuccgacucccagguucaagggauucuccugccucaggcucccaaguagcugggauuauagguggccaccaccacaccuggauaaucuuuguauuuuuaguggagaugggguuucaccauguuggccaggcuggucucgaacuccugaccucaagugauccgcccgccucggccuccaaagugcugggauuacaggcgugagccacugcacccagccuagaauauuuuuaaagcaaagcucagacaucauaucauuucauccauaaaugagaggcaugucuguuaaucugcaaacacuuuuagaguucucuuuuuguuacugauuuccagcuuaauugcauuacggucagaaaauauguuuuguauuuguauuuuuuucagcuuuuugaccucuguugagacaaacuuuaugguccauaauauagucaguuuuaguaaaugugccgugugcaugguguagcugguaagugcagccuucuuccgacauccauuaggacaaauuugucaagcgcauuguguuauucuccuauaagccuugcugauuuuuuucuucuugggauguacugggcucagggagcuguucugggggugagggacaccaguacacacaguuccuacccuugccuaaggguaaggaacaggagcugagcuuucuccccaaauagcaggaggcaggcugugaaaaugccacaaggagagagaaacgugccaacagacaccccuuuugcuggaaaccaaagacagcuuccuggggagguggcagucaggcugaacgcuaaaggucaguccaaaucuuaagguauugaugggguagggaggcaggaaagcucacaucugggaguguccucauuuuaccagcacagcgggucugagaggaccuuauucugugagcgaugcuuuugaagguuuucaaagacgaccguggcauugucggacaagaaaacaaacagcugaguguguguaaacucaagcuuccuacucaacaaaaauaucucucaauguaugugcuacagacuucgcagcaccaauucucugcucccuugacugagcacacagcagagggaaauaaaccaaugcugaaugaaugaaucuuguuggccuuucaagcucuggcugaauagaaacuccaagucuagccucgccaugaacuuaaguuguuggaaacgccuuccucacuuaugcuggacuugguacaugaacuauuauuugauaaauacagguuggaaggcaaaaaucuuuuaaacauaaggcucagggcagagaacaaaauaaauccauggguuccuauaauaaaugagaacuaucguuuagcauggcaccugugccuggaaucuucucugucuccacgccauguccaagucuggcucaauucccacccuccauguagccucuuuguguagcccaguuaacacagccccagucccucccucccucccuuccuuccuucuuuccuuccucucucucuuuuuuuuuuuuuuuuugagacagggucucacuuugucacccaggcuggagugcgggcaccaucauagcuuacugcagccuugcagccuccaauuccugggcucaagugauccuucuuccucagccuccugaguagcuaggacuauaggcauguaccaccacucauggcuaauuuuuaaauuuuuuuauuuugagacaaaaucucacucuguugcccaagcuggagugcaguagcgugaucucggcucacuguaaccucuaugucccagguucaagugauucuccugccucagccucucaaguaugugguacuacaggcacacgccaccaugcccggcuaauuuauuuuuuuuguauuuuuaguagagacgggguuucacuauguuggccaggcuggucuugaacuccugaccuuuugauccgccugccucggccucccaaagugcugggauuacaggcgugagccacugcacccggccaauuuuuaaauuuuuauuuuagcagagacagggucuggcuauguugccuaggcuggucucaaacuaacggccucaagggauacucccaccucagccucucaaagugcugggauuacaggugugagccacugcaccuggccccuuucaggcauacaauagcuacugaauuuucauauuuaggggggcguggguauaaucacacauuagccuucacuguuaaaaauggcugcaaaugaggggucuuguuuccucuaacuauuuuggaagcucuuagaaagcaggaagccuuccacuuuaucuuugcuuccuucuaagcgauuggcacggugcugggcacacaggaacugggcucccgacacugaggaaugcuacugaaaacgggucuaucuuuagcagcuuugcaaucccccucaaccccccaaccaccgacacgaaacacucugagcguugcuucuagaaaaacaagcguccagagugucugaggaauucgguuauaaauacauuuuaaaauuaacccacugccugggugucuguauauaucugucucuuacucacacgucuuauauuuuuaaucgugagcuagcuuuucagucuuucuccuaaaucgaggcuuccuccccucugguggcaccacccacaucuguccccucaaaaccccacucggacccaagccaaccccauggccucuucuccuuuagcuagucuaggguagaaaaacauaaaauaaaacuucacagaaaccuaggauccaggaguccugguuucucugcucacggcugauuuuuccaagaggcccugccccauauucauucucucucucucucucucucucucucgcauuuccgccugggugacgaggccaggagcagaaauagcucugccucaauuaacaccuucuucaucggggaaagaaauaauuaggacauuccauauugagcaaacuucacaagcccaggagagaaagagacaggaggagcaagagaaaaagaggaaaaaaaaaaccaacaaaccaaaacccacaaaaaaacccaaaccuccaaccauugcaaauaaaccuuccccaguggguuuucccuccccguggggaggaguggggagggagggcucaggggcugccucugcggauccacuugggggucacuggguggagaggguggguggaaauccacucccagacagaaucuucuucuguggcugccuuucccaaauaaggggccugaaaccucuuucucugcccaccuggguuccccuuugggcuucuugauuccuucuauccacuccuucaauucacagcucccuugacccaaaucaucagaaccagaacugcuauucagucugucugcacccagauggccagugguccaaauacugaaauacugaaggcaucccuuccuacuugauuccauuucauucuggagcuuuagagagcaagcagcuagaguuuggauggcaaagauuuaacugaaaacguauccaagggcuauuugguuccugaguguggaucgugguggacacacugcuuccacacugcugguucagagcugagcccugggagagugucucugcgcugccuggcuuuuccggggcucacccuacccccagacccagccacugaaggguuaaugugggcauagucagggaggggcagaaugcugcugagugcuagguucugauugguuggugccaggacucccaauugggguaucucugguacauccuggggguugggggagaccaggaggacucauccaguacucucacccagcacucagggcagagaacaaaauaaauccauggguuccuauaauaaaugagaacuaucguuuagcauggcaccugugccuggaaucuucucugucucucaccuuccacaagguaccacucacaaugcauugaggcaauaacccuuuucuggcccaacucuccccacuucuugcuugcuuuagaagucaggacuggucgaggucugaaagcacccagaauaccuguuccacucagccagaugugccaggcauuaauucccacucuaggagcaguccucaccaaugucaaaaagaagccaguguauaaauaccccagcucccuugccccuuggcugggacggcucugagguguguguucuuuuuuuauuuauauuuuuauuuauuuauuuauuugagauggagucucacucuuucgccaggcuggagugcaguggugugaucuuggcucacugcaacuucugccucccggguucaagugauucuccugccucagccuccugaguaauugggacuacaggugccugccaccacacccagcuaauuuuuguauuuuuuaguacagaugggguuucaccauguuggccaggauggucucugacuccugaucucaggugauccacccgccuuggccccccaaagugcugggauuacaggcgugagccaccgugaccagcugaguuguguguucuuugcugucucccagaggugcccagggggauccagucccaguuuuaagugguaacccgcuugauagcacacucuuuaaaagaucccuucuuucucugcucacuuccucauucccccgauggugcuuccugggaucauucccaaauaaacucuuucucugcugggucaccuucuguggaaccccaccccuuucaacagcuaagaucucagaggcuauuucacucacugccucuccuguagugcucucugaaggagacgguccucccagcugccaggagaaagaagcacaccccugccuaauccucccaagagcuugucccugaaggagaaaacuggaaagaugcaucaugcuccguggaccuaccuguccccucuucaaagcaggugguaugaaauuuucccauauaaaauucuaacccuaugauugcaaaaauaaggauugcaaaaaauaggaggaggccgaucugcagcaaagggaucaucgccuucaugaucgacuucaggacgacuuguaaaccuggggggacacagagagaggccccauaagcccaugagcaaguacccccaaaccccgccaccaagacgcccaggucucucccagacaaagcagguguguuccugagggaauauuaagcacccaggagccuggggauugggcaauggugaaggaagcaccacacggaggcugauccuuaucaugggaacaacacuuccuagguuuuuuuuuuccuuugagacaggguuuugcacugcugcccaggcuggagugcaguggcacaaucacagcucacugcagccucaaccuccugggcucaggugauccuccugccucagucccugcaauagcuaggacuacaggcaugcaccaccaugccuggcuaaguuuuaaaacuuguuuguagagauggggucuugcuauguugcccaggcuggccugaaaccccuggucuccaaggacucaaacuccucagccuccuaaagugcuaggauuauaggugugagccaccauaccuggccccuauuauuauuauuauuuauuuuauuuauuuuuuuugagacagagucuuguuauaucgcccaggcuggagugcaguggugccaucucggcucacugcaagcuccgccucccagguuuacgccauucuccugccucagccucccgaguaggcccagcuaauuuuucauauuuuuaguggagacaggguuucaccguguuagccaggauggucucgaucuccugaccucgugauccacccgccucggucuuccaaaguucugggauuacagacgugagucuccacgccuggccuuauuauuuuuuaaaaagcacuuuuaacuuuaaaguauuuauuuauuuauuuauuuuaauuagccaggcaugauggugcaugccuguaguccuagcuacucuagggacugaggcaggaggaucguuaaggcugcagugagcuaugauugugccacugcgccccagccugaguggcagagcaagacgcugucucaaauaaaucuauauauauauuuuauagagacagggucucacuauguuauccaggcuggucucgaacuccugaccucaagcgaucuuccagccucugccucccaaaguucugggauuacaggcaugagccacagagcccagccaacuuuaaaguacuuaauaaagguauuugacaugcuguuccauuugaugaucuuuugggcaagaaaggggugggaguccauugcuuuuggagccauauuccuggguguugggcaacuugcacccagaagagggagccauuuucuuaauuuuuuuuuucugccaagaggcggugucuuuuccucauucauaaaaggccgccauauaggcuaguugcugcucuggguaggaaagcgguuggcggucccaauuucaaccccaaggaaccagacucaacauuauuucacuggcuucuagugacaagccccugagguggccauacauguaaagucacucucauuuuacagaagugggaagcaaggcuaacagagaugcugugauucacccagagaaugcaugagaaauggcagaacuaggcagggcgcggcggcgguucacgccucuaaucccagcacuuugggaagccgaggccagcggauuaacgaggucaggaguucaagacaagucuggccaacauggugaaaccccaucucuacuaaaaauacaaaaaauuaucugggcaugguggccagcgccuguaaucccagcuacuugggaggcugaggaaggagaauugcuugaacuugggaggcagagguugcagugagccaagaugacgccacuguacuccagucugggugacagagcaagacucugucucaaaaaaaaaaaaaaaaaaaaaaaaaggcagaacuaggauuugaacccagguccaucugaaaugaagccccauguuugcccaugugcugauguugcuuucucuguucugagcaacccaauucagaaagaugguggugaauaagaaggcagggggccaggugugguggcucacgccuguaaucccagcacuuugggaggccgaggcgggcagaucacgaggucaggagaucgagaccauccuggcuaauauggugaaaccccgucucuacuaaaaauacaaaaaaauuagcugggcgugguggcgggcaccuguaguccuggcuacucgggaggcugaggcaggagaauggugugaacccgggagguggagcuugcagugagcugagaucacgccauugcacuccagccugggugaaagugcgagauuccaucucaaaaagaaagaaggcagggaacaguccccgaagggacacaguggaacagaagacacacccaacugggcaucugaagaccuaaaucuggggguauugucaucaaucagggaccccaugcaagcucuuauccuaccaagcucagccuccaguagccucucaucuaacaaaugguucauucauggcggcugaauuacucugggcuucaaauccuuuugggagaggaagggguuaauacugaaauucgcauccugcacuaaaaguuccacuguuguaagacucgaagaauguuaauaauaauaauagcuggccaagcgugguggcucacaccuguaaucccagcacuuugggaggcugaggcggguggaucacuugaacucaggaguuugagaccagccugagcagcguggugaaacccugucucuacaaaauacaaaaaaauuaacugggcauggugcugugugccuggagucccagcuauuugggaggcugagaugguaggauugcuugagucuggggagguugaggcuguacugagcugugauugcaccacugcacuccagccuggcgacagagcaagagccuuaguuaguauuucucugccuaucauuggcuuuuuuuuuuuuuugagaugggcuugcucugucacccaggcuggaauacaguggcaugaucacggcucacugcagccuugaccuccugggcacaagcgagccuccugccucagccucccgaguaggugggacuacaggcacacuucaccauaccugguuccacuaccauuuuuuucuugaggcuauuaacucaggucugaacgaugacaacauccuauguuuguaaccacuaugguaucuacuaggaaagucuaugaucaaaaugaagguucaaacauauagccugaggcuuugcuucuugauugcaggaacuucccauggcucuugauggguggagaccacaguaagagagggaagcugucaggauagcucgaggggccaugccacuccaagggcuuaaaaauguaaugugggugcuggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucucgccacugcacuccagccugggcgacagagcgagacuccgucucaaaaaaaaaaaaaaaaaaaaaaaauguaaugugggugcuaacagaugcaguguggugcagugguuaaggugcuggauacucuuggugucuggccaagaucccauuuucuuucugguguacccgcccuccagcugcuauggauguugguugcuaaugccucccagcugccucucuucuuaguagaauugcccuuggugaucaaaagcuaucucaccugggagcuacugcgucucuaccucccauccacagugacugacuauagaaguacaaaaggccggcauccuugccaugcauuggaggacaacucuggugucacacacacuccagcugaaauugcgucccugcucuauccauuccccagccccacccugcugaucuccugcugucucucccaagagccgucccccaauaaagcaggugcaucugaacacccaccuaaguauccgcuucaagggaaccugaccuagucauccacuuacuagugaauuccaaaccucagcuucuccaucuguaaauggggacugcaauaguaccucccucauacgauuagaugagagaguucacacacagugaaguaccugguaagucauagguggucauuaaacagagacucuuguuacuacugcuauuauaauauacauauauuuuuugagacagggucacacuuuguugcccaggcugguguugaacuccuagccucaggcaaucguccugccuuggccucccaaagugcugggauuacaggugugagccacugcaccuggcucuuuugacuauuagauuugggauggcccuuaauuuaauaugaugcaggcaucugcugggaucuugcagagaccuuggauagaagugucuucuuucuacaaaaagauccugcuggugauccucugggaaaucuuacucuuuaaaccuggguagcaaugaaccggaagaacgaagccaauaaaauguaaaauggugauaauaaaagagacuacuucacaggcuuguugggaggauaaaggacuuuaaaaaaauggaaauacuuagaauaaugucuggcacauaguaagugcuuuuuaauuuuuuuuuuucuuuuuuugagacggaguuucacucuuucauccaggcuggagugcaguggcgugauuucagcucacugcaaccuccgccccccggguucaagugauucuccugccucagccucccgaguagcugggauuauagaugcccgccaccacgcccggcuaaguuuuguauuuuuaguagagacgggguuuccccauuuuggccaggcaggucucgaacuccugaccucaggugauccacccauccaccuuggccucccaaagugcuaggauuauaggcaugagccacugcacccagccuauaaauuguuuguuuuuaaacuuuuuguugucuguuuuuuugagacaaggucucacucuguuguccaggcuggagugcaguggugcuaucacagcucacugcagccuugaccuccugggcucagauccuccugccucagccuuuuaaguagcugggacuacaggugugcaccaucaugccugcuaauuuuuuuuuuuuuuugagacaggguuucgccauguugcccaggcuggucuuaaaacuccugagcucgcucuaucugcccgcuucggucucccaaagugcugggauuccaggugugagccacugugcccagucaaccuggcuaauuucuaaaaaaaaaaaaaaaauuuguagauauuggcgggggggugggggugguguuccucacaauguugcccaggcuggucucgaacuuguggccucaagugauccucccaaagugcuggaauuacaggcaugagccaccaugccuggcuaaauuauuauuauuaaccaagacaagaagauagaaaaaggacagcccuguuuuauuuuugcuuuuuacauuuuuuuuuggcucaaccuacacuuaaucuugacccugcauauggcagccacccuuaaacggggacuagauguaucuguggagaaugagaaagcagcaaggaaugaguaugaauuuuagagcucauuacuguccacucuaagaauucaggugaguaauuuaaccuccuuaagccucaaccgucucaucuguaaaauggguguucgcugggugacugugaggaugaaauaagguaauucauguaaaguccuucuguagugcccugcacgcagcaggcacucauuaaaugggaauggucauugccaccagugguacggcccaggcuuggagucacacuugcucacuccuaguucugccacuucucagccacaaaacccugcuccaauguuucagccacucugagccucaguuucccccuccauaaaauagagacaucaguccuaucaacuucauagggcugugaguacugaaugagaucacacguggugcuuagcauggcucccgauagacaguaggugcucaauaaauggguguggcuccuaguuugcuuucaggagcucauggggagcuacagucauauuccuaggggguucccuauagggagucccaaagaagagacugcccucacacaggcugguggcaggauguggccuccugagaugcucugcauaggggaaacugagggcuccuggggcccgugagcaaaccccuugucagggucggaaacucacgcacuugggauuccagacaccagcuugagcggccgcagcacucgaacugcccucagcguccguaggucaaacuccgucccaacugucgccaagaugcugaaagaaagaagccagaauggagaacagaggguggguuuugggggucagacagcagggcgggggugcuugggauuccaagcuguccuguauugguugggugaccacaggcaggugacucgacaccacuggccucaguuuugucaccuguaaaauggucuuaacaguaccugccucacgggauaaaaggugauuuacgaagacccccaacagaugguucauguugcacaaauguugcaaugagagaaauggaaucuuccccauggcucaagguuggggugacauucaguauauuucacaaccuacaaugacaauagauugugggguggccuggggcccugggggaauggcagaccuuucgggguuuguggcucuuuauuuuauuuuauuuuauuuuuuugagacagagucucacucuguugcccaggcuggagugcgaucuccaauggugugaucucagcucacugcaaccucugccucccggguucaagggauucuccugccucagccucccgaguagcugggauuacuacgcacccgccaucaugcccggguacuuuuuuuuguauuuuuguagagacaggguuucaccauguuggccaggcuggucuugaacuccugaccucaggugauccacccgccucggccucccaaagugcugggauuacaggcgugagccauggugccuggccugguuuguggcucuuuaacaaauggcaggaaaguaguucaguguuaagagcccagccugcauggguucagaucccagaucugccacuuuccaguuggguaaccuugggcaagggacaucccugcucugugccucaguuucccccuuuuguauaaccuggauaacaauaguaucaauaccuccaaggguugugaggauucaguaaguugacaaaaaguggucagcacaaugccaggcacacagguuaccgguaugcuaaccuauucagaaauaaauaagaaaacaaaaaaaugggugugauccugcuuguguggaccagccagcaucagcuggcuagaaggcagcuacagaccccaagccucuggucaaaaagagucccuuuuguaaaugcaaguuaguaaggaugauagcaguaggugggaugaggcuuccauagaaacccuccgagcaagacccugucaugagaccucauuuguaaaaguauugcuguugaaacacagggucccaccuggcccuguuuccugaacauguccauuucagagcuaagugauguacagugcguggucaaggcacaauacaauaaaagagacugucaucagaacuucauauaauggacaagaaaugcugaauaccagagggucugugguuaauggaagguuggucacagcaaauaacuuggggauuuuucaguuuauuuuuauuuuagacauggggucuugcucugaugcccaggcuggaaugcaguggugcaaucauagcucgcuacagcauugaacuccugggcucaagcaauccuccugccuuagccuacugaguagcugggauuacaggugggaaccaccacaucuggcuugauuuuucaguuuuauccaggggcuugggucuuaacacuucagucuguggccaacugguaucuguaccucuugccuuagggcugucuccaaaucuggggcaggcccagggaaugaacuuuaagggagcagcccucaaccaaagauugcugggaguugguggaucaauaccgcagcucccucacccuucauucuggaucacuuaagaggugaguuccacgugggcucccaguaggacggagcucaguugccuacaggacaacucacccuuccuugccccaccuccccucuccuucuccaacccuucuggggucaccucucagaugaacuacuugcacaaggauugcccuaaauucuuguuucaggaucuauucugggucauccuaaacuaacacaaagcaaguucccaacuuuuuuucucaagauuaccccuagaggagagaugggcauauuagguugggcugaccuuuuccaccauccacaagugggcgucugagcguauccuaugugcuggguagagugacauaugagacuaucccugccccauggagcugaugcagaagagaagugguuaagaaaaacaugcacacaaugagugaaucuguugcaggugugaugccuucucagcuaggaagacaauggcuuugaggggcacacagcaggucguguuaacuaguccagggccugggauacccccuacuucaagucaaguucccauagaugagggggagaaaucuggccaguggggaaagaacuuuccaggcugagaguggccaugacagagagcuugggacugaaagagggcuuggcaaauucaagaaaugacauggugucaccacugggauuuggauggugagguucaagcagcaagucaugaagccagaguaggcaggggccaugacauacaacuuuacaaaaaaugaauuuauuuauuuuuauuuuuggagacagggacuuauucugucacccaggcuugaguauaguggugcaacaacagcucacugcagccucaaccuccugggcucaagcgauccucccaccucugccuccuaagcagcugggacuacagguguacaacaacauauucagaaaauuaaaaaauuuuuuuuguagagauggggucuugcuauauugcccaggcuggucuagaacuccuggccucaagugauccucucaccucagccucccaaagugcugggauuauagguaugagcuacugcacuuggcccauucaacuuuuaauuugauuuacuuuauuuuucucuucuccucccagcuuucugguacuaauuuggguuccucaaauucugacuuagagaucacuauucucuucuugcaccuuguuuucuucugugcuggcacauaaaagcugucagggcaugaacagcaaagaacaggcagugguuaaguccuuaguauuucacuucacaaacaucaacugagcacuaauaacaagccaggcccuaucucugugugggggagacugagaguaaacccaauaaauauaagcaggcuuuguuuuguuuuguucuagagauggagucucccuguguugcccaggcuggccuccaacuccugggcucaagggauccucuugccuuggccucccaaagugcugggauuauggacgugagccaccacaccggccgaggaagacuucauuucauugugcuuugcuuuauugcaauuuguagauauuguguuucuuacaaauugaagauuuguggcaacccugugucaaggaggucuaucagggccauuuuuuuuccaacagcgugugcucacuuugcgucucugugucacacucugguaauucuuacgguauuucaaacuuuuacauaauuauuacaucuguuaugguggucugugaucagugaucuuugaugugacuauagucauuguuugggggugccacgaaccacauccauagaagauggcaaacuugaucgauaaauauuguguguguucugacugcucuaccaacuggccauuuccccaucucucccgcuuuccuugggccuuccuauuccccgagacauaacaauauugaaauuaggucaguguauaacuguacaauggccuuuaagugcucaagugaaaagaagaguugcacgucucucacuuuaaauuaaaagcuagaaaugauuaaacacagugaggaaggcgugucaaaagcugagauagggccagggaugguggcucaugccuguaauccgagcauuuugggaggcugaggugagaggauggcuugagccuaggaguuugagacuagcuugggcaaaauagggagacccuaucucuacagaaaauaaaaaaauuagcugggugugguggugcacaccuguggucucagcuacuuaggaggcugaggugggaggaucacuuggucccaggaagucaaggcugcagugagcggugauugcaccacugcacuccagccugggcaacggagugagacccugucucaaaaacaaaacaaacaaacaaacaaaaggccauaagcuagagguuagccaaguugugaaugcaaaggaaaaauuacugaaggaaauuaaaagggcuacucuaguaaacacaugaaugauaagaaaguaagacaggcuucuugcugacauggagaaaguuuuaguggucuggauagaagaucaaaccagccacaacauucccuuaagccaaagccuaauccacagcaagcccacagcaagacugagagagguggggaagugcagaagaaaaaucugaagcuagaagaucuugguucaugagguuuaaggaaagaagguguccccauaauauaaaagugcaaggugaagugauaagugcugauggagaagcugcaguaaguuauccagaagaucuagcugagauuauuaaugaagcuggcaacacugaauaauagauuuuuaauguagaugaaaugcccuauuggaagaaguugccaucuaggacuuucauagcuagagaggagaagucaaugccuggcuucaaagcuucaaaggacaggcugacucucuuguuaggagcuagugcuccuggugacuuuaaguugaaaccaaugcucacuuaccauuccuaaaguccuaaggucuuaagaauuaugcugaaucuacucugccugugcucuauaaauggaacaaugaagacugaaugacagcccgucuguuuauagcauggauaacugauauuuuaagcccacuguugagaucuacucagaaaaaaauauauauauaauauauaacacauaauauauguuauauauaacauaugagauauauaacacauaauauauguuauauauaacacacuacacauauguuauauaugauacacuacacauaauauauguuauauaugauacacuacacauaauauauguuacauaugauacacuacacauaauauauguuauauaugauauauauaacacaauauguuauaugugacauauauaacacauaauauaugugacauauauacacauaauauauguuaugugugauauauaacacauguuauaugugauauauaacacauauguuauaugugauauauauaacacaugauauauguuauaugugauauauaauuuauauuacauauauguuauauauauaauuuauauuacauauaacauguuauauauauauauguauuuuagaugaagucgcacucuuguugcccaggcuggagugcaauggcacgaccucagcucacugcaaccucugacucccagguucaagcgauucuccugccucagccuccaggguagcugggauuacaggcaccugcuaccaugccuggcuaauuuuuuuguauuuuuaguagaguugggguuucaccauguuggccaggcuggucuugaacucccgaccucaggugauccacacgccucggccucccaaaguggugggauuacaggugcgagccacuguacccagccagaaaaaagauuucuuucaaaauauuacugcugacaaugcacugguuauccaggaccucuaaugggcauguacaagaagaugaauguuguuuuuaugacuucuaacacaacauuuuuuuuuuuuuuugagacagagucucacucugucgcugcaguggugugaucuuggcucacugcaaccucugucuucaagaggguucaagcaauucuccugccucagccucccaaguggcugggauuacagucauacgccaccaugcccagcuaauuuuuguauuuuuaguagugaugggguuucaccauauugaccaggcuggucuugaacuccugaccucaaguuacccaccugccucagccucccaaagugcugggauuacaggugugagccaccaugcccagccacaacauucauucuguagcccauggaucaagaaguaauucucuauuucaagucuuaugauuuaagggauacauuucauaaggcuauagcugccauagauaaauuccuuugaugcaucugggcaaaggaaauugaaaacuuucugaaaagcauucaccauucuagauaccauuaggaacauuuguggcuguuccaguggcucaugccuguaaucccagcacuuagggagaucaaggcaggaggaucacuugaggccaagaguucaagaccagucugggcaacauagugagaccucaacucaauuaaaaauaaaaaaacaauccacaacaaacaaacaacaaaaagaacauuugugauucgugggaacaggucaaaauaucaacauuaauaggaauuuugaggaagucaauuccgauccucauggaugacuuugaggaguucaagacuucacuggaggaagacacugcagaagugauggaacuagcaagagaacuagaguuagaaguggagccugaagaugugacugaauugcugcagccucaugaucaaacuucaaugcaugaggcguuacuuguuauggaagagcaaagaaagugauuucuugagauggauucuacuccuggugaaaauucugugaacacuguuaaaaugacaacaugagauuuagaauaugacauaaacuuaguugacaaagcaguggcaggguuugaaagaacugacuccaauuuugaaaaaaguucuacuguggguaaaauugcugucaacaagcaucucaugcuagagaaaucuuucgugaaaggaagagucgauggaugcggaaaacuuucuugucuuauuuuaagaaaaugucacaggcaccccaaucuucagcaaccacccccacgaucagucagcacccaucaacacugagccagugacccuucaccagcaagaugaggacucacugaaggcucagaugauuguuaacuuuuuuaguaauaaaacauuuauuuauuuauuuauuuauuuauuuauuuuuugagacagagucucagucugucacccaggcuggagugcagcagugcaaucucggcucacugcaaucucccccccgccucccagguucaagcaauucucgugccucagccucccgaguagcugggcuuauaggugugcaccaccacacccggcuauuuuuuuguauuuuucauagagacgggguuucaccauguuggcugggcugguuuugaacuccugaccucaagugauccacccaccuuggccucacaaacuguugggauuacaggcaugagccacugugcccagccuuuuuuuuuuuuuuuuuuaauuuuuguugagagauacggucucacucugucccccaggcuagagugcaguggugugaucacagcucacugcagucucaaucucucaggcucaagugagccucccaccucagccucucauguagcugggaccacaggcaugcgucaccauacccagcuauuuuuaaaaagaauuuuuuuguagaaacggggucucacuuuguugccugguuucaaaucccugggcucaagcaauccuccugccuuggccucccaaaguguugggauuacaagccacugugcucagccuugauggauuuuaaaauuaagguauguacauuuuuuuuuagacauaaugcuaucaugcacuuaacagacuauaguguaagcauaacuuuuaugugcacugggaaaccaaaaaaggcacgacucccuuuauugcaauauucgcuuuguuauggcgaccuggaaccaaaccagcagugucucugagguauaccuguaugacagauguuagggcgaugagugcuuaggagaaaguuaccacagagcaaggggaaaggacgcgucagugacauggggcuggcgggaugaagggaguggugacauuucuaucaguaaaggcaccugcucuuuaccaccuggaaggcaaacaguucaguguuaaaaguguuacagggccgggcgcgguggcucacaccuguaaucccaacacuuugggaggccaaggcuggcggaucacaaggucaggaguucgagaccagccuggccaauauggugaaaacccgucucuacuaaaaauacaaaaauuagcugggcgugguggcgggugucuguagucccagcuacuugggaggcuaaggcaggagaauagcuugaacccgggugacagaggaugcagugagcagagaucgcgccacugcacuccagccuggugacagagcaagaugccgucucaaaaaaaaaaaaaaaaaaaaaaaguguuuagaccagcacugcccaggagaaaucuauuaagagcuacuuaugaaauuuuauagccaggugcgguggcucaugccuguaaucccagcacuuugggaggccaaggcuggcggaucacaaggucaggaguucgagaccagccuggccaauauggugaaaacccgucucuacuaaaaauacaaaaauuagcugggcgugguggcgggugucuguagucccagcuacuugggaggcuaaggcaggagaauagcuugaacccgggugacagaggaugcagugagcagagaucgcgccacugcacuccagccuggugacagagcaagaugccgucucaaaaaaaaaaaaaaaaaaaaaaaguguuuagaccagcacugcccaggagaaaucuauuaagagcuacuuaugaaauuuuauagccaggcgcgguggcucaugccuguaaucccagcacuuugggaggccgacgcaggcagaucacuugaggccaggaguucgagaccagccuggccaacauggcgaaacuccaucucuacuaaaaaugcaaaaaauuagcugggcguggcggugggcaucuguaaucccagcuacucagaggcagaggcaggcgaacugcuugaacccaugagguggagguugcagugagccaagaucacaccacugcacuccagccugggugacagagcgugacucugucucaaaaaaaaaaaaaaaaaaaaaaaaaauuaaaauuugcuaguagccacauuaaaaaaguaaaaagaaacagguaaaauucauuuauugguuuguuuguuuguuuguuuauuuauuuauuuauuuauuuauuuauuuauuuauuuauuuugagacagggucucccuguugucuaggcuggagugcaguggcucaaucuuggcucacugcaaccuccgccuccugggcucaggugaucuuccuuccucagccuccuaaguagcugggacuacaggugggagccaccaagcccagcuaauuuuuguauuuuuuuuggagagacaggguuuuaccauauugcccaggcuggucucgaacuccugagcucaagcaaucugccugcuuuggccucccaaagugcugguauuugaggcaugagccacuaugcccagccugaagcauucuaagaagaucguagaccugcugggcacaaaagcuccugccuguaaucucagcuacucgggaggcugaggcaggaggaucgcuugaggccaggaguuccagaccagccugagcaacauggcaagaccuugucgcuauuaaaaaaaauaauaacaauuaaaaaaaugggcggggcauuguggugugugccuguaaucccagcuacucgggaggcuguuggugggaggaccacuugaguuugggauuuugaggcugcagugagcugugaucgugccacugcauuccaggcuggaagacagagcgagacccuguaucuuaagagauaaaagauauuuugcacaugguuuuccuuggaaucuggucaauauucuacacuuucauguguuucaacugaagugcucaaaggccacauguggccagcggugacuguaucaaacagcacaagugcagagaaauagacauuugaauaaagacugggagaaagcaagggaagcaagagagugagccauaugaauaugucagggaaaacucuaggcaaauggaacagccggugcaaagguccagcuggugcaaagguccuccucccgcucucccccucacucacucuguuccagccacaccaauucauccguguucuucaaaugcaccaggcuggaccgugcauuuaauagcuaggccaugccugguguauuugagaaacagagaugaguugguguggcugaagcagagcgagcaagggggagggugugaggggacgaaggcagugaggugauggauggugcagggcuuuguggguuguggagaggacuuuggcuuuuucucugaguaaggugugagccauggaggguucugaggggaggagggauguaaucugacuuguauuaaaauaugaucucucuagggggcaaggccggaagcugggagauugaggaggaggcaacugcauugacgcaguugaacgcugauaagccuggaccagggagguugugcuggaugcagugauaacgcuaagacaaacuccacccugcuuuagggagagaccacaccaaugagugagugagagauucaacuacaagucccucugaccccagggauagaggaggcagggaugaaagagggaaugauuacagccuggggacagcauuaucgcagagcucauguccggggaggcagcauagcacagucagaacaucucagacggguuaaauccuggcccugcauuuucucauugugugaccuuucccauugccuuaacuuguucaagccucggaaaugcagauaaucucaccacccugugcaaucccagcuggcucccaagaugcauuaccucacagccuccucccuggaaggauaagaaggaauuaggaggagaacaggaagauaagggaggcuucucuggcuaagaaagcccuauggaggcagaaggcuccacucaggguaugugguaggggagagguuggguaagcuggacaguggaggcugucaacuagaggcugggucuuguccuguggacagugagagucauguaagguuuuggagcaggaagggaugugauuaggguuggcguucagaagacaagccugacagcugaaaggacagauugguggugauggagcagaaguuaggagggagccgcaagagcaggcugguguaaugagggcuggaacuaggacaaaggcagugggaguacaaaagaggccccgguuuauauauagcugccauugauugcugugcuccagggagccugccugggcucaucaaauccucccugcaucccagcgguuggcaguuugaggcccauuuuacagaggaggaaacuaaagaccagauaaguuaaucccacauggagguuccuaccacugaguaagaacucgaaccccagaccagccacaggacuccagaaucccaguucucuacugugucauccuucaacuccugugacuaguugggcggggugaggggcaacgguggugaagaaagagaagaauggcucugguucugaaaggaccacggagugauguucauucauuuauucaacaaggauuuagugagcacguacuaugugccagauauucagagagugccuaaagaugcuaccaaggacaaagcaauagugggaaaagauauaguaugucagacggugugaagugcuauggagaacaauauggcagccccuagggcuuccaauggaaagacugaguguggagcaggagagagguaucaagggugacuccaggguuuuggccugagcuaacugaaggaugaaguugcugucaauggagauggggaagauggaggaagaagguuucaaagaucaagaacuggguuguagacauguugaguuugagaugccaguuuuccgucacuccuuaguuaaaaucuuccaauggcuuccaucaggcuuggaguaaaauuuaaagucuaccaugaccacaugaccuugcgugaugugacuccugcugaccaccuugucccacaacacccuggccacuccgacuuccuuucuguucugccagcaggaaaagcucacuuucugcuuuauugagaauuacuauauuggcugucuccucugccguccccauuccuucaacucucaucuuuugccuagcuggccucuucgaauucuucagguugaaacucagauucugccuucucagagagaacaucccucaacuuccuagcuaaagagauccugccucuucacucucuggaauuauauuguuuguuuguuuguuuauuuauuuauuuuuaagacaggaucucacucugucacccaggcuggcgugcagugcacagucacagcucacugcggacuugaccucucaggcucaagcaauccuuccaccuuguccucccaaguagcuggaacuacaggcaugcauuacccuauccagcuaauuuuuaauauuuuuuuuguagagacagggucccaguacguuucccaagguggucucaaacuccuggauucaagugauccucucaucuuggucucuuaguguuuggaugauaggcgugagccaccaugccuggccguacuguuuauuaagucguauuuauuauucaugcuuucuucuagaaugucagcuccacgaggacaggggcuuuuuuuguauagcaucuuucauggccuagugaguacucaauaaauauuguggugggugaauaagugagguguggcagaggacaggguuauggaagaccagauaacccaggguagaugagugaaguggaaaaagccaaggguccccaguggagagggagaagacacagacaugggaggagacugguguggagaauggcauaccugacagucaaguucaaaagcauuuugaggcugggugcgguggcucaugccuguaaucucagcacuuugaaaggccgaggcagguggauccccugagguuaggaguucgagaucagccuggccaacauggcaaaacuccgucucuaccaaaaauacaagaaaauuagccagccgugguggcgggagccuguaaucccagcuacuugggaggcugaggcaggagaaucgcuugaaccugggaggcagagguugcaguaagcugagaucgcaccacugcacuccagccuaggugaugagagugaaacuccaucucaagaaaaccccccaaaaacaauagcaacaacaaaaacacacagaaauaaaguauuuugagaaaggagaggucacuggucuccagggccgcacagaggugaguaagaguaaaggaugaagaaugcauuucauacggcaucagggucacgucagucuugcgggggcugaugguugagggagaacaagaggagaagaacuggaaaugugagccuggguaggagaggagauuuucagggugggagagaacugaauaugggucaagggagagaaguugaugauguaucucuuggccuuuagagagcugcaccgcccaauaaaguaaccacuagccacacauggcuauuuaaauacagauuuaaauucauuuaaauuaaaugaaaaauucgcuuguaccagucacguuuuaagugcucccaagccacauguggcuggugcauacauacauacuucaucagugcagaaaguuccauuggacuuugauguucuagcauguccauccccguagggcagauauuuucuauucuuucuuucuuuuuuuuuuuuuuuuugagacagggucucauucuguugcccaggcuggagugcaguggcacgaucucggcuuauugcauccuccgcuucccagguucaagcgauucuccugccucagccucccaaguagcugggauuacaggcacuugccaccaugccuggcuaauuuuuacauuuuuaguagagacgggguuucaccauguuggucaggcugaucucaaacuccugaccuugcgauucaccugccucggccucccaaagugcugggauuacaggcgugagccacugcgcccggccuucuuuucuuuuuuagagacagaguccuaguaugcugcccaggcuggacucaaacucccagucucaugagauccuacugccuuggacuccugaguagguggaacuauaggccuaagccacugugccuggcuuugcaaaauuuauuuuuauuuuuuauuuuauuuuuuagaaauuuucaucuguuuuguucauagcaucuccagcaccuaaagcugugccuggcauacaguaggcacucaauaaauguuuacugaaugaauaaugaagcaaaaauguagaaaagugugguugauaauuaacagaguauauucuagaagagguggaaggcucaguauuuaaagaagagaguccaggcgugguggcuuaugccuguaaucccagcacuuugggaggcugaggcaggaggauuguuugagcucaggaguucaagaccagccugggcaacauaaagagaccccaucucuacaaaaaauauaaaaauuagccggccauggugguacacuccuccagcugcucgugaggcuaaggugggcggaucaccugagccuggcaggucgaggcagcagugagcugugauugugccacugcauuucugccugggcaacagagugagaccuugucucuuaaaaaaaaaaaaaaaagaagaagaagaauggaagacacaguuguccauccaagagccaccaccacuacccgccuuacuggcagagcccaccucccaucaaagaggcagaaaaugccuaauagucucuuuuucccaagauuccuugcaauaagagcacuugucacaugacccauucguaggccuaacaggaucugggugaaaaaucugcugggugcuucuggaaaaggauuuuuuccccgugagaugagucacaugguaagagacagcccuuccucucccucuucuuuggccggaugcuuuugugucugucuacguggauggcuggguaaguaccuuagaacugaggcagucaucggccgggcacaguggcucacgccuguaaucccagcccuuugggaggccgaggcaggugcaucaccugaggucaggaguuugagaccagccugaccaauauggugaaacccuaucucuacuaaaaaaaauacaaaaaauuagccggaugcaguggcaggcaccuguaaucccagcuacucgggaggcugagacaggagaaucgcuugaacccaggaggcagagguugcagugagccgagaucaugccacugcacuccagccugggcgacagagcgggacucugucugaaggaaaaaaagaaagaacugacgcagucgucuuggggcugugagugguaaauguuaaaaaaaguccuuacagugacgauguuagaguggaaagauggaaggacucuuuggagacauuguugagccaaggaaccaacccugcaaccaaccuccuggccuccagacuucuuuuguuuuugagacaaaucucacucugucgcccaggcuggaguucaguggugcaaucugggcucacugcaacuuccaccuccuggguucaaauguuucuccugccucagccucccgaguagcugggacuacaggcgugcgccaccacgccuggcuaauuuuuguauuuuuaguagagaugggguucaccauguuggccagccuguucucaaacuccugaccucaggugauccaccccacccgucuuggccucccaaagugcugggauuacaggcaugagccacugcgcccggccuccauuuuuauuuucuuaauuguagcuaagucauaucagaaccugcugauuaaaggagccaauauucacuaaauguauucucuuccagguugugugcuuguuacuuuacauucugagagcucauuuuaugcugcuuaccagggacuuguucuauucucccuuucauugauggggaaauugagacccaugggguuaaacuacuuguccagcuaacauguggugccugcgugcuacgucugguuuuacccauucuaccaugcugcuccugguuaacucugccaccccacucaccuuccccacugggaccucagccaaacucaugccuucacuagccugagcaugggaaggaggucaauucucugcugguuggaagucaggaugucaauaaauauuuacagaggagcaacuaccauaugccacucagaagagaggggaacaugugcaaaggcccuggggcuggagagaccucaugaagagaagugagguuaccaguugagaaguggaggcagaggacaggaguuugagcccaagaguuugaggcugcagugagcuacgucacuacagccagugcaacagaaugacauccugccucuaaaaauuaaaacaaaauuaaaaagaugacacagaggaaugucugcaaaucagugagaauaacacagcaaccccaauaggaaaacaggcccaaaaugugaauaggcagauuaggggagugagaaggagaggagacaggagagugagaagauguuagcaugguuagaaagcaggggaggggauggggauguaguggcccccuaaccucagguuagauaaaguaccugccucuuacagacucaggccaaauauuucuaagauggguaccaaggagcagaaccacuucccauacagucuauauucuugccacuccuagguugaggacugagugauccucuucaaguucauucuuaaaucacccagcuuuccccuucuugaaaaaacgauuucuuccucuucuuuuuuuuuuuuuuuuuuuuuuuuuuuugagacaaagucuugcucugucacccaggcuggagugcaauggugugaucucagcucaaugcaaccucugccucccggguucaagugauuuuccugccucagccuccugaguagcugggauuacaggcacaugccaccaugccuggcuaauuuuuguauuuuuaguagagacaggguuucaucauguuggccaggcuggucucgaacuccugaccuuaagugauccaccugccucgcccucgcaaaguggugggguuacaggcgugagccacccccuggcgagaaaacuauuucugaaauucauuuucugaaucuucaaaugcagagucaaguucuuugcucuccucagguuacgggauaucuuuaccuuuggucuguaugacgccugucucuuguuuauaccuucauucauucaugcauuaauuccccuauaucucucuauacccuacuuucauucuucucccucccagagacaacugagagaauguuuaauuuggccuuauaggagugcauucucgcaaaaacacgugcgauauuuugagugugucuauuuuuaacugacauaagcaggaugaaguuagacacauucuguuguuuccuguuuucacccagaaccauauuuuuauuuuuuguuuuuuaaauuuuuugagacagaguuuugcucuugucacccaggcuggagugcaguggcacgaugucggcucacugcaaccucugccuccuggguucaagcgauucucuugccucagccucccgaguaguugggauuacaggcacccgccaccacguccagcuaauuuuuguaucuuuaauagagacaggguuucaccauguuggccaggcuggucucgaacuccugaccucaggugauccacccgccuuggccugccagagugcugggaugacacgcaugagccaccgugcccggcaacaaccauauuucuaaaagccccaucccguaguaucugucggauaugcggucuggagcucucacucauucuggugcuccaugggugccgcugucacaugccgccuccuggucuccaggagggacaccagguggccuucagcuccccuuauauagauggugcuggaguaagcauucucguaccugccccuaacagaccugguaagaaugucccugggauggaugccuggggacauaagcgcugauggugcuggaccucacuggacugaguacuaccgauaugucuccagaguggccucccugggccacaccccuuugaguggugcaagacuuuccucugugcccgcaucgcuggaaacccuuggcuuauucacauauuuuuuccccaauauuaaagguguacagagauacugcuuucauuuccaucuuucugguuacaaaugacuuugaguaccaugucauaggcugauuagcuuuucagacuucacuucccugauccgccuguucacauuuucggccuguuuuccuauugggguugcuguguuauucugguugacuugcagacauucccucagguagucuuugcauuuuuauuuuuacuuuauuauuauuuauuuauuuauuuauuuugagacagagucucgcucugucgcccaggccggagugcaguggcgcaaucucagcucacugcaaccucugcuucccagguucaagcaauucuccugccucagccucucgaguagcugggacuacaggcaugcgccaccaugccuggcuaauuuuuuuuuauuuuuaguacggacgcgguuuuaccauguuagccaggguggucucgaucuccugaccucacaaucugcccaucucggcuucccaaagugcugggauuacaggcgggagccacuaugccccaccuacauuuuuauuuuuuauguuuagagacaggucucacucugucacccagacuggagugcagcggugcgcucauaguucacugcagccucaaauuccugggcucaagcaauccugucucagccuccugaguagcugggacuacaggcaugcaacacuuugccuggcuaauucuuaaaauguugguagagaugaggucucucuguuucccaggcuggucucaaaccccuggccuccagugauccucccaccuuggccuuccaaagcacugggauuacaggugugagccacugcacccagacccucauguagccuugaucaacacugucugacagaacuuucuggaugauaaaucuguucucaaucugugcugccaaauaugguagccacuagucaccuguggguuuugagcacuuaaaauguggcuagugugaaugaagaacugaguuuuaaauuucauuuaauucuaaaucaucuaaauuuaaaaugaccacacagugcuagggaccucuauaacaaacagcaguuagaaguuaaccccugaucaauuuuuuuuuuaugauucuauccacuauuuaccaugugcuaauuccuauucuaaaugauuuauaaauauuaacucauucaaaacucacaacaauuccauagguagauacuauuuucuccauuuuauugacgaggaaacugaggcucagagagguugauaacucacccaaggauucacaggaaaugggacaaccagcaucuggauguaagguuugguucccgaaccaccugcuauugcaucuuuuuuuuuuggacggagucuugcuuugucgcuagacuggagugcaguggcgugauuucagcucacugcaaccuccaccucccugguucaagcaauuccccugccuaagccucccaaguagcugggauuacaggcacgugacaccauuccuggcuaauuuuuuguauuuuaguagagaugggguuucaccauguugaccaagauggucucgaucuccugaccucgugauucgccugccucggccucccaaagugcugggauuacaggcgugagccaccgcaccuggccccaauugcaucuuuauuugaacaaauaucuuaguuuucauguaaucaugucuuuuuuugccuuagaguuugugcuuuacaaguucaguggaggaaguccuucucccuuccuggguucacagcuauucuccagcauuuuuuuuccuuuaauguaaaguucuccccacucacagaagguccucccaagcuccuuaaccuucuacauggagagcaauucuucauuuuauuugucuuuuaaaguaaaggauugaacaaaaggacauguuucuauuucgggugguuucugaagcccucuuaaaguacaguguuuucuuaaauaaagaggaguaggaacagaggcaaaaaccccauaagguggugagguaagugauucuagaagagacaggagcucgagagggaugagagcucuggagaagucaagaaggggaaauugccgggugcgguggcucacaucgguaguccuagcacuuugggaggcugagacaggaggauugcuugaguccaggaguucaagaccagccuaggcaacaaagugagaccugucuuuaccaaaaaugaagaaauuagccauggccgggcgugcuggcucacaccuguaaucccagcauuuugggaggcugaggcaggaggacugcuugagcccaagaguucaagaccagccugggcaacauggugaaaccuggucucuacaagaaguacaaaaauuagccaggcaugguggcuugugccuguagccccagcuacucgggaggcugaggugggagaaucgcaugagcccgggaggucaaggcugcagugagcugugaucaugcuacugcacuugguugacagggugagaccaugucucaaaaaaaaaaaaaaaaagaaaaaaaagaaaaucagcugggcacaacguugcaugucuguggucccagcuacuaaggaggcugaggcaggacgauaccuugagcucaggagguugaggcuacagugagcuguguuugugccacugcacucgagccuggucaacaagagugaaacucuguucaaaaaaaaagaaaagaaaagaaaaaagaaagaaagagaagaaugggaaacuuagugaaggccagugcauucacagucaugaguguuuugaaggguacuguugcgagaccuugccaaucaccagggcuagaggagguggugaaagagaaaacucuccuugagaggcuggaaugagaagauaaugugacuugggcagguggaggcaggaugucuuccaaauagaggugagaacauagugucaguggagaugggagagccaauggaugaauccaauugauggagugaagcucuugaggaaaugaacaagugcauuacauuugaauucccagacauucagugggaaccugcuacaggagaggcacuccaggagcaaaauaaaaacaaacucucauucacagguggugggaguuuuaacugguccaaccacuugggaaaacuguuaggcaguuucuuuuccuuccuuccuuccuuccuuccaucccaaacacuugggaaaacuguugggcaguuuccuuuccuuccuucccuuccuuccuuccuuucuucuuuuugagauggaguuucauguauucugccacccaggcuggaguacaguagugcaaucucugcucacugcaaccucugccucccagguucaagcaauucuccugccucaguuuccugaguagcugagauuacaggcacacgccaccaugcucggcuaaucuuuguauuuuuuugcggagacgggguuuugccauguuggccagggguuuugccacauuggccaggcuggucucgaacuccugagcucaagugauuugccccccucagccucccaaagugcugggauuacaggcaugagccacugugcccggccaauuguuaggcaguuccuaccaaagcuaaaccaauuccucccucugacucagauguuccgguccuaggaauaucucccauagaaauaugaagaguggucacccacagacauaucugaguguguucaaaguagcuuucucuggaauagccccaaaguagaaagcaccaaacugcccaccauuaguagaguaaaugaacaggugguucagcacacacagcgaugagaacaaaugaacagcaacagcacagaugaaucucacacauacaacgucaagggaaagaagucaaugcaugcaugcuguaugaccccaugugcuuaaaguucaaaaacaagcaaaacuaaucuagacuguuugaagucaggauggaguuacuggugaccucagaggcacaaggggguuucuaaacguuggugcuguuuuuuuuuccuuccuuccuuuccuuccuuccuucccucccuccuuccuuccucgaagcugcagcuguucccucccucccccccuucuucuucuucuuccuccuccucuucccucccuauuuuccuuccuuccuuuuuuucuuucuuuagcuuucucuuucuuucucugucuuccucuuuucuuucuuucucuuucuuuccuuuucuuucuuuaccuuucucucucucuuucugucuuccucuuuucuuuccuuuucucucucuccccuuccuucccuucccucccucccucccuccuuccuuccuuccuucccucccuccuuccucucucucucucucucucucucucucuuccccuccgcccccauugcccacgcuggggagcgauagcaugaucucugcucacugcaaccucugccucccagauucaagugauucuccugccucagccucacucggcuauguucuguuucuugaacuaggcgcugguuacaugacugggcucaguuuuugaaaaucacucaagcucuacuuguaugauacaugugcuuuucuguauguauguuauauucaauaaaagguuaaaaauauauuuaggaaguagcuaacauuucuugagugcuugcugugggccaagucuuaugcauuauuuuauucaauccccaugaugacccuacaaguguggcggugguggguccuaucauucccucuacuuuccaggucagagagguggggucacugcuucgaguucacacagcuagcacauggcugggcugggucuuaagcccauguccugcucaauucuaacuucucugcaaugcucucagguuuggaaaaguaaaaggacaaggauuucucaaagucagaggguaaaaaggaaaaaaacaaaacaaaacaugagaugaugaucccgccauacaauugccugcuaacuucaucaagaaacaguuggaagaucucgaggaccaggugaagguuugaagcaggguuggggugaauuuaauaaaguguugauuaaacguugucaggggauucugaagacucagcuuaagaggauaccugcaggaaagaaaggaacucuuccugcuucuucucuugaacaauuuuggcuuuaacgaccauuuccccacaaggcaacaacaaauauuucauaguucuacucuuccaaagcccuguucacagcaucgucacugugggaggugggcgccuauacccacuucacugauaagcaaacuguuggggcucagaaaacaauaccccaaaaugaaguucuccgaagcagccacagaagcaaaaguuuuucucugaccuucuccugcccuucuaucucuuagucccauucuccccuggggcuagccacaaaaacuagaaucccucuucccuaaggcgggucguagaaaccagaccucuuuuccccaaagucagcccuaacaccuaaaaauguuacucuaacuuucccuccaccuuucuuuguaaaaacuaguuauaaaaaaauuaucuggccagcugugguagcucaugcugggauuacaaaucccgggacuuugggaggccgacguggguggaucacuugaggucaggaguuuaagaccagccuggccaacauggcaaaacacugucucuacuaaaaauacaaaaauuagcugggcaugguggcgcgcaccucuagucccagcuacuuggaaggcugaggcaggagaauugcuugaacccaggaggcagaggcugcagugagcugaguuugcaccacagcacuccagccugggcaacagagugagacuccaucucaaaaaaaaaaaaaaaaagaaaagaaaaagaaaaagaaaaagaaaugaucuggcugggcacaguggcucaugcugggauuacaaaucccaggacuuugggaggcccaggugguggaucacuugaggucagcaguuugagaccagccuggccaacauggugaaacccugucucuacuaaaaaauacaaaaauuagcugggcaugguggugcuuaccuguagucccagcuacuugggaggcugaggcaggagaaucauuugaacccagaaggcagaggcugcagugagccgagauugugccacuguacucuagccugggcaacagaaucagacucugucucaaaaaaaagaaaaaaaaaaaaaagaaauuaucuaacuuacguuauuugaccguagguuauaaggaucccauuccagagaggguccugccccauacccagaaggaaugcaugcucugagagaccaagaagaaucaagacagcccccuuauuccagagaggguccugccccauacccggaaggaaugcaugcugagagagaccaaggagaaccaagagagcccccccuccauuccagagagggucuugucccauacccggaagaaaugcaugcucagagagaccaaggagaaucaagacagcccuuuuuggguuuccccacucagucuauuagcauuuacauuguacacuuuuuguucaaucauauuucuacaccgcuguccauacuuuguugaaccuaagcuuaaaaaacggacaauuuccccugcagcuuugggucuucauucugaaggcucucgugcaaacacauuaaauaaaucugccugccuuuucuccaauuaauaugccuugugaguugauuuuuuucagugaaccuucagagggucaagcccuuggccacuacaaaaccaagguuccggaaggccaggugucuugucagaacacucauugguucauuucagagcugaacuugaacuaaagcuuucugacucuacucuuccccgugagggaagccuccaucgcagcaaagcagcucacucaacuuucuugcuucucaacugcuccuuugccuagagagucuccucccuacugauccacagcucucugucucccuucaaaacugccucuugugcuguuuucucucuucuccauuccauaacaugcaugggcucagguuacaccacagcugcgccggccccuagaacuuucugggaugauggaaauguucuauucugaucuguccaauaugguagccaagagccacguguggcuaaugagcauuugaaauggggcucaguggcuaaaauuuucauuugguuaaauuuuaaugaauguacauuuauauuuaaauagccucguguggcuaguggcuauccugcuguaccaugcagcucugcaguugaauuauagaguggauuacauaaucgagggcgugcaguccgucacaugauggugcaaacuagucauucccugugugcccucuaggucaaugcuccagcgggcucugugcccucgaggcggacccuugaagacuacaacucccagaaugcuuugcuccguuuccgguuugguuuggcugaggggaagcgcuggcagaagaugaggggagggaaagagauuggaauauugcuucccugcucccucccugguucugacaguagucccuucugcacagcucugccuccacuggguuccaggaaauguagggcucgcgauggcuucucucugaggaccucaaacagccguuaucuauuucucucaccuguuccuaucucuuuaaggagucucuucauggcauggucuucuuuugaaccaucuagaaguuaauucuuuuuccuguuaggacccugauugguaugaggugggaggaaugaaugguucaugaaagcugcccaccugaagaccuugaaguccccccaguuucugaggucaaagucuggagaagcaggauuugauucuagauuucccuaccucaagagggagggaugcucuacugcuuuuuuucaaauaagacuucaaauuguggggagagacauucuuccagauucuugcuucaccccauuguaaggcaaaggcaaauccugagagcuggaagcccaagaaacagaggagguggguggaagaacucaggagugucccuuaaaacuguccuaaggguggaagaagauaggaaugucccuuaaaauuguccuaagguagggcuugcaaggaggugacacagaucaaaaugugaagcuugauucucagugaggacccacgcagagacugaugucugucucuccuuccuggaugcucaguuagacuccguuucccagcucugcaagugggcgccgccauguacgcucuggugacaucgaucaaaauguggagcuugauucucagugaggacccacgcaaagacucaugucugucucuccuuccuggaugcucaguuagacuccauuucccagcucugcaagugggugccgccauguaagcucuagccagugggagguagauggaagucauauggacuacuucugggucugucccagaaacauuucuccugugcccuucucaugcucuuuucccuucuguggcuugauaucaagaagcauggagacuuuggaagccauggguugaagaugaggagcuacaauauggaacaagccugggccccugacuuacugcuuagaggagaggugccugcuguuuaagaauacauuuuuuuuuuggccaggcacgguggcucacggcuguaaucccagcacuuugggaggccgaggcaggugggucaccugaggucaggaguuuaagaccagccugaccaacauggugaaaccccaccuauacuaaaaauacaaaaaauuagccaggugugguggcgggcaccuguaauuccagcuacuggggaggcugagucaggagaaugcuugaacccaggagguggagguugcagugagccgagacugggccauugcacucaugccuggaggauaagagcaaaacuccgucgcaaaagaaaaaaaaaaaaagaauacaccuuuugaacuuuaucugugcaagaacgaaauuuuuauuguuuugagcccuuaugcauguugggauucuuuguuacagcugcaagcauaucuaauacacuuaauaggaacuuauaaacaguaacuaauacacuugggcagguaaauugucaguuucaugagaccauggauuugccucuuugguucacugauggaucucuggugucuagaacagggcugagcagguggaaggguucaauaaguguuuguugaaugagcuaucagcuuccaauuuuucuuugcagcugacuggaaagcagagaaguauaguagaugcaagcucuggcucccaggugggaaaggguuggguuuauauccugccugauuauuuacuaauugucuacauugggcaauugccaagccucaguuuccucauagggagguuggagaauuauauaaaagcucuuucuuuuuguggacagagugaggauucaacgugaucauucaugagaagugcugagcacaccaccugaugcauaguaagugcucaggaaguagcggucaugauuaucuggacuuuucucauucucugggcaaacaaaaagcacagaagcugccccugcaauaggcucugacaaauuucaggccccgaggggagggaggccaggcuugagccugggauuauagccaaagaccagcucaggaaacaauauuacauucccaugauccuccugcgaucccaggagggcuugagccucuguuucuuguccugaccucagacuaacucugcagaaaugcugcucggggcuuggacuagcugcucugguucagggagccccauugagaccuggaacuuagagggccugguggaguccucaagacuaauguggggaaugagccauaguuuaauucaggacaccccacuuuuuucaaguauuauuauuaucaccagccuggaguuaugcgugauugggcagaugccuuaggacugaucagguuuuucuccuccauuaauuaaaaugugaaucacagcugagucacuaaagaaaacgguuaaugagcaauucugacuuccucccuccuuccuugcucagagagaugagucagcagaaguccagauccaaaaaugagaagaagaagaagaagaagaagaagaaggagagaaaaggaaaaaaaaaaaagcccagaagagauguagggcuugggaaagcaggagcaaaaugaaccugaaccauauuauucuuugucuuagcagaaaaaaguucccaaaucgcuaucccaaggccuaacggucaaauccucuaaugagcacgaccaguucucauuuuuacagacagacccacaggcacccagagauggauccaagccccagcaaucuccuuucuugcuuuccucaagcaacgacaggcuccucaccaugccaaaaacaaccaccaaccuccaccuuucuuuuucugcuucguuuuccccacaaagcccaggcucuccuuugaauucagacaucauggucauguuucauaagauaagggacgagugaggagcuggggugccuccggucaauaggaaagggccauggggaguaacaguagaagauuucagaaguggggaggucccucagaaucagggaagcuacguaacucaaaacaugauuccuggagccaggcuaagccuggauccuggcuucguguagagcuaaucaaucuuucugagccucaguugucucaucuguaaaauggggagaguaaaaauaccuacgcaguguugcaaagaugaaaaagucagcacccaucagaaguuaacaauuauaauauucauuagaaaacuaugauccaagaauuucugccucacccauagggucaccccaaagcaagaugaucagacagguuggggagaugguccucacugagcacuggcacacacacuugaacaggugugugugugugggugugcaagcucucaugugugugcaugcaauuuccccucccaaaucaacugaucauguauaacacugcacauucgacuuuugacuuuugcaggaugaauuuucaugaugccuauuuauauuuucaaauuaugagcaggggcuuucaccaauuaccccugucuugaccccuuguuauucaaaugauucucuuuugaagagccugcagugucccaguccuugucaauuuuuaacuagaugaauacuguccagaucccaucugcuaaugucugggggugugauuucagcagcuugccaccaucaugcucacugacuuuaagaaaucuucuauuuuuugcaagguugguaauuucuaagucaguuugccuuggacuugugcuagaguguaagauaauauuuaacaaucuagaacagugacucucaaccaggggugauuucaccucccaggggacauuuggcaauguguggagacauuuuugguucucacaacuggggcgcgggcgcuacuggcaucaaguaaguugaggcagugcacaggauagcucccauuuuggagcuaauaaugcagcccccaaagucaucagugcuguggcggagaaacucugaccuagaacccagggggccauggcgguccugaggcagagucuugcucugucauucaaguuggaguaaaguggcgugaucuuugcucacugcaaccuccaccucccagguucaaacgauucuccugccucagccuccugaguagcuggaauuacaggcacccaccgccacacccagcuaauuuuucuauuuuuuuagagacaggguuuugccauguuggccaggcuggucuugaaauccugaccucaggugaucugcccgccucagccucccaaaguccuggaauuacagaccugagccacuguugccuguccaggacucacuuuuacaaguagucaauucagucaguuccuuagggaccaaaaaauggauuaugccaauuuuaggguccuucugccucuuucuaaacuacaaugaauuuauacuaagcguggggcucugcagccagauuuccuggauucaaauuccaacucugccacuuccuagcugugugaccuugggcaagauauuuaacggcucuggguuuccauguucucacuaauacaugugaccaauaaagcacccacugaguaguuguuugcauuagguaggcugauauguaaaguacuuacgacagugccugauacauaguugaggcaugagugggagguagacugaaucccuggugcaaacauggugagcuucccacuaaagauucacaagugggacugggaaauggcagccuaaucagagacuacauuucccagccucccaugcagcuagccugggccacaugacuaaauuccacccaauagaaugcaggcagaaguguuguucaccacuuccaggaacccucauaaguaccucccacuccacuuucccuuuuccccagcugcugucucaauguaggcucuuagaacaaccuuggaagccacauguuuaagcagggagagccuccaacagccuggaucccugagugacugcauggagucgagccauauuugagucacccaccacuccaccucauugcaccccucaccaguuucacuuuauuauuuuuuauuuuuaguagagauggugucucacuguguugcccagguuggcguuaaacuacuggggucaagcgacccucccaccacagccucccaaagugcuagaauuacaggcauaagccaccacauccggccaccaguuguacuuuagaaguugauuucucacucaugcauacucuuaagccagagauuuuugguuuuauugguuauugcagcugguguuaacuaacacagccucuucuuccagcauugcuuugucucucuugaucagcaaauauuaucaucucuucaacaucugaccagcuucaagacaacuacaguccucuccuucauaccuuuccuaugaguuggcaaauaagcuggggaagaagccccuucucccauuggggaugaggaaagggaauagguucccuaggccaggaucuuaguaaagaucuuugauacagaaacaagaagggaucugggagucaugaccacucagcaucucaggccaaagaaugugggugaguaaaauaaugguacaauggacuuuagagacuuggggggaagaguaggaggugagcacuggauaacagacaacaaauauggugcaguguauacugcccgggugaugggugcaccagguucucacaaaucuccacugaagaacuuacucaugcaaccaaauaccaccuguaccccaauaacuuauggaaaaauaaaauuaaaaaaaagaaaaaagaaaauuaagcaaauaaaaauaaucaaaaucuaaagaaaaccccaaaaccuaacaauuucugaaaaaauaguauguggguaucuguuuauuaauaaaacauucaauuauaauuucaacaucaauuaauugaucagcauaaauaaauggaccaaauuucauauauauauauacauauauauacacauauauauacacacauauauauacauauauauacauauauauacauauauacacacauauauauauacauauauacacacauauauauacauauauauacacauauauauauacacacacacacacacauauauauauauauauauauauauauauauauauauauauauacuugcaagugaaacucaaacucauauuaguaccaucaaacaguagcaauaugugccgacaucuagaucgucugcucaaauaucacuuucccaauaaggccuacccugaccacccuauucaaugcuguaucuugcaccccagaaaguggcagggccaggacuugagcacagcacucccaaauucccuuuacccgacuuuacugauuuucccaccugcgaacacaccaucguuaauguuuaggguucucacccucccccaccucacuaccucauaagaaccagagggucuccucaucaccuagaauagucauggguacacaguagaugcuaaauaaauguugaucugagugaaguguuguucuuugccugggacauucuaagagguuuauacauaugaacucauuugcaugcucaaagcaguuugaccaagugaugaguuuaaaaaaauuaucuccauuuuauagauaaagaaagacagguucagagagagcacucaggcagaaguggaagagccaggauuugaacccagacugucuggucccugggucuaggagcuccagacacugcuuugucuaggcccacaacacagagucaacaaacccgggacaagugugaggggaacccaaaccagagguguucauucaguuuuuguuugaaaaauacacaccauguugcguauggguguggauagggccaggcucacaagauugugcuuggcgaccuuuauaaggagggaggaccugggugcaguggcucaugccuguaaucccagcauguuggaaggccgagguggggggauugcuugaaccuaggaguucuagaccagccuggguaauauaaggagaccccaucucugcaaacaaacaaacaaacaaacaaaaaaaaacuuuaaauuagcugggcauggugguaugcaccugugguccuagcuacuugagaggcugaggugggaggauagcuugaaccuggagguugagguuguaaugagccguggucaugccacugcucuccagccugggugacagagcaagaaugcaucccaaaaagaaaaaaaaaguugguacauaugguacaaugguacauauguucaaaucuuggccucaccacucuccagcugugugaucuuggggcaguaacguaaccucucugugccucaagucuuauuuauaaaauggguuguugggaggauaaaauacauugacauuuguaaagugcucagaacagguucauaggcacacauaugcacauaugugcauauauauauauacacauauacacacacacacacacaguaauaagguucauaguuaaugcugcuauauauguuucuguuaaggaaauaauggucacagcuuccacccggagcucaggagcguggagcaggccaccugagagcagagccaaucccugcacuguauucagccucaugccaccuggggaacaguguguuccagucaaaagagcuaacagcgaccuuccaacagcuccugcuaauuuuaaggacaagccucucagugcuggcgcuggagucaauuguugcuuuuucaacaacagcaccagguguguguuaagaggcgugccaucaggaaggcauccucucccgagaaagcuggaaguggcaaguggcccaggcugcccugaacaggacagaaaaugguucagagcaaagcugagguaggcagggagaaaagauaccagggccguauccucuguguccucccccugccaggcagaauaaucuggcauugcuuaaauaugguacaagucccgugauguuuccagccugcaaagcaccuacagcuccaaagugcuuuccagaaaugagcuaacuaauccccaggggugggucaugaugcuaaacgugaaccaucccugaggggaaagguguggaagaguguuauuccaagaaaacaggcaaaacugcagggcaaggagugagagacuguuaguaagaaugaugauaaaaaugauauuauuauuauuacucauauuauuauuugagauggagucucacugugucaccuaggcuggagugcaguggugugaucucggcucacugcaacuuccaccucccggguucaagcgauucuccugccucagccuccugaguggcugggauuacaggcaccccgccaccacacccggcuaauuuuuguguuuuuaguagaugggguuucaccauguuggccaggcuggucucaaacuccugaccucaagugaucugcccgccuuggccucccaaagugcugggauuacagguaugagccagcgcgcccggccauuauuauuauuuuugagauagggucucacucuguugcccuggcuggagugcaguggugugaucacagcucacuguagccucaacuuccugggcucaagcaauccucccaccucagccucccaaguagcuggaacuacagguaugcaccaccauaccuggcuaauuauuuguauuuuuauuuuuauuuuuuguaaagacagagucucccuauguuacccaggcuggccucgaacucccgugcucaagcaaucagccugcuucugccuccuaaagugcugggauuacaggugugagccauugcuccuggccauauuauugguaguaguauugcauuauuaucaacagucuguaauauuucuugagcgcuuacaaggagccggauacuguucuaagagcuguaugucaauuauuucaauaaauccuccauaacuguaugaaguaagaguguuauuauccccauugaacagaugaaacaaaugaggcccacagagguuugggcaucagcuccaagucacacagcuugcaagaaggggagcugguucaagcccagguauucugauaacauagcaucucuaucauccucaccauuauaaugauguucuguauauuucacaguauuugcugggguuggcuacuguugacgccauuuuacagaugagaaaacugaguuauagagggacuugcugacuggcccagggucacauagcugagagguggcagagucagaaugcauccauucauguggucucagcagccacaucagcaccaaugggacuucgauauugccuggauggucuucccucuuuccauaugccagcuuuauggagaacagagucuggacagaugcaguggcucacaccuguaauccuagcauuuugggaggcugaggagggaggaucgcuugaggccaggaguuuaagaccugccuggucaacauagugaaaccacaucucuauaaaaaaagguaauauaaaaaggacgggcaugguggcucaugccuguaauacuagcacuuugggaggcugaggcagacugaucacuugagcccaggagcucaagaccagccuggccaacauaggugaaucccugucucuacuaaaaauauagaauuagccaggugugguggcgggugccuguaaucgcagcuacuugggagucugaggaacaagaguugcuugaaccugggagguggagguugcagugagccaagaucgcgacaaugggcuucagccugggugacagagggagacucugucucaaaaaaaaaauuauauauauauauauauauauauauauauauauauauauauauauaugaagggaaucugaucccuaacauuaguggaacagcuucaauucagggauugagcaggaggagaggcuggugcauucaguguccacuccccagcaucagaguggauucuacccagcuuggugagaauucucuguacccaauuugcccuuugauacugcacugggcagagagggugggugggcauccuccuacuagggcaggaggaguccuucacauauaccuguauucugggccaucacccuucagccagagucauccuucuaaauaaaaagcuaagcacaaccaccccuugucuaaauccuuccauggcucccuugugccuucaggauaaaguccaaacuccucaaaacauggguugguuccugcugaccuucuguagguucuucucuugccauuucccucucccaacacacaagcacauucacacacacacaaacacacacacacaugcacacauguaugcauguguacacacauacccacacacaagcacagcucuguuuaccuguuuccuguauaaacccuaugauguggaaucccagcucugcuaccugggcaagucacuuaacuucuccaugccucauuuuucucgucaguaaaauauuuugcucuccugugcuucucuagacuagaagaaugccugacacacaaaaugcaccaaauggucauuuucuguuugguuuugugaaagacaaaacgcguagacaguacaaaauucagaaagacacaagaaaguaaguuuccuuuccacaccuacuuccaaaucuuucagggugccgcuacagaggcaaacacaauuauuaauuucucauggaaucuuccagauuugcucuuacgagaaaauggcggcaccauucaaaaacugcuuuugucaccugauaacauaucuuggauauagagauuccuauuuccuucucuguaaaauggggauaugaaagaauccaccucacaggcuuguuacaagaauuaaaugaguuaauacucacuuucuaacagcacuuguauacaguagacacccuauaaguacuagcucuuauugacacucagagaucugcuucuucuuuuuguaaugacuucauaacacgcuaagggauggguguaccauaguuuauccgacaguucuuguugauggagacguccaucaauggagucuuccaauuguuaugcugcaacaaugcuucucuuugcuguaacaaugcuuaauaaauaugguucacgucuguaauccuagcacuuugggaggccaaggcaggcagauugcuugagcucaggaguuagagaccagccugggugauaugguuuggcucuguguccccacccagaucucauguugaauuguaauccccaauguugggggagggaccugguaggaggugauuggauccugggagcagauuucccccuugcuuuucucaugacagugagugaguucucgugagaccugguuuuguagcacucccccccucacucucucucuccugccaccaugugaagaugugcuuguuuccccuucauuuuccgccaugauugcaaguuuccuguggccuccucagccaugccuuccgcacagccuguggagccgugagucaauuaaaccucuuuucuuuauaaacuacucagucucagguaguucuuuauagcaaugugagaacaaacgaauacacugggcaacauggcaaaaccccgucucuacaaaaauuacaagaauuagccuggcgugguggcuuguaccuguggugucccagcuacucaggaagcugaggugggaggacugcuugagauggggagguugaggcugcagugagccacgaucuugccacugcacucuagccugggcaacagagugagaccccguuucaaaaauauauauguggugaaacaaaagaacuaaugaaugaagaaauaaauggaggaauacuuugagcaggguauaaggaaccuggguaaguuucagagauuccaagaucuucaaagguaccuuucuaggcacuaaguccuuuuacaaauuccuuucauguggcacuaacauuauauguucaauacaccagcaugaucagauuauaccacuguguguggggugcuagggccauucuuugauggagaacuggucuacccauugcaaucauucucacagaugcaagcugagcugguucacaggugagcaacuguucuugccccaaagaauguaguuaauguucuucccauaagcucauggcuuuugagaauacuguuggucccaaaggggagacaguaguuggucaaaggaauaccaccucagcccaggaaggggacuguguacugaaggaacaguaagguguccuugagggguuugaaggguuccuggugaggcucgauuguguuguaggaugaaggcugaagaguggggugggaggcagggacgaggaaggagaugggucaugagcucuauuaaaauguauuuuuguaauuccgaguugaaaauagacauaccgacuucaugcugacuguuucggcuucgugacauagccuggcucgugggggccuucccauucagcacgucuccguggcaacaggccacuuucucauucacgccaucuccaggguuaccuugcuuggcucauucaggacuguugccauagagacagguccauugauacaaucuugacgcuuuggaacuuugcuuucccgaaugauggaguauuggccgugggguacggaugacauugugauagggugugaggcgaagagaguucugggaguugagguauaaagacuuaaaaucuggcaagaggaagaugaggucaugguaggagauaugguaaggcaguaguagaccaauaucauuccugaucuugacaugugaaaugguugauccuuugacaauccuguguguguguguguguguguugugugucugugugaugucuuuuauuagacucaaaguacaaauacgccaggcacuuagccuugucauuguugaugucuguaucuccagcaucuagcacagcgccugguacaaaguaaaugucuccucaaauaauaauaagaagaagaagaauaagaauuucuuuuugaggcagggucuuauucuaucacccaggcuggagugcaguggcucgcucuuggcucacugcaaccuccaccuucagggcucaaaugauccucccguuuuagccucccgaauagcugggacuacgugcaugccacuauaccuggcuaguuuuuguauuuuguguagagacaguguuuugccauguugcuuaggcugaucucgaacuccugauucaagcucagaagugaaucaggaguucaagcaauccucccaccuuggcuucccaaagugcuaggauuacaggcaugcaccacugcacucggucuacccacaaauaauuauugaauaaauuagaacuuguuguuugcaguaaacuguaaaaauauaaauuguccuugauaaaccauaaaaauauaaaaacauuagaagagaauuuccacaagcaaccaccacuauuauuuacucucuaccucccagcauguaugcccauauagugcauuuucuccuguuucuauagauaacugugugugcugucaucuaaagugaaaccuuccaccuguacaccaaaugccauccccucucguccaccaagagauguccuccugacacucuucuuccuccagcauccucauguuuuucuccccuaauagguuauuccuaucagcauaaaaucugcuguuaggucucccaucuuuuuuuuuugagacagggucuugcucuguuguccagccuggagugcaguggugugaucauagcucacugcagccucgaccucccaggcucaagagauccucucaccucagccucccaaguagcuaggaccacaggcaugcaccaccaugcccagcuaauuaaaaaaaaauuuuuuuuguagagauggggucucacuauguuguccaggcuagucucaaauucccgaggucucagccucccaaaaugcugggauuacaggugugagucauugugccuggccuuuuuuuuuucuuuauucuuuuuucuuuuuuuuuuuuuuuuuaagggaaacaaaccucugaaauccacuucccccaccagcuaacacaugccccaucucucuuccucuacccuucacagcagaacucuuuaaaagagcuaguaguaauccuuccaguagccucuugccuucaccucuucaccuaagcagcucuggcucaggucacgaaagaucuccaugccacuacauccaaugguugauucucauuuuucauuugagucaacacaucagcaucaguggacaucauugaucauucccucauacuugaaauggcuuagcacuuuccuugcaugacagccagcacccacauucuucugauuugcuccaauucagucuucucugcuggcuccuccucaucuuccccaaccucuuuaaugauggagaguaagcccugggcucaguccugggugcucuccugcaucuaugcccuuauucaguuccuuaaauagccuccacaggaggcugacuccugccuuuggaucuccagcucugacuuaccuuuuuugaauuuuagacuccaauuccuauuaggcuggugcaaagguuauuuccuuugccauuacuuuuaauggcaaaaccgcaauuacuuuugcaccaaccuaauagauggccaacacaauaucucuauccaucaguaggcacuucauagaaagcugaguuccuaaucugcccaccuagucagucuccuuccccauuuuauuugauggcaaacccauccuuucacuugcccaugugauaggguuuggcuguguucccacccaaaucucaacuugaauuguaauaauccccacgugucaagggcggcgccagguggagauaacugaaucaugggggcaguuucccccauacuguucuugugguagugaauaagucucaugagaucugaugguuuuauaaauggcacaagcucucuugccugcugccauguaagacaugccuuuacuucuccuuugccuucugccaugguugugaggccuccccagccauguggaacugugagugcauuaaaccucuuuccuuuauaaauuacccagucucagguaugucuuuauuagcagugugagaagagacuaauacaccaugucaaaaaaugugggguucuccuugacuucccucucucucuuucucucucuuucuccuucucucucucucucucucuccccauucuccuuuuugagacagggucucacuuugucucccaggcugaagcacaauggugcaacuacagcucacuacagccucaacuuucugggcucaaaugauccuccugcuucacuguccugaguagcugggauuacagggacacaucacccugccuggcuaauuuaaaaauuuuuuuuuguagagacaggggucucacuauguugcccaggcuggugucaaacuccugggcucaagcggccuuccccacuuggccuccuaaagugcugggauuacaggugugacccaccgugccuggccucucucuuucucuuaaaguucauacucaguugagucugcaaaucuaaaauuaagucaacacagauagugaaaccaaccaccccuccccaccuccaugaccacagcccugacuugaggccuccguuacugcuugcucagaacauugcagacaacucccaaaugagauccuuguuuccacgccgccuccaguguauucuuuuuuagauguuuuauuuguuuucuuuugcagaaaagaggucucacuguguugcccaggcuagacuugaacuccugggcucaagcgauauccuccugccuuggccuccugaguaucugggacugcagccaugugccacucugcacccagcaauuccuuagcauugacaagcauauggugauaauauaagauacaaacaacaggagaaacugggugaaggguaugugggaacucuuuauaauauauuuauaaccuuucuuuuuuuucuuuucuuuuuuuuuuuugagauggagucucacucugucacccaggcuggagugcaguggcgcgaucucagcucacugcaaccuccgccuccuggguucaagcaauucuccugccucagccucccgaguagcugagacuacaggcgcgugccaccauaccugacuaauuucguauuuucaguagagacgggguuucaccauguugcccaggcuggucucaaacgcccaaccucaggugaucuaccugucucggccucccaaagugcugggauuacaggcguuagccacugcgcccagcuacaaccuuucuaaaagucuaaauuacucuaaaauaaauauuuaaaaaauaacauuuguuugguagaaaggguccacugauuuaaaaagauuugaagacuacuuugguaggcauuucugaagugggacauguuauggugugacuuaaauauuaggacaaaauggugugguuggaaguucagaaaguggguuaggaccaggugugggggcucacgccuguaaucccaaggcuuugggaggcacaggcaagaggacugcuugagccuagaagcuugagaccagccugggcaaccuagcaagaauccaucucuacaaaaaguuuuuuguuuuuuuuuuuuguuuuuuuuuuagauggugucucgcgcucugucgcccaggcuggagugcaguggcgugaucucagcucacugcaagcuccgccucccagguucacaccauucuccugccucagccucccgaguagcugggacuacaggcgcccgccaccauaccuggcuaauuuuuuguauuuucaguagagaugggguuucacuguguuagccaggauggucucaaucuccugaccucgugauccgcccgccuuggccucccaaagugcugggauuacaggugugagccaccgugcccggccuacaaaaaguuuuaaaaauuagccagugugguggcacaugccuguagucccagcuacuagggaggccaaggcaagaggaucccuugagcccaggaggucacggcugcagaaagugauuauagugccacugcacucuggccugagugacagagcaagguccugucuuaaaaaaaaaaaaaaaaaaaaaaaaggccaggcacaguggcucacaccuguuaaucccaacacuuugggaggcugaggugggaggaucaccugaggucaggaguucaagaccagcccggccaacauagcgaaaccccgucucuacuaaaaaaaaaaaaaaaauugccggguguggugccagguaccuguaaucucagcuacucgggaggcugagacaggagaauugcuugaacccaggagguggagguugcagugagcuaagaucuugccauugcacuucagucugggugacagagccagacucugucaagaaagaaagaaagaaaaagaaagaaagaaagaaagaaagaaagaaagaaagaaagaaagaaagaaaaggaaggcaagggaagggaaaggaaauaaaagaaaagaaaggaaggauggaagaguggaaggugagauaaaagcagauagaagccugggcaacauagugggaccccaucucuacaaaaaauacaaaaauuagccagguguguuggugcccgucuguagucccagcuacucaggaggcugaagugggaggauccuugagccaaggaaaaaauugaaacugcaaugaacuuugaguccgggaguuugagaccagccugggcaacauagggagacuccuucucuauaaaaauaaauaaaaauaaauuagccaagcaugauggugcaugccuguggucccagcuacucagaaggcugaggcaggaggauugcuugagcccaagaagucgaggcugcagaguaagcugugauugcgccacugcacuccagccuaggcaauagagcgaggcucugucucaaaaaaaaagcaggcagauagcagcgaaggacaaugugccacauuaaggagcuuggauaguaucuugaaagcaauaaggguuuaaaaaccagggaauguuggagacacguggcacaagaaaggugucaucuagauggacagaagacccucaugaucccaugacagcgacugggaagggguaauuaaaaacaaagaaacacaagccaaaagcaucaucaggcugagaagagaaaaugucuuagcauggcugagaacacacucaagaaauagaagcucugccgggugugguggcucaugucuguagucccagcacuuugagagaccaaagugggcggaucgcuugagcccaggaguuagagaccagccugggcaacacggcgaaacuccauuucuaccaaaaguccuaaaaaaaauuugcccgggugugguggcgugugccuguagucccagcuauuccagaggcugaggggggaggaucgccugagccugggaggucaaggcuacagugagcugagaucacaccucugcacucgagccugggugaaaaagagagauccugucucaaaacaaaagcaaaacaaacaacaacaacaacagaagagaaguucugagaugcccauguaggacagcugguuacucauugggggacuuucccaaagcgauuuuggggaagguaggaacuacugggaugaggagggcauaggagaugggcuguauucccagggagcuuaaaggagucagggcagaggcuucagaguaggaaucagggcaggauuugggggauggaagauccugucuuccuccgagacagagagaaggcgggugugugugcggcgcggaauagaggcagguggugccgacaaggaaacgugcggaaggaagggagauagacgcaaucccugcauauuuuucucagcccauucugugcucuucacaacacgccugccuuuaugaccugggggacagggugagaggcuucugcaugucagagcuagacugagaggauguuccucccuugucuucagagcugagugggucauaacauuuagaacuagaugaggccaggcgugguggcucacaccuguaaucccagcacuuugggaggccgaggcgggaggaucacucaagguugggaguuugagaccagccuggccaacauggcaaaacccggucucuacugaaaacacaaaaauuacccaggcaugguggugcacgccuguagucccagcuacuggggaggaugaggcagagaauugcuugaaccugggaggcggagguuacagugagccaagaucaugccacugcacuccagccuggucaacagagcgagacucugucucaauuaaaaaaaaaaaaaaaaaaaaaaaaaaaaaaguagauggggccucagaauucacugaggccaauuuccugauuuaacaaugaagagaaaacuccagagggacugagggagcuguccaaggucaccuagcaagugagggacagaucugggaucagaagaccagucucucaccagcuggccugugucuucuacugcacugugcugguccccacaggccucugagcgguccucucugaugaagcuuccuacgcugauaaaaauauucucuauccaugcuguccaauaugauagccaccacccacaagggaugauuaagcacuugaagugcagccugugugagugagaaacagaauuuuaaauuucgcuuaauuuuuuuugagacaaggucuugcucuuucacccaugcuggagugcaguggcacaaucacagcucacugcagccuugaccucuugggcucaagcgauccuccugccucauccucccgaguagcugggaccacaggccugcaccaccacgccuggcuaauuuauuuuuauuuuuuauagagauggggucuuccuauguugcccaggcuggucucaaacuccugggcucaagcaauccucuggccucagcuuaccaaaguguugggauuacaggcgugaggcacagcauuuaggcugugugcgguggcucaugccuguaauccuagcacuucgggaggccgaggcgguggaucaccugagaucaggaauucgggaccagccuagccaacauggugaaacccugucucuacuaaaacuacaaaaaucggccgggcgcgguggcucacaccuguaaucccagcacuuugggaggcugaggcggguggaucacaaggucaggaguucgagacaagccuggccgacaugguaaaaccucaucucuacuaaaaauacaaaaaauuagcugggcguguuggcgggcgccuguaaucccagcuacucaggaggcugaggcaagagaaucacuugaauccaggaggcggagguggcagugagcugagaucgcgccacugcacuccagcccaggcaacagugcuacacuccaucucaaaaaacaaaaacaaacaaacaaauuuaaaaaauccaaaaauuagcuggguaugguggugcaugccuguagcuacuugggaggcugaggcaggaggauuguuguguauauuuugccacaaucaaaacaaaacaaaacccaaaaccaauuuaauauccacauacggauauuaauauccaaauacgugcaauuggugaccgaauugcacgguacagcucaaagaauguuuccaagaauggcuuuugaugaccaccucaaagcucacagucuuuccagagagaccgucacccucuccccaagggggcagccugauguuccaggagguggcagccacucguccaggucagaaagcgacugccaagaacucacuggaccuuggaagucagccagcugccaaucugucagcuugcauccggagggcuggagaagaagcgcuguguuaacugugcaacucugugcugcugugcacgcucgguaugugggucccgagggguuuccacuccacugggcaggaacagggagggaaggcugucauguuucgguuucugaauguccagcugcugugacagcaggaaagagucgccaagggcugagacuggugggugggcuggcuccccagauagaacaauccacccagagcccauucuguagguagugaggcagccuccaucaaaccagucguggauucucuguuucuguagagcucugccuguuuaugccucacuuucuggggaugaacuggccugggcuucugcaauaauuucagcacaaggaguuaaaagagaaccauaguugcccagugugguggcucaugccuguaaucccagcacuuugggagaccgaggcggguggaucacaacaaggucaggagaucgagaccagccuggcccacauggugaaaccccaucucuacuaaaaauacaaaaauuagcugggcgugguggugugugccuauaaucccagauauuugggaggcugaggcaggagaaucgcuugaacccgggagguggagguugcugugagcuaagauugcacuacugcacuccagccugggugacagagcaagacuccaucucaaaaaaaaaaaaaaaaaaagagaaccauagcaucuuccaccaagacacagaccuccauggccagcccuguccccugucaagagcucucccggccccauguucuuuuccuuccuggcgguuagcacaguagaugcucaaaaagguaucugugacaauauuuguguugcaaaugaugucaaaacugugcaaaaccauguugguuugaauccuggcucugccacuuacuguuccuccucaggugaguuacuuaaccccacucugucuugauuucucugugguuuuccccauagagagaagacauuuguuaauguaugaaaaguccuuagaacaauggaaugaagcuuccaugaagucagcuuucucagguccacagcaaauauuugggggaguggaggugggggcagaacccuucaggcauucaguacaagguagugguguguguacgugggaggcagucccagaugucagaaccugaauucaaagcgcauucuggcuguaguggguugaacagugaacccuccagaaguuauguugauguccuaaucccuggaaugcuaccuuauuuagaaaaaauaagguaugcagguacgauuuaguuaagaauaugagggcaagaguuuauuccuggauuuucugaguggggccuaaaugcagucauauguauccuuaugacacagcagaagagggaacuuugagagggaagaggagaacgcccugucaccacugaggcagagacuggagugaagcaacuccaaauccaauggaaggauccucccccggauccuuuggagggacccuggugacaccucgauuucagaccuauggccuccaaaacagugagagaauacauuucccuuguuugaagccgugugguuuaugguacagucaugugcuacauaacgauguuuugauauguuuugaucaacagcggacugccuauacaaugguggucccauaugguuauaacuguauuuuuacuguaccuuuucuguuuagauauguuuuuuauuuuuuauuuuuuugagauggaguuuugcucugucacccaggcuggagugcaguggcaugaucucagcucacugcaaccuccaccucccagguucaagcgauucuccugccucagccucccgaauagcugggauuacaggugccugccaccacaccuggcuaauuuuugcauuuuucaguaaagaaggaguuucgccauguuggccaggcugggcucgaacuccugaccucaggugaucuggaauuacaggcgugagccaccgugcccggccuagauauguuuagauacacaaauacuuaccauuguguuacaacugccuacaguauucaagacaguaaccugcugugcagguuugcagccuaggugcaauaggguaugccccauaacugaggugugcaguaguuuauaccaucuagguuuguguuaaguucucuacaugauguccacacaaugacaaaaucgccuauugacucaguucuuagacuauauuuccaaggcuggaaacaguggcucauaucuguaaucccagcacuuugggagguuaaggugggaggcucuuuugagcccaggaguuugagaccagccuuugguaacauagggagaccccaccucuacaagaaauuuaaaaauuagccaggugugguggcaugcaucugugguuccagcuacucuggaggcugaggugggaggaucgcuugaacccagguggucgaggcugcagugagcuguuaucaggccacugcacuccagccuggguaacagagugagaccuugucucaaaagauaaaaaguaucccccaggacaaugucaguuaaacaagaucuguagauuuuguuaucuaauuagacccaggauagaauggaugugggacaaguaagaaugcuguuaaaaugaagaaaauccuggccgggcaugguggcucaugccuguaaucccagcacuuugggaggccgagguggguggaccacuugaggucaggaguucgagaccagccuggccaacauggugaaacccuguuucuauuaaaaauacaaaaauuagcuggguaugguggcggacaccuguacuccuagccacucaggagacugaggcaggagaaucacuuguaucuggaagguagagguugcagugagccgagacuacuacacuccagccugggcgacagagcgggacucuaucucaacauaaaaauaaaaauaaauuaaaaaauagagaaaugauuaaaaaagagacugcuguugacuuuggaauuuuugggcaggggucagcaaaccccaugggcuggccaucuauuuuuauaaaguuauguggaauucagcugcauccauucauugaccuauugcacagaaaggcucgcucucucucucaagcagaaggaggcucacuucauggucucuuuucuuaaguaaagcagugaauugaguugaauacuauuucccccaaauucguguuuaccgaaaccucagaaugcaaucuuguuuugaaauaagcucuuugcagauguaacuaauuaaggaucuugaggugagaucauccuggauuuagaguaagcccuaaauucaaugacugguauccuucuaagaagaggaaaggacauagacacacagagaaaaaaggcaaaugaagauggaggcagagauugaaguggaugccagacaaagaauaccaaggguugccaggagccaccagaagaggcaaggaagaauucuuuccuagagcaguugucaagguggcucugcugacaccuugauuuuaggcuucuagccuccagaacuaagagaaaauaaauuucuguuguuuuaagccgccaaguucauguuacucuguuauaacagcccuagaaagccaauauagggagagaaagaugaggugacaugccuuugccccugauuuaauacuucaguuaauucuggaaaagaaccccuuaucagauagguccuguuugacaauuugauucaauaaauaugguagcaaccacuggauguccaccacucccccaucccccaccaucuucuacaguaauggaauuuuagccaagucauggaguucccaacaaaacuacauuucccagcaucccuagcaguuugguaugaucacaugauuaaguuuccaucagugauaugucaguggaagugacagcugccacuuuugggucugagacuucagaaauucaaggucugccuauucaagaccaguuaaguuuugauugugcaaauggugcugaagaucauuuggugguagaaaagaagagggcaacaggagccugaaucccugagugacuuuguggaagugagcuucccugccaaccugcauggcuaaccuugcagcuauuauaggagagaaauuauuuuuuuuucuuuaagguuuuaauccgguggccuuuugggucucuuaguauggcagcauaccuuugcuacauaauauaauaaauauuaauuauguacccaggaaguuguagucaugggggauaggacaaugacuggauggguagggcccugcucucauggagcuuacaaucuaagggaaggaaagcagauaauuuaaaccucaauuauaauacagggggauaaaaaaccugguggaagagcacugcuauggucugaaugucugugucuuucucaaauucauauguugaaaccuagucaccaaugugaagauauuaggaaguggggccuuugggaggugauuagaucaugaagacagagggauucaugcucucaugaaagagguuucagagagcugccucaacucuuuucaccauggaaagaugcaguaggaagaccccuucuacgaaacaagaaauggccccucaucagacaccaaaucugucagugccuugaucuucccagccuccagaacuguggaaaauaaauuucugagguguauaagccacccaguuuaagguauuuuauuauagccaccugagaggauuaaaacaggugcucucugggcaaaggaaguguccucauccagauuuggagggucaggagaggguuuuuggaggaaauaaugccuauucugagacuugacagcaaaggguggaaagaagaagaguauuucaaaaagaaggaaaaauaauuccaaggcuauccagugacagaaaguauaggaugcuaggggauccuuaaaaaguucaaugggcuggaugugguggcuaaccccuguaaugccaauacuuugggaggccaagaugggaggacugcuugagcccaggaguuugagaccaaccugggaaacauagugagaacccaucuuuacuaaaaauaaaaauauuagcuggguguaauggcaugcaccugugggcucagcuacucaggaggcugaggugggaggaucacuugagcccaggaguuugaggcugcagugagcugugacuguaccacugcacuucagccugggugauggagugagaccacaucucaaaaaagaaaaguucaauguagcuagaguggagagauaacacaggugauaugggucaaggccagaugacgcagggucucaaagacacugcuaaaagcaaugggucaccuugagaggacuugacaagaagaaagacuuggugagauuuauauucuguguaguaaagaguuaacuccuugggguuggggaguucaaacucugcauauuccaaaggaaggacuggcccuuggcuggcuccuggaaagaauaucuguauaucuagggcuuugggccaugccugguagcuuaugcucacaaugggaucuauggugacugccuguuuguguucagcuggggcccugggacacacgguaucaguuugaucuuggagugugcuggagacccagcaguuaaagucagucacaugggugcuccaugucaauguaacugagccccaauaaaaacccuggacaccaaggcucaggugagcuucucugguuggcgguacacuguacauugucacacaccauugcugggagaauugagcacuguuugcauaacuccacugggagugaacagcuggaagcucaugccugaucuccccuggacauugccuugugcaucuuuugcuuugcagauuuuaaucuguauuaucuguauucuuccacuguaauaaaccauaacugaauuucacagcuuuucugggucccgugagcccuuuuagcaaaccuucaaaccugagaguggucuuggagaacccugacacauacucuuacaaccuugaagcuacuccaggucaauaagauucuuguucuaguugcaucucaagagaaaagcaauucccucucugacgaacuuucagauguccuaccugcuugcuggccacaggacuuuaggggauuuggagauggacaaaacuggccucugucuccaagcagcucagagucuagagggcaaggcagaaaggagaccaaagacagcaaucagcacguggugugcuuuuauggcagagugcgugauggagggcuaguggguucaucccuaccuuaaauucuggccaggaauggggacaagucacagcacccagaucagagauuaaguugaugaagcuugggggaauggugcuguguaucucaggggagaaggaggugaagugaagccaaugcugugugggccaggauugaaucccagagagaauuuucuuuucuuuucuuuucuuuuuuucuuuuuugagacaaggucuugcucugucacucaaaugggagugcaguggugcaaucuuggcucacuaccaccuccaccuccccaggcucaagcaauccucccaccucagccucccaaguagcugggauacaggcaugcaccaccacgccugguuaauuuuuguauuuuuuuuuguagagaugagguuuugccacguugcccagucuggucucaaacucuugagcucaagugauccaccugccucagccucccaaaguguugggauuacaggugugagucacugcaccuggccaagaguuuucuucuagaaaguccgccugaaguugugcagcauuuccaguagccagagcuacucugagagauaaaugaggcucuuugccaauguuggcuaaaaucuaaaacaucacccaaggcaaccuguaucauacucucugacuucuccccuccacagcccccuugcccugcccuccagggagugucccuugcaaaugucacuguucuuccuucccuuucauaccaccuucauuuaacaaucaaaacagcuggccaggcgugguggcuuacgucuguaaucucagcacuuugggaggccgaggcuggcagaucgccugaggucaggaguuugagaccagccugaccaacuuggagaaaccccaucucuacuaaaaauacaaaacaaacaaacaaacaaaacaaaacagcuaggagugguggcacgugccuguaaucccagcuacucaggaggcugaaguaggagaaucaccugaaccugggagguggaaguuaugaugagccaagaucaugccauugcacuccagccugggcaacaagagugagacuccgucacaaacaaacaaacaaacaaacaacaacagucaaugcaugccaagaacugugcuggauguucuauuacuuauuuauuuuauuuuuuaacuuaauuuguauuuauuuuuauguuuuagaggcagggucuugaucugucacccaggcuggagugcaguggcaugaucauagaucacuguagccucaaacuccuaggcucaagugauccuccugccucagccuccugaguagcuaggacuagagguaugccugcaccaucaugcacacuaacuuauuuuauuuuacuuuugcagagaugggggucuugcuauguuucccaggcuggucucuaacucauggccucaagugaucccuccaccuuagccucucaaagugcugagaugacaggcauaagucauaguucuuggccaucuacucuuuuaaauaauccacacaacagacaucuauuucuuuuuuugagacagagucucguccugucacccaggcuggagugcaguggugcgaucuuggcucacugcaaccucugccucccggguucaagcaauucuccugccucagccucccaaguagcugggauuacaggcacgcaccaccacacccagcuaauuuuuucuaucuuuaguauagaugggguuuuaccauguuggccaggcuggucucgaacuccugaccucaugauccgcccaccuuagccucccaaacagcugggauuacaggugugagccacugcgccuggcccagacaucuauuucuaaugcaguaagcuggguaauaagacugacucucuugcugaaaacgaugacaaauccugcauaaaaucugaaguccauguuguugaaacaagaaaggccugacaauuaguaguuaucagccccaaauaaauaagugaagucaagaauuucccagagguaaccugagcaucuaccagagcauuaaaaccacuuuugccccaagggcaucugucuaacccauggaacugcugcuucaaguuuuauggccuccuagggagcagggguggggcaaaguccaggguacacacguguuagaaagucucaaaggagacacaccacuccccaaguaggauggggccccaauaggcuaucacuuucagguaagaaaccugaaguuaauuuacucccgucuuuccauucccagagauuuuugaggaaguuacuuuggcacuuugcagaaaaggagaaaaacaaaaguuuuugagaaauuauaaccacaagcuggcuuuugcagacacuggugaccuaaauucucaacacauuguuggucuaaaagucuaagaugguccuagacugggaguuucccagacaccuggaaaaaguaaaugcaaauuguccauggaggguucgccuucaucgcaggccucaaugaacucccuucaacagugucccauggaugccgggcacgguggcucacaccuguaaucccagcacuuuggggggccgaggcggguugaucacuugaggucaggaguucaaaaccagccuggccaacguggugaaacccugccucuacuaaaaauacaaaaaaauuagcugggugugguggcacacgccuguaaucccagcuacucaggaggcugaggcaggagaaucauuugggccugggaggcugagguuguagugaacugauauugcaccacugcacuccagccugggcaaccaagcgagacucugucucaaaacaaaacaaaacaaaaaauagugucccauggaaaaugagcuucacacaaccaaagauaacaagacauucaagaaaacaaggcaccagaaugaggaaucacaggaaacaagagacagcagaaaaaaagccauaacaauuuuagauacuuaaguuauuggacacugauuauaaaaauucuucgcauauuaugggcuuuuuuuagauuuagccuuuucuuuugcauauuauacuuaaagaaauguaagacaugcuugaaaauaccuauagaacaauucucaagugggggcguuucuacccuccaugggacauuucguuuggcaaugucugagccauuuuuggcugccacaacuggggaggggcugcuacuggcauuuaguagggugagaggccagggaugcucuaaguaucuuagcacagggugguagcucacggccaagaauuaccuagcccaaaaugucaauugugccaagguugagaaauccugcuguaggaaaacaauacugcaaaagaugaagcaggauuaaaaaagaucagacagcuuguaggaagaaaacaauucuaauacuuggaauuaaagacauagugggcgugguuaauagcagauuagacauagcuaaagaggcaacugguaagcuggugagagacagguaccauuauucuccucauuugacaaauaaguaaacugaggcacacagagagccagcaucuugguuugcugggaaauaaaucacaaauuggcauccaccuaacucaagaucugugcuguuauccacucugccauucuguuuaaacccaagggaaugguguccucucucugccugagccucugaaugucuuccccauuugcuauuuucuuuggcaaaauauuuuagggaaaauagaauuugucuaaaaaugccugacagaagaaaggcacauuguguugcauuagcaugcaggcaacaaugccuagcggggaaaaauggcacagcaauuuccgucucuaaaacauuuaccuuccauuaacuaauuauggcccacaguucauagucaaggggcuuggggguguuuaucuuuacacagacacagggaaaauggaagaaaugcaccgauaaaaguggucccccccagggcaugcgugguggcucaggccuguauuccuagcacuuuggggggccgagaugggcggaucaccugaggucaggaguucgagaccagccugaccaacauggagaaaccccgucucuacuaaaaaaaauuaaauuagccaggcgugguggcauaugccuguaaucucagcuacucaggaggcugaggcaggagaaucacuugaacccaggaggcggagguugcagugagccgagaucaugccauugcauuccaggcugggcaagaagagcgaaacuccaucucaaaauaaauaaauaaauaaauaaauaaauaaauaaauaaauaaagaguucccccuaugagcugcuagaagcuggaaugcaggguccagggccgucccaaauuugcaacccuagagucuucagcugcaggaucuugggcaaguuacuuccucucucuaugcuuugaucucucucucuccauaaaauguggaucaugaaaaacaacccuuuuaggauucuuuccaaagauccaaggagauguguguuaagggcauggcacauaacaacugcucaguguuacuggugauuacuucuauugcagaagcaggaaaacacagugguaaaaacaaacaaacaaacaaacaaacaaacaaacauacacacacacucugggaucacacuccugggucugaaucccagcucuaccacuccguagcugugugaccuuuggacaguuacuuaaccucucugggcaucgguuuccucauagguaaaauguggauaauaacagguuguuuuuuuuugugugugugacagaguuucacucuuggagugcaguggagugaucucgacucacugcaaccuccgccuccuggguucaagcgauucuccuaccucagccaaguagcugggauuacaggcaccugccaccaugccuggcuaauuuuuguauuauuagcagagacaggguuucacccuguuggucaggcuauucuugaacuccugaccucaggugauccaccugccuuggccucacgacgugcugggauuauaggcgugagccacugcgcagggcaagagcucuuaucuuauaggcucuuuagaagauuaaauggguuaauauuuguaaagggcucauaguaaaugcuaguuguuauucucaucacaauuuaccuggauuauuaggcugaugagugcaaugcaguugaacugaaguuuuacaagggcagaaagcaggccugucuuguugaccgaugugucaucagggccuagcacauaguagaaccucagugagcaauuuuggaaugaaugaaguauuuccuuuuuaccugccaauauccccaaauguaacaaaaaccaugacuaccauuugcugagaaucuacccuggagcaggcccccuagugggcauauuacacggaucaucuccucgcauccucaaaacaacgcugagacagguggcaucguuccauuucacagauaaggaaaccgcaggucagaguggccccgcagccugugaagggaaaagccagaauuuucgccacguccacugggauucccaaauccaaauguucagcuacuuucugccaccaguguuuccuucaaccugcgauccgcucucauggaugucacagccaaucacguagaccccgagagcccucauguuuguauuucuuugcuucuaccauauguucccccugcuucuuacugaagaauagaagcaguucaaugccucaguuucccuacucauaaaaggaggaaaacaacagugguguucucagaauggccuugaggacggcacaggugaaucacgccucaaacagagagagccucugcaaauggaauagccucucuaccacuugccuaugaauccccccaccaccuugacccucgggcacacaucuuuagauuugcugaccaccuucugagcugggucucgcuccucugcccauuagcuuucuuugcccaagcugauuuaucugucauuucucccccuccagccucuaucacugugcguacacacacacacacacacacacacacacacacacacacaccccucuuucucucucuucuugcagccucuucagccacuaaaauuagcuccaucucuaguccacauccccagcacgccuguccugguuucucugggcucccagccacuugcgauauugugucucagaugccacacgcugccugccugaugucacagccgcuuccuaaaacaagagguauuuugagaucuuggagggggugggagcggggggaagggagggauuucacacaucuuccucccgggguguuuuuaaaaaacgcugacacgagagaugugugccccccucacugugccccucacuccuauuuuuaguuucaaagcguccaaaaaaaaaaaaaaaaaaaagcuucagagccaaugagaccucuaagggccccagugggucaaaucuugauuuaaaaaaaauuccacuucugggucuauauccaaaagaauugaaagcagggacucagcuauuuguacacacagguuuacagcagcauuauuuacaauagccaaaagguggaagccaagugcccaucuggaugaacagauaagcaaagugugguccauccacacaauggaauacgauucggccuggaaaagaaggaaauucugacucaugcuacaauauggaugagacuggaggacauuaugcuccacgaaacaaaccagucacaaaaagacaaauacuguaugauucuacucacaggggggacccaaaguagccaaauucacagagauagaaacuagaacggcgggugccaggggcugggggaguggggaguguggaguaggguggggggaguggggaggggggaagggggagucggggagaggggaagggggagcggggagugagaguuuccugggggcagagcuucaguuuugcaagaugcaaaaguucuggagauggauggcgguccugguugcacaacaauaugaauguacuuaacgccgcucaacuaaacacuuaaaaaaugguacauuuuauguuaugcauauguuaccacaaugaaauauauauauauauuuuuugagacagaguuucgcucuuguggcccaggcuggauugcaauggcaugaucucagcucacugcaaccuccaccucccggguucaagcgauucuccugccucagccucucgaguagcuaggacuacaggcgugcaaugccacgcccagcuaauuuuuguauuuuuaguagagacaggguuucaucauguuggccaggcuggucucaaacuccugaacucagguaucugcccgccucggccuccccaagugcugggauuacaggcgugagccaccauuagaacaaugagacaagcaggucaggaggagauagcacauggacagggggugaggauguuaccaccuagucauggcaggggcuugaugccccuggaagauuuuacuggcacaauucauauuacaaauuauuuagugaauacuuacuaugugccaggcuguguucuaggcucugggggaauagcagugaacaaaacagacagaagucccugcccucauggagcuggcauucuagugggggcaggggauuggcaauaaccaauaaacaaguaaauauagcuuggcagaugcucuucagggguguagagggaaauuaagccuagaggcggggagugggguggcacagugcaggugaggcaguuacauguuagaaggacacuugagcaaagacccaaaggaagugaggggggagccaagcagauaucugggggaagaguguuccaggcagagggaacagccugugcaaaggcccugaggcuggggagugcuugguguguaagggacagcagggaacuuguguagcugaagccgagugaguggagaggagagugggaauagagggggaugggggaucacaggggcagaguuugugggucccugugaggagaauuugggcuuuuucuccaagugagguugugagcaaagaggagccagguccugacucaguggcucacaggugcccucuggcugcuguguggggaacaguccuggggguggggcaaggacugaaguuaagagaccagauugggguggaggggcaacugguuuaguccaggccagcaaagaugggggcuggaccgggguggggcugugaagguggugagaggugggugguggauucuggguagauucugaagguagagccaauaagaugugcuaacagauuggaugcaggggguggagaaaaagaggcauagaggcauagaggaagaucuggaggucugaggccagagcacugcaggggguuaaagccgccuuuaccuaaacagaaaauagggcaggaggagcagguuugggugacgguggucuuuuggaggagcuguaaucccucuaacaccucagagucagcugcacacccauguucaugacagcacucuucacaauagccaagaugcagguacaacccaaauguccaucaguaaaggaauggaugaagaaaauauggcguguauauguacacaaugaaguacuauucagucuuuaaaaaggagcaaauuccaucuuuugcgacaacgugcaugaaccuggaggacauuauacuaagaugaaacaagccagacacagaaacgcaaauaguacacaaucucgcuuauaugugagcucuaaaaaauuugaggccgggcgugguggcccauaaucccaucacuuuggaagcccgaggcaggcagaucacgagaucaagagauugacaccauccuggccaacauggugaaacccugucccuacuaaaaauacaaaaauuagcugggcgugguggugcacaccucuagucccagcuacucaggaggcugaggcaggagaaucgcuugaacccgggaggcugagguugcagugggcugagaucaugccacugcacuccagccuagcaagagagugagacuccgucucaaaaaaaaaaaaaaaaaaaaaaauuuuaggccaggugcaguggcucaacgcuuguaaucucagcacuuugggaggccgagguggguggaucacuggaggucaggaguuccagaccagccuagccaacauggugaaaccccgucucuacuaaaaauacaaaaauuagccgggccugguggcaagcaccuguaaccccagcuacucgggaggcugaggcuggagaaucgcuugaacccaggaggcggagguugcagugagccaagauggcaccauugcacuccagacugggugacagagcgagacuccaucucaaaaauaaauaaauaaauaaauaaauaaauaaauaaaaauuaaaaauuucaaaaaauaaaaaauuugaacccauggaagcagagagaauggugguuaccaggggcuggugguggagggauuggggagauauuaggcaaaggauacaaaguuucagucagacaggaggaauacguuuuagagaucuuuugcacagcauggugaccacaauuaaugauaacguauuguaguguauguuucaacguacuauacaacauaauguaauauacaacauaagguauuguauauuucaaaauugcuaaaagaguagauuuuaagcguucucaccacaaaaaauaaguaugcgauguaguggauauguuaauuggcuugauuuaaucauucaaaaauguaaacauauaucagaacaucccauuguacuccaugaauauauauaauuaauuuuucaguuagaaaaaaagucaggcugggugcaguggcucaugucuguaauccuagcacuuugggaggcugaggcaggaagacuuuuugaggccaggaguuugagaccagcuugggcaacauagcaagaccccgccuuuauaaaaaaacuuaaaaauuagccaggcaucuggcucaugccuguaaucccagcgcuuugggaggcugaggugggcggaucacgaagucaggagauggagaccauccuggcuaacacggugaaaccccgucucuacuaaaaauacaaaaaauuagccaggcgagguagcaggcaccuguaaucccagcuacucgagaggcugaggcaggagaauggcaugaaccugggagauggggcuugcagugagccgagauugcgccacugcacuccagccugggcuacagugcgagacucugucucaaaaaaaaaaaaaaaaaaauuacccaggcaucauggcgugugcccauaguccuagcuacucaggaggcugacgugggaggauugcuugagccugggaggucaaggcugcaauaagccaugaucacaccacugcacuccagccucggcaacaaagcaagacgcugucucaaaaaaaaaaaaaaaaaaaaaaagucagcugaagaagauggacccccagggacauggaaacugguuugcacccagagccuuggaucagggccugcauuguggggaagugaccuuggucuggcugguaggcgggggaugcaggucagauuauugaccugggcuuuggugucucaucugcuaauaagggaugcaaaaagccccaaccucagaaucucugggaggcaccaaugggagaauucuugcaaagggcucagacagcccuucccugcauagcacccagcagaacaagagcaaguauaaguauuagcaauggaaugguugcagugugucuagcuaaccucuccugggcaacacugcaucauccaguggccauccccugggaacuaagucaagcagcaaacgucuggaaacagggucuuuacuuuccagaaucagauaaucacagaaucagcaaccucuacuccauguauugaguguggcaguuaagagcuucgacacugaagucaagcuuccucauuuaaaccccaauuccaccacuuccuagccguguggcuuggggcaaguccucuagcuuuucugaacgucaguuuucucaucuguaaaauggggagauugagagugaaugaaauaaucccugcaaagcccuaagggcacagccuggccacacacauguuauaucuguguucacuauuguuguuguuauuauuauuuuuagagauaaguuuucgcccugucacccagggugcagugcaguggcgugaucauagcucacugcagccucgaccuccuggguucaagugauccuccugucucggccuccugaauagcugggacuacaggcuacuguuauuacugauaccuucauuuguccugugaaauagguacaaugagccccugagauauuagguuggugcaaaaguaauugugguuuuugccauuacuuuuaauguacuuuggaucugugucuguccgcaaccaaaucuuauggcgaauuguaauccccaauguuggagguggggccugguggaagguaauuggaucaugggggcagauuuccgccuuggugcuauucucgagaucgugagugaguucuugugagauuggacauuuaaagguguguagcaucuccccacucucucucuuccuccuguucuggccaugugaggacaccugcuccagcuuuaccuucugccaugauuguaaguuuccugaggccuucccagaagcugagcagaugcugccaugcuuucuguagagccugcagaaucgugagucaauuaaaccucuuuucuuuauaaauuaccccagucucaggguuuuuauuuauuuauuauuauuauuauuauuuuuacaaggucucacucugucgcccaggcuggagugcaguggcauaaucauugcucacugcagccuugaccucccaggcuuaagcaauccucccaccucacccuccugaguagcugggaccacaggcgcgugccaccacaccuggcuaauuuuuguacuuuuaguagagacaggauuucacuguguugcccaggcuggucuggaacuccugggcucaagcaaucuucccaccuuggccucccaaaguacugggauuaugggugugagccacugugcccagccaggcauuuuuuuuuuuaauuuuuuaaaaauaauuuguuuuuugagauggagucucacucugucucccaggcuggagugcaguggcgcaaucuuggcucacugcaaccucugccuccuggguucaagcaauucuccugccucagccuccuggguagcuggaauuacaggugcauaucaccaugccuggcuaauuuuuuuuuuuuuuuagaagagauggggucuugcuauauugcccaagcuggucucacacucccaaucugcccaacucagccucccaaagugcugggauuacaagcauaagccaucacgcccagccccagccaagcaucucguuauagcaaugugagaacgggcuaauacaggccccaauuuucagauggggaaacugaggcucagagagacaacagucuugccagaggucagcagagcagcagaggugagcaggaagggugcucugccagccuguccucauuuucccagauguacacuggggacaaugacggcaccuaccaagaaagaugugccuggaggauuaaaugagauaauuuacucaagauauugagaauagcacuagguacaaauuguggaugaauguugguguuuaucauaacucccucgggucacucggcugggcacuggagaagcccaugacugucugacugcaggguccagcuccuuauuacagagcuuugcugcugaaccuacaauuuaaaaacacacaaggcuuuacuuguuuuuguuuuguuuuguuuuaagauggagucucacucugucauccaggcuggagugcaguggcgcagacucagcucacugcaaccuccaccuccccaguucaggugauucucaugccucagccucccgaguagcugagauuacagggaugcaccaccaaacccagcuaauuuuuguauuuuuaguagagaugggauuucaugauguuggcuacgcuggucuugaacuccugaccucaagugauucaccagccucggccuccuaaaguguugggauuacaggugugagccaccgugccuggccugccuuugccuguuucuucagaaaggacaagggaaugaaaaaucagggauuguucccugagccuucgcuuuuucgaagcacucagcauuccuggugcccaaggcuucccacauuguccccuuggcugguacagcugcugaggcgagugugauucugagguuggggcuuuuugaauucccuguuugcaaauaagagaggaaccucagcugcuccugaauccacccagagcaggcugggcagucccuguuuuucuccuccugcuacagaacaacaggacuggaauuaaguauagcucuucuuccuucuguccauccccuagcaaugucugggcaagccuaacaaaagccaugaagccuguauuaucagcuaugaauucauucauuaauucacucauucauucauucacucacucauucauucacucauucauucauccacucacucauucauucacucauucauucauucacucaaucacccauuuaugcauucaacagauuuuuacugaaccccauucucaaguucuacacgaggcucugugguucugucuuuaccccccagaggaaggagacagaugauuaaccaaauagacaacauuaagaggauucacacugaugccacagauggccauaaagaggggaccuaaacugguaucauagugggcaugcaguggggagaucagggaaggcuuccuuccuggaggaagagacaguaucauaucaguaaacauguacuuccuugaggccugagagugccccuuuggcaccuuggccccucuucaaggccccuggacugcccccacaaugcagcaaacaaugaguacacauguggcacaacaggggaaccucuuuucagguuagcuggugucccugccaccuggauguuaaauacuuuauguaucaugucuggguaagaauuaagcagauacagaggagggagcauaucucagacacaggcacacagcaugugcaaagucccuggggugagugggcagaagcugcucguggagaaggcuggugucccuuucccuauuuucucccucuaaaauuugacaguggacagaaggaagccugguucuacaguggggcagagcuguguccaaauccuggcucuagccacacagaacugugagaagguuugaagaugauaagcuauguaaaggaucuaagacccagcagaugcucaguucaugcucucugaaguugaucucuacgccggccucgguuuccauaaaccuaacacugcagaagggaagagagguggaggcagcuaagaaaagaaaagggccaggugugguggcucacgccucuaaucccagcauuuugggaggcugaggaggguggaucaccugaggucaggaguucaagaccagccuggccaacauggcgaaacccugucucuacuaaaaauacaaaaauuagccagguaugguggcgugcuccuguaaucccagcuacucaggaggcugaggugggagaauugcuugaacccaggaggcagaaguugcagugagccaagaucacgccacugcacuccagccugggcaacaagagugaaaccccaucucaaaaaaaaaaaaaaaaaaaaaaagaaacaaaaagaguuggggcgggagggagaagaguuaaggucuccacauagacacccaaccagccuggccucugcccccaccugagccccugagccaauggaaucagagccagguuuccauccagcucugaucaggaguggguaacauuucaacaaacaaaauccaaagccccaguggacagagggagccagguugcgugucugugcaugucagcauggcagacaagaaaucucuucccuugcacgccaaccaccugugaggguucagaacucagauaucacagugagauuugauaaaagcuggaagcaucugaggaggcuguguaaucauucccacuuuucuuuccagcuugcuguaugaugggcccucugcucucagcagaguuuuugcugacauuuuuuccuccuuuucucugugcaagugacacaguaaugacacgucaucuacauugauugcugagggucagggauggaaaggaaucugaaaauaugcucugagggcccacagaagucagggcaaaaggccccagggaacaggaauggggccccaguggccccagguaaauaccagaugggcucuguugccccauuccuugaaucuggaccagcuucauugcuugcuuuggacaacaguggccaacacgauguugugccauuccugggacuagcccuuaagaaggcugaacacuuccucuuucucuuagaaucccauugcugccacgugaacuagcucaggcuagccugcuggaggaugaaaagcugccaugugaacuagcucaggcuagccugcuggagggugaaagaccauagggaguggagcacagucauuccagccgaggucauccuggaccagucugcagccagcuaacagccaaacagaagagccacccagcugacccgcagcugaccaaagaugcaugaaugagcucaacugagaccagauaaagcacccaacugggcccagccuaaacugccacccuucagaaucaugagcuaaauaaaugcuugucauuauaagccacugggucuuggggauuguuuguuacacagccguauuauggcaauauauaacugaugcaaaggagcauacagaagagguaaauaugaguuacacuaagacagaguuuuaaaauaaaauauccugauuuuauuuuauuuugauuauaggugcacgccaccacacccgacuaauuuuuauauuuuuagcagagacgggauuucaccauguuggccaggcuggucucaaacuccugaccucaggugauccaccugccuuggccucccaaagugcugagauuacaggagugagccaccaugcccagcuuucucuuucuuuucugacuauccuguuccccuguuuccugguauugccaaacaaaccacuuguccucaaauuuuuuuuuuuuuuuuuugagauggagucuugcucugucacccaggcuggagugcaguggugcgaucuuggcuuauugcaagcuccgccucccagguucacgccauucuccuuccucagccucccgaguagcugggacuacaggcgcccaccaccacgcucagcuaauuuguuguauuuuuaauaaagacgggguuucaccauguuagccaggauggucucgauuuccugaccucgugauucguugcccucaaaucuuugucucaggaucagucuggguucuggguucuucuuuuuucuuuuuuuuuuuuugacggagucucguucugucgcccaggcuggagugcaguggugccaucucagcucacugcaagcuccgccucccggguucacgccauucuccugccucagccuccccaguagcugggacuacaggugaccgccaucaugccuggcuaauuuuuuuuuuuuuguuuuguauuuuuaguagagacgggguuucaccacguuagccaggauggucucgaucuccugaucucaugaucugcccgccucggccucccaaagugcugggauuacaggcgugggccaccgugccuggcccagucuggguucuugauugcaaaaccaaacacugaccggcuaucuuaggcauaaaagggauuuuuaggaaacucagauaaucaacagggggccagaagaggggauuugggaaaucagcaggaacaauguagccagccugaccuucuccuguagcaggaggccaugaaagaguccaaaccaucauguuuggaucacuugguccauuuucaaauuccuggguaggaaaacgugacugguugaguuuuuuauuaguuuguuuuuugagacaggaucuugcccuguugcccaggcugggcuggaguguaguggcacuaucacggcucacugcagccuugaccuccugggcucaagcaauccuccugccucagccuccugaguagcggggacuacaagccugugcuaccacccccagcuaauuaaaaaauuuuuaagagauaggggucucacuauguugcccagucuggucucaaacuccugggcuuggcucaagcuauccuccugccuuggcgucccaaagugcugggauuacaggcgugagccacugcgccuggcccugguuguuuaaaucacaugcccugacuaccaggugauggggugacaaugaaucccuuucaccuucaacuuauuagugagggugggaucccauagaccagcaguacuuuauagaaaggggaggauucucccuaaauuggaaagggaggucagauauugggaacccaacuaauaauagcaaacguucccuacaguuaacuaacuggucuauggaacugggccuggggaaguaguaauaauuauuaucaucauuauaaugauaguuauuagucuuacaauagcuaauauaauugagcacuuauucugugccaguuuuuguucugaaugccuuauauguaucucacugacuuuuaccuuuugagguaggugcaauuauuauucccauuccacagaugaggaagcugaggcccaauggacuauaucacuuucucuuucuucagacugucccugggcaaguaacauccauaaacccagcccagcaugggucagacauuaacucauugaaccuugaaaacaacuccauaaggugguaguauuuuguuguuguuuuguguuuuguuuuguuuguuugagacaaggucucgcucuguuggacugcaguggugcaagcacggcucacugcagacuugaccuccugggcucaagugauucucccaccucagccuccugaguagcuggaauuacaggcacacacuaucacacccagauaauuuuugcuuuguuuuguuuuuguagagauggaguuucaccauguugcccagaauggccuugaacucccaaguuuaagcgauucacccaccuuggcuucccaaaguguuuggauuacaagcaucagccaccaugccccaccaagucaggggaugcuacuacucucauuuuccagaugaagaaauggaagauucagggagguacaguaacuugcccaaggucacacagcuuggaaacaguggagucagguugggaauccacucuaaccccaaagaccaggucuuaaccacuaugcuuccuuacgugucuauguagacuggcuguccucauuuagagaugccugcacaagaagcagcuggguugcaaagcaauguuuaaaaaaaauuauuuuuugagacagaguccuauucuguuggccaggcaugguggcucacagcugcaaucccagcacuuugagaggccaaggcgaguggaucaccugaggggagaaguucgagaucagccuggccaacauggugaaacccccucucuacuaaaaaugcaaaaauuagccaggcaugguggugugcgccuguaaucccagcuacuugggaggcugaggugggagugcuugaaccugggaggcggaggcugcagugagccaagaucgcgccacugcacuccagccugggcaacagagcaagacccugucucgaggaaaaaaaaaaaaaaaaaagagucucgguuuguugcgaguccaguggcaugaucuuggucucccggcuucaagcggcccaccaggcagccaccucccugcccuggugagaggagaggagucauuaggcaugcaaacuguagaggcagugggacagaugccccuuggaggcaggcuggcauuugucauagcaauucgagaaaacaagaccucagucggcccccaaaccugcggagagauggauggcaaggucuucuccagccccacagggaaaauggccaagaagcucaguauggaacaaggucaccuggccaucuggccuuuacucagucccucuccaccccagcuggaggcagagggagggaagagaacauuuuagcacaauacggugugcugggagcuguccagggugcugaaaccuguaacccgcuaagcuuccaacuuccgcuccuugaguuagcgccgaguagaccccaaggcaaaaacuaggguccaaugguuaauuugggagguaaugcaaggaauuacaagugaggaaugaggaagagagagauugguaaaggguacacuagugaauggguuuuaugugaacaacuaggauucaauuuuacugaggcaccucuaugaugcuguauaacauauuucaguguuuucccacugagcaauggggaagccaggguauuuauacacugacucccuagcucacugguugagggaugcuaccgagguuguuaagcaucuggcucagcaaacucugugaugccagagacugcccuccaacagagauguagagagaugggaguguaccaagaggaagcugcaggugaacuuagacguaagcuagguaaauaaggcauggagaauuuguagcaucuaucacaugcucccccacaagaauuuaaguuuuuuuccuucaguucaccaacuuucgugugugaugcaaacccuaggagcuaggcacuaguuuuacucccuuuuuccaggugagaaaacugagguucagugaguucaacccacauucucacugucauagagggaggagcuuccucugacucugaaguccaggucuuaaccauggcgcuaggccaaucucucauuucuugaaaucucuucugcuccuguuuucccccagccauaguggaacccaagaucagggaggggaaggaaggaucacccugacuucccaugucagagagcucuauucaaauucucaaguuuauuuuccuuggcaaacuugaccuuagagaaauagcguaggauucaagaaaauggguucuagauccagaucugccuuaguucaaauccuggguccaccacuuaugagacagaugcucuggcuugaauauuucaaaccuuccaaaacucauguugaaauuuguuuuauuuauuuuauauuauuauuuauugacacggggucucacccugucacccagccuggagugcaauagugugugugcauuauagcucaugcagccuugaucuuaaacuuuccagucuccauaacuguaagaaauaaauugcuuuuucuuuauaaauuacucaguuucagguguucugcuauaagcaacagaaaacagacuaagacaguaagcauuuaaugucuuugagccucaguugcuccaucuguaaaugggaauaauaauaguauuuauuuaaccuugagaguugaaauaauuuuauuuuuauuuuuauuuuuagagacagucuugcucugucacccaggcuggagugcaguggugugaucauaguucacugcagccucaaauuccugggcucaagcaauccuccugccucagccuccucauuagcugggacuauaggcauguaccaacauaccuggccaacugaaaaaauaaacuuuuuacagagacaggaucuugcuaugcugcucaggcuggucucgaacuccugggcucaagugauccuccugacuuggccuccuaaagugcugagauuauaggugggugccuauguauguauauaauauauaguauaucauauuguaagcaccucauaaguuucagcuuaucaauguugccacuguuguuaauaacaggcauuacauuccuaaggacacuggguugaauacagcucuuugcugaacuuaacacaggcccaguauuauucuagguuuagagaaguguccuagcagagaggcugagauccugauccaccccuuaccagcugugugacucccuugugagcagcuuaaccucucugagccucagauucaucuguacaaaggcuagcgaggcucaaugugauaauacacauaaaacucuuaauguagucccuggcacauaguaaguacucaauaaaugauaagaauaacgaccauggcagcuaacaucauuauuaucacugucacugcugguguuguuagaagauggaagaaaauagcuccugcugcuaggaagugaugugguuccuggugaaacaugguccagcaaauaucaugacaaccaaaagcuuugaacaauaaaaagaucgaugcucucucaaugguauaacucacugagaaugacaaaaagcauuugugucacaguggggaauccuuuugguaccaaggaugacugauccauggaggggagaaacuacugcagagagacauuaaaauaaaaugcugcugguauuuauaggaacuguugcuggucucaugaguuagaaugcugguuguguuuuguuguuguuguuggaaugcuguuuacaugugaaggcaacuaagagcaggugcauggggcaggggugaagaaagaaaggagguaagaagcaacuacauguauuuauucaauuaaucaaaaaggagagaggacaugagagguguauggucaagacacugaccccucugagacuugguuuccucaacuauauaauaaaaagcgaggaacugggauuauucucugaggaucccuuucuuauucucuggaaagaggccauaggcuagucagggggcaagaggaaggaagagagagcugggcucuaguggcagaaccugaggggugauauuaaacauuuauaccacuuccauugcccaaaaagccaggguuccuggcuccaugacuugaagacaccuucuuauucuagaucucuugccaccaucucugugugacuuuggacaaaccacuuguuugugaguaaaacagaagggcuggaccugccagaauccauggagccuuaaaauccaaugaugcggcccggugcgguggcucacgcuuguaaucucagcacuuugggagacagaggugggcggaccaccugagggcaggacuuggagacuagccugaccaacauggagaaaccucgucucuacuaaacauacaaaaaaauuacccgggcuuggugguacaugccuguaaucccagcuacucagaaggcugaggcaggagaaucacuugaaccugggaggcggagguugcagugagccgagaucaugccauugcacucuagccugggcaacaagagaaaaacuccgucucaaaaaaaaaaaaaaaaauucaaugaugcuucaagaccaaaaaacaacaucuuucccugaugguuccuguguaguugugucuuuuccuugccucugaucuucaacaaaauggcccaaagccugagacaguuuauagacccuucuaaaaaggaaccuuccguuucauagagucauaaaaugucagagcuggcaaagacccagagcuucucugucuuauaucucaucugauguucagggcaucugccauagacuucuggacuaucugacuauuucuaucaguguguuggucccaucuucuaaacagcuuaguaaauuucccaggacacucauuaucagaaguguuacccuuuuccggcuuaacaaccauuuauuuuacugagcauuuauuaugugaaagggacagugcuaacccugugaauaaaaaagaaaaaaaauugugcucaccccucucuggugagguucacagucucuuuucuuaacaugcacgauuuguguuauuugaucucuucaauauuuauauauauuugagaaugacaguaaaagaacugucaucucagacauacagccaagcuucugaaaucuuccucuuacacauuuucaguuucaugaucagaacacaaauacaauaaaaacaugccuuacaaggguuugacaacauuauaaaguuaggauuucucugaggcucugaguuacaaagaacaaacagauguccgggguaagaucuuuuccaccaaacuucacccaagaagaagguaaacaccguggugguccacacaaaaugaaucacguuuuaacgcugugguuugcuucaggaaucugagagggcaacagguuaaucagaaaguacucauuaggccgggcacgguggcucaugccuguaaucccagcacuuugggaggccgaggugggcagaucaccugagguccggaguucgagaccagucuggcugauagugugaaaccccgucucuacuaaaaauacaaaaauuagccaggcacagcagugcaugccuguagucccagcuacucaggaggcugaggcaggagaacugcuggaacccaggagguggaggcuacagugagccaaaaucccaccacugcacucugucccgaaaaaaaaaaaaaaaaaaaggaaagaaaguacucauuaaagucaucacugucucaaugucaaauuaauauauuugaguccccuccucucugaaacauagaauuaagugucuacuguguuucucuaccauugacauuggcagaaggcuaggucugcaugaugugugugugugugcgcgcguguuuuuucuuucuuuuuuuuuuuuuuuuugagacagagucucacucugucauccaggauggagugcaguggcacaaucucagcucacugcaaccucugccuccuggauucaagugauucugcugccucagccucccaaauaacugggauuaccagugcacaccacaccaccaugccaggcuuuuuuuuuuuuuuuuuuguauuuuuaguacagaugggguuucaccacguuggccaggcuggucuggaacuccugacuucaagcgaucugcccgccucugccucccaaagugcugggauuacagguaugagccacagagcccagcugggauuuuuuuuuuuuuuaagacaaaaucucacuuuguugcccaggcuggccuuaaacccuugggcucagggaauccucccaccucagcuuccaguagcuggaauuccaggugcuugcccgcugcacccagcucaugcagaauguuuuacuuuccccucccuguuccuagcuuacaacccaacaggacacuaaacagcaccuuggaauuuggaguaauaaaauuugagcaaugugccucauuugaaggagauagaaccaccagacaaaaaggauaacugacuaccagagaaauaagagcaagaaaagcaagugaaagaaaugcauggagaauucaacaagaaaggagaaggggaugugaaaggaacccaaucuagaauagaaggucuucaugauaggaucaggauucccugagaaucuaauaaaaacuacagaccagaaaaaaaaauauacauauacacaauuuucuucuugcauaaaauuucaguggguucauucaucccaacgaugagcucucacccuuaggaccuaucuguucuagaugaaguauuucuccucuagaggaaugagucuagaaucucuuccaucagaugacaggaaacuagaagaaaggccaccuuguuguaagcagggagauacaaacacaagugacaaacugaccuacugaaugacugccuucaguuuaaugaucacuuauugggacccacuaggugucuguauuagucaagguucuucagagggacaaaacuaacaggauagauguauauaugaaagggaguuuauaaggagaauugacucacacaaucacaagguaaagucccacgauagcccaucugaaggaugaagagcaaggaagccagugguggauccgucagaguccucaaaccucaaaaguagggaagcugacagugcagccuucagucuguggccaaaggccugagagcuccuggcuaaccauugguguaaguccaugaguccaaaagcugaagaacuuggaaucugauuuuagagggcaggaagcauucagcacaggacaaagaugaaggccagaagacucagcaagucuacucuuuccaacuucuucugccugcuuuuauucuggccacacuggcagcugauuagauggugcccacacagauugggggugagucugccucuccuaguucaccggcucaaauguuaaucuccuuuggcaacacccucacagacacacccaggaacaagacuuugcauccuucaagcugaucaaguugaugcucaauauuaaccaucacacugcucaauaauauaugagcuucccuaaguguucccauaaccguguuauuaugaaaaaaaaaaaaaaacagggcugcaaaagcccaucaaugauagacuggauaaagaaaaugugguacauauacaccauggaauacuaugcagccaagaaaaagaacaagaucauguccuuugcaggaacacggacggagcuggaggccauuauccuuagcaaacuaaugcagaaacagaaaaccaaauacugcguguucuaagugggggcuaaaugaugauaacacauggacauacagaggugaacaacacgcacuggggccuuuuggaggguggagggcgggaggaggaagaugaucaagaaaaauaacuaauggguacuaggcuuaauacgugggugaugaaauaaccuguacaacaaacccccaagacacaaguuuacccauguaauagaucugcacuuguaccccuaaacuuaaaauaaaaguaaaacaaaaaaaaccacacagggauuuuuaaggcuccuuccugccagcaaggucaagccagccucagccagcagaagccagcccccagggagcaugaauuggcacaaccacuuugcagagcaauuuggcaauaccuaguggggcugaggaugcacacaguauacaacucagcaguuccacuccuggguacgugcccuagagaaacucacuugggagaaagcagggacacuuugggucaaaauagcccaaagcuggaaacaauccaaauagauaaauacacggcagcauacuccuaccacagaauacuaugcagucaugaaaauggaugcauggaaacuauuuuuauuaaucagauuuaucucauguugaacacaaaagucagguuagagaaaugugaaguuugaaaaacaguaccacauaucucuuuuuuucuuucucuuuucuuuuuuuuauuuuuuauuuuauuuuauuuuuuugagacaaggucuuacuuuguugcccagccuggagugcaguggugcaaucacggaucacugcagccucgaccuccugggcucacgugauccucccaccucagccuccugaguagcugggacuacaggcgugcgucaucaugccuggcuaauuuuuugcauuuuuuuuauagaugggguuucaccauguugcccaggcuggucuuaaacuccuggacucaagcagucuuccugcccuggccucucaaagugcuaggcuuacaagugugagccaucacaccuggccuuuauuaaaaaaacaaaaaaacaaaaaacaacaacaacaacaaaaaacauuuuuuagggacagggucuugcucuguugcccaagcuggagugcagucauagcucacuacagcgucgaccuuaugggcuuaagugauccucccgccuuggccuccugaguagcugggaccacaggagcacaccaccaugcccagcugaauauuuuauuacauuuuauuucauuuuguagagacaggguuucacuacauuggccaggcuggucucaaacuucuggccuaaaguaauccuuccaucuuugccuccaaaauugcuaggauuacaggugugagccaccauucccagcccacauauuucuuaucuaugcauguagucaaaguguaaacuauucucacucugaugcuauuuaaaaaauauuuugaaguguaaaaauagguagcauauauuucuuauauacuuaggcagccaaagugugaauacauaaaugcaaauaauaaacauaaaauucaggaaagugccccuggaugggggagagaaaggaaugggucuagggagggagaaaacagggauuagaaagguuagaaagguuuuguuuugcugggcacaguggcuuacgccuguaaucccagcacuuugggaggccaugccagguggaucacuugaggucaggaguucaagaccagccuggccaacauggcguaaacccgucucuacuaaaaauacaaaaauuagcuagauguugugguacacgccuguaauccaagcuacuugggaggcugaggcaggagaaucacuugaaacugggaggcagaggcugcagugagcugagauuguaccacugcacuccagccugggugacagagggagacucuugucaaaaaaaaaaaaaaaaaaaaaaagagaaagguuguguuuugauagcagguuacuccauuacuucucuauccccaauucuccccauucuucuggucaccuucucuagccaugugggucuucuuacuguugaucaaacaugucagauacaguccagccucagagccuuugcacuggcuguucccuuugccugacacucuguuccagcucuccucauggcucacucacucaccucccuuagguuuucauucagaugucacaugcccagugaagucuucccuggcuuccagcaccccucaccccugccugccacacaucccaucccuccccugcuuuauuuuuccucuguaccccucaccgccaucugacacacuagauucauucaucaauuguguccaucuccaucaguagacucucagcuccaugaggacaggggauuuuucuauuuuguuuacugcugugucccagagccuagaacaggaccuggcacacagaaguguucaauaaauagucauugaauaaaugaauguauacacagguguuugcucuauuauucucuacuuaguuuugcaugggaucuugcuagguuacccaagcuggucucaaacuaguuaggcucaagcaauccucucucuccagccuccugaguaauugggguuacaggcaugugccacuguacccagcuuuauacacuuuuaauuuuuauuuuguggagauguggucuugcuauguugcucaggcucgucucaaacuccugggcccaagcaauccucccaccuuggccucccaaugugcugggauacaggcaugagccacccugcccagcuuuacauuuuuuaaacaauaaaaaaguuagccacuaggcuguuucuagaugaguuuccuaguagacuaagagaaaagugcccaguaccauaauaugcccuuggaacccaccaaggucccaagccaccgaacugugagcacagccaacaaagaucccucugugaacacccaagcccaugagagcuagcccagaguccuuacaacagacugcugacaucugaaggccucuacagaaacagcccaauaggccacagcuccuucugugagaggcaacauugcucugaaacaaaucugcauugugagagcccggccagcacagugugggugcugcaacccaucacauccgccaagagagacagaaccuggagcagcaacaaaacauggaaagcuaugauccuguaaaugauuacuaugaaaaagguguccagugaagaagggucuuagaauagaagagcccagacuuagcugagaggagaguagagagugggaagaggaggaaccagccauugguaccagauacuaaugucccuacuggaaucuaauaaaaguuuuuaaggucccugacagacuaguaggucauucuccaaauccauuucccuuuucuucuaagcacaaucugauacuucccagcuucccuugcagugauguguggucaugugaccgaguucuagccaauaggauaugaauggaacagguaugggucacaccccuuccaaacucauaaaccuuuccaaguaucaccuucuaugcucacuucuccuuccugguuugauacagacaagcauggaguuauuggaugaugugggcugacaaugaagagccacaauauggcaagggucaggguccgucagucauuggaggagaugagccugucaacuaggaacaauuauuuuggacuuuuuuuuuucgagauggggucuugcucuguugcccaggcuggagcacgguuggaugaucauagcucacugugcccuccaacuccugagcucaagcaauucucccaggcauguaccaccaugccugguuaauuuuuauuuuauuuuauguuuuacagauggggggguggucucacuguguugcccaagcuggucuugaacuccugagcucaagugauccucccaccucagccucccaaagugcugagauuacaggcaugcaccaccacacccagcucaauuuugaauuuucuaugagugacaaauaaacuucugccguguuuaagucauuuccuagcuuuggaucuuuuguuauaccagcaagugcuaccucauacagggugcuuagaggaaagcauauacacauuucaaccacaguucaucauauauggaucugaaaacuccuugaagacaguaacuguaccuuauuuagcuugcuuuucuccuuugucauaaucacaaucccuugcacccagacauucucaaaaaacauucaccaaguugaaauaaaagcaagauauccucaagcaaaucaagagacccaugcacguacaacacuuaaaaccuugaguucuggaaugcauaaucuucuguucaucucccaguuccaucacuuacuugcuggguggccuuaagcaaguuacacucugaguuucugauuccucaguggucagaugggaauauuaauauuuccuaauucaguggguuguugcaaggauuaaauuagagaaugggcauaaagcacucuggaagcagccaacaauaaugagcuauuauuuuaauuguaacagaaagcaucugcuguaauauacagcugagacauggaggugggguguuggcagaaaggaggcaggcgcauaacaaggggagggagaacacaagggcucagccuuccugagccuggcccggaccacaccaaccaaaagccucguaauccuucagcuaguuaaauccaaagcguauagcacgcgccacuuaccccguuagcaccaccacaaaguccaugacauuccagccauuccucaaguaggagccuuuguggaaggcaaacccaagggcaaugauuuuaauuccagccucgaaacaaaaaauuccaaugaaguaugguucugugucauccuggaagggagagaaggcaaggucagcgucuugggcugggcagauguugacaagaucagggaaccagcccaccuagaaaucaguaccuaucacccucucacuuccccugacccuccugcacucaccaccccucacugccucuugcagaguucucuuguccaaagccuuuugcgagcaaagccaaugccuagagaaggcaccuuccuccuucauuccuuuugggccaaccucacauaucacucagcuaaacagaauuauuuguuugcaccugucuuauucaauacgacagucacaggccacauguggcuauuucaauuaaaauuaauuuaaaugcaauaaaauaaaaaacacaguucugcagucacacuggcuacauuucaagugacaauccuauuggacagggcagauggagaucauuucugugacugcagaaaguucuaauggaaagcauugguuuagagaauuuacuugucacaugcagcguucaagguauuugaggcuagagcuugugcauugaccucacuccuaaaucugaccccuuaggaugguucucagcuggcauguagauuguuaaagguuuggaauaggacuucuguacuggcugauaaguggccaguauccucaccuccaguuccucugcagaaccuccggcugguucuggcuuccagcugcuaaucuaucauauuugaaauuaagcuacaagcucuucuccaucagagccccaaugugaauguuuucccaucuguuacagcaacguuucucgagcuacaaucauuuucacucugccugaaugauuuuuuuuuuccacauuagcuugccacugguacuucuacuugcuuaccagucuuucaauggacgcuuuuuauuuagcuuuauuuuaagugaaaaugcaaagaucuagaaaucauagguuugcuaggcuaguuauaguuuuuagaagacugugacauugugaaauguauguuuggucuuugacacuguuuccugguguacagcuccuaaaacccuugggaucuccaaagggaugucuuuuugcaggcuaaggauugacugauggcuggcagcuucuagguagcuucaggauggggguuggucaccgggaaaaccaaggcaugauuagagguuuggauuuaaaucauugaccguuggugaucaacuugauuuucagccccucugcccucccagagguugggggguggggcugaaagucgcaacccucgaaucaugccuuggucuuucuggugaccagucccccuccugaagcuaccuagaagcugccagccacacccuucuccuauaucucacccuuugcaucucuucaucuguauccuuuguaauauucuuguuucuuuuuuuucgccucccccccaccaagauggaguuucacuccuguugcccagacuggagugcaauggugcgaucuuggcuuacugcaaccucugccucccggguucaagcgauucuccugccucagccucccaaguagcugggauuacaggugugcaccaccauauccagcuaauuuuguauuuuuuuaguagagacgggcuuucaccauguuggucaggauggucucgaacucuugaccucaagugaucuaccugccuuggccucccaaacugcugggauuacaggcaugagcuacagugucuggccaagacauaauuauuaacauuaacaauguucauuugaguauacugccugaaauuaugucagaugccaaagugggcaguuugagaccagccuaagcaaccuagugagauccccaucucuacaaaaaaagauaaaaauaagaaaauuaacugggcaugguggcaccuguagucccugcuacucaggaggcugcagugggaggauggcuugagcccaggagguggaggcugcagugagcuaugacugaaccacugcacuccagccugggugacagagcgagacucugguucaagaaaaaaugaaaaggaaauuuaggcuucccaugaucuggcucugggcuccaggacugagagccuccucugugcccugcuccacucccccaaaaauuaauguccugcuaaagccaaggagaagacccugagaaaagacaucacucaccagccguucagacaucggggucuugucaucaucaggcagaugcugcuccagugcgaggacgaugcaauucgcuaugaugguggcuaaaaucauauauucaaagggaguauuggggaauuaaggaaaaaucuuguucaaagaaaagaaggguguuggaggugcacccacccccacugaccccaguggaaagaucucaagcccucuagauccuuccaacucaucagcacagguggaauuauucguucuccugucuggaguagaucccugcagaucucaaacccagaucaggugacuucuaaagggaaauguggauauucaccuucuaucucacccacaauauucacugaacacauauucauucaguaccugcugugugccagacucuguucugggcuagggacacaguugagagcaaagcagacaagaggagaagcuuccuccugcuucccagaggagaagcaaauaaaugagaugacuacaucauguauacuaugcuauacaguacacugcauauaccauguuauacaguacaucauauaugcuauguuauguaguaagauggugaagacuauagacaguggaaggggucagggcugcaauuucaaauaugguggcagggccagcaugauggcaggcaccuguggucccagguacuugggaggcugaggcgagagaauugcuugagccgaggagguagaggcugcaguguacaaugacuauaccacugcacuccagccugggugacagaaggaggcccugucucaaaaaaaaaaaaaaaaaaagagauaaauuaaaaauagauagaggcugcgguggguggaucacuugcggucaggacuuugagaccagccuggccaacauggugaaacccugucucuacuaaaaauacaaaaauuagccaggcguggugguacacaccuguagucccagcuacuugggaggccggggcaggagaaucgcuugaaccugggagguggagguugcagugagccgagaucaugccacugcacucuagccugggcaacagagcaagacuccaucucaaaaauaaauaaaauaauaaauaaauaaguaaauaaauaaauaaaacauuaugaucagauuugacaccuaaugcaugauccacagaagaaaaaacagauaugcugggcuuuaucaaaauuuaaaccuuuugugcaucaaaggacguuaucaagaaaguuaaaaggcaaguaacagaauaggagaagcuauuugcaaaucauguaucugauaagggucuaguacuauauaaagaacauuuacggccaggugugguggcucacgccuguaaucccagaacuuugggaggccaaggcggguggaucaugaggucaggagaucgagaccauccuggcuaacacggugaaacccuaucucuacuaaaaaaauacaaaaaauuagccgggcgugguagcgggcaucuguagucccagcuacucgggaggcugaggcaggagaauggcgugaaccugggaggcggagcuugcagugagccaagaucgugccacugcacuccagccugggcgacagagcgagacucugucucaaaaaaauaaaaaauaaagagagaacauuuacaacacaacaacaaaaagauaauccaauugaaaaauggacaggaggcuggaauagacauuucuccaaagaagacagucaaauggccaauauguacaugaggguauuagugaucagggaagugcaaaucaaaccccaacgggauacugcuucacauccacuaggauagcuauuaaaaacaaacaaacaaacagaaaacaaguguuggugaagaugugaagaaauugaaacccucaugcuggugggaauauaaaaugguguagcuggccagaugcgguggcucaugccuguaaucccagcacuuugggaggccgagguaggaggauuacuugagcacaggaguccgagaccagccuaggcaacaaacugagacucuaucucuacaaaaaauaugaaaaauuagccgggcauaguggcgcaggccuguagugccagcuacuugggaggcugaggagagaggauugcuugagccccaggagguugaggcugcagugaaccaugacugcaccacugcacuccagccugggcaaugggagugagacccugucucaaaacaacaacaacaaaaacaacaacaacaaaaaaacaccagugcaacugccauagaaaaccauuccuugguuccucaaaaaguuaaucacagaguuaccaugugacacacaguaacuccacuccaagguauaaacacaaaaggaucguaagacagguauuccaacgaacacucauacacaaauauucacagcagcacuauucacaacagccaaaagauggaaacaaccuaaauuucaccagugggugaauggauaaacaaaauguggucuacucauagaauggaauaguauucagccauaaaaaggaaugaaguaggccgggugcaguggcucacgccuguaaucccagcacuuuggaaggccgaggcaggcagaucaccugagguugggaguucaagaccagcaugaccaacauggagaaaccccaucucuacuaaaaaaaguacaaaauuagcugggugugguggcgcaugccuguaaucccagcuacucaggaggcugaggcaggaggauugcuugaacccgggaggcggagguugcagugagccaagauugugccauugcacuccagccugggcaacaaaagcaaaacuccguuucaaaaaaaaaaaaaaaaaaggaaugaaguacugauacaugauagaacaggaaugaaccuugaaaacauuaugccaagcgaaagaagcagacauaaaauaccccauauuguaugauuccauguauaugaaauaucccgaacaggcaaauccagagacagacagcagauuuguuguuccuggggaauggcaagggaaaugggaguggcugcuuaauguuuuagaacuagaugaaggugacaguuacacaacauugugaguguacuaaacgccucuccccuccccucuccuuucuuuucuuauuuauuuuuacuuuuauuuuuuuaaagaaacacaauuuugcucugucacccaggcuggagugcaguggcaugaucauagcucaccgcagccuugaauuccuaggcucaaacgauccuccugccucagccuccugaguagcugggacuacaggugcacaacaccaugugugccuaauuuuuuuuuuguaagagacagagucuuacuuuguugcccaggguggucuugaacuccugggcgaccuuucuuccucagccucccaaagugcggggauuacaggcaugagccacugugcccagcccuaaaugucacuuuaaaaugguuaauuguguuauauuaauuuuaccucaauaaaaaaaaaauuacagugaucagggcagaccucugagaaucuguucuuccaagacccgaggcaggggaggggucguccaguaaguaucucuagaugccccauuugcauucucuccaguuugcauagguaaacuccucccugcauccugggaacugucauuuggguuuaggaggccucccucccuagugucccaccagaggaucugcagggcagguggggagggucuaucuuguucauuucauauuagcuccuaaccugcugaucagcugguaaaugggaauguccgcugucucccugccacaccccucagaagugucccacgccaacaggcucugcauauggaucuggcaaucucugaggagguguaagcgcuggagaagcggcugcuugagugaaaaagccauaggguguugguuacuccggagcaggauuucccaaccucagcacuagguuuagggguggaucauucuccuugguggggcugucugggcacugcagcauguucaacaguaucccuggccugugugugcuagaugccaguagcagccccuccuguccagugaugacaaccucaaguggucucuaaacauugcugaguguccccugggggcacugaaaucccgcauucuguagagagaucaauuaguaugucuuggggaacuugaccaugcuaaaccucuccccuccucguagcucuaaccuuuggaaaauuaauugguuucagucuccucuucugcccuggaguuagguuuggcauuuuggaagcaccauaaaaccaucccuuccaggccggagggagaguggaaccugcuuuccaggugggaaaacggagucugaaauagaaacccccucaguaaaagucucggaaagccaggaaaaccaggcuuccuuuugucaccagcuucagccuuugccuccagcugaaagcacacucugaaaagcaaaauccgagacucagggcaauuuggggagccaacaaaagccggccuugccgacgaucaucucugauuggcuuucugccucugagcugacaggcauuaggagcccagagaacaaagcugggcuguguugcacaaauacuccacucugccucacccugcagccuggaaaauaagagacaauauuuguacacagagcagcaacgccaagcccuucccuggucuccucucgcuaugauuugaagcugacuucgcuuucucucccugccaacucagccuccuuacacgcgcuucugccaucccacuccuccgguucccuggucuccugccccucaauggcagggaugugacuuccuuuggaccggcucuggcacugaagguuccaggaagagucccagaaguccaccaugcagcaugcagcacuuuuaugggcugcaauaucaggguuucaacuggccaguguugccuggauuucagacccagggcucucuggguauggcaauaaaaccuuagcacguaggcaaaaauaaagagguucuacucucccaccuugcuucauuuucuuacuucuuaucaaacacagauacucacacugcuuuuccaacaucauccccccucccucugcucacccgcacccccgcaaguguccacagacaugccccagauggacaucugcaacaaugaccucagacccuugcuacucaaaguguggucccagaaccagcaccgguuaggaaugcagccuuagaccuugcauccaccugcugagucagaaccugcauuuaaaaagaucgccaggggauuugugugcaccgggaaguuuaggaagugcuaagugccucuauuucagggauaggaggaggagcucagguaauugcgguuuugagucauccagaaagagguggggguuccuguuucuccuccaagcuuucuccuccacguucugaccccagggggagaacugaacagcccuggguaccagccuucugcucccacuuggguaaagagccugagaagaaaccgaagauuuugaugaaauaaaagcaauguuggaaugcgacaaaagcagaaaagaaaauuucagccuaaugcauguggaaguauucaaagccuucccauggaucccaucucacucaaaagcaaaaacaaaguccuuccagcaccagcaaggugcaugaccugcucccauuaccucccuccccucaucuccucuauucucucccuuagucacucagcuacagcaacgccggccucccuuuuauuccccaaacuccccaggcacauuuguacccaggggccuuuguaccugcuguucauucuccuggaauagucuuuccccagacauccacaugacucccucccucacuuccuuuaggccuuuacucaaaggucacauccaucaacccccuuagccugcuuauuuuuuucuuucuuuaguccccguccccagucaagcaucugcuauuuuuuuccuucuuuaucuuguucccugucucucccacgagacugcacacucuaugcacguggggauuuuuugucuacuuuguucacugcuucauccucugugcccaggagagcauucucuauauaguagaugcucaaaaaacaccaguggaagggccuggugcgguggcucacaccuguaaucccagcacuuugggaggccgaggcggguggaucaccagaggucaggaguucgagaccagccuggccaacauggugaaaccccgucucuacuaaaaauacaaaaauuagcugggcauaguggcagacgccuguaaucucagcuacuugggaggcugaggcaggagaaucaccugaacccgggaagcagaguuugcagugagccgagauaacgccacugcacuccagccuggacaacagaacgagacuccgucucaaaaacaaaacaaaacaaaacaaaacaaaacaaaacaaaacaaaaaucaccgguggaggaaaugaaggaaggggacauggguccugcugccuagaaaccccgacuucaucucaagccaagucuccaugagcauguuaaggacacaaugaaacccccugaaauaugcaaugauguacuuggugcccagaugaaagaaagaugggcugcugaguucuuggcaugguaagagaugccucgcccgaggcagaagccaaagguuucacuggguagucgagcuggggggcaggcgaggcuuucucagcccaaccucaagucaugccugauccucccgauuuagaaagccugaguucuaacucacagcugcggugagcaaugccucuguuagcugagcugagccuuucugcucccugauuggcucggagagaaagcaccugugucagcgggauccagaaaaaucagccauccuaggaggccaaagcggggcgggggcugaaagaagagaagcaucccugaugggaggaaaagcuggcuuccgaaauggcucucggaagucaggauagcagacagcccugcaggcaggugaggagacacagagcucuauacacaaugaaauugaucaggaccugcagaggccccagagagaggcuguaugugacccuggaaaagaccaaguuugacucugcguagggaagaaggagggcuugcaucugagaacaggaccuugcucuucagauucagaacaugaaggaaaauucucaaagugggcguggcugaugguucccaucccuuagcaagaccuugcaguguccaaguaauccuugcaucccucuguggugcccuucacccucaucucauuucaagccuccugugguuggugcggaaaucaaaucagguuugucaacucuuugugaccuugucuccacuauggggacugcugauggguggguucuaaggaaacagauacuuguagcaguuagccaggucauugagcuugugugaagaagccaaacagaccucauuuucauguaaguuccaugcucaucacaaucaccaggaaaaagaguagaggguaccagaacccuagauauauggguuuaagacauauuccuugguccauuaaacacauaccccaauuucacucugcaauaugaucaacuauuauggggccauuaacaagcacagcgaccauaauuacagcugccuuguuuccaacugcuucuuugggcagauaccgugguaagcacuuuguuucaguuaauuccuugcaacauuucuacaagguggguucugugguaagccucauuuuccacacaagaaaauccaggcucagagagauuaaacaaauuuucaaggucacauaggagguacuggcagagcuggggcucacacccaggucugcccaacuccacagucuaugccuuuuuuuguuuguuuguuugaguuagggucuugcucuguugcccagggugaaauacaguggcacgaucacagcucacuguagccuugaccucccaggcucaagcgauccacccacuucagccuccugaguagcugggacuauaggugcaugccaacacaccuggcuaacuuuuaacauuuuuguagagaugagggucucaccauguugccuaggcuggucuugaacuccugggcucaagcgauccucucaccuuggccuuucaaagugcugggauuacagguaugagccacugugcccagcccacagucuaugcuuuuaagcuggugguccccaaagaccacucaggagcuauccugguuagaagauagauggguuugccuuuauuuaaaaaaaaaaaaaaauagaaugcaggugcacuuggggcccuaaccauauggauuagaccaaauggguuacaccucacccaagucccaaccaauggccacaguuuaguaaaggccaaccauugcaugcuaguccacgcccucauaagcccaucucaaguaggaauuauucaugacuauuucaacuucaaacaauccaaacagucuccaguucccagacaugggcuuuaaaaucuucaacacacaguucuaaccaaaaugaagccuggaaaagaucucuccacucgcugaucagccuaagacucuuagcagggauggcaugcuaacaagggcaacccuagcgcugcccgggauguuuucagcaccacggccagcggcaaagaggcacaaguuuaauuucacuugcacccagggaugggaauccccggggagagaaaacaaaaccagcagcaacuauuaacacucucugagacaucugcaaagaccuacauuucacauacaggguagaggcaaaaaagauuaaucaugucaucaggaaaaucaaaugaagagaaaauuaaaaacaguaucaaauagguuugugugucauuuguuuuucauauuauccaacaauguccaacacuuugguucugaaaugagaagucuacucagggcugcuaaaucaugcuucugcuuagaaaacuggcaauaucugcacuaaaaaauaguagugcagaggaguugaaaggauuuggggaucagacguggccuugaccuugggcaaggcaguuuccuucucugagccucaguuuccucauauauaaaagguagaaaauagcaucaaccucauagguugugugagaauggaaugagcugauacacacaauaaucuauuacagggcccugcauauaguaagugcucaaggaaugugaguguuuuauauuguuuauuuugguucccaugaugacuagaaaauuuaaugugggccaaaugcagagguagaugccuaucaucucagcccuuugggaggccaaggcagaggaucgcuugaggccaggaguuugaggacagccugggcgacacagcaagauccugucucuacaaaaauacauuuaaaaauaagaaaacuagccaggcauguuggcacaugccuguaguccuagcuacucgagagacugaggcaagaagauugcuugaaccugggaauuugaggcugcauugagcuaugaucauaccauggcacuccagucugggcaacagagcaagacccuaucucuuaaaauaaauaaauacauacauuuuuuuaaaaaagaaaacuuaauaugcuuauaaaaacaggauacaauuuaucucauuguaaucaugcaauaaauguucauuacuuuaugacaauugcugcuaauaguaaauaacuuuuccaauuuuuuuuuuuuuuuuuuuuuuagagaccgagucuugcucuuucgcccaggccagacugcaguggugcuaucucggcucacugcaagcuccgccucccagguucacgccauucuccugccucagccucccgaguagcugggauuacaggcgccugccaccgcgcccggcuaauuuuuaguauuuuuaguagagacgggguuucaccguguuagccaggguggucucgaucuccugaccuugugaucugcccaccuuggccucccaaagugcugggauuacaggcgugagccacugcgcccggccaacuuuuccuauuuuugcccuucuaggucuugguuccuuuucuuuucuuuccuuuucuuuugguuucuuuucuuuucucuucucuucucuuuucuuuuugagacagagucuugcucugccacccaggcuggagugcaauggugcaaucucgguugacugcagccuccaccuccugggugcgagcaauucuccugccucagccucccgaguagcugggacuacaggcgugcagcaccauaccuggcuaauuuuuuguauuuuuuaguagagacaugguuucaccauguuggccaggcuagucuugaacuccugaccucaagugaucugcccaccucagccucccaaaguacugggauuacaggcaugagccaccgcguccagccuuaguuccuuuucuucaaggagggagggaagggacaauaccuaccgucaucauagcugaacagaccucucaaaucugaaauguuuccaagaacauacugcagugcaugcauaugugugguccacucacugaauauuauacucaaaauaaauguugccaaaaaaaaucuucauuggacauuucauguaaauggaauuaaacacgauguugccuuuugugucuggcuucuuucacucagcaucaacuuuuuuguuuuguuuuguuuuguuuuuugagauagggucucacucuguugccuaggcuggagugcagugguaugaucauggcucacugcagccucggccuccugggcucaaucgauccucucgccucagucuccugaauagcugggacuacaggcacaugucaccacaccuggcuaguuuuuuguaaauuguuuuguagagauggaguuuugcuauguuacccaggguggucuugaacaccugggcucaagcgauccgcccaccucagccucccaaaguucugggauuacagguguaagccacuguguccagccacaucauauuuuugagguucaucuauguuguagcaaagauuaguauuucauuccuuuuuaaggcagacuaauaucugaggaaggcauaucacacuugguuuaucuguucauccauggauggacuuuugggauaucucauccuguugacuaccuagaauagguaaauccauagagacagaaugcagaugggugguugccagaggcuggaggaaggugguggggaggggagaaggagagagacugcuuaauggguacaaggucuccuuuagggguggugaaaauguucuggagcuagacagaggugguaguuacauaacaguuggagugcaguaaaugccacagagccguucacuuuaaaaugguuaauuuucuguuaugcaaauugcaccugauuuuuuuuaaauuccauuuugguuuugcuuuuuuuuuuuucuuuccccuugacucucuccucaggguucccaucaugggccuuuacucauugcacuuuacccugggcgacacagugaggcucuguccuuuuuuuuuuuuuuuccuuuucuuuuuuuuuaagacggagucuugcaccuaaccugggucagcacccaggcuggagugcauggagugcaguggcacgaucuuggcucacugcagccuccauuuccuggguucaagcuauucucgugccucagccucccugguagcugggacugcaggcacccaccaccauaccuggcuaauuuuugcauuuuuaguagaguugggguuucaccauguuggccagacuggucucgaacuccugaccucaagugaucugcccaccucaaccucccaaagugcugggauuacaggcgugagccaccaugcccauccgagacucugucuuuuaaaauacugcugcugcugcugcuacuuucuucaauaauaauaauaauaaucaucaucaucaucaucugaccacgcauccuugugcacuugugagaauuuuucugcagaauaaauuccgugaugugaaauugcugauuuuuuuuccucugagcccucaaccauuuagagaagcaugauauggacgguuuucaagaguccuucccucucucuuuuaaauuuccauuauuuauuuauuuauuuauuuauuuauuuauuuauuuguagagaugggucucgcuauguugcccaggcuagucucaaacuccugggcucaagcuauccuccugccuccccaccucccaaaacacugggauuacaggcgugagccacugcauccagcuacagggaaguuaauguuuuaauaaaagcuggaggaggcaagggaaugagcccuguuucugucugggagaagaguaacccaggaggggaagcagccaguacaaagaaugugugugggaaaaaauuugaaagacaaacacgaaauugcuagcagagguuaucucugggaggugggaugggguaagggcuuuucaccuucuaaaugacacacuacacauuuuuuaagcuuuuaaaaaaccacacaaaacaacaagcccauauucuuuucauaauuaaaaccuuuuuuuaaaaaaagggggaugccaggcaugguggcucacaccuguaaucccagcuacuggggaggcugaggcacgaggaucacucgagcccagaaggucaaggcugcagugagcugugaucacuucacugcacuccagccugggugacacagugagacccuaucuuuuaaaaugauaauaauaacuaucucaccauacauccuugugcacuugugauaauuuuccugcagcauaaauuccaagaugugaaguugcuggaugucagaggggaugcacacugacuuuuucuuuucuuuuuuuuuuuuugugagacagagucucagucugucgcccaggcuggggcgcaguggggugaucucggcucacugcagccucugccuccuggguucaagugauucuccugucucauccucccgaguagcugggauuacaggcaccugccaccaugcccagcuaauuuuuuuauuuuuagugaggauaggguuucaccacguuggccaggcuagucucgaacuccugaccucaggugauccacccaccucggccucccaaagugcugagauuacaggcaugagccaccauacccggcccacauuagauauuuucuggauauuuacagggcuauauuuuacaguuuuuaaaaagugagaugagugaguguguguguguguguguguauguaccuucugaaauuaaauccauaauuuaaauguauaaauuccucugggccaaaaaguuuaaacauggaagaauuaacaugacucauggaaaacacacaaauacacaaaaguaaaauaaagaucccuugaugaaaacagaaagaaaaaacaaaacaacaagccaaguuuuaaacaaaaaguauuaaucaauuucagacucucggggucgggaagagagugaggagugaggaugcuucagugucagauuccaaacaagaacugaagaccuucucccuguuuaucuuuuuuucuaggucaguaaaguucucuagggaccucugaguggugugaggucucugucuccugauucaauuuucaaccacuuucccuuauauguucacucuaccaagggggaauccuuuuccucucuggcaauagugacaucccuguucaguggucaguaaaauccuccauuucccuggucucucucuacacaguccaucuacuucaugguuuaaacuuaaaccuggaggucaggcgcaguggcucacaccuguaaucccagcacuuugggaggccaagguggccggaucacuucagaucaggaguuugagaccagcuuggucaacauggugaaacccugucuccacuaaaaauacaaaaguuagcugggcaugguggugcgugcuuguaaucccagcuacuuaggaggcugaggcaggaaaacuguuugaacccaggaggcggaggcugcagugagccaagaucgugccgcugcacuccaaccugggugacagagcaagacucugucucaaaauuaaacaaacaaauaaaaaaccuuuaaccuggaaauucccugcagaccaucaacucuaagaccaagguggggccacuggcagccucaaauuaguuccuaagaacaaaaggaaagcucagcucuggaauauguccaccaucauggcccccagaaaaaccagugagaagggccccaagaaagcaagagaaucaaagaaagaccuucccaacucagauaagguggaaaaggugcccccaagaagucaggugaggugaggagggcucccucaaaagcagguguagccaagaaggcccccaagaaagucagcaaagccaaggaagucuuccuuaaaccagccaaugccaugaaggucccucccagugcugcugggcucaaugggaaguccaaagucagagguagcaccagcagccaagauccugagauccacaggaaaacagaagcugggagcuaagacuccgacggaaccuguuaacauuugaugaccuccaauuucccuguggagagaccauuguccaugcugguccccugcuuccuugaucacuggaggaugucccuaccucuucaucaauaaccaaugucuccuccaagccacuccagcuaugcaugcucagaagcuacaccagccaccuccaaaacaccuguuuccagcauccuugucuugaaccaccucuuuuuuuuuuuuuuuuuuuuuuuuuuuugagacggagucucgcccugucgcccaggcuggaguacagcagcuccgccucccggguucacgccauucuccugccucaggcuccugaguagcugggacuacaggcgcccgccaccacgccuggcuaauuuuuuuuuuuuuuuuuguauuuuuaguagagacaggguuucaccguguuagccaggauggucucgaucgccugaccuugugauccgcccgccucggcuccccaaagugcugcgauuacaggugugggccaccgcgcccggcugaaccaccuccucuuuaaccaccucccagcucacuaacucccuuaaaugcaaaccaacguccaucccaucgagcccugcaacccacugaccccgccauuucucaggacccucuccugccuugucaaccuuacauagguugauuauaucgcacuuucuugccuccuguuucucuccuggaaaaaauccaucccugcaugaacucaacuaguugccuuccccauaccugggcaguggagcauuccugaaugagaucaacuaucugggcuggugacauuaaauucaugaugcuaaacucaaaugggcauuugagaaucccagcauccuauaucagagaagacacccgugcauauugguauaauggaugggaaugacccaauuuacagaaaucaauauucuuccaucauuaaaaccuccacccuugacugaaaauuuuccuucagccaccaaccaauuucucuacuccccuucaugaagaguugccuucacguguuccugccacuuccucacugcacauucuucuccuacccuccccaggcugguuucuagcccccaucacucaaccaaaacucuuccaaagaggaucaccaaagacccccaggcugccaaaucccagggccauuuuucugugcccagauuacuugaccaugcccuucuuaauguuguucuaguuuuccuccuauccuccuggucucuacuucucaaucuucccuuuuugcuccucuuuuucuauccaaucucuaaauguuggucuucccuggggcuuaauccuagguaaucacccuuuaucuaucucuauccucuuucuagagcuugcaugcauuucgauguauuuugccauucucuuguugcccuuucucccuaaaauauccacucauugcccuguuuggcauccugguagaggcagggcugacuucugugacugcaucauccaagcccugcaacgcugcccuccaccacaucuucugccuucuggguuggcuuggccaacgggaggcaccagcaagagaucagagaggagggggaguuggggcauuucuccauuugauuuccucccugcuacaguguguggucuuagcaauagcuauaccacucugugucuucuuagagcaucucauaggagugucuauauuagucuccuagggcagucaugacaaauugccacagauuggguggcuuaaaacaacagaaauuuauucucucgucauccuggaggcaagguucugaaauuaggggguuucccuucaaaggcucuaggggaggauccuuccuugccucuucccgcuuuuggugccucuacaugucuuuuggcuuguggcugcagcacuccauucucugcuucuauugccacaugacuuucuccccuguaccuucucauauaaaagcacuuaccauggaaucucgaguccacuguaauccaggaugaccucaucucaaucccugacucaaugacaucugcaaagauccuacuuucaaaugaggucucagguucugaaguuccaaaugcaucugaauuuuugguggacaggauucaaaccacuacaguguccaaggcccaaacucuuccauucccucccuaaucccaugucucuuucucuauuaaccuuuguuaugaauuguaccaccagcugccuaguaaggagcucaaucagguaagguuacccuaagagaccuucccaguuccuacaucuuccucccccuacagcugauguaucaucagaccccaccaauucuacuuccgaaauuagacuuugaauccuccugcucagcauugccucuucagcaccacccaaggucaagccacugucccuucccacagaaauaucuauaaucucaguagacuccaaaguggucuauccauuucauucuccagagagaagccagggcauuaugcuaagugaaagaagccagacacgaaaggucacacagugccugaauucauuuauaugaaagagccaguauagguaaauccauagaaacagaaaacaaauuuguaguuaccaggagugguggggguuggggggauaccgggaggggaggaugaggagcaacugccucauggauacaggguuuucuggagggguggugaugaaaauauuucagcacuagaaagagguggagguuguacaauauugugaaugcgcugaaugccacugaauugcucauuuuaaaaugguuaacuuauguugcaugaauuucaccucaauacaaaaauuauuuuauugagacaggaucucacucuguugcucaagcuagagugcaggggcacaaucacggcuuacuggagccucaaccuuuggggcuccagcaauccuccuaccucagccucccggguagcugggacuacaggugcacacuaucacacccagcuaauuuuuaauuuuuauuuuuauuuguagugauggggucucccuauguugcccaggcuggucuugaacuccugggcucaagugauccucccaccucagccucccaaagugcuaggaucacaggugugagccaccaugcccagcuaaaaaauauauagacagguagauagauauguauauauguauacauauauaugcuuuauauauguaauauuauauguuuguauauauguauauauauuuaaaguaaagcaguucugucccaucccacuuaagcuucucugaggacuucucauugcauguagaauaaaguucaccuccggaacuugaccuagaaggucuugugugaccugucucugccaacuucuugggugucuucccaccugugagucccuuugcucaucagacucuagcuacacuggcucauuuuuaacaugaugaacuuguuccuuccccagggccuuugcacaugcuguucccucugccugggauucucuuccucccucugucucauucuguucacacucugcucugugcuuaacaaccuucaggucuucacuuacgugguaccccuguacuucuaauuauccucuacgcaaagggccuguaguagguuacuuauuuuauuuuauuuuucagagauggggccuugcucugucacccagccuaaagugcaguggugcaaucauacccaugcuuuagccucuggagccucuggccaugaccuuauuuaguaaaacggccucugcaaguauaauuaaauuagagaucucaagaugagauuguccuggauuaucugacgggcucaaaauccaucgacaaagauccuuauaagagacagaagaggccaggugcaguggcucacaccuguaaucccagcacuucgggaggcugaggagggaggaucacuugagcccagaaguucaagaccagucugggcaauauagugagaucccaucucuaucaaaaauuuaaaaauuagcugaguaugguggugcacgccuguaagucccagcugcucaggaggcugaggugggaggauuguuugaugcugggaagcagcaguugcagugagcuauaauugcacugcuguacucuuguacagggugacagagugaggcccugacaaaaaaaaaaaaaagagagagagagaagaggaagagaagacacugacaugaaggagaaggccaugugaagacagaggcagagacugcagugaugcagccacaagccaaucaagccaauguaugcuaacaacuaccagaaacuggaagaaucaaggaagcauucuucucuagagccguccaagggagcucagcacugcugaugccuugauuuuggucuuccagccuucagaacugggugacaauauauuuauguuguuuuaagccauauaguucauggcaauuuguccuggcagcccuaggaaacaaacacaggacccugcugguuuucucccaaacacuuaccacaauuaguaauuaugucuguauuugccuauuccuuauuuuaugccuucuuuuccuguuacaaguuccaggagggccaggaggaaccacaucuguccugcccacugucauguccccaccauguacaucccaguuccaggcacauggcaggcucccccccaccccccugccucccaaaauguuuauugaaugagcaaauggauccaccucuccuucauuucucuuuacaucucagcggcaguccuucuugcaucuuccaccuucacuucuaacucugagcuguugcauuagcaacuccaguuaaacagauuuucuggaaagccccggccucccaaugaaaccucccucacuugcuccccacugcacuuccccaaauauuugggucugccucgccuuuuccaucacugguucugccauccaugaagauucuccuugaagcuuuaucauuaaaaaauaaacccacauauucugugucuccaaaagaagcuuuuacuuuugcaaacucuauugauuuaauccuagaggcugcuggcagcagucccaggagcuuaaucaauaugacaacacccagcgcagacagaacaucaaggagccucggccaagaucuccugcucgggucuucacugaccccgacugaaucucuuacaaccaugaagacagauuuacaguagggggcaggauauuugcaacagcuccaggaucuugcuuaggugagcaaaaggaaaugccuccaagcuugaggcgcuucagagcuauuuguuaauuugcgacuauggccgauucccauaagacucaaggaagauggaagacaacaacagaaaaacauugcagguucuagaaccugauuauaaacucccugguggggugagcaggggaggaacaggcaaaggggaggugggaaaaagaagaugaagaugucaagaguuaaaaaugcaaagaguuugccaggugugguggcuuacgccuguaaucccagcacuuugggaggccaaggcgggcggaucacaaggucaggaguucgagaccagccuggccaauauggugaaaccccgucucuacuaaaaauacaaaaauuagccgggagugguggcagacaccuguagucccagcuacuugggaugcugaggcaggagaaucacuugaacccaggaggcagagguugcagugagccaacaucacaccacugcacuccagccugggcaacagagggagacuccgucucaaaaaaaaaaaaaaugcaaugaguuaaaacagacauuccuucaccccuuagcagacacuaagugaccagagaaggagaaaaaaaggucauagaaacaaggagguugagaaugacuaaaucaaugccccaggcuuuagaaaccauuaaucuccucgaaggagaagucaaacacuucucacauuuuauucaagauugaaaaacaggaaaauuagaagcacuauaggaagaaauuggaaagcaagaaauauuuguuaaucagaaguuuacaugcaugugacauuuccaaaccuauugagcccuuauaggaaaauaugaauauccaucccuaaaacauacaucaacauaaucuuccuggagacacugugauuagauaucagccccaaaaugcagauaaugagguauacagucagccuagucuauguccugcugcaguaacaaacaauccccagaucucagugguugaacacaccccaggucuauuuuucuacucaugcuaugaagugggauggggacugaucuaugucauccucucuccagcacuuacuuugagagaggguccaucuuugugcauccaugacaguggaggcaggaaaaaggaaacauggugaaucccaugcucacccuuaaggcuucuguccggaaggacucacgucacuuccccucacauuucauugaugaaaccaaaucacacagccauaccuaacuucagggagguggggaaaaugacacucuacucugugcccagagaaaaacaagaaauguuagcugaacaagguaaaggauacccccucaggaagaucauaugacuugcccaaaguaaagcagcuuugaaggugucagaagugggaccugaauucaagacuaaaugguccaugucuuuuugcacuaucacccugaacuuggcaggaguugagaauuaaaucuagauagcagugaagagaaacaucaauggaggcagggggcagaaggaacaagggaaaauaauacaucaaguaagggagaaauaaaaggagccagaaaauuacaaccagaacauaauuaaaggaguuucaucuuuagaaaccaaaacacauugugaaaaguagggaaaaagugggggaguuuuacacucuuuucagggagaggcaaacaguaacgggauagugcagggguuuauaugaggcuauauaaggaggcggggacacaaccaugaaagaaacuuguacacuucuuguucuuccucugaagcugccaucuuggcucagacugaagguccaacaaaugcuaguuggugcaacagcagcucaggaagcuggggccagggcuuaccaggacuuccaucagcugcacuguuccucccuggacauuuuccugcucaguucugggaaaucuggacaagaguuggaugauguuccagaacagauggugcuagcuugguucuucugaucauuccuccccuaucccuaacccaagccagacuggaaguaagaagggauccugguucugccacccucccggccagcaggugagaauucuacacagccagguaggucaguuuagcacuagagcagggauucuggaaggacucaccaucauugccaacucaucaucaccauuucaguuuugagcaccuaugauaugccaccugaguacuuucugugcaugaaugcauugagcccucaccaccugucugccuagaaauccuacuggucaacuuucaacuuauauccagaauuaguaguuuccagaagcugggggaagggagaaacuggaaguaacuacuaaugggugcaggguuuccuuuaggggggaugaaauguucugagauuaaauagaggugacuguugcauaacagggugacuguaguaagugcuguggaauugcacaccucaaagugguaaauuucauuuuaucacaauaaaaaaauucauuuuaucacaauaaaaaaacuuaaaaauuauaaccagaauccagccacucauuauuaucuccacagacaacaaccugguuccacccccacuauuaccugccaggaccaacacugucaccuccuuccuaauuccccagcuucugcccugccugcccccaaccuucaaagucuguucuuuucacagcagccagaggagccuaugaauaucugagucaggucacgucccuccucugcucaaaagcccuccguggcucccagcucccucagagcaaaagccaaaguccuccccgcagcccauaaggcccuccaaaaccugucccgucaccucucuguccuuauccuugcaccuucccucucucuugcucacuggcuucagccacaucugccuccucacugucacacaugucacauauaccccuaccucagggccuuugcaccagcuguuccuucuuucucuagacauccucacagcuuccucaagucuuggcuccaaugccaucgccucgauaaagcucuaucuaauacagcaacugccuccccagcccuuucucugcuguucucuucccauuacccuuauaaucuucuaaaguacuaugcaacuuaccuacuauuuuuguuucuuaucauacaucucuccccaugagcauguaagcucccagagggcagggacuuuugucugcuuccugugucuugaagagugccuuggccaccauguauacuccuucaguguuugcuaaacaaaugcacagccccaugaggcaaggacuguuuugcccauuuuauggaggaggaaaacugagacucauaaucagguaugcagcagcaaacugucugaauucacagcccaaacucaacacagcgaucguuccuuauuauuauucacacagcaaagauggaccaggcaguguucuaagggcuggggaugcaacagaagacaaaauagauaaagcugagcccucauggaggugaugcuguaucugguucaguuguuuccugcccaaacucucauccacucucacuuuuggcucugacaguggccucugaguaacacagugugacaugccuucaacuaugaucugaauguucuauagaagccgccuuuccauuaugcaacugugguggcuuuucuuuuguuauacgacgauuauuugucaaccccacuaucuuugcacucaaccaugggcccccugggcucagagaccucgugacagucaucuucucaucaccacaucugcaaauguguggguggauggggcagcaacaguccaccuccuccaagaagcagucccugauuuuuccuccccagacaaaucuucgucucucuguucuuggaaacucaaagaacuaagcaccucccucgagcugcugugcaaauguguguguuguguuuuauuugguucuuccguauuuucacucuggaagucgacaguucuggccagaaugccacccgcccccacaaaauaaacaugucauugugauaaauguuaugaaagaaauggggugaagucuaauucagacuuggggugaguugcugggucaggaaaagcucuaaggauguuccuuuuaagaggaaaccuaaagguuuuauuauuguuguuguugcugucauuuuuacagacagggucucacucuaucgcccagccuggagugcaggacgcgaucacucacugcggucuugaacuccugggcucaggcacucuucccaccucagccuccuaaguagcuggaacuacaggcaugcauugccacguccagccaauuuuuuauuuuuuuguagagacgggucuugcuauguuacccaggcugguuuugaacuccuggccuccagcgauccuccuaccucggcuucccaaagugcugggguuacaagcgugagcuaccacaccuggccuaaaggauuuauaaggguucaccaagugaagaauugggcaaagguauaaguauuucacagcagcuuuguucauaauggcccaaacgagaaucaacagaaaugccaaucaacagguaaauggauaaacaaacugugguuauuuccagaugaaugcuauugagcaacagaaugacagaagccacagugcucacucauccaacacauauuuaucaacugcuuacugcaugccaccugcugaucuaggcuguucuaguccacauugguggguaaaaccaaaagaucaggugugguggcucacaguaaucccagcacuuuggaaggcugagguggguggaucaccugaggucaggaguuugagaucagccuggccaacauggugaaaccccaucuguacuaaaaauacaaaaauuagccaggcaugguggugggugccuguaaucccagcuacucaggaggcugaggcaggagacucacuugaauccgggagguggagguugcagugagcccagaucgugccaccacacuccagccuggguaacaagagcaaaaccucaucuucaacaaaacagaacaaaaaacgaauaaaaucaccuucccuuguggagaucauagugauguagggugacagauagcagacagaugaguaaguaagaaggugaaaaguuccaaaggggaaaauaaggcagaagggcgggaggcaaaugcugagaagguggccuuugagugaaguccugaaggagaggagggagaagccaugaggucaccugagagaagaacaaugcagacagaggaaacagccagugcaaaggcccugagguaggacugugccuggugugucugaggaagaguaaagacaauggcaggagcugggugagugaggccagagaugcucgugggcuuuuccaagugaucuucucgggcuuucucccaaggcagagaaaaucagcaaugggaaaggaaaauggcaacuucuggagcuugggaagaaaagaggaaagaggaaagaaaaaacgaagagagggaagaggaggaggacaggccugagcucagaguccugccaccuucacucuucaugucuuaucagacaaacaagccuggagucaggagagcccaugucccaguggccugccaugcuguccuaaaagacagaccaacagagagaaagaaaggcuggccuuuaagaaaggaagggcaaagaagaacauaaacaaagcaacagaaaaaguaaagcuaauauauaauaacauauacuauaccagccguugacaaacucuggcccauggcuuguuuguguaaacaaaguuuuauuggcaaauggccaugcccauucauuuacguauugccuguagcugccuuugcuauaauggcagaguagaguggucccaaagagacaguauuuacuagacauuuucuagcuaauccuuugcagaaaacauuuucugauccccguacuauaacaauaacauacaacuauauuagcauauuacguauuuguagcauauauaguugaccccugaacaacucagguuugaauuuuauggguccacuuauguagauuuguuuccaauaacaguuacaccaagcgugcuugucuuucuggccuccccuuccaccuccaccucugccaccccugagacaacaagaccaacuccuccucuucuucagccuacuuaaugugaagacaaugaggaugaagaccuuuauaaugaucccuuuccaauuaaugaauaguaaauauauuuucucuuccuuaugauuuucuuaaaauaauacuuucuccucccuagcuuacuuuauuguaagaauacaguauauaaugcauauaacauauaaaaucugucuucaucgacuguuuauguuacugguaaggcuucuggucaagaauagacuguuaguaguuaagcuuugggggagucagaaguuauacacaggcugggugcgggggcucacaccuguaauccuagcacuuugagaggcugaggcaggaggaucacuugagcccaggaguucgagaucaaccugagcaacaaaagcgagaccuugucucuaauuuuaaaauuucuaaaaaauagagaaaaaaaguuacacacacauuuuugacugcacaggaggucauugccccaaccccuauguuguucaagagucaacuauauuuaucuaugaauauauaauuacauaacauaaaaugguuuauuacuauuauaaauaacaugcugaguucuuaccaugugcugggcacugggcuaagcuuuucugccuaugcucuuguauugaaucugaucaaaaacucaucagauuaggacaauauuauuauuguuguuauuauucauugagaccguggacuccgaaucuagauagccuaggcugaaaucccacuuuuguugcuugaggggugcaagaccucagauagugagucucucucucuguuucgguuuucucuuuuuguuacacgggaugauaacaguacccaccccucagggcacugaaaggaugagcuaaauugaugcaagcgaggugccuggcauauugaccagaacucucauuaccauggcuguccuuauuuuacagaugaggaaacugaggcacgggaaggugaagucaugggcagccaccacugccagaaguggagagcuggcaaaguuggggagagggugauaaaaacuaggaaucacggcucucaugauagguggaccuagaagacagcacuggggaacuugguccugucuaccucucaccucauuguccuagaccugggagugggcagaaggcagggaccugcuggucagcugccagaggcaaugagggguugcucuuccguucuccauggaggggaagaaggccgguuaagcuugaaugguggaagcuaagacagugacagcccuaucaucacagauccuuggaggaguucaaagaaguggguggggcggggaggggacagaccauuguuacagccgcugggcugacccugggggcuggagaugaggaugcacggccaguacagcuggaccagauuggagucaggcgggcucacaccauuguuaacaugcccagcuucaacgucacuuguauaccuacuucugguugccaagauaggcuacaaagagguaggagcaggugaggggcagguugcuuccugccccugggacccaaguccaccucccuggacccagccugagggaccguuucuagguuucaccuccaggaaagugacugcuugguucaggcagcgaucacuugcuuucuguucugacuccaucaaggcaucuuuccccacccagccucagguuaaggugaggggcuugccaggggcacagacugccugcagagacccccacuaucucaguucuaccucaucuccuggagaagacagcuauccaagcagaggaccccacacucaagcuuggcauagaauuuaucucccuuggagaacacggaaagauuuucacuuaaagggaaagaauuugcagaacaaggaaagaaguaagggagaaaaaaagaagagagcagauacuggcauguagagggaacuaagaaccaauaaccaucaccaccacugcuaccaccaauaauaagaauagcaguaaggaggccgggugcgguggcucacgucuguaaucccagcauuuugggaggcugaggcgggcggaucacgaggucaggagaucgagaccauccuggcuagcagugaaaccccgucucuacuaaaauacaaaaaaacuagccgggcgugguggugggugccuguagucccagcuacucgggaggcugaggcaggagaauggcgugaacccaggaggcagagcuuccagugagccgagaucgugccacugcacucccgcuugggugacagagugagacuccgucucaaaaaaaaaaaaagaauagcagcaaggcaaaccuucuuuuucuuuuuuccaccugagaaccuaguuucacuuugugaaaaagacaaagugacguguccacuaaaccuucuucuccauggacugaauuucucaguucccccugcagucagauggaccauggguauuggcugucuuccauuaccccaaauccacucuccuuccuucuuuacccuucuaggacugucacauggggggcugaccuguguggaugggcucacugggcucccagcccucuggcuuuggacaaugggggacauuuauucugccagcuuccuguuaggaaaugcucccucucucucuuucucuccccccuucuuucucucaacuugugugugugugugugugugugugugugugugugugugugugugugucuuugugagucucagucucucucugucucugccuccuuccucucuuccuccuucucuauuucaguaagggcccacaccuuuguaagcuaucucuuaauuugauucuuaagcuaucucuuaauuugauucuuggucugugucuuccguuuccuacugggacccucucucauacaccaugggaugaaauuccaguccacagaaugcaggcagaaguaagguucacuacuucuauauguggccucccaaaacuuccugugugagccuucauacucuuuuccuacaggccggaagugaaggacuuucugaucuuaggggaugguggagccacagauggaaagagccggguccugaaaucaccacauggaaugccacuugcugauuaucugauuggauuuagggugagugagaaguacauucguauugccuuaagcuacugcagacuuggggguugcuuguuacagcagcaagcauauccuaauacaccuuuaagaagacugcucuuccccacuuggagaaguuggcuccaccccaacuccauaaagucaugugacccaagccuaagccaaucagagcaccccguucuccaccucccauuuccccacagugauugguucuggcaugagcacacgaccucagcaacagccaaucaaaagcaagaaagcauuugcugaaaauuccgggaagauagcugaaaaagagagaagaaucucucucugaauauggucuugggcagacuggagggcuggaagugcagcuaagucauggauaauggagccagcugcaaaaaguagagccaagaaacagaaacagaggccuaaugguguuaucugaucccuagauccaaacaagccugaagcuggacacuccugagacucuucagucucaugagccaauacaauccccacuucuuguuuaagccccuuugaguuuuccaccucuuccaaguaaagggaacuaagggauucacauagguaaauauaaugaguccacaccaugugucaggcccacugaccucacagcaagucaacagguagauauuuuuacuuuaauucccauuuuauaggcaaggaaauggggaccuuuuaaauuggccaggagcaccucaguagggaaauuauuugcaaaagaguauguuuggggauugggugugugagcuugaguaauugggauugggcugaaaguccagaaaccaauccugaaaccaacaucuuuuguaugauuucaagagugccaauuaacuucccccguucuauaaaaaauggagauaaaaacccuuccacuucucccccaccaauuccauagugucgguuuggguaacaaaguaagguaacaguuaaaaggugcucugaaggaaaggcuagcaacucauccuugcuguuguuaauaaacagucauuguugaauuggcuccagaaacccugggggccaggggcuguccagugacucucuuggccagaauuccaaagaccaucuguggcaaauacauccuccagagcacauacccuuggcaggaucacaaacugcuuuucucacccagaaaacacaaccagaaaagaaacagagauagagagaggggagagaggggaaaaaucaugccagcucaaaauuucuuuuaaucugaucaaugauuuccaucuccacagccaccaugccagcccaaggcacacuucccugaaugagugaaaucauuuccuaauuggucucauggcuuuuuauucuugcuguauuccaauacauucuccaugcagcaaccaguggaacuauucacagacauaaaaucauuguauuacugcuucaguagccugacagugccuuuaggauaaauaucaaacuccuaagcaccuuccacaggaccuuugcacaugcuguucccuguggccaaaacaucuuuuccaccauucccaccccuacaauagcagaggcccacuaaagacucaguuuaucagcacuucccuggaagauguuguuucacauguuucuuuuagagcaagccagacuugucccuuuuugcaaggccuauaacauuuuaaauuauaaguaguaauaacuauuuacaugucauccuugccagacuguaaacuccaugaaagccaugauugcaucugucauauccgucacuguaacucagugccuggcacacaguuggcacucaauaaauauuuguggcuucaaagguugaguauaaaaacagaccagaugaaagaagguaaaaguuaaacagucaagagguugucuugcagaucauuggggcaagaaugggcuuuuuaauaaaugaugcugggacaauucuuauggaauaaaaaggaaauuggaccccuaccuaccaccacauauaaaaaucaaucccaagcugauuaaagacauacagugaacacaacuguaaaacuuucagaaauaacauaaaauauauccauggccucaggguagaaaugauuuucuuaaauaagauacaaagcccacaaacuauaaaggaaaagauuucuaaaaucaaccacaucaaaauuaagaacuguuggugaucaaaagacauuauaaaaaagaucaaaagccaagccaagagaaaauauugcacaacauauaaugaugaagaaucaguuuccaggcuauguaaggaucacccacaaaucaauauuuuuuuuuuaaaagugaccuaaucaaaaauggacagagcauguagaggcacuucacaaaaaagcaagcuugaauagucaauaaauauuuuaaacuauguucacucuaauuugcaaucgggggaugcaaacuaaaaucacaaugagaaaucaccaugagaaaggcuauaacuuaaaaaccugacaauaccaaguguuggcaagguugugaagcaucuugaaugcucacccaccaccggcaggaguguaaauuagcacaagcacuuuggaaaauuguuuggcaguguuuagucaaggugaaaauguacaaaucuuaguauccaacaauuucacacagagcgaugugcuccagagagaccccugcaagcgagcagcagaauccauaaacaaccaacaaagcugcuuaugccagugcccaaaagagaacaaagucacaugcucaucaucaaugaauaaacaagaucaugaaggagcugcagugaccacaaugaggaugaaaucucacaaagguaacugcaaaccaaugaagcaaaauacaaaacaacuccucucacaugauuuuauucauauaaaacucaaaaccacauaauaucugacuauauugcuucaggaugcguacuuaggugguacaaccacacaagaaagcaagcgaaugguucccauacaaucuccaauagugguuccuccaggagggaaggaguggcugugauugaggaugagcaugagggagaaucugaugguggcccuguggcucuugaccuggguaaaauggguguacgcuucaugguuuggucuuuaaaauguucaucuauguuccuacacugcucucuagguuuguucugucucucucucucucucucugucugucugucucucucucucucacacacacacauacacacacacgucaguuaaagacuaaaaaagaaagaagacacauacaccaaccaacaguuuaugcugagaaagagaaaaggggaaaauacccagacagaaaauuaaaagauaacauagacacaggaaaugaaaagagaugacgaguuggcaagacggcgaggguaaggaaaugagaacuggagagacagaaaaaagaaaaaaauaauaagauggucaaggauaacaggagaaggggaagauacaagaagcaauauucucucucuucuuucugucucucuuucucuaccuccauaucucucccucuccuucaucccuuccaucuuugucucucucucuuuucccucaccauugccuuccuugcacuuccuccauccagguccuucucuccccuuccaucucugucucuuucucaccuuccacuuuucuuucucucucaucucucucucucucucugugucuccucuuugucuccucugucucuuccuucuucccuacacacgcagccucucuuucuuuuaacacuuauuuaucagguggcuacccugugcuggacacagugcuaaaaaagaggcccuggcugggggaaaugggauggcauggcccaccgugguucccaagcaucaguggcacggacgccugcccagggcgccucaucccagcuccagcauggaccugugggccgccugccacucucuccccaucauuaauuucacuaucaaacacucccagcaucacaaguuguaggucuuauuuauuaaauauuuaacuaggagaaacccagcugagaugaaaccucucauuuguggcagccacaggagagcagaacauggaccugcugcugggauuaagccaggcugaugaguagaaccagggugcccagagggggaaacaggugggggcagcccccaguggggagaggaagacccagaaaugcagggagcugggcuuucacacagucucaccuggauggcgagagguugucagccagggaaggcgaguucaaaaacccccaaaaucagaauaggucaaucuauacagacagaagauuaguaguugccaggggcugggggagcggggagagacagggagugagcgcucagugaguacggggucuccuuuuuggggucuuugaacuacagagaggugaugguugcacaacacugaguguauuaaaugccaccaaacuguacacuuuaaaaugguuaauggucaauuuuauguuaugggaauuuuaucucaauguuuuaaaaauuaaaaaaaaaaaaaucccacacccaaacccauuaaccauuagcucuaaggcugcugaccucauuuuuuaaaauucaugcuuauuacacaggcacugcuuacuaucaauccaaggcacucgcucagcauuuuggguuucuuucuuuuuuagaaauagggucucacucuugucccccaggcuggagugcaguggcaccaucauuguucacugcagccuugaacuccugggcucaagggauccccccaccucggccucccaagcagcuaggacuacaggcaugcaccacuacaccuggguaauguuuaaauguugcccaggcuggucucaaacuccuggcuucaagcaauccucccauuucagcgucccaaagugcuaggauuauaggugugagccacugcaucugacccuacucagcacuuugaaucaucccaucauuuacuucucacagcccugggagggaggugccagcaggucucuaguuuuagagagaagggagcuugugguucagagaggguaaguggcuugcccaaggucacacagcuccaacuucagucuaccugcuuagccaccuaaugggcuuucugcuaacucuggcugaacuuuagaaacccuuggggaguuuucaaacauuccccacuccaggggaagcccuggacaaaucucuccagcaucuguggggguggagcuuggggcaucagcauuuuccuuuuucuuuucuuuuuuuuuuuuuuuuuuuuuuuuuugagacagagucccacucugucacccaggcuggagugcagcagugccaucucagcuuacugcaaccuccaccucccagguucaagcaguucuccugccucagccucccaaguagcugggacuacaggugugugccaccacaccuggguaauuuuuguaauuuuuaguagagauggaguuucaccauguuggccaggcuggucucaaacuucugaccucaggugauccacccgccuuggccucuuaaagugcugggauuacacacgugagccaccgugcccagccucagcauuuuuaaagcuuccaagugauuagaaggugcagucaagaucaccugaggaaucucacugaagagcagauugggauugagcaggucugggguaggggaugagauucugcauuuccaacaagcucccaggagaugcuaauucuguugguucagggacccuggcaacauguccaguaggaugcucuagaucugcacuauucagcacaguggucacuaagccacacagggucaucgggcacuucaaauguggccagugaaacucagggacuguuuuuauuguaauuaauuucuuuucuuuucuuuuuuuuuuuuuuuuuuuuuuuuuugagacggagucucucucuguugcccaggcuggagugcaguggugcaaucucagcucacugcagccucugccuccuggguucaagcaauucuccugccucagucucccgaguagcugggacugcgggugugcaccaccaugcccagcuaauuuuuguauuuuuaguagagaugggguuucaccauguuggccaggaugaucucgaucuccugaccucaugaucugcccgccucggccucccaaaguguugggauuacaggugugagccaccacauguggccuguaauuaauuucuaaaauugcaauagccauguguggcuacugccuaccuuauuuggcagcauaggucucccgggcucaagagauccuccuaccucagccucccaaguagcugggacuacaggcaugugccaacacccucggccaauuuuuguauuuuuuuguagagacgggguuucaccauguugcccagccugcucucaaacuccuggguucagccucucaaagugcugggauuacaggcacaagccauugagcccagccuggucugcaucuguaagugauccaagacuauggccaagggugagacaaacaccuuaggggagcaaugaagaaauuaggaacucacuuggguccuccaccuuuccuuucucagcacuggccaccuguucaggggccuucaccuguccccuugggucuccccaacgaaucccugcuucacuccccagagagaaccaucagagccuccccacaccagccccugacuucuccuacuccucagaucacccuaaaucaagcccacaucuccccuuggguuuccuccuaucucaguuucucaguuguaucuccugucaccuccaaaugcagcuaagaucaccugggagaucuuuauuuuugagccuuaguacuuaccacacucaaacuauccuuuaccuguuuaucugguccuuggacucccucucucuccccacccagaauaucagccacaccagggcggggauuuuuguccguguguuuauuucucucuguguuuuguccaucuacgucccagugcccaugccaaggaggaaauuaagagcuugcuggucauuagagaaaaguaaaugaccagcaaugacuaccugcugagaauuuacuaugugccacgcaugauguuuuacagucaccauccacuuaauccuugcaacauuccugcaagaaaaugcuacacugcuuaucuuauagaugacgaaacagagugguuaagauuagguagcuucccaaaagccacaccaccgauagaaaccuaguccuagcccaggcgugguagcucacgccuguaaugccagcacuuugggaggcugaggcaggaggaucacgaggucaagaggucgagaccagcuuggccaacauggugaaacuccaucucuacuaaaaaugcaaaaauuagcugggugugguggcgcgugccuguagucccagccacuugggaggccaaggcaggaaaauugcuugaaccgggaggcagagguugcagugagcugagauugugccauugcacuccagccugggcaacagagcgagacuccaucucaaaaaacaaaagaaaagaaaggaaaagaaaagaaaagaaggaaggaaggaaggagaaagaaggaaagaaagagagagagagagaaagaaaggaaagaaagaaagaaagaaagaaagaaagaaagaaagaaagagaaaagaaagaaagaaaagaaggaagaagagaggaaggaaggaaaggaaagaaaggaaagagaaaggaaaaaggaaggaaggaaagaaaggaaggaagaagggagggagggaaggagggaaagagaaaggaaaggaaggaaaggaggaaggaaggaaaggaguaaggaaggaagaaggaagggagggagggagggaaagagaaaggaaaggaaggaaaggaagaaggaagggagggagagaaagacaaaggaaaggaagaaggaaggaagaaaggaaggaaggaaggaaaggaagaaaccuaguccuaguugagcucagacucugucccuuaaccaucgucccgcgacaucucuugcccacucgcacaccaaccucucuggaaugcaaaugguuucccggagaaaacuugaguauuuuucccucuggguuuuuauccuugcugugccuucaccugucucauaaaguuucuccauuugcuagaugugugaccuuggcaagcaguguuagcucucugagucucagugugcacaucugcaaacugggggcaaaaauaagugccaugagcucugggggcugggaugaaguucucauaaacugccagggcaguucuauaaagcuuaggggcucauaagcuccccacagagaggagcuacuguuacuguaacuauucaccacaaagcagagaguuuccauguccuccugggacauggugcuuccucuuuaucagggauggagugaaauccugacaugagcaagggcaggagccaagaaaagggccuuuccgucaugaauguggaaaauggucuguuugcuuuucaucagguuuuggggguuggggacaugggggauccuguuuggucaguuagaggaguugcagcugguccuaaagcuuggagagcuugcacuaaaucuuguggcugccauuucgcuuugaaauaaaggggcugucuaagggccaggugugguggugcacaccgauagucccaacuacucaggaggcuaagcugggaggauugcuugagcccaggcgguugaggcugcagugagccaugauugcaccacugugcuccagccuaggggacagagugagaccucaccucuaaauuuuaaaaagggcuugucagcaccaacagagguacacagaggcgcacacacacuauugcacuggggagggaggaggccgauaccuauaacacuaauacaucagacucuuauuuggcacccacugugugucagguacuguuuugagugcugcuuuccucacaaccaccccacaaugcaggcacuaauguuauaccacuuuuacugaugaggaaaggcaggcccagggggcuaagugauuugccuaaaaugauaugaauggaaauaagcagaguugguauuugaaccuaggcagccaggcuccacagccucccucccuccacuacacuggacugccucaagccccacacagagccaugacaugccucaauuucaacagaaacuugcucaaucccucaaagacaucgguaaagaaugugccugagaaaacagaggaaaggauauccaaacagcccacagagaucuggaaaaugcucuaugucuuaagucaccaaagaaaugcacaggauaccacaacaggauuucacuuucacuuaucugauuggugaagauguaaaaucaagggagggcaagccugauugggccacgucgucagggaaaggggaccuuggaauuugaaagggcacagacuuccuguuucuugcaaccuggcccaaaagccugacauacaaccuugccauaccauuuccaggaaucuguccuagggaaacagugacagaagugugcaaagacuucucuaccaggaugcucacugcagugugaucaguguugguggaaaaacggcuggucucaaaacaaauauacaaaaggaagcccauuuuuguuaugaaaaucaaaaaguuuagguauaucggggggaaaaaaggagugguuauuccauuuccuuuggaaaaaaacaaaauccucaccauaguucacaaagcccagaauaagccaaccuugucaccucccugcccucacguccucccauucaccuagcauacaguaggugcucagucaacauuuaugaaugaaugaacgcacuccuucccauuccccuccaucucuaagcugauaugcuccagggucucucuccuguacguuccuaaggguguggggaucaaggggauauagaaacacaguccauaccagcagcauucaccaugccaggagaccaaagaaaguaaggcacgauuuucaaacagggcaacagaaggggaaggagagagaaggggaggccgccgcaguuuucauuccaacauuuuccagcucugggugagauuuccuucuauacacucaucuauauuuacaucaacgaaucugucgguagcaagccuguugcuucuugugugggaucuaaaguucacagaaagcuggcuuagacacccagcuaggaagacaaacuguaaauuaaauuuaagucacccaaaaacccuaaauccacccacuccucuugaagaaacccaugacaucgauuacaucaagauuucucaaccuugguauuacugacauuuggagcuggauaauucuuuacugagaaaggcuguccugugcauuuuaagaugcugaacugcaucccugguuucuaccagccagaugccaguagcaucuugcccccucccccuacauucgugacaaccaaaaacgucuccagacauugccaaaaguccccuugggggaaaaauugcucccaguucaaaagcacugcuuuacaugcagcccaggaaaaauuccaaaccauuuaacuguucuuucucuguuccuugucaucaacauccugaauauaccagucaccuguucucaaaauuccuucuacagauucaaagaaagugguaacagcagaguuucaauuaugggcuuggagugccauauauagacaggaauuucauucagaaaacuaucagaaccuuggacagagauucacacacaaagauguuuacugcacuguuauuuauaauggcaaaacaaacagccagagauuguuacaugaauauaauacacguauaaaguggaacauuaucagauauuaacaacagucuuuucugggguugccaccaacccauacagcaccacuguaugaauuuaaacaagacaccccuuucucugguugugaaauuaaacaagacacccauuucucugauugugaacuuaaacaaaacaccccuuucucugucaaaaauugucauaauagcuucaucuugcuagaacaagauacuuaagcuuuuaucagcugggguacugaaauaguagacauacaagcuccaugauacuuaagauaugugacaugcuaucuuugugcagugcacaaccugugcaacuauacaugguggcccuuauuuuuucaaggauaccuaguggcauggaaauguguuccuaaaaguuuacaugcauaaaaagguaugggaugaaauacauuaaaaugucuucagagauuuuuuuguggaugagagaguauacauauauuuuauauucuuuuuuguacaugagauguucaguaaaugaaaaggauaggccucuuggaggagguaacuuuugggcugagaccuaaaugaagagaaggaguuagccauggggagaccuggagaaacagugaugcaggcagaggaaauagcuuaugcugaacagaaggaaugucauguaaugcaaaugacaugggugugaguaaaauggucagcagggcugagacagaauagacaaugaaaggaagguagacaaugaaagagaugagaucaaagacaaaacagggaccagaucacauggggccuuaaaggaccuugcuacaucaguguguuaguccguuuucacacugcuauaaaaguaauuuauaaagaaaagagguucaauugacucacaguucugcauggcuggggacgccucaggaaacuuacaaaucauggcagaaggcaaagggaaagcaaggcacgucuuacauggcagcaggagaggagagagaggaaagaggcccacacaaguuuaaaaccaucagaucucaugagaacucacuaucacaagaacagcaugggggaaaucacccccaugauccagucaccuucaccaggucccucccaugacauguggguauuacaauuugagaugagauuuggguggggacacagagaaaaaccauaucaaucaguaaucuguaaucucugacuaguggguaagaaucuggggcauuuacccaaucugcuuggaagagaaagagucuaccaguccaccaccacaugcuauccuauccaccaauggagcaaaauccaaggaauuccacuuucagucccagugcugaaacaaaaccagguguuuccagaauuuuaauaaucuuuguucaauaacacuguuuacuuuccucaccauuacucaauuaaauacuuaugcaugauauagugcaggaacuuuggggggaugugaggaaggcaaaucacuguccccuacccucaaggagcuuucuaauuacauagguaaaaccuaagcauauaauauuuauuuauuuauuuauuuugagauggagucucguucugucgcccaagcuggagugcaguggcaugaucuuggcucacugcaagcuccaccucccggguucaugccauucuccugccucagccucccagguagcugggacuacaggugcccgccaccacgccuggcuaauuuuuuguauuuuuaguagagauggggcuucacccuguuagccaggauggucucuaucuccugaccuugugaucugccugccucggccucccaaaguccuaaacauacaaucuuauugauuuuuacaaaagugugcaaaauucacuugauacuggaaaagguacaaauaaggugguaagcggagagacuuggucauucccaagucaaacagaacaccaaauaucagggagacccacacauagacagcuacccuaccauacacccuuauauccaacauccacccauccacccacccauucaaccaucuaucauccacucauccacccauccagucauccauauuuuuaccccucaauccagucuagucaucugccuauuuauucauccagccauauauucacucauacaccaauccauccagucauccauccagucauccauucacccauccauuuguccacccacccaucgagucaucuaccaaucuacuuauccacccaccuacccuccaaucacccauccuuccuuccuuccuucaucccauccauccauccauccacucauccaugcaucuguucaaccauccauccauccauccauccauccauccauccauccauccauccacccagacauccaacacuaacugcagaggaugccuccauccccucuaaaccacaaacauccagcuaugauccauaacuuaaaagacugcguugugaucagaaacaggccacaagucaaaaauuugcauucugacaacucuuucaaagacaacucaagucucuaaacauuucugaccauuccaauuuguguaagacccaaacacuccauguccuuguaaggcccucagagaagcuaaccuauauuuggugcucugaaguauuugaugucuucaaagacggugcccuuagggagaagguaagacuagagacaguauaguuagaggaaggggaagcuguggggagauuggagagucuggcaauggggcauaacaaaugagagaaaaagauuagaaacauggaagaaggauugcugagacguggggaaaauccuacuugggccuaggaaucauggaauucuaguauggacaaucaaugagaccuugugauuguguucuccuuggcuuauauauuggagcaacagugauucagcugaucauucagaagaauggguuaacaacacagacgccaaaaauaacagagaucaagggaguugagagacuuggcaagaaagagcagaauauuaacacuuaugcagcaccuacugugugccacacacuauucucagcaguggaucagagaagcccaaauauggccacccacauaaguccauccaucuauccacucuuccauguauaaacacauauagugcuuccuaagugucaggcaccacucuaaacaucagauguauuaacucauuuaauccucccagauaggagcuauuaggauccccauggagcuauuagaaucaccacugggacagacugggaaacugaagcacagaacacuuaagugacuugcccaagaucacgcagccagugacuaguagagcugggauuugaaccccagccaccuagcuccagaauccaugcucucaacucaaccaugcugcuucucuacaaccauaucaauugccagugucuaaaccacagguucugacucucagaauacaagcaggaccaagagcuaaccgguugacccagccucuuagagaaaaugaugaguaagcugugaaaugucuuagcuccugccauaaaugcugaugaaucucagcugauucuaggugaagcuagauuuccaaguacacagacuaaaauuaacaccucgaauucauucauucaaaauuauugauuccuuacagcagcauuguucauaacagcaaacaaacaaacaaucccccaccccaaacuagaaacaucccaaaugcccaucguccugcuugaacccgggaggcggagguugcagugagccgagaucgcgccauugcacuccagccugggcaacaagaaugaaacuccaucucaaaaaaaaaaaaaaaaaaaaaaaaaaaaaaaaaauauauauauauauauauauauauauauauauauauauauauauauauauauauauauaaauuuauguuguuaaagcuggguacgguggugcaugccuauagucccagcuucucgggaggcuaaggcaggaggaucgcuugagccuaggaggucgaggcuauagugagccaugaucaugccacugcacuccagccugggugacagagugagacucugacucaaaauaaauaaaauaaaauucauugaguuggcuacuucacaggaugauuauauaugccaugugcuuucuggguacaguaucuuuuaaccuucuuacaauuccucggacauaggacuacuguccccguuuuacagaggagaagacugaggcuccacaacugugagcuggagcugagauuugcagccaggguggacuguucccaagcucuauaugucuccccuccauccaauaucaccuucccuccucuuuuccuccuuacagccuccacugcuugugcuguuaaucaaacagacacauuccuaugcagacgccacaacaugccacgaacacauuucacugcagugauggucagcauagcccucccacccacacacaccaugcccaucauucucaauaaagaagauaauaaagaucauggagauaaaagaacgugacagacucuggaagaucagaauccauguaacaccacugcgggccaaguuuuaagucugccccagagucucauugaagacaaauccauccacuuuuacaaaaagguaacauccagacuucgcccuccugcaaaugcuguucguaugaaaauacuuuaaaaaucaguuuaaaauuacauauauuuuuuacacauaggccuaaaaugagaacagaacuuaacagcaugaauauuauuuacuggcaagugggugacuaaguuggguuucccucauggcuucagagaggggacucuugaauccuguuauuugggggcugggggugggaggcugcuaauuucuaacugcaggugccgccugagcaacaggcaccuuuaaggaagacucacggcugcucccagucugaacggcagauaaagccgugucugaccgaagcgagaugucaaaacuugauccggacuuaacucaggcauuucccuucauagcuggaaucucucuuguauuagcugccuuaaagacggcuucuaaaagcugcauucauuccaauaaaaagucuuggcuuuucagagggaauaaguaacugacucucccccuuucuuggucaacggcaccaucucuugcaccauucuucucucucagguguuaagaacucaccauuagggugaccagcgucccaguuugcccaggacugugaguuuccagagaugcuaaacccaggauagucccaggcaacccuggcugaagggucacccuacucagauaagaacugaggcccagugguuuuugaaaccuaaguugcugugcccacucaugguucccucgccaggaauguuccuuguuuuuccuauuuuuuuagggagugaggagaaagaagaccaaaguuuggaaggggagggggguaccuaaauucuaaaccaaaaguugagcaaaguuuuucuguggaguuugcaguggacaccugggguggccauccugggcugcacucucgaccggccccaaaggaagagacagggagugcaaaaggggaagagggaagcuaauuauauacuuuaaaacucccucaccuugucacccacagagagagggagggaccaaaggaggaaagagaauuaauuuuuaccuuagacucaagggaauagaaaaaugggucaaguggccacgaauuuuuuuuccccugaaagcuuccagagagaacggagaaugcaaaauguccaaagguggcuuuaaagagcgccacgaucagguuaaucaauccacacugaccagucgcaggggguggugggggggggcacuucgcucccauucccacccagaaagccucuuuucuggccgguuuccaaaaaaagaacacuggaaccuaaaugacuccauaguauuacggcucuggcguuuugggguuuuucucugugcuggagacugugcuggccauuuuucacgcacgaccccauuuaaucuccugagagcccuccaagggagaugcuacuagaaggaauauccucaucaugcaugucaagaaauaggcucuggugcccaagauaacauggcuggugaauaaugugaaccugggccagucugacccagaguccggaguguuuucccucuccucucugcccucuuucagagcaggcaccaucccauccggcccuuuucucaggagcugagcuggcauucucggaaaugcguuacugcacggcucuuaggcucugaucauuucuggauggaguccaccuucccggcggugcuuuuuauugcugagaaaguguauaugugugcuugcuacugggggggaaacagggagggggaagcauaagcccuacgcacccaacagaugccucccacuccaagucccugaagaaagacuucauucucaaggggccgcugcauccaaucuacucaagcacuaacauuucagaaacuuucauuggucugauaaucucauggacagucucucaacccccugcaacuaaaacccaucaaaauccuaaaacguuggcacaaggguagaucagauagauguuauacaauuuaguuaaugggugaagacagguaccuuuucucauuugcucagcaaacguuuauaggacgccugcuuugucccacacacugggguugcaguggugaagaacaggguaaagaucaugggucucacagccucagagcuugacuuuuuccuggggaaugguagaacuaccagggagggguggaaccccacccaagagaaccccuucuuucucucucucuagugcaggcacauagcuuugaaugacauccuuaaucuuucuuauuucucugaccgggauuuaacacuauuacuuccacuccuuuccauagauccacauccuuaauccuaagccaucgaggccagacgugcuuuggaauucagaacucagggcuuuuagacgcauugcaaagaugggaauguaaaaugguacaaccacuuaggaaaacaguuugagagccucuuauaaaauuaaacauacaccuaccacacaacucagcaaucucacuccuggguuaauuuacccaagagaaaugaaauguaugaaaugaaauguucccacuaaaacccauaagccaauguuuauagcagcucuauucauaaucauugaaacuggaagcaucccaauguccuucggcugggaagcaaacucugguccauccauaucauggaauccugcucaacaccaaaaaggaaggcgcuacugucacaggcaacagcaugaaugaaucucaaagucugaguaaaagaauccacauucaaaaggcuauauacugugaaauuacauuuauaugaccuucggcaaaaggcaaagcuguagggauggagaacagaucagugguugaaggggcuggagaaguggggugcugacucaagaggggcacuguggggguauuuuaggguugaugaaacugucccauaucuugauuugggugguggccacaacuacauccauuugucaaagcuugcagaccaguaugucaaaagggugaauuuugcuacaaauaaauuauacaucaauaaaucuauuuuuuuuuugagacagagucucaaaaaaaaguacaguggugcaaucucggcucacugcaaccucugccucccagguucaaaugauucuccugccagccucccgaguagcugggauuauagacgcacaauaccacgccuggcuaauuuuuguauuuuuaguagagacgggguuucaccauguuggccaggcuggucucgaacuccugaccucaugauccaccggccucagccucccaaagugcugggauuauaggcgugaaccaccagacccggccccuauaaaccugauuuuuaaggaaaagaaaaaugauaacaagaugucucuaugaucuaaccuggauacuccaacccuagcccaugaacuuaccacauggggaaucccuagaagcuagcuagaaaagcagaaucccagaccccacccaaauccugcuggaccagaaccauccuguuaacaagacaacuuccauacaccugaaaguuugacaggacuacaaugcagaccuaacagucaggagcugaagcagcaccucaucaucaagcacaucuaacauuucugcugcaaaacauacucaaaugcacaccaaguagaaugaaugaaaacuguaaauuaagacuucaaacugaagucaguucagguuagguuuuaccucuauaugagcucgucuuuugguuuuuggagcuuuuuggauuggggaauuguggauaagaaauugcacccuuuuugaaaauacucccauuggaaaagccgugcuaaauuuuacuucgcagaauuuugcuccucuggaaauaccagccaagccggucuaguacaaggaucacguaagugacaccauccugcccucuacggcaguaccuucuagaacauucuaucucucaggacaggccaagagucugauaaccugcucccaugucucccagcgcuucucaugcagaaaguuucucuuuagagagcuuuucuuaaaaaaaaaaaaaaaaaaaaaaaugagaggagugccaaucagccaauguccacagaugucaaagugaugucaccugaugucaaugugacuuuaggugucuuguuaagauuucugcaaaccggaugaaaagcuggaauucuacguguaauucaggcaacugugcgugauaauacacugaccugcuuccaguguuccuccgauggccugaguuucuacaucauguucagugggagaccugguggcacagggagggcuggaaagaugacauucaccuuggcacuugguagaaggagugaguggcauuaaguggggagggaacucuaggaaggcugacagaugcuccuuuuugagcugacagaucugagcucuucggcaaucaucagagacccucauggcccuauuugaaucacaauuccagucaaugaaaacaugaaaccaagguguguggucaagacggcuugcugccuggcaugagaaaaacacggcaauguaaauuugaacaucaaagacuuccauuuggguuuccucacuuaggaagaggggaaaaaaugaaauaaaugaggauucuuaauugucauugauggcuucaaguuugacccacugagggaugaaagaggaagaaaucauagugacaaauugccccgaguguggagaaagcaagacugcauccuucaccaguguaccaugccagaauuuacauuuggaaguagcacucuuaggcccugugagcauaccgacaaguucauggaucauucacucacuucucuuaaacaagacagggaggaaccugcuuuccauaucgaccugcaacccuuagucaacaccauuuccaaauacacaucccacaacacaugcaucaaaaaguagcaggggcgauuccacuccuaucuaagagaacugugggaaaaaaauaauagaagacacaagaauguucccaguggcacaaacagaaaugacacaaaugcccaucaacaguagaauggauagauuguaguagagucacauacacagaugugagcaaaagaagccaguggcaaaagaacguacugugugacuccauuuacauguuuaaaagaggcaaaaugaaccuuagaagucaggugagcgguacccuuguugggggagcaacuaggaggcgguauggggagggggacuuccagggcacugaucgggaccugggugcuggauacguggguguguucauuuuguaaaaaucuaugcaucugaauauauguacuugccuguacauauauuagacuuuauuuaaguaccuacacacuuuuuuuuucacucucaggauaugcugaaacauuuuuuuuuaauggcagaaauauuuagauuaaaaaguagaauguucugcccugguaucgugacucugacauuccacgugucuuucucuuuacacuggccugaauucuuuuauucacuaccucccuccccaggucucuguccauccccucucaucuccaacccucccacccaccccgccaccgcccuccgcuccauccaggacagagaaagcucaguccuggaugacccagcucgaugacagauugugagguggggaguuuucccuuccagaguagggcuguauaauguguuuguuaccucgggucaaagagaacaaaaacagucugcagagagcauaaugcacaaacucaucauaagagcaagaaagccccgggcgagcuggccagagaauagaugaaguggcaagcaacacucgcaauucaccugccucccucucccacgauucccccuuccgaggggccacugcaaucccccucucccccaacagcccuccaaucugcaggauucaggcuggacagagguaagcuaaggacacagcagaagggcuccccaccuccuuccuuuccucuuagaagucuccaaauccaggcuccagaaggcgaucuaaagccauuuucaaugaggaaaccugucagccgagcaaagcccucucacuccuggagcuaacugggugugcacccaugaauacccuguccuccugcaaggcacucccacuccucacucuguugauaggcagaguaaucaagccaccccugagcacuucaaugggccugggauggugaggaauugcuaaccuuaagaaccagccucuuuaagagucugaaacuuaggaagcaaagaccuggcaccugcuuugggcaccaacggagauggcaucguaguuagagguaugcuccccucaaaagcaccucugcugaacuucuuaauuuuccccacccucaaaguagaccacucacacacuccaaaaccucagugcccucuguugcaaucccagcacccaggauccaagcgccaggcucgauuuugaaccccccugaagugagucccucuaccacccgccaugcuccucaaacagcaacccccggagaccacacagggcccagccccguuuagucuauaacugcaaaaccacauacaaaagggauaggggacucaucgcugagccccagggacccauccagcccguucauuuuuacacagagggcagcugguuggaacugugcggagaagcggcacaucugggcauggcacaguggccagccagccugggcagcaggguguguccccccuccuggaaucugggucaugcuuagauaacugcuagaaagcccgacuaauuacccacccuugccugccuacaucucgauagauguuaagcccuccucaagguuuauuucaagcaggcagggauuuaaagaaacacagaagaucugcauuuugauagcaucuccacagaagaaaaugugggcuucaccuuuuuccucuggaucuuugauuaaaaaaaaaaaaauuuaaaaggcauuuaccuaccuaagauguccacaugggugcugauucuccugguguucccucucggcuacucgggguaggaaaagcuggacauggugcucuaaaauggacccaccaccucauuugcuguugcccugucuuucuuacugaaaguguccagaucaggucuucccaggccaggggcccagauaaagcaagugggaucucuuucucgacacccccaaagaugaugagguuccccaaucagcgguuaaaggcaaugggaccugcacacaugagggaaacauaagcgccccccagcccaucacuauccucuccagauaggaacagcggcccacccugggguacucacuucggccagugcuggcuucucagugugaaggccacauggacucccucuugcucuuagcccugggagcccccaagcgcccugcccuaaaagugcggcggccccccaccuuggggaaagcaguaguggagaggcuguccagcuuccccugcguggacuccagugagcgacggccaagaaaacccaaccaaggcccccauaguuccccugcccuggccagaagcgcccaggcccgagcccgcuccaagcucacuccguagaacuccaaacccuccggacuuggcucgaaagcccccaccaaggcuccugcacgaccccaggccccagaucucauucuagagucgguccuugggaaggauccacucuccgcugcccaccccccagccccccacaaacccauucccaagccuccaggguagcucaacccagcucgggguggagagauucuuucacacuccucccggugcccccucucccagccccuggaagaccccccuccuccccaccucccaucaacccccgggucucucucccagccuggaagaggggaggcggagggaggagggggaggcgcagcugcugcugggguucgggcaaaaggauauggccauucggugaucuuuuuggcguauuuucucaccacguugucuucgcugaagaggaagagagaccgguuaaccgugaggcaguucugucggacggggaugggguuguagagugccaugguccgcgcucucugcgccauugacugcuuguacauccuuugcgccccgggcugcccgcccugccggcugcccccggcuccucgcccgccuccgcugcccacgaccaccccggcggcugccccggagccuccucccccguagcgggccggcaucucgucuccgaagcgggccauucugcaaagagcaaagggcuccggguuacgcugcggcgaacgaugcggaagacgccgccgccgccgccgccgccgcugaugcugaggcugccggggcugggagcgcggcggcuggagcuacgacugcggagacgcuccacggcccagcccaucgggcggcggcggcucggcgccucgggucgggggcucagaaggcggcugcccgggccgagccggggauagcagcucgggacauc

SEQ ID NO: 192943 - RNA, 15054 nt, Homo sapiens
aauagcaaaaucauuaaguguuuaugauucauaaauacaguuuuugucaacuaaaaaaauaaaauauguagaagucaaaaaagugucuaugauucagaaaugccaccguuagaaguugccauaagagugcacacaaaaaggacauaugggucaaaguguuugcagcaguguugucccaaauaaggacauuuugcaacauuguggggugguuaaaauaacuauagaauaugcauuagaauacaaugaaaccauuaaacauaauguggaagaauauuguauauuauagggaaaugcucauaauauauagugacaauuuaaaaagcagauuacaaaacaauaugccaagacaugauuucugcccaagucugcccugaugggugagcuaaccaagguugcugcacugugagggcauaggggcugccccucagcccccaccccagccacugggcuccucaggaaaggacacgugaguguuuacugcacauccuacagaugaggagcucacaaggacccuggaugggggaguccucugagguugcuggagcugcugcagccaucuugucacugccaggggagagcucucucugagagcgaaggcacaguggaggaaagcagaacuaagaagagacagagaaagcgaaagugggagagagagagagauaugaggugacaaguguggguccuuggauccugcuugguguaaagcuagccugcuccuggacuuuacagauaauaaauuccuuccucaucagauuaaccuggguuuuuguggcuuguaaccaaaagggucugcacggcccacacacaggcucccagcucauuuccuuugcaaugagugguaacuggaggcgggcggugcauggaccugccuugcaaggcuucucuguuaguggugccuggagcccacucucucagcuggcacagccagugugacacaucaguccggguguguccuggaccuacccccuuucugggugcaaaccagaacugaggaugccgagggugguggggggguaguuuccugccucagggcugugcuccugcuaccucuuugccuaaaauucuccccucucugugcucccagggccagcuccuuuguaugcucugugauucuuugaacagcgcccccucugagaagccuucccugaccaccuggcugaggacaucauucugucccagcuuccauuugcuuugggaguggccuccugacacuucacuuccgugaggcagggaccaguucuguccuggucacugcuguauccccagcucuagauaaggccugagacaucguaggagugccagggaucuuugguuacugagaaaacgagcagcuagaucaagguucccaacaccaacacgcuggggacauguugggagucaacuuagcccuaccagcagguggaacuaguuuugcugcuccaaaacagaguucuagcuauggggacagccacuagagagcagagcuaaguccaugcuaugcugaggggccacagucugcccugaacugugccucccagccuggagcuagugagggggccgagccugggagcugacagaugagggcucggcguggggacuuuuggaggggagggcauuuucuugaucuuaccaugggggcaacagcuagauggguagggggggacccacucaaggacauacugcggcuucaggcuucgaccagcccagaacgcucgcuccaucugagggucuugauaucaggguguggcgucaggagccggagccuacggguugaaagccaagagugggcaaucaaagcugaaaccaggcccacgacuuaggagcuggagagcacacagggcugaacacucgaguuggugaccaggaaaccagggagcaaagucuccagggugcuugggcaagaccccagauggucugcagcaacgcacgggcaacacgggaugaucagcgcuacguggugagaaacuuaccuccuuuugcaggacaacauuuuccaguccuucugaguaaaucaaagagaagucucagcuuggugauugcaggucucuaaugcuuauuucucugucucugucucucucucuuuuaacaaaagucuaccagcggccucaggcucagggccugucucagguaaaagcggguuaggguguaauaacagugaucgguuucauuguguuuauuuuuguagcuacuuucuaauuauagcaagugauucugaguuuccauuuaggauaguaauaggaaguuucuuuuucaaguaaaugugcauaaguaaaaggagacugcucaaaggaaaacagcuggugauugauagaacaggcuguggcauuguugggccccagagggaagggcugugugagcaugcaggaaauucugggaaggcagcuaaaugcaguugcugcaugggggccaggaagcauuuggagacguggcugggcacagcuuggcuuuugagcccaagagaggccugcuggggauguguugggagccaaccuaccccuaccagcagguggaacugguuuugccacuccaaaacagaguuccagcuauggggacagccacuagagagcagagcuaagggcauucuaggccaaggggucacaguccacccugaacugugccucccagccugaagccagaaagcucagggaggcuagcggcccugcccaggccucagcacugacccugcaccccuaggcccagcuggaugaccccuaagagcuuccuggaauuuggaugcaggguuauucugugugugcugccucucagagcaugucacuuugacguggacaucucgggucugguucuggugcugucccugucucgccacgugacccuggauaagucaucucuccaggccuugauuuccccaucuguaaacagaggugagugaaaugaucuuuaaaggcgugucaguccauuuugcauugcuauaaaggaauaccugagguuggguagcuuauaaagaaaagaggguuauuuggcucacaguugugcagguuguacagaagcauggcaccagcauugcuucuugugaagcuucaggaagcuuccacuuaugguggaaggggaagggggaguucgugacuuacauggcaagagagggagcaagagccaugucaggcucuucuaaacaaccagcucucauguaaacuaacagagugagaacucauucauuaccacggggagggcaccaagccauccaugagggaccugcccccaugagccaaacaucucccaccaggccacaccuucaacacugggagucacauucagcaugagauuuggaggugaccaccaugcauccaaaccauaucaaggacccauuucggugaggggaccaggaacauaucccuuccccucuccuccacauccuuuaauguggaguucagcaaggaaaguagggcuugggucaaauuaaagccuggucuuaauuuccugguccaguuauuagcuguguaacccugggcaagucacuuaacccccucagguuacaauguuacaaaugaucacauuuuccucaacugaaaaaugggauaggaacaugucccaagcagagcuggagugacggugcuaucaauggcccggcagugccuggucacacaguaggccuggggagcccugacuuuuaccgcacagggagcugcuugcagagcuuguuuucaauugugggcuuggcagggaacugccggcaucccaggggacagggucucaugaggaugccuaaucccagcucaaaguggagaccccaggacuccaucacagccagugggggggaguggcugcugcagcagggagggcuucauuggaaugaaccccuuuaagcuccaguccaaaugcccagagugguuuugcagguaugguugugaggcuggcaugguagucccaucugcaguccccugggaugaggcaccuguaugguagagggcccggguggagagaagagaaggauggggaugaacccaggaccacagauggcccaguuccauggaugauuuucauugaggugccuucaagucaguucaacacugggcuucucaaccuuugagguaugcagguaagagucaccugcggcagugggggaugcucuuguuaaagugcagacuccgauuaagcaggucuaggguggggccugaaauucuguguuccuaacaaggcuccauccuggguauggaggucagguacccccucaccucuccuguggacccagcuuuugaggggucaggagaagaauguucagucccagcugccaccacucuaaaguccccuagaaacaaggacuaauacagguggcgugggagagggcccaggcaaacagggaggugggguaccccgguggggcugcagugggcccugcggaaagcuugcuggaggugggggccuaaggaauucaaggacuuguuccaggaacccaaggaacgagugggcucuaacugcugcagcauaugggagaugccaggaggagcuggcuguggcaggccaucccaguccaucagacaacuuguaguggaugaagaugcaguguccauggccagaagaaacucccguggaugcucaggccaaggcugccagaagcacgaggaggggcagcauugagugucaucgggaaaaggcaaagugaugguccugaagcugccccauguggccagucccuuuuugggaagccugaauaaauccauuuccugugcacugugugggaagccaaccccucuucagagguacuuauggggaaccccccaugugauucuauaggcuccuuuacucccauauaaguauuuucucucugugugcaccccccgccccacccccccaacaccccacacauaucaucuaucugugauuuugagaugacuuuuuuuuuucacauuucagcaccucugaacucaacaggauccuacacuucuuauaggccuggcuugaugcugacauccuucagccccagggaagaccuaaagaucuccaggucuugaggcaccuggaacaccuccaccugagaccacuuuaacaugauuucucugcuugagggauuuuggaccaugcuguguguauucagcccuaaaacaugggcgagugcccgcuugcaguucaaauucucagaggaaguucccuguacuccacccagugccaaguuuaguuugugcaaauuuccuuaauguccccuccuguacaacaggcuuauuugguguuaacccucauaucgggggucuaacucuuugcuuuuccagcuuuugugcuggaauaucccauuaaacuguccauguuggguauuuuuucuuuguuaguaaacauuuguugcauauuguugauagcauuuuagauuugaagaaauaacugacaaaaucaauaucaucuguuucaucauuacaaauagacucauagcucuuuaauuuuuccauuuaacacuuuaauuuuccauaggccuagauuuucaagaaguccaauaucucucacuugaagugucuuuucccuggaguagauugggagauuugagggauaucuguccaaagaugagacagucuguuucuaguuucccauccagccugauggggcgucuacaguuuuuaccacaaggugucgcuguugaacagauucuggugcagucuagugcauagcuguccacuucuagagugaucacuugcugggccaaguuccucuccuuaaguggugucucacauuaagguucccaaauuacagacucauuaauucacccuaauaagcucauccaggcaguuuaggucuucaggggcuuccagccuccaacacacauugggccaaaaccagccuguaccaccagcuccaagcccuguguugaaucuaggucauugguccagaugccccuucauucugggccugugguguccuuuccagacagcagaccucaguuaagggcaucccaguccaucagagaaguuccaggaucacagacccucaaaaggggcaguguugaggauucagucuguuuucugcccagaggccccauuaaguauguuguaucaccuccuccccaggcuguuucuacauaacccagggaagccauucagggaacagcugccuuaugaaugaaaauccaccccuagacaaugugcuaugccaucccagccagaaaaauuguuggcaacuucccuugccaaaaaugccugguaucacagaaucuuaugccauuauugcuuucugguccaggguccucccacccuucaaaaggauggcauacaacucccaccguguguguguguguguguguguguguguguguguguguguguguagaggcuguucuugagggcaauaggugagcuuuuguuuugcuuugucaggucuacaugguaagggggaagggcuagaauacuaagauaguauuaggauaauggauggaaauauuuuaaagcaauuccaagguggaaggaacagagagaaaagccuuggagcagcuggagagaacugucuucaaggaaauggacuaaguuuugucuagaaugugugagguaaacuucuucuccagcuucccacaaagacacuggugggguggacacugcucuggacgguuuuggcaguugguuuuguguuuuggagaugaaguggcccuggcaucaagaggacgugggacacaagcagaggcuuccaaggggucccaggagcaccucuguccaauacagauggagaaauugaggaccagaggaggggcuuguccaaagucacccagcgaguuagagcccccaguggcuuuucccauuaaaaaugaaccccaggccaggggugguggcucacacuuguaaccccaguguuuugggaagcugaggcaggaagaucauuuaaggucagaaguuagagaccagccugggcaacagagagacccugucucuacuaaaaaauuaaaaauuagccuggugugguggugugcaccuguaaucccagcuacuugggaggcugaggugggaggauugcuugugcccaggaguuugaggcugcagugagacauaauugagccacugcacuucagucugggugacagagcaagacugucucaaauaacaaaaaagaaaaggaaaaauaaaaaaaaagaaccccaaacagcccacugugagccauggugaccccaaaucuccagcgucccugcggggucccaggccggcucagugcagguauucucgcacagugagcuccuucagggugaugccucggggcgugggccuccggagcuggcucuccuccagccucuccugcagagucacgaaguccuugcccagcgcguaggccaggcggaccauggcguccagcagaggcgcauaguagcgauggcccucccgggccugcaggcgcugcagggcccucucuccggccgcgaaggccucggcggggcggucgaggucgcgguggcacagcagcacggcgcacagggccgggacggcggccgcagggcagugggcggugagcuucuccugcagcggcagcacgcgcagcagcagcuccagggcgcgcggguacuggccggcccgcaggcagccgaaagccucgcgcagcuccggccgcgugaggaaguccaggaacucccgggagcggcgcacgcagcggauggcguagagcaggcccagguacuccugcagggcgcgccgacgcucacagaucaucuccucagcgaaguucccagucaggugcuuccugggaaacuccacgucuucgaucuccucccugaacgucuucagcagcgcuuucuggagcuucgcgaagucggaauagcgccguuccaggacggccuuguuguugucaaagcucccagucuggaugacgaugauuugguacaccuagggcgcaaccagagagagcuguggccaccucccggcgggggcugcggcggacggagcacacccagaguaaaguuaaccaggccgguguaaagcaugcccugaaaacgggcgauccuuauaugcaauuguuuguuuguuuguuuguuuguuuguuuauuuauuuauuuauuuauuuauuuauuuauuuuuagagacagggucucgcacuguuacccaggcuggaguacagugaugcgaucauaccucacugcaaccuugaacuuaugggcucaauugaccugcccaccugagccuccugaguagcugggacuacaggcacacccacuaccuggcagauuuuuugauuuuuuuuaaaagauggggucuggcuguguugcccaggcuggucuccaacuccugggcucaagcgauccuccuaccugggccucccaaagugcugggauuacaggcaugagccacugcaccuggcccaauucuguuuuaaauugcuauuggcaucagcugagucaacccuggaacaacaacacagcaagguggggacaucugggaggagaaagggcagaggguccugcccugcaggcugcuggggucccucuuggcuuuacuugcuaaaacugggccucuguuuucugaacugagaugcuguguuuuccaaauguuucacacuugggaauuaguuuuacguacaauauaacaucauuuagguacacuggugaugccguuauaugguaagaaaaucaauccuuuucaaucaucuuucaagagaauccugauuacgggcaauuauauauuaagggcaauuauaacccaugcaucugacuccagagccagauugcauggguuguaauuauagcccuaccauggucuagcugugugguuuuagaugaguaauuuaaccucuccgagucucacuuuucucauucauaaaacaaggauaggcauagugccuaccucacccagugaggauuaaaugaguuaaugcacugaaaccacauggagcugugcccggcaugccauuggcauucagugguagcuauguuauuuaucccggucccagguaagugaaggagaaggaugaaguguggcucuuaggcagucuuuaacaucccuuaacacaagcuaaaauuccauucuaacagggagaggagcagcucccaggcacagggcuuucccgaagccacaguaaccagcuagaauuuaauaacagcacauagcuuuccuuguauugacuuuccuuguaucgacuuuucuaguauguuacuuuugcuuugugccaugugauauugguuuuccauuuaagguauuucucuuugaaauaaaugugcuucauguuuuuaaaaagugauccaauuuaaagaaaaaaauaaguaauaauaauuagaacagauacagugauauggcaaaauuggugaagaaaggacacaggugacugacaccugauaagaugggauuaaacugggcuauuuccuucuugggaccaagaaauaugacuuauaugguucgaauccucacagacccuagcaggugcugagccugaaaucuugcucuuuggccauuuucuccagaagaaagcugugaguuaguguguugacccauuucauaguugggaaaccugaggcucuacaagacuuauucagggccaggaaggaagcagagugaaagaggcuccaccauuucccaaucucugcuuaccacaaacuuagagacuuuucucuccucgaugcgagcugaagcgaucucaaagagcaguuugacgugcuuccagcggcauuucugguucugccaguacugcugaagcucccgcguggucaugcuggaguuggagcucaggccacugugugugucuggaaggacaacacccuuaaggaucugcacccugucagugcacuuccgaggcaugggcuuggggagauggcugggucuaucugagauggcauaucagaacuccugaagaguauugaauaucccucucucccaccccgccauuuauaggcccaauuggggcaucagacagaccucugugcccagccuggcagaauccacccuaccaccgacaaucccaaauagcccaucacccccaagugguuucacagcuuuggaaugcggugcgggcacuuugcaucguccacuucuggucuguagauuggccauggugaaaucccugcucuggacaagcagagacgguggcuuguguguuucugugcucccugcagcccugacuucgugacuguugccacgacuccuugagcacacaucagugggcaggggaggcagugaggaggauguuauguuccagccucagcgggcuggcccuuccuaaccuucucaucuaacugcccacaugccgggcucuucucggacgugcacugcucugccuugcauccaacccucuauuuccacgccuggaaaacgaacacaguguuucuuaaaccccacuugagcccugcgccacucugagguucuuaagaagcacaaauaauugugcauuuuauugcaaagggcaugggucccagcccuuuuccagucuacccuucaagacccagcccccacaucacugcaaaugccccuuggcauuagaguaagagcuucccaccuuguuccuacagguuuuucauuuuauuuauuuauuucucguggcacguguaacuguuucucacugaucuguuucucuaccaaaccucaggacuagugcaguguuugauuucuuccuguuucuguuucuccagugcccugcauagggccaggaacagagcagguauugaauagggcaucucgaaggacuguaagaaaagaucuguuccaggagauggcacuacagcagaugcuguccaugccccaggcuggaccgugcccucuuggcacccacuuuuccagaacaugccacuggcuucccugagggcuuucuagggccauagcagcaggcccaggagcgucccuucuccuaugcagggcaggacugguagauaacagcccggcuuccucaccccuaggauaggacaacccagagauauguuccagggucucccagaagacccccgcugggguugagcuucagccaccuaccgugccuaucuguucacugauguccugcccuggccucuugcccuuuccuuccauucccacuccccugccaugacuccuaggaccgucucccggauaaacagcuugcacuagaucugugucucagugucuguuuugggauaacccaaguuacaagagcugcccgggccucuugcugcaucccccaaagugacccacauuuguacuuugaaugucuucagaccucucccccagaccgagucucaagccucaagcccaccuaagugcccgucagguccugggugcgggaggucggggccaguggcuggugcuuccugcuggguccuugccgugcacuggguuaugggucccaugcagccagggcucccagggugcucuggacuugccaugcuccaaggcugccagaggaaaaagagaacagugaggacccacuccaguugggguucccgguggcuccuggggugccuaggagcugugucaugcccccuccuggcaggcagagggaaugacaagggccccacggcucaaccuuccccacucucccagcugccagaucccaaaucugggucugccccuuugcugggcagguuacuccaaggcagagaagacccuucaccuauugcgaugauccauauguuauugaggugauccuuacguauugcucagaguuuuaaaugagaugauuucaaguaaaaguauuggcuuuagugauuacuugaaagaaagaugcuggcuugucuagauacucaguuuuauguuacacaugcgaaugaagucucaguguucaaguugaacauggccacucaugccuguaaucccagcgcuuugggaggcuggguuagaaggaucacuugagcccaggaauuugagaccagccuggccaauguagugagaccccgucucuagaaaaaauaaaaaaaaauuauccaggaugcacgccuguggucccagcuacuugggaggcugagacaggaggaucccuuaagcccaagagacugaggcugcagugagcuaugaugaugccacugcacuccagucugggugacagaacaagaccaucucaaaaagaaaaaaagaaaggucaguguucagagcagguagauacugguaugaaucuucuaucgaucaaucaaucaauaaucuaucuaucagcaaaauuaacugauagcuuauuauacccacuucauacccaucuagguucuccauagccccuaaucuaguuuaaugcucacaaaagucuaucauuaccaccacauaacagaugagaaaacugaggucuaaagucacgcagcuggugagugugcgcaacaagcaaagcugaauuugucuccagugcuugugacgugcuggcugugcacuucacacccagcacacacucuugcacuaaccugaacacugucugcacucaggacuguuuacaucucccuuuuaugauaagggaacugagacuuagaguugccaaagaugaggagcuggugaguggugggcaggauacagacccaggcugggcugacuucagaauucucuccaccuuacucagggagggagaacaggcagcugggaucugguuuacauaauaacucugucugugacccggauaaguggaagggaugaccugguagcuggcaagugacucaacuucucugugcuucuguuuccuauaaauuggggauaauaacagaacccacguucacaaggcuggggugaggauucagucaggcagacucugaagccucagcucagggcccuguccaucccagggacuguguaguacccccgcuuuuagugucuguuaagugcuagauguuuccagaaauauuugugaaauaaaugacuaaauuaagguggauuggaauagaauuacaaauguuugagacaacuuagagaaagggacaauuaaaacauuagaucggcuggagggaguagcugguauacugacugguuaggcauggaaauucaagacaaggaaggugcaaaugaccugaggaagcugccaguggaacauagagguagagcugggacuugaacucugaucuguuggauucugggcucuuggucugaaccccugggcugacuacggccuagagaaagauagagccagugccucccuggcacccccugagcacagaugggggcgggagucaugcaugucccugagcacagccagcgccugucccuugcuccaggggugagagccgcuggccugggagaggggaggucagcuggggccuggagccugcacuucagggggaagugcuugcugugucgggugaaaggaacccuggggccuucuccguuuggcucugcacagccauccagugggcggcccucagggacccucgauccaaccucaccuuuuacagaugggcaaacagaggcacggagcaggggccuggcuggcccagggcugcacguucuugagcaugccgucacgggcaccucucgcuugucucuugugccugucagggagucaggagacaucgccuuccauccugaccaaccguguguccuuaagcaagugcuuuaauaucucuaggcuucaguuucccuaccugauaaauguggcuacaagccccguccuguugauaagaugauggaugacuagggguggguucccuacauucugacuggugccuaagugagacaguggaugguuuacgugauucuugguggcugggauucuugggggcccagggcacuccuaugcucagcacuucuguaaaaugggugauggcgaguggccuuggccucaggggccccagccuuugcagaucugcuuucaugaccaggcagcuggcuccaggucagaagcagggcacuauuggcccagagacccuguaagacccuagaaaugaugccucggcuugacacuccaguaaagacugagaaagcugauuauaaaaccaggccuuagaauaaaaucaaauucagcagccacagucagcucccuuaugguugucucuuacagguuucauugggagucacccauuuaaagaggagggggaaggaaagaguugugcacugguguauccauggggccuuggguagcuucccaucccucuccaggccucaguuuccucaucugugaaaugggaaagcaauccugucacucuaaaagcucucuggggauagccacauagacgguuccauggcccuuuccuucccucuccucacccucuguagcaaagauuucuugacuuuauaacaaaauacuaaaaguguuguugcuguuggccugggggccuguaguuggcccaggggacagagcagcuucccagccuccucugccuuccagccgugugugcacagacagucauucuccuccuccuguccccagguguccuaaccacccccucuccaagagcugacugccaaguccaguccuucuucugcugggcacacagaggccacacuaucuuucugagggccugcggaggacuuuucaugggggaugagccucuagggggugaaauaaagcacauggcccacgcugggagacagagaucccaggauguuggauguguggcugccucucuuggggaaaggguggguacccuccaacaacuggacgcucaccugagaagccuugccaaagccaggggcucccaacccaguguguguaagaauccccugguggggugggggugggaucccaggggcuuguccaagagcagguuuccuggcugcuaacauaggaaggugccauugaacaggccuggauucugcauuuuccaugaguccucuaaggcugugcugaggcagggguucccugacacuguucuuuugagaaacacagguguggugacuuauucuccaggcccaagauggguuguacaagcgccuagcauuucaaaaggaauggaggugauggaagguccaggagcugucccuuccucugccucagugugcuaaggagagcuccagacacaguggcugucacuaacucuucccccucccacccugcccccagcaggugccaggcagggccccaggagaaggggacucaggccacagcaggcagaggacagcugagcuugggaucaaauacugaccuccagucuccagggcuguguguguccagggguccgggaggagugucauauggccccuucgagcucuugguucucagcuccggcgacaagccgaggggcugccacuuucuaaguuccccguuugaaaacaggaaacaggcugugugaccugcuucugaucgccc

SEQ ID NO: 192944 - RNA, 15054 nt, Homo sapiens
gggcgaucagaagcaggucacacagccuguuuccuguuuucaaacggggaacuuagaaaguggcagccccucggcuugucgccggagcugagaaccaagagcucgaaggggccauaugacacuccucccggaccccuggacacacacagcccuggagacuggaggucaguauuugaucccaagcucagcuguccucugccugcuguggccugaguccccuucuccuggggcccugccuggcaccugcugggggcagggugggagggggaagaguuagugacagccacugugucuggagcucuccuuagcacacugaggcagaggaagggacagcuccuggaccuuccaucaccuccauuccuuuugaaaugcuaggcgcuuguacaacccaucuugggccuggagaauaagucaccacaccuguguuucucaaaagaacagugucagggaaccccugccucagcacagccuuagaggacucauggaaaaugcagaauccaggccuguucaauggcaccuuccuauguuagcagccaggaaaccugcucuuggacaagccccugggaucccacccccaccccaccaggggauucuuacacacacuggguugggagccccuggcuuuggcaaggcuucucaggugagcguccaguuguuggaggguacccacccuuuccccaagagaggcagccacacauccaacauccugggaucucugucucccagcgugggccaugugcuuuauuucacccccuagaggcucaucccccaugaaaaguccuccgcaggcccucagaaagauaguguggccucugugugcccagcagaagaaggacuggacuuggcagucagcucuuggagagggggugguuaggacaccuggggacaggaggaggagaaugacugucugugcacacacggcuggaaggcagaggaggcugggaagcugcucuguccccugggccaacuacaggcccccaggccaacagcaacaacacuuuuaguauuuuguuauaaagucaagaaaucuuugcuacagagggugaggagagggaaggaaagggccauggaaccgucuauguggcuauccccagagagcuuuuagagugacaggauugcuuucccauuucacagaugaggaaacugaggccuggagagggaugggaagcuacccaaggccccauggauacaccagugcacaacucuuuccuucccccuccucuuuaaaugggugacucccaaugaaaccuguaagagacaaccauaagggagcugacuguggcugcugaauuugauuuuauucuaaggccugguuuuauaaucagcuuucucagucuuuacuggagugucaagccgaggcaucauuucuagggucuuacagggucucugggccaauagugcccugcuucugaccuggagccagcugccuggucaugaaagcagaucugcaaaggcuggggccccugaggccaaggccacucgccaucacccauuuuacagaagugcugagcauaggagugcccugggcccccaagaaucccagccaccaagaaucacguaaaccauccacugucucacuuaggcaccagucagaauguagggaacccaccccuagucauccaucaucuuaucaacaggacggggcuuguagccacauuuaucagguagggaaacugaagccuagagauauuaaagcacuugcuuaaggacacacgguuggucaggauggaaggcgaugucuccugacucccugacaggcacaagagacaagcgagaggugcccgugacggcaugcucaagaacgugcagcccugggccagccaggccccugcuccgugccucuguuugcccaucuguaaaaggugagguuggaucgagggucccugagggccgcccacuggauggcugugcagagccaaacggagaaggccccaggguuccuuucacccgacacagcaagcacuucccccugaagugcaggcuccaggccccagcugaccuccccucucccaggccagcggcucucaccccuggagcaagggacaggcgcuggcugugcucagggacaugcaugacucccgcccccaucugugcucagggggugccagggaggcacuggcucuaucuuucucuaggccguagucagcccagggguucagaccaagagcccagaauccaacagaucagaguucaagucccagcucuaccucuauguuccacuggcagcuuccucaggucauuugcaccuuccuugucuugaauuuccaugccuaaccagucaguauaccagcuacucccuccagccgaucuaauguuuuaauugucccuuucucuaaguugucucaaacauuuguaauucuauuccaauccaccuuaauuuagucauuuauuucacaaauauuucuggaaacaucuagcacuuaacagacacuaaaagcggggguacuacacagucccugggauggacagggcccugagcugaggcuucagagucugccugacugaauccucaccccagccuugugaacguggguucuguuauuauccccaauuuauaggaaacagaagcacagagaaguugagucacuugccagcuaccaggucaucccuuccacuuauccgggucacagacagaguuauuauguaaaccagaucccagcugccuguucucccucccugaguaagguggagagaauucugaagucagcccagccugggucuguauccugcccaccacucaccagcuccucaucuuuggcaacucuaagucucaguucccuuaucauaaaagggagauguaaacaguccugagugcagacaguguucagguuagugcaagagugugugcugggugugaagugcacagccagcacgucacaagcacuggagacaaauucagcuuugcuuguugcgcacacucaccagcugcgugacuuuagaccucaguuuucucaucuguuauguggugguaaugauagacuuuugugagcauuaaacuagauuaggggcuauggagaaccuagauggguaugaaguggguauaauaagcuaucaguuaauuuugcugauagauagauuauugauugauugaucgauagaagauucauaccaguaucuaccugcucugaacacugaccuuucuuuuuuucuuuuugagauggucuuguucugucacccagacuggagugcaguggcaucaucauagcucacugcagccucagucucuugggcuuaagggauccuccugucucagccucccaaguagcugggaccacaggcgugcauccuggauaauuuuuuuuuauuuuuucuagagacggggucucacuacauuggccaggcuggucucaaauuccugggcucaagugauccuucuaacccagccucccaaagcgcugggauuacaggcaugaguggccauguucaacuugaacacugagacuucauucgcauguguaacauaaaacugaguaucuagacaagccagcaucuuucuuucaaguaaucacuaaagccaauacuuuuacuugaaaucaucucauuuaaaacucugagcaauacguaaggaucaccucaauaacauauggaucaucgcaauaggugaagggucuucucugccuuggaguaaccugcccagcaaaggggcagacccagauuugggaucuggcagcugggagaguggggaagguugagccguggggcccuugucauucccucugccugccaggagggggcaugacacagcuccuaggcaccccaggagccaccgggaaccccaacuggaguggguccucacuguucucuuuuuccucuggcagccuuggagcauggcaaguccagagcacccugggagcccuggcugcaugggacccauaacccagugcacggcaaggacccagcaggaagcaccagccacuggccccgaccucccgcacccaggaccugacgggcacuuaggugggcuugaggcuugagacucggucugggggagaggucugaagacauucaaaguacaaaugugggucacuuugggggaugcagcaagaggcccgggcagcucuuguaacuuggguuaucccaaaacagacacugagacacagaucuagugcaagcuguuuauccgggagacgguccuaggagucauggcaggggagugggaauggaaggaaagggcaagaggccagggcaggacaucagugaacagauaggcacgguagguggcugaagcucaaccccagcgggggucuucugggagacccuggaacauaucucuggguuguccuauccuaggggugaggaagccgggcuguuaucuaccaguccugcccugcauaggagaagggacgcuccugggccugcugcuauggcccuagaaagcccucagggaagccaguggcauguucuggaaaagugggugccaagagggcacgguccagccuggggcauggacagcaucugcuguagugccaucuccuggaacagaucuuuucuuacaguccuucgagaugcccuauucaauaccugcucuguuccuggcccuaugcagggcacuggagaaacagaaacaggaagaaaucaaacacugcacuaguccugagguuugguagagaaacagaucagugagaaacaguuacacgugccacgagaaauaaauaaauaaaaugaaaaaccuguaggaacaaggugggaagcucuuacucuaaugccaaggggcauuugcagugaugugggggcugggucuugaaggguagacuggaaaagggcugggacccaugcccuuugcaauaaaaugcacaauuauuugugcuucuuaagaaccucagaguggcgcagggcucaagugggguuuaagaaacacuguguucguuuuccaggcguggaaauagaggguuggaugcaaggcagagcagugcacguccgagaagagcccggcaugugggcaguuagaugagaagguuaggaagggccagcccgcugaggcuggaacauaacauccuccucacugccuccccugcccacugaugugugcucaaggagucguggcaacagucacgaagucagggcugcagggagcacagaaacacacaagccaccgucucugcuuguccagagcagggauuucaccauggccaaucuacagaccagaaguggacgaugcaaagugcccgcaccgcauuccaaagcugugaaaccacuugggggugaugggcuauuugggauugucggugguaggguggauucugccaggcugggcacagaggucugucugaugccccaauugggccuauaaauggcggggugggagagagggauauucaauacucuucaggaguucugauaugccaucucagauagacccagccaucuccccaagcccaugccucggaagugcacugacagggugcagauccuuaaggguguuguccuuccagacacacacaguggccugagcuccaacuccagcaugaccacgcgggagcuucagcaguacuggcagaaccagaaaugccgcuggaagcacgucaaacugcucuuugagaucgcuucagcucgcaucgaggagagaaaagucucuaaguuugugguaagcagagauugggaaaugguggagccucuuucacucugcuuccuuccuggcccugaauaagucuuguagagccucagguuucccaacuaugaaaugggucaacacacuaacucacagcuuucuucuggagaaaauggccaaagagcaagauuucaggcucagcaccugcuagggucugugaggauucgaaccauauaagucauauuucuuggucccaagaaggaaauagcccaguuuaaucccaucuuaucaggugucagucaccuguguccuuucuucaccaauuuugccauaucacuguaucuguucuaauuauuauuacuuauuuuuuucuuuaaauuggaucacuuuuuaaaaacaugaagcacauuuauuucaaagagaaauaccuuaaauggaaaaccaauaucacauggcacaaagcaaaaguaacauacuagaaaagucgauacaaggaaagucaauacaaggaaagcuaugugcuguuauuaaauucuagcugguuacuguggcuucgggaaagcccugugccugggagcugcuccucucccuguuagaauggaauuuuagcuuguguuaagggauguuaaagacugccuaagagccacacuucauccuucuccuucacuuaccugggaccgggauaaauaacauagcuaccacugaaugccaauggcaugccgggcacagcuccaugugguuucagugcauuaacucauuuaauccucacugggugagguaggcacuaugccuauccuuguuuuaugaaugagaaaagugagacucggagagguuaaauuacucaucuaaaaccacacagcuagaccaugguagggcuauaauuacaacccaugcaaucuggcucuggagucagaugcauggguuauaauugcccuuaauauauaauugcccguaaucaggauucucuugaaagaugauugaaaaggauugauuuucuuaccauauaacggcaucaccaguguaccuaaaugauguuauauuguacguaaaacuaauucccaagugugaaacauuuggaaaacacagcaucucaguucagaaaacagaggcccaguuuuagcaaguaaagccaagagggaccccagcagccugcagggcaggacccucugcccuuucuccucccagauguccccaccuugcuguguuguuguuccaggguugacucagcugaugccaauagcaauuuaaaacagaauugggccaggugcaguggcucaugccuguaaucccagcacuuugggaggcccagguaggaggaucgcuugagcccaggaguuggagaccagccugggcaacacagccagaccccaucuuuuaaaaaaaaucaaaaaaucugccagguagugggugugccuguagucccagcuacucaggaggcucaggugggcaggucaauugagcccauaaguucaagguugcagugagguaugaucgcaucacuguacuccagccuggguaacagugcgagacccugucucuaaaaauaaauaaauaaauaaauaaauaaauaaauaaacaaacaaacaaacaaacaaacaaacaauugcauauaaggaucgcccguuuucagggcaugcuuuacaccggccugguuaacuuuacucugggugugcuccguccgccgcagcccccgccgggagguggccacagcucucucugguugcgcccuagguguaccaaaucaucgucauccagacugggagcuuugacaacaacaaggccguccuggaacggcgcuauuccgacuucgcgaagcuccagaaagcgcugcugaagacguucagggaggagaucgaagacguggaguuucccaggaagcaccugacugggaacuucgcugaggagaugaucugugagcgucggcgcgcccugcaggaguaccugggccugcucuacgccauccgcugcgugcgccgcucccgggaguuccuggacuuccucacgcggccggagcugcgcgaggcuuucggcugccugcgggccggccaguacccgcgcgcccuggagcugcugcugcgcgugcugccgcugcaggagaagcucaccgcccacugcccugcggccgccgucccggcccugugcgccgugcugcugugccaccgcgaccucgaccgccccgccgaggccuucgcggccggagagagggcccugcagcgccugcaggcccgggagggccaucgcuacuaugcgccucugcuggacgccaugguccgccuggccuacgcgcugggcaaggacuucgugacucugcaggagaggcuggaggagagccagcuccggaggcccacgccccgaggcaucacccugaaggagcucacugugcgagaauaccugcacugagccggccugggaccccgcagggacgcuggagauuuggggucaccauggcucacagugggcuguuugggguucuuuuuuuuuauuuuuccuuuucuuuuuuguuauuugagacagucuugcucugucacccagacugaagugcaguggcucaauuaugucucacugcagccucaaacuccugggcacaagcaauccucccaccucagccucccaaguagcugggauuacaggugcacaccaccacaccaggcuaauuuuuaauuuuuuaguagagacagggucucucuguugcccaggcuggucucuaacuucugaccuuaaaugaucuuccugccucagcuucccaaaacacugggguuacaagugugagccaccaccccuggccugggguucauuuuuaaugggaaaagccacugggggcucuaacucgcugggugacuuuggacaagccccuccucugguccucaauuucuccaucuguauuggacagaggugcuccugggaccccuuggaagccucugcuugugucccacguccucuugaugccagggccacuucaucuccaaaacacaaaaccaacugccaaaaccguccagagcaguguccaccccaccagugucuuugugggaagcuggagaagaaguuuaccucacacauucuagacaaaacuuaguccauuuccuugaagacaguucucuccagcugcuccaaggcuuuucucucuguuccuuccaccuuggaauugcuuuaaaauauuuccauccauuauccuaauacuaucuuaguauucuagcccuucccccuuaccauguagaccugacaaagcaaaacaaaagcucaccuauugcccucaagaacagccucuacacacacacacacacacacacacacacacacacacacacacacggugggaguuguaugccauccuuuugaagggugggaggacccuggaccagaaagcaauaauggcauaagauucugugauaccaggcauuuuuggcaagggaaguugccaacaauuuuucuggcugggauggcauagcacauugucuagggguggauuuucauucauaaggcagcuguucccugaauggcuucccuggguuauguagaaacagccuggggaggaggugauacaacauacuuaauggggccucugggcagaaaacagacugaauccucaacacugccccuuuugagggucugugauccuggaacuucucugauggacugggaugcccuuaacugaggucugcugucuggaaaggacaccacaggcccagaaugaaggggcaucuggaccaaugaccuagauucaacacagggcuuggagcuggugguacaggcugguuuuggcccaauguguguuggaggcuggaagccccugaagaccuaaacugccuggaugagcuuauuagggugaauuaaugagucuguaauuugggaaccuuaaugugagacaccacuuaaggagaggaacuuggcccagcaagugaucacucuagaaguggacagcuaugcacuagacugcaccagaaucuguucaacagcgacaccuugugguaaaaacuguagacgccccaucaggcuggaugggaaacuagaaacagacugucucaucuuuggacagauaucccucaaaucucccaaucuacuccagggaaaagacacuucaagugagagauauuggacuucuugaaaaucuaggccuauggaaaauuaaaguguuaaauggaaaaauuaaagagcuaugagucuauuuguaaugaugaaacagaugauauugauuuugucaguuauuucuucaaaucuaaaaugcuaucaacaauaugcaacaaauguuuacuaacaaagaaaaaauacccaacauggacaguuuaaugggauauuccagcacaaaagcuggaaaagcaaagaguuagacccccgauaugaggguuaacaccaaauaagccuguuguacaggaggggacauuaaggaaauuugcacaaacuaaacuuggcacuggguggaguacagggaacuuccucugagaauuugaacugcaagcgggcacucgcccauguuuuagggcugaauacacacagcaugguccaaaaucccucaagcagagaaaucauguuaaaguggucucagguggagguguuccaggugccucaagaccuggagaucuuuaggucuucccuggggcugaaggaugucagcaucaagccaggccuauaagaaguguaggauccuguugaguucagaggugcugaaaugugaaaaaaaaaagucaucucaaaaucacagauagaugauaugugugggguguuggggggguggggcggggggugcacacagagagaaaauacuuauaugggaguaaaggagccuauagaaucacaugggggguuccccauaaguaccucugaagagggguuggcuucccacacagugcacaggaaauggauuuauucaggcuucccaaaaagggacuggccacauggggcagcuucaggaccaucacuuugccuuuucccgaugacacucaaugcugccccuccucgugcuucuggcagccuuggccugagcauccacgggaguuucuucuggccauggacacugcaucuucauccacuacaaguugucugauggacugggauggccugccacagccagcuccuccuggcaucucccauaugcugcagcaguuagagcccacucguuccuuggguuccuggaacaaguccuugaauuccuuaggcccccaccuccagcaagcuuuccgcagggcccacugcagccccaccgggguaccccaccucccuguuugccugggcccucucccacgccaccuguauuaguccuuguuucuaggggacuuuagagugguggcagcugggacugaacauucuucuccugaccccucaaaagcuggguccacaggagaggugaggggguaccugaccuccauacccaggauggagccuuguuaggaacacagaauuucaggccccacccuagaccugcuuaaucggagucugcacuuuaacaagagcaucccccacugccgcaggugacucuuaccugcauaccucaaagguugagaagcccaguguugaacugacuugaaggcaccucaaugaaaaucauccauggaacugggccaucugugguccuggguucauccccauccuucucuucucuccacccgggcccucuaccauacaggugccucaucccaggggacugcagaugggacuaccaugccagccucacaaccauaccugcaaaaccacucugggcauuuggacuggagcuuaaagggguucauuccaaugaagcccucccugcugcagcagccacucccccccacuggcugugauggaguccuggggucuccacuuugagcugggauuaggcauccucaugagacccuguccccugggaugccggcaguucccugccaagcccacaauugaaaacaagcucugcaagcagcucccugugcgguaaaagucagggcuccccaggccuacugugugaccaggcacugccgggccauugauagcaccgucacuccagcucugcuugggacauguuccuaucccauuuuucaguugaggaaaaugugaucauuuguaacauuguaaccugaggggguuaagugacuugcccaggguuacacagcuaauaacuggaccaggaaauuaagaccaggcuuuaauuugacccaagcccuacuuuccuugcugaacuccacauuaaaggauguggaggagaggggaagggauauguuccugguccccucaccgaaauggguccuugauaugguuuggaugcaugguggucaccuccaaaucucaugcugaaugugacucccaguguugaagguguggccuggugggagauguuuggcucaugggggcaggucccucauggauggcuuggugcccuccccgugguaaugaaugaguucucacucuguuaguuuacaugagagcugguuguuuagaagagccugacauggcucuugcucccucucuugccauguaagucacgaacucccccuuccccuuccaccauaaguggaagcuuccugaagcuucacaagaagcaaugcuggugccaugcuucuguacaaccugcacaacugugagccaaauaacccucuuuucuuuauaagcuacccaaccucagguauuccuuuauagcaaugcaaaauggacugacacgccuuuaaagaucauuucacucaccucuguuuacagauggggaaaucaaggccuggagagaugacuuauccagggucacguggcgagacagggacagcaccagaaccagacccgagauguccacgucaaagugacaugcucugagaggcagcacacacagaauaacccugcauccaaauuccaggaagcucuuaggggucauccagcugggccuaggggugcagggucagugcugaggccugggcagggccgcuagccucccugagcuuucuggcuucaggcugggaggcacaguucaggguggacugugaccccuuggccuagaaugcccuuagcucugcucucuaguggcuguccccauagcuggaacucuguuuuggaguggcaaaaccaguuccaccugcugguagggguagguuggcucccaacacauccccagcaggccucucuugggcucaaaagccaagcugugcccagccacgucuccaaaugcuuccuggcccccaugcagcaacugcauuuagcugccuucccagaauuuccugcaugcucacacagcccuucccucuggggcccaacaaugccacagccuguucuaucaaucaccagcuguuuuccuuugagcagucuccuuuuacuuaugcacauuuacuugaaaaagaaacuuccuauuacuauccuaaauggaaacucagaaucacuugcuauaauuagaaaguagcuacaaaaauaaacacaaugaaaccgaucacuguuauuacacccuaacccgcuuuuaccugagacaggcccugagccugaggccgcugguagacuuuuguuaaaagagagagagacagagacagagaaauaagcauuagagaccugcaaucaccaagcugagacuucucuuugauuuacucagaaggacuggaaaauguuguccugcaaaaggagguaaguuucucaccacguagcgcugaucaucccguguugcccgugcguugcugcagaccaucuggggucuugcccaagcacccuggagacuuugcucccugguuuccuggucaccaacucgaguguucagcccugugugcucuccagcuccuaagucgugggccugguuucagcuuugauugcccacucuuggcuuucaacccguaggcuccggcuccugacgccacacccugauaucaagacccucagauggagcgagcguucugggcuggucgaagccugaagccgcaguauguccuugagugggucccccccuacccaucuagcuguugcccccaugguaagaucaagaaaaugcccuccccuccaaaaguccccacgccgagcccucaucugucagcucccaggcucggcccccucacuagcuccaggcugggaggcacaguucagggcagacuguggccccucagcauagcauggacuuagcucugcucucuaguggcuguccccauagcuagaacucuguuuuggagcagcaaaacuaguuccaccugcugguagggcuaaguugacucccaacauguccccagcguguugguguugggaaccuugaucuagcugcucguuuucucaguaaccaaagaucccuggcacuccuacgaugucucaggccuuaucuagagcuggggauacagcagugaccaggacagaacuggucccugccucacggaagugaagugucaggaggccacucccaaagcaaauggaagcugggacagaaugauguccucagccagguggucagggaaggcuucucagagggggcgcuguucaaagaaucacagagcauacaaaggagcuggcccugggagcacagagaggggagaauuuuaggcaaagagguagcaggagcacagcccugaggcaggaaacuacccccccaccacccucggcauccucaguucugguuugcacccagaaaggggguagguccaggacacacccggacugaugugucacacuggcugugccagcugagagagugggcuccaggcaccacuaacagagaagccuugcaaggcagguccaugcaccgcccgccuccaguuaccacucauugcaaaggaaaugagcugggagccugugugugggccgugcagacccuuuugguuacaagccacaaaaacccagguuaaucugaugaggaaggaauuuauuaucuguaaaguccaggagcaggcuagcuuuacaccaagcaggauccaaggacccacacuugucaccucauaucucucucucucucccacuuucgcuuucucugucucuucuuaguucugcuuuccuccacugugccuucgcucucagagagagcucuccccuggcagugacaagauggcugcagcagcuccagcaaccucagaggacucccccauccaggguccuugugagcuccucaucuguaggaugugcaguaaacacucacguguccuuuccugaggagcccaguggcuggggugggggcugaggggcagccccuaugcccucacagugcagcaaccuugguuagcucacccaucagggcagacuugggcagaaaucaugucuuggcauauuguuuuguaaucugcuuuuuaaauugucacuauauauuaugagcauuucccuauaauauacaauauucuuccacauuauguuuaaugguuucauuguauucuaaugcauauucuauaguuauuuuaaccaccccacaauguugcaaaauguccuuauuugggacaacacugcugcaaacacuuugacccauauguccuuuuugugugcacucuuauggcaacuucuaacgguggcauuucugaaucauagacacuuuuuugacuucuacauauuuuauuuuuuuaguugacaaaaacuguauuuaugaaucauaaacacuuaaugauuuugcuauu

SEQ ID NO: 192945 - RNA, 30804 nt, Homo sapiens
ggcgggggcgaggagccgggagcacgguggagcgguggagggcgucacuggguuucggcgucuggcaagcgguucagcugucugcucccuagcagccggccuucgggucgggcgucuccgccggcuacugccgcuucaguucucccgguguggccacgagucgggugagucucgggaguccaggccguuccgaacgcguuccguuguuccuccucaggucccugauggcgcgucccgccgagccccuuccugccgcccgucggccccaggagguggggaccaggaagacccggcugccgcaggcccacagccgggcugcugcgcuggggaggcugcgagcgagguggcugggcgcucgcuggaacacgcugguggccgagacaggccgugggcgucgcucgggguugggauccgcccgccacucacucaacuggcuggugaccuugggcgcgcuccuccccucccggagccggggcuuccucgccgguaaaauggaccuugaggaauggagcccucaacacaggguuugacacgaugagcgcccaauaaaguguuguuauuguuguuuaucuagcaauugagaauuugcggguagaaaacgggggccguucaagcaagucucagcugcagugcccugugaugugagaacccaccaagagccccaucaguacacuuuacucuuuuuucuccuuuaaugcuuuuuuuuuccaggaaaguaauacauucaucuugcuuuucuugcguuuaaagaucaggcguuuuacguagagucuuaaguaaaucaguuuuggaagucuucauuuaaaaccucaaaggcauggaaguuuucgauggcaaaggaauuauguugugaugccauucguaucuccucuccuuuauauguauggcuuuugcacuuguuuaguugauuuaaaaugaguuucuuuuucauccuuuuccuacugcguugaggccugaacuaguugucaguuucugacauuccgcgaacaucgauugggcauuuaccaugugcauuggcaagaaugcucccucacgagccugugcguuccuugagaugugugaacgaguauuuuccucugaaauucacaugauucuggcagagugcuaggcaccuuguaaguccugguaauguuuauucagggaaagcugcgagggcgcauucucugagaaacucuucgguggaagucagaguaguuaagcccuucucccuaggcagcacccccgggucccucccagaagcagccuggcauggggucuacagugccagcgccagucgcuuucuuagugguaucgguuuagaacugguccugugauaaguggaagugggcaggggaggccguccccgaccgugucugcgaccucugcugcaguauggcucauagcuugaaaaguugaaaaauaauucuuuaauaccagggccgaaauguaggccuuaaaaauguuuuauguuauuuauuuauauauauauauauuuaaauuuuauuuugagacggcgucuuguuuugucgcccaggcuggagugcaguggcgcgaucucggcucacugcaaccuccaccucccgaguucuagugauucucgugccucaaccuccugaguagcuaggguuacaggccacgccuggcuaauuuuuguauuuuuaguagagacggggauucaccauguuggccaggcuuguccugaccucaagugaucugccugccucggccucccgaaguggugggauuacaggcgugagccaccgcgccuagccuaaaaagauauauuuuagaaagcggaguguuuacaguuuuuuuuucuggagaacaguuucuucagacucugcacaacagacuuuucuggccuuguuuuuugcuuauuuugcaguagcauuagaaauuacaacuguaguguaaauuuccugugcagccgcacaauaggaaaaucuuucuaaagaaaagccaacuggcauuaaaauacaggguucuuccuugugauuauagauuugcugaagugaguuauuagaaugcuuacccguuuucuuuauacuagaguuaauacagcgcuggcucuugguuuauuuucuaaaauugugccaccuggugguugaaaucugucuuagacuacucuugaggaaaauuguaccucagagucaguagacaaagauugaaggagugaguaaaagaaagcuauaauuuuuauaucuucacuaagaguacccuaccgcuucuacccucccagcuuacuccccaggaaaaguuaaaauugcccuuaugggccccuuagcuagcuaucaaaacacauuugacagcugaaaauuuuaaggaauuucaguggacuguuuugguaucauugugugcauacacaguggauggggcuggauugaggagggaggugguggaaucgugacaaguuuaccuuuuugauguuuucuuaaaugccauuguaaagaugagacugacaaacugauggaagucagaguaguuaagccuuccuccccaggcagucccuggggucgcucccaggagcagccuggcuuggggucugcacuggaauuaaauauuauucuauucaaauaauaacaguuugaauggaauuuaucccucucuauuucacuggaaacauccaagaacgaggucuuauguuccuuucacuuucguuuccaccaugcugcugauguucauaauuauuauuuuuugagauggagucucacucuuucgaccaggcuagagugcagguggugccaucucagcucacugcaaccucugccuccagggcugaagcgauuccccugccucagccucccaaguagcuggauuacaggcccccaccaccacgcccagcgaauuuuuguauuuuuaguagagacuggguuucaccauguuggcuaggcuggucucgaacuccugaccucaagugaucugcccaccucggccugccaaaguucugagauuacaggcgugagccacagcuuccagccucacauaaguuauuuuaaacccaugccaucacugagauauauaggucaagagcaaauuccauuuuauggaagagagacuuaggucucagauuaguaaccaaaaugauguaacuugugaguagcugacuagugacaaauacaauacucuucucuuuuuuugugucuugacagacucacuauuuccacacuuacaggauaguauuacguuggcugcuuuggaacuugggccuagaaugacuaccuuuugaacuuguagucaaucagaagcucuuugggaaauaguuuuuccaucugaauguauuucauucacaaacugcugugaaugccugucuuuccuauuuugaacauggauuaaaaaucugucaugguuagagauuauguuggguugugacuuugcagcuaacuacugugugaccuggggcuuaguuucucuaugaaaaugugggcagugcauauuuugaccuauaaaaagacaguuucucaugguucaacugaauuuaaaaggcuacccguuucauaagguuauugcauuguaagacuugugcuuagcacuuggcaaguguucaacaaauuauuuucuaaacuaauaacguugauaucuucuuaugacuuugaagaaauuuuaagaauaagaauauggaauacguauuuagcguuucuucaguuuguuaaauauauuuugaguuaaauuguguuacuagaauagucuuuuaaaggugagugcuggaagacaucagcacuuaauuacauguguucugagagaacauugccauuuuuacaguuguaccuuacauauuacaccccagaauacagcaguacaucuguguaugcaccaacauuuaggcaaagccaagugacacaaaguggauggaagugagcauaggugacggguagguagagggcaaggggaggaagaacauaucuagcuaaaaauaugugguagaagaaagaagggagugauggggaaagcaaggaaucuguuggauaagggauaaggugaguguuuagagcuuuagguuaaguaguagcuucuuaccaagaauaggaaaaggaaaugaaauuaaaccauuuuauucuuugacauagucaucuaggcuaagaaaguagaagggccuuauaaauauauacaauuauuauuugucaauucaaaguaaaacuaaauaaugugaauuagaagggaagacguuuuauugguacccuacccugauugacaauagcauauguauuugagguaaacuuguuauagagggaggaaaauauguaccauuuuauguacuuaggcuuauauacaucuuugcaucuauuaauauugucucagucaagugucuucucagguauuugucaauuaaagaaaucauuucaguacaucauaagcuuguuucugaauuguaaaggcacacauuugagugccgguugauagaaaugugcaaaaauauuuugucaaauacauuuagaaaauguuagagacauuuucuagugauuaaaccagugucuguuuucuguuauuguuguuuuugagauggagacuugcgcuguuacccaagcuggaggucaguggugccaucuuggcucacugcaaccuugccucccagguucaagugauucuccugcuucggccucccaaguagcugggauuacaggcgcccaccaacacgcccagcuaauuuuuugaauuuuuaguagagaugggguuucggcauguuggccagguuggucuugaacucuugacuucaggugauccaccugccucagccucccaaagugcugggauuacaggugugagccaccgcaucuggccuauaccaguguauguuuucuuuaggaaaaaauaaggcagaaaccagaaaacuaacacuucacauaaauguaggugcagaauauugguacgauauuggauaacuuaaauugcugaacuguaugaaacuuaauuuuucuaaggcaaaaauugauaucauuggaaggaucuuggagucaguggcaggcaaacaaaauuuaaacuuggcugcauuuucuuuuuucguuucaaaugaauacuuaacuaggugcaauggcuuuauuuguggucuucagcugugguguguguguguguguguguguguuuaguaguuacugaauaguacagggaccuacugcauuuuuauaaguugcaauugaaauaguagcuaugcuauaauccuuuggaauuauuuguucagacaguuuuuuguuucuguugagugggagguggaugggcaguuugaauuucucacagguuuuuuuuuaacagcuugagguauaauuuacauaccauaaaauucgcauggugaaaugcacguaacauaaaauuuaccaucuuaaccauuuaaaugcacaguucagugguaucagauacauuaauaauguugugcaaccaucaccaccguccaucuccauaauacuuuuuaucuuguaaaacugcuuguuaaacaguaacuccccauucaucuccuccugcccuuccaccucccucugguaaccaccauuccacuuuccgucucuuugauuuugacuacuuuaggugccucguauaaguggaauguuaaaguauuugccuuuuaaaaaauauauaauuucaaauuuuauuucagauuuuggauauaaguaaugugcagguuucuuacauggguacauuggaugacacugagguuugggguacuguugaucccaucaugcagguaagugagcauaguaccuaaugguuuuucagcccuuacccuccuucuaccgucuauuaguccccaaugucuuuuguugccaucuuuaugucugugaguauccaguguuuagcucccacuuauaagugagaauaugccauauuuggcuuucuguugcugcguuaauucacuuaggauaauggcuuccagcugcauccauguugcugcaaaggacauaauuucguccuuuuuuauggcuguuuaguauuccaugguguauauguacauauuuucuuuauccaauccauuacugauagacacuuagguugauuccauaucuuugcuauugugaauagagcuacaaagaacuuaugagugcauguuuuucuuuuuguaaaacgguuuauuuucuuuuggcuauauacccaguaaugggauugcuggaucuagugguagcuguuuuaagcucuuugagaacucuccagacugcuuuccacagugggugaacuaauugacauucccacaacaguguauaagcauucucuuuucucacaaccucccccagcaucuguguuuuuuugacuuuuuaguaauagccauucucacugaugugaggugauaucucauugugguuuugauuugcauuucucugaugauuagugauguugagcauuuuuucauguuuuuuggccacuuguauaucuuuugagaaguggcuguugaugucuuuugcccacuuuuuuuuaaaauuuguuuauuuguuuuguuuuuucgagacggagucucacucuguuaccuaggcuggagugcaguggcgccaucuuggcucacugcaaccuccgccuccuggguucaagcgauucuccuuccucagccucucgaguagcugggacuacaggcgcccgccaccacacccggcuaauuuuugcaucuuuaguagagaugggguuucaccauauuggccaggcuggucucgaacuccugaccuugugaucugccugccuuggccucccaaagcgcugggauuacaggugugagcuaccgugcccagccuuuugcccacuuuuuaaugggauuauuuauuuuuuacuuguugaauuaauuucuuuauagauucuggauauuagaccuuuguuggaugcauaguuugugaauauuuuguccuauucuguagguugucuuuauucuauucauaguuucuuuugcuguuuugagaucuuuaauuagguuucaguuuuuguuguaauuguguuugaguacuuaguccuaauucucuuccgaaggugaauguccagaaugguguuuccuggguuuucuucuaggauucuuauaguuugaggcauucuguguaaaucuguaaucuaucuagaguuaauuuuuguauaugaugaaagguagggguccacuuuuauucuucugcauauagcuagccaacuaucccagcaccauuuauugaaugggaaguccuuuugccauugcuuauuuuuguugacuuugucaaagaucaaaaguguguggcuuuauuucugggcuguuauguuccauugguccauguguguguuuuuguaggagaagcuugcugauuugguuauuguagccuuauagucugaaguaggguaaugugauacguuugguuuuuguucuuuuugcuuaggauucuuuuggcuauuugagccccuuuuugguuccauaugaauuuuuggauaguuuuuucuaauugugugaaaaaaugccauugguaguuugauaggaguaguguugaauauguagauugcuuugggcaauauggccauuucagugauauugauucucccaauccaugagcacggaauguuuuucuauuuguuugugucaucugugauuucuuucagcaguguuuuguaguucuuccuguagagaucuuuuaccuccuugguuggauguauuccuggguauuuuauuuuuuugguggcaauugaaaaugggauuguauucuugauuuggcuuucagguugaaccuuauaguguauagacgugcuacugauuuuucuauguugaucuuguauccugaaacuacucaagucauuuggcagagucuuuaggguuuucuggguauagaaucauaucgucagugaagagagacaguuugacuucuuuucuuauucggaugccuuuuauuucucuugacugauugcuuuggcuaggaaauaaguacuguguugaauaggaguggugagagcgggcauccuguucccuuguuccgguccucaagggaaaugcuuccaucuuuugccuguucaguaugauguuggcugugaguuugucauagauggcucuuauuuugagguauguucuucagugccuaguuuguugaggguuuuuaucaugaagggauguuggauuuuaucaaaggcuuuuucgcaucuauugagauaaucacaugguuuuuguguuuaauucuguuuguguggagaaucacauuuauugauuugcguauguugaacccuauauauauguuuuuugacuggcuuauuucauucagaauguccucacauuucauccauguuguagcauaugccagaauuuccuuccauuuuaaggcugaauaguauuccauuguauguauauaccacauugugcugauccauugucuguuggacucuuggguugcuuccauguuuuaauuauugugaauaauaugccgugaacauggguguucaaauaucucuucaaaacccugcauuuaauucuuaugaaaauauagccggaaguggaauuguuggaucauaugguaauuucauuuuuaauuuuuugaggaacugcuauaccaguuuccacaguggcuaucccaguuuacaugcccgcccacagugcgcaggaguuucaguuucuccacauccucuuuagcguuuguuauuuucuguuuuuuuuucagcaguagccauccuaauggauauggguugguuccuguuuucuauuuggaacuuuaaaaaaaauuaaagcagguaaucgguucuuucuuuugguaaucauuucugaguuagaguagguuaagcccagguggggcacgguagcucaugccugucccaacacuuugggaggcugaggaucacuugaggacaggaguuugaaaccagccugggcaacauagcaagaccccugacuacaaaaaaaaaaaaaaaaaaagaacagcugcccaugauguuuuuccuuugaccuuggcugcuaauuuuccaccuuguggaugauccaauuaaacuuaaguucagggauuucagcuucauguuuucaguguaauaauuaguuuuauggcuauaucuguuaaauuugaaauuuuuuuucacaacuucugguuucauuucauuguuuaguuuuuuuuucagccagcuauuaagaaaaaagcaaucuauauucacacuaauaugagacuaaugacccuuuaacccucagaauaauauacauuuuaaaauaauaagccaauucucuuaauugguagaauuucaucugaacaaaaugaguuguuaauuucgagaauguggcgaaaauauuugaagucaggcuuauuaauauaagcaagcuguuucugcuuuagugcuuauuuccgggauugggucucuugaggcuuccugcuuuucuccugaaccuguagguucucuaaauacuacugauaacuugcugaauaucuuaaaucauugaauuagaaagcuuugucucaaguuuaauaauuugccugaggucacacagcugguuaaugguuaacauacuucucugauaaaggucacuagagguucuuaugaagauacuuuuagguggcguaacaaauguguuuaugcauauucaagacacucuuguauccacagguugcacugcugugauccauccucaucuccuaaagaugcauccugacuuaucuccacacuugcacacugaagaaugcaacgucuugauuaacuugcuuaaggaaugucacaaaaauguaagaguucagaaaaacgacuguacagccaaaaugaaacuuaguuauaacccacugauguaaaauguuaucuccguugauagaaggaaacgauaaugucuuaguaaggagucugaguuuagucaagauuagcaguugauaugugcgauuuuuuucuuuuuuuuacacaaacuaccuccuuuuaugauuaguaaaaaucagacaugguaguuuguuagggaacgucugaacugguauguaacaguuggaauccauguucuuacaauaaaaugcuuucucuuuccuaauuauagggcacuagaacaguuauauucagcgcugacacuucugauuauaauggaauuauucuaaaaguaucugcucuuugauggcuaccauucuguguuuaaugguaauagaaacguguuauauaauuagacauuaacuagauuuaugauuggcuuaaucugauguguuuaguuguuaguggaauggaaguaaaauuacaugguuaaaaccaaaauagaaaaggagcccauccauauuuggaauacauuaaaucaagcugacauuuuuauagcuguugaauauuuagcuuuuccuuauauguuugauauaugacaccguuguuacaagaagcauuuguuuuuucuuuagcuuugcauaguuuuucucaugaugucuacaaacuguagauauaucaaauuauaauaauauaaaguaucacuuaaaugaguaaaauuuauagaccaaaaguaaggugguaaguagugcuuauaaaaugugaagucagauauuuuuacugguucaaagaauguuguugaugacaauauuuuuugggcuauuucacuauacauauagaucaaaugagccagacuacaucaauaaaacauaacguuuugauuuuuaaaguaaaaacuauauaaaauauucacuguuuaaagaacaagaacuaauuauuuguguuaaaguagaauauuucaauuuguauauggucaguuauagucagagacagaaaaggggagagggucuggcaacagagaggcacagcggagagaaagagacucuguggaauaacauuucagucuuguuauugaggauuuugccaguauagcccuuuagauuuauguugugcuuuuuguaauacuagacauaaauaaggauauuaucgcaucauauuuauuuccaugguuaaucaaauuaaggggcagaguuuuucaacccuugcuuuuaaguaaucuuuguuuuauguuuauauuuguauauugcuuuuugguccaugacuguuuuuaaauugaaaucuauuuaaacguuguuguuuuuuuuuucuuucaaauggauuucuuauaauaaagguggcuucuugaaucacuggaacuaaagauggauuuuaaaaaauuaacuuuauugagguguaauuuacauguaaggaaaugcaucuauuuuaaguauacaguuugaugaguuuugucauauauagauacccaugcaaccaccaucacagucaagaucuaaaacauuucuaucaguuuccugugccccuuugcagugaguccccaacccuuaacuuacgucuugcccagguaaccacugcacuacuuuuuguugauauagaugaauuuugcaguucuagaauuuguuagaaauuuacacuacaucguauauucuuuuuguuuuugagauggagucucacucugucacccaaccuagaguguaguggcgcgaucuuggcucacugcaaccuccgccucccagguucaaguguuucuccugucucaguuugccuaguagcugggauuacaggcgugcgccaccaggccuggcuaauuuuuuuuaucuuuaguagagacggaguuucaccauguugggcaggcuggucucgaacuccugaccucaggugauccucccgccucggccucccaaagugcugggauuacaggcaugagccacugcaccuggccuacauuguauauuccuauauuuugcaccaugauauguuuuugagggucauaacaugcuguugcacaugucauuaguucauuuauuuuuauuucugaguaguaguucauuguauggauaugccacaguuuauuuaccuauuaauggacauuuaggcaaauaaacaguuugcagcugugcuauuuuggauaaagcugcuaugaacauucaugcacaagucauuuguuuuugagacagagucucgcucugucacccaggcuggagugcaggggcccaaucuuggcucacugcaaccucugccucccagguucaagcaauucuccugccucagccucuugaggagcugggauuacaggugugugucaccacaccuggcucauuuuuguauauuuaguagagacgggguuucauuauguuggucaggcuggucucgaacuccugaucucaggugauccaccugccauggccccccaaagugcugggauuacaggcaugagccaccgcacccagccaucaugugcaagucuuuguguaaacaucauuuuauuucucuuggguaaauaccuaggaauggaaugacuaggucauguguuaaguguauauguaccuucauaaaaggccaccaaacuguuuuccauuuuauacuacucuacauuccuaccacuguccaucaccacugccuaauauuauaaacuuuuuaaguucagccauuguguggauauguaguaguaucuccuuuugguuuuaaauuguauuucccugaugacuaaugauuuugacaugcuuuucaugugcuucuuuggccauucauauaaaauuuuuugccuguauuuuaaaauuggauuguuuuaugacugaguuauaagcauucuuuuuaucauuugggauacaaauccuuugauaaguguauugugaauauuuucucuguggcuuuuuuuuuuuuacuuccuuuaggauguguuucaaagaguagcuuguacauuugaugaagucuuuuuuuuuucuuucaugguuugugcuuuuugugucuuaaggaucuuuguguauucuguggucacaaagauacuccuguauuuucuuuuaguucuaucguauuagcuuuacauuggucuaugauucguuucaaguuaauuucauuuuuuucuuuugauauuuguguauucuuaucugagauuucaaguuaauuuuuguguauaguaugaggugugaguugaaguugauuuucuuugccuguggguagccaguugucucaacaccauauguugaagagacuguucuaucccugcugauuuaccauggucccuuugucaaaaaucaauuuaccauaugugagugggucuauuucugggcucucuagucuguuucacugauuuauaugucucuucuuaacaccaguaccaugcugucuuaauuacuguugccuuguaguaagucucagucauauaguauaaauccuccaauuuuguucuuuuuucaaaguuguuuuggcuauucuaaguacuuucauuuccauauuaauuuuagaaucagcuugucauuuucuacaaaaaacuuguuuacugguuuuuuguuuuuugaggcugaacauuguugaugacuuggauuuuaucuuuuguaucagcaggcaguucguguuuuuacauauuuuuagggcauagcuggcauagucuuuacucuagaguuagcuuagcccaauuacuaaauuaggauucuuuacugauugacuugcauauucaaugagaucucuacuuuggcuuauaaggacuccauugacucccagcccugugugagcucugcguuuuucagcuuguagcugcuguaauuguucuucguagugacuauggcauugugaaagucacccaauacauguguagugaauacucagucagugacucaaggcagcuccauguagauuucuggaguucuuuugcugcuuaucucuaccucacaaauuccggcugccccagccugcccgaauuccucugacguuugccuccucugcucggugaaacuaccauucuccucuugaguucuguucucugcuacaugguuuggaaauugucuguggguagaaagcuaggugaauguaggguucacuuuguuuuguuuuuuucuuucaguuaucacaguccuguagucuguugucccaauaucugaaaauaguuguuuuauauauucaguuuguucuuucauggcuagaagcagaagucuggaaaauagauuuuuaaguaaauagcauggggacaauuacauagcuguuuggaaaaaguuagaauaccauacauaugaaucaacuaauggggcagacaucuaaaugucaaaaaugaaacgauacaaacacuaagaaaccuggauaaauucuuauauaaccuagguguggggaaagugugccuaaguaaggacccugaauuccagagacaauaaaaucaaagauugauaaaggaucguuugaggccuggaguuccagaccagcuugggcaacauagcaagauccugucucuacaaaaaauaaaaauaaaaguggccgggcauggcacaugccuguaguccuagcuacuuggaagguugagguaguaggaucacuuacccaguuguuugaggcugcaguacaacacaucagccugugugacaaagugagacccugucuuuacacaaaaaaaaaaaaaaaaaggagggggaauaagaggccaaaaaucagagagaaaaaugagcaaaagcaugagagacaauuuaaaaaaaaaagaaaagauggccuuuaaacaugagaagauguucaaccucaauaauuagagaaauacaaauuaaauauacugaacauaccauuacuuaucugcaggggggccaaauuaaacagugugacagcgcauucuguuggcaacacuguauacccucauacauuucugaugggacugcaaauuguuauaaucuuuauagagaggaauuugcugccuuguagcaaaacugccguauauuugcuuuuuaauccaucagucccacuuauaggaauuuaucuuaaaaguauaacucuaacaguaugaaaaaauguaugcauagaguuauuuacugcaguguuguuugcacuuggaaaauguugggaacacacuuucccaacguaaaguaguugaacgaccuauggugcauccacacaauggagcacuauacagcuguuuuguaauuuuuauuuuuaaauagacuuuguuuuuuuagaacaguuuuagauuuacagagaaauugugaaugcaguacagggaguucccauauaccucacaucuagugucccuuauuauuaacaucuuacauugauaagguguuuguuacaguuaauaaaccaauauugauacaugaucguuauuuaaaguccaugcuuacucagauugcuucagguuaguguuuaccuaaugucuuuucucuguuacaggauuccguccaggauacacauuacacuuaguucuugucacucuuuaggcuccuguuaucugugacauuuucuuuguuuuugaugacccgaaaagguuugaggcauaauggccagguauuugguagaaugcuccucuguuugaauuugucuuguuuuccucauaauuggauugggaucauguguuuucggaugaagaccacagagguaaaguacauuuucaucaaggcugcauacuacaacauaauuuaucacuguuaauguugacguugaucaccuggcugagauacguguuagguuucuguaccuuuuuuuuuuuuggagacaggguccacuaugucuuccaggcuggagugcaguagugucauuuuggcuuacugcagcuucaaccuccugggccugggugauccucucaucucacccucccgaguagcugggacuacaggccacgucaccaugcucgaauaauuuuuuguauuuguauauuuguagagaacggguuuucgccauguugcucaggcuggucuugaacuccugggcucaagcaaucugucugccuuagccuaccaaagugcugguauuacagaugugagcuauugcacguggcuagguuucucugcuuugaaguuacucuuuuucucccuuuucauaacucuuuggaaggaagucacugugugcagccuacacguaaggacugggaaguuacccuguuccuccaaggugguggaguaucuacauaaucuuguggaauucuguucuggagaguugccuguucucccccauuuauuuacuuaugucaguauggacucauguauauuuacuuuauaccuuggguuauaauccaauacuacuuuguuuuguugcucaaauuguuccagcuuuggccacugagagucuuucaguuggcagugcagcuguuaaaaaaaaaaaaaaaagccaggcuugguggcucaguccuguaaucccagcacuuugggagucugaggcgggaggauugcuugagcccaggaguucaagaccuacaugggcaacauagugagacaccuguuucuagaaaaaauuaaaaaaaauuaugucacuagaugacacaugccuguagucccagcuccucaggaggcugagguugaggugggaggaucacuugagccugggaggucaaggcugcaguaagucaugauugugccacugcauuccagccugggugacagaguaagacccugccucugaaaagaagaaaaaaaaauuucuuugaaccaacauguaaugacuuccaggauauauuucgugaagaagucaaaggacaaaacaguauuuauaguauccuagcguuuguauaaaaaaggaggagaagauagcaaaacauauuuguaucucuucauuugugcaaaaagaaacaagauaaccagaagcuaaugagauugauuacguucugagagguugguaggagcaaagcagagagaguggaggagugacacuuuuacaaaaucuuuuggccgguggcgguggcucaugccuguaaucccagcacuuugggaggccauggcgggcagaucacuugaguccaggaguuugagaccagccuggccaacaucacaaaacuucaucucuaccaaaaauaaaaaauuagcugugcgugguggcggaccccuguaaucccagcuacucaggaggcugaggcaggagaaucacuugaaccugggagacagagguugcagugagcugagacugugucacuggacgcuagccugggugacagagugagacugugucucaaaaaacaacagaaaaaaauuauauguuuuguauaauucaugcuguuugaacuuuguuaauguuucauauacucaaaaaaaggggagggaaugaaaaaaaggaugagcagaguugggaagaaaacucaaaaauggaauacaagcaaaaccaaacaaacuuacuugaaaugagucaucuaauuacacuaaagaaaaaaaugaacuaacccaaguaauuugaacguaggcuaaagacaaaguagagcuguuguuaguaguauggauuuugcagcaguguggauuggcaguucugacacuggcuucuauguauucuguguauuccaagacugagcaaauaaguaaacauauuguagacgaaaagagacagguuucuuacugucauaaauauagaaguggaaagacuaggauguauccugugauguuggauuggaauuagagguaucagugugaacucaugguuuucaauauauauaagauguagaauagauaaugugugucuauguuuguuucauguauauauucaauauauguuuuccuguagcaaugagcauacguaacgcccagauuuuguuuuuuaaauaccgcucuuccguaaacagaaacagggauccuuggagaaaugacugauuguagggcuagggcugggaaagaacaagaagaaccugcaacaucuuguaccagaaaguaugacauuuaucaaagaaugauagggacuguuaaaaggacaggggcuagcuugaagggauucccacuggccaaaaauggggcagagcaucaaaguaaugaaaauaauauaaucaauugaauaaggauccaugaguccaaacucauauaaauauauaaauggaugagaagggaaaguuucccuuacaguagaaugccaacuaaaauauaagaggagugcuagaauuagaaaaucacuuuuuguuaacuguuguaguaguaauugauuuagucaguaaucauuaauagauccucauacuagugggugaaaaguuugaggaaauaauuggauaguuaaauggucucaaaguguguccccauaauaauuagagaggaaaaacgaauacgguguagaaacuuggcagguagcuucuuaccuagguaauaaaaguuaacaucaauaaugggacaaauugccaugugccucuugaugugauacacugaagacacaacaucacuucuaggguauuccugccaaaaagucacgaccugaaucgaguugugaagaaacaccagacaaacccacgugggggagcauuuugcaaaauaacuggccuguacucuuuaaaauguuaagguaaugaaagaaaaaagagacaagcuguuucaaauaaagauuaaagauaagaaaaauauuguuuagaguuggaaaaaaaaaagacuaaaaagacgugacaacuaaaugcaauggcaauccuggaucgggaaaaaaaacccacccaacuuuuuuugccuuuugcaugaaugauauuauuaggcaaauuggugaaauuugaauaaggucuauaaauuagauacuaguguuaauguuaauuuccuaauuuugguaaucguauggagacuuaaauuuaaguccuuguuuuuuuuaggaaacgugcaucauaucugcaacuuacucgguucagaagaaaagcucggguguauauguaagagcuagaaggauaaagcaaauuuggugaaauguuacuauuuggaaauucuuuguacuguucuuggaacuuuucuucaaguuugaaauugacaaauguuuuuaaagacaucugcugucaucaagaaauacuuuaccuaacugaucuuucugaagacuugcacuuuuuaaguguuaaauugagcccaggaguuugaguguauagugagcuaugaugucacuccggcacuucagccugggcaacggagugagaccaugucucucaacagcaacaccaccaccacuuagugacuuaaaacaaccauaauucugcaggucuauaucugggggggaaaaguuaauuaaaaguuuaucgggaggaugucucacucugucacccaggcucgagugcgguggcacaaucaaaguucacagcagccuugaacuccugggcucaagugauccuucugccucauccuccugagcagaugggaguacaggugugugccaucaugccuggcuaauucaauuuuuuuuuuuuuuccuccuagagacaggcucuccuguguugcccaggcucaucucaaacuccuggcuucaagcuguccuccuaccuuggccucccaaagugcugggauuacaggcaugagccacugugccuggccugaucccaguuauuuaauuaauaaaucgagugaauuauauuaccuaagaugucuucuagcccugaguuuguguaauucuguuuuagucuuuuuuguugauuagucuuccugaauaccccugucugugcuggaaugcugcagugcucuccaaccugcuugaagugcaugaguguuuuaucuccaaauagccuaccuugcugugcuuuuaucauucuuuccgugcuuuuauaguucugcugugaucuuugcaggcaaguguuauuuccacagcuuucaggugucuguggguggcuucugaucuacuggccuauuuugccuaaauuugucagcaagacuuagauauucuuugcaucugaagguaaaauacagaauuuagaacagcuuauuucgucaaagcuacuuggaaauccuuguguauuuuuucugauuuauaaaaguaauauguaaauaauacauaucauuuuagauaguguuaaaaaaguaggaaaguauaaagcaaacaaaaauuaccuuuuguucaaccauccagagauaaacucacuaaguacuggguuuuuccaccauuuaaaaauuuuuguauuuucccuuuuucucuucuucuuauuagcauuuugaaaugcccacuuuuuuuccaucgugagaaaauaaauacauaagauuccuucccauaaucccagccuucugguaucuuguguuagcgucccuuucagagcuauugaaagaauacugcuuucuucuuucagguuggcuucuacccucacuagggucccaaaacuuucaagaucacuaaugacugcacuacuggcaaauuugguggauguuuucaguaguuaccucacuuuucucccagcagcaauugauucccucucaaaacacucuuccacaggcuucuaccauaacuuucucuucccugguuuuccuuaaguuuuuuuggccacucuucaggauacccuaggcuacaccuuccugcaaaaaaucauucgcuuuccugguuucaguaacucccaaaucuguaucucuggcucagauuuucucugaguuccagguuuaucucagcuagauaguggacuuaacuguuccaccaauaaacucaacauguccagauacaaauuuaucuuaucucuuuuuaaaacuuccacugucauucuuggcugaaagccagugucaucuuuaauuccuccaucugccucaccucuuccugugaguccuuaccagggcuguguguucucugccgaaucucucuugaaccauuguucuccuuugccagugccacugccauaguccauggcaacacuuuuauuggggccaccuguaaaggacuucuaucuggucuccuggcgguuuuguuuucuuuuuuguuuaaaucaauuuuccacccuggauuuagagugaucuuucaaaaauaaguuuaaucauuguuaccuuuuuuuuuuucuuuugagacggaguuucacucugucgcccaggcuggagugcagugguacaaucucagcucacuguagcuguuaggaaucugcauuuuauuuauuuauuuaguuaguuuugaggcagaguuucucucugucgcccaggcuggaguguaguggcaugaucuuggcucacuacaacuuccgucucuccgguucaagcgauucuccugccucagccucacgaguagcugggauuacagguaccaggccauuaugccuggcuaauuuuuguauuuuuaguagagaugggguuucaccauguuagcccaggcuggccucaaacuccugaccucaggugauccgcccgccugggccucccaaagugcuggaauuacaggcaugagccaccgcaccuggcucauugucaccuuuuuaauagauccuuuugccuauacaaugcguuauaaaugucuugccuuguguuucaaguccuuaaugaaacucauccuugaguagcuguuagucuucaccacucucccacagcuccuuccccuucauuccugugguuuuuuuuuuuuuuuuugcagguauaugggagaaugauauuucugucuuccaagccuugauuuuuccuuugcugagcuuagugcauuccuccuggcuccacuuacuguuugcuaaaccaggucuuaucauccuucagguuuucuucagcuuaguuggucguuuccuuuucccuuuccuggccuagauucuccuggugcagucacucuguuugaguagcaucauacauaacagcuuuucuccuucguggcaguucucacacuuuuuggucucaggacucuuuugcacucuuuuaacauuauuuaggauucuagggagcuauuguuuaugugggugauaucuacaauauuuauuggauuagaaaugaaggcugagaaaugaagaaaaaauuauuuuaaaauuacaaugauaaauuauaauuuuacauguuaagaugacauguuagcauaguuauuuuucacgaaaaucuuauuuuucaaaccagaaaaaagcgaaaagaauugcauugcuuuucauuuuuuaaaugucugaauuaauaaaauauaccugaauucucaugucugccucuacauucaaucuguugugauguuagacuucauguagccccgggaaaacuccgcuauacccuugugggaggaugaaaaugaacaaaacaaauguuuuuguauuauugagaagauaguuuugaccuuguaccuucccugaaaaggucucaggaaccccucggugucucuggacugcacuuugagaaccacugcuuuauggcagugacuucuuauuugccucuuucccucugacuauguacugugagaguaggacccagauccaccuugcucacuucugugucccugguaccugggacauuguucuuuauguaaaagguucgcagauaucuguugauucacuuauucaaucaguuacucgguugguuugguucucaagaaauugacaccaggcacuagagacucaguccauguaaguauaagaaaauuguagccugugggcauuucuucuaccaauuucucuggggcacuugggucuaauauuuuucauguaacaucacaagaguauaauucucauuuuaccuuaguuaauauugagguaaaaggaagcauauaaauuaguuuuugucauggauuuuugaauuaagauguacauauguggaaugauaugaauaaaugucaacuauguaauauugccucacauuugaaaagucuacuugacuugaaggcaugaaaaugcauugucauguuuauuuguugucaaggaaguaguaguauaguaaaauacacaggaaauauuuauucuuugggaaugauagaggaaagaaaaaaguaaaauaaaaauuaaguacaaaaaguuuuuuuaauuaaaaaauuuauucuggaaaggucauuagguaacaaauaggagacuuuagucuauguuaaaugcuuucuggaaaaacugaccacuuauucaguguggaauugaaacguacguuuaaaaugguggugaagcaggaaaaaaagaaauagcaugaggcauagcuuauuaauuauguguugucugguuuccaugaaagccuuaauuagaacgaaaaggaaaagaugugcuuauuauuacaacuaccaaguucagcauuuaugaccugucauuauaaaacagaucaccaugcugucugacccacccuugaaaaucgugaagugcaaacacacuaauuauguuccuacugaaauucagguucuuaacuucaggcuucagcuuaaccugcuuuagagcacgcauacuuuuugccacgauaauacucauaggacuagaaacaacuaggagauguuauuuuauuuuuuaaaucagacugaacuucaggcagauuuccuuauauuguaaauuaguggcuuauuuauaugaccuuuauagggcaucuaaugauaguggguuuuuuuuucuuuuuuuuuuugagauggaguuucgcucuuguugcccaggcuggagugcaauggugcgaucucagcucaccgcaaccuccaccucccagguucaagcaguucuccugccucagccuccagaguaguugggauuacaggcauaugccaccaugccuggcuaauuuuguauuuuuaguagagaugggauuucuccaugucggucaggcuggucucaagcuccugaccugaggugauccgcccaccuuggccucccaaagugcugagauuauaggcgugagccacugcgcgcaucuguguuacuuauuugauguauuuuggugacauuuugaaugggggcaaaugagaaaagggcucuggcacuaagcauuuauuagauaacucuuuuacaggacaguguuugguagugaaguuacucugcccauggcaguguggccaugcugcagcuugacaccacucccuguaauagagaauggauugugcugugauuuuaacauuucccuuaagaaaaggguguuagguuaugauaaaacuuuuauacugucuuugugagguuuuggugaguuaguaaguaggcuucccuaucauuaagaaaaagucuuuaaaucuuuguuucuacuugcagaacauuuauuccuucuuuguaagaagaaccaggauaauuuguucauuuguauaguugauccuugaacagcuuggaaguucggggcacugacccccaugcaguugaaaguccacauauaacuuuuugacuccccaaaaacuugucugagaguuuccuguugucugaaagccuuacugauagcauaaauaggugauuaacacauguuuuguauguuauauguauuauauauuguauucaugcaauaaaguaggcuagagaaaaaauaaggaagagaaaauacauuuaugguaugguauuguauuuauugauauuguaaguuuacaucaucuguuuacaagaugauguaugucaguccgaaaugguagguaaccacagcugcagaccucaaucuacaguacauuucaaguaguucaacuuuuuccuguaaugucauuacuuuucucugcuucuugggagcacuuccagcauuacuaguggcacuucguaugggucccaugguguuauucaaguuuuaugguuauuacaguaaacaugacuugcuuacuguguauguuauugguaucacaggguguuauaaguggauaauuguagugucugagcccaguguaauagcaauaggaggugacuucagaauuauuacggcaguacaguauauaccgcaguuaauuuuauguaguugugauuugauauaucuuuauguuugcuuacaauucucucaaauuugaaugaugcuauuuauguucuguguguguguuaguuuugauaaauuuuaucuuuuuaaaauuuguauauguuuuaugguaguaaaugacaaaauagacuaguauucacuuuuuuuuuuuuuuuuuuuuuuuuuccugagacggaguuucacuccgucgcccaggcuggaguagugcaggggcgcgaucucgacucacuacauccuccgccuccuggguuuaagcaguucuccugccucagccucccaaguagcugagauuacaggcgcccaccaccacgccuggcuaauuuuuuguguacuuuuaguagagaugagguuucaccauuuuggccaggccgaucuugacgccugaccucgugauccacccacccgucuuggccucccaaagugcuggaauuuacaguugugagcuaccgugcccggccaguauuuacauguuuuacacauuuaugccguaucuuucucuuaaauuuuuuugauauuucuaggcuaugguaguucaucugugagguuuuuuuuaauuguuccaaauguucaaaaauguuuucaauauauuuauugaaagaaaauccagguauaaguggacucaugcaguucaaauccauguuguucaagggccaacuguguuuuauacaugugauuuaacuauuacuuguuuauuaacaaagugacacuguaaacucaugucuguggcaguauuuaaauuuuaugugccccaaaccuuggcauauuaugggaugaaauauuuuacuccuuuucuuccuuuuagcacaacauucugaaauuuuuugguuauuguaaugauguugaucgggaguugagaaaaugccugaagaaugagguaagaaaagugucaaaggauggauaugguugaacaauagaacagaacauuuuugaauauuguguauuacugccauuauugaauuuuucccacauuuuaguguaacagaaaauugacuuuacauguaugaacuuccucuguuuaggggaagaaaugaaagcuuuucuggggacaguuuuagaacauggcuuuuuggccaugaacacaaaugaggaaaacaacuuccuuaugaugauuacuguaggucaucuggaugaauuuaaugguuuaggaaguuguaucucuggccggcagaaagacuuauaucagucaccuauuagcugauugguagguaacuaaaacucucagggccucaauuucuauauauaaauugaggaggcuagaauuaggcuguuuucagcuuuaacauuuugaauuucuuuguaguuaugguuuguguaagccacagggaucuaauuugacuuguuuuggaacacugucaucuccugaacuugauuuuagggcacaacuuggacuugggcaaauagccacaguacacaguucauugucuuuuuccaggcacugccaaauaagcagagugcauuuuaaaccuuugaaaagaaauuugauucaauuucuguuucauacaucagauuuuuuguguccagaacuuuuaaaaauauaugauggcuaaaauuuugccuuucagauaucauuuuuguuauuuuugaacuuuuuuuuuuuuuugccucauauugaaagauuuaaauauaauauuugaaguuguccaacaucuuucuuuugauuuuguuuucugcuuaggcuguuuuucccuuccuggauucccuuuaaauugugacauucaccuuuacuguuugaagaacuuuuuggaguacucagugaagaguaauaguuuguuucuuuuuuucuuuuuucuuuugagacagguucuugcucugucaccuaagcuggagugcaguagggugaucguaacucacggaagccucaaacucaagugauccucccaccucagccuccugaguagcuaggacgacaggugcguaccaccaugccugguuaagguuuuacacauuuuuuuguagagaucagagucucacuguuuuggccaggcuggucucaaacugcuaaccucaagcaguccucccaccuuggccucccaaagugcugggacuacagacaugagucaccauucccagccuuauuaguguuuuuaaauuauuuacuaaaaauguuuguccuuuauaugaaaaagccaguuuacaugaaaaauacaccuagggugauguuucuuuaauaguaaacuugugagcuggcaucuguaaucccagcuauucgggaggcugaggcaggaggauccuuugaggugaaagcuuugaggccaacuugggcaacauagugagacccugucucaaagaaaucucuuaaaauuuagccaagugugguggcacagaccuguggucccagcuacuugggaggcugaggcgggaggaucgcuugagcccaggaguucauggcugcagugagcuaucuaggucgccacagugcuucagucugggugacagagugagacccuaucucuaaaaaauaauauuggccgggugugguggcccacgccuauaaucccagcauucugagaggccaagacaggcggaucaccugaggucaggaguuugagaccagccuagccaacauggugaaacccagcucuacugaaaguacaaaaaaauuagccaggcaugguggcgggcgccuguaguuccagcuacucgggaggcugaggcaggagaauaacuugagccugggagacggagguugcggugagcccagaucacauuacugcauucuagccugggugacagagugagagacucugucucuaaauaaauuaaaaaaaaauaaaauaaaaaauaaauaaaauaaauagcuuauggaaaaauauagcucauauuauuuuauucaguauggcuauuuguuuuuuacauacuuucagcuguauaacauagguuuuuuucauguuuuuaaauuuuuuuccuguauaguucagaaauuuugccacugcuuugucaauuagaucuucauaugaaauugucuucucagcuggccugagaucuguuagugacuuuuugguagaccguuggagauauuuuucuuauuuugucugaguuuguuuuccuauacaucucauguuuucucuuugaauucuuuucuaaguccucuguguaguuauguuacuuuauucucuaauuuguagauguuuauucucuaauuuguagauguuuuucugucugcuugcccaucacuaaucucugagucugcacucauguauuucuucucuacucuuaaugcuugcuucagaugcuuuccugcuacuguuugcuucauaugucaucugauuacuucauuccaugaagcuuuuuuauuuuuuuauuuuuuuugccagagucucacucugucacccaggcuggagugcaguggcgcaaucucagcccacugcaagcuccuccucccggguucacgccauucuccugccucagccuccugaguaacugggacuacaggugcccaccaccacgcccagcuaauuuuuuguauuuuuaguagagacggggcuucaccguguuagcuaggauggucuugaucuucugagcuuguuauccgcccgccuuggccuccuaaagugcugggguuacaggcgugagccacugcgcccagccuccaugaagcuuuuaaguagaaaaaggguauggccauuucuuguugggacuccgcugugucacuccuuuuauucuuuuuuuuuuucuuuuuuuuagagagauggagucuuguuguguugcccaggguggucucagacuccugggcucaaggaguucucccaucuuggccucccaaaguuuuggauuacaggugugagccacugcaccuggccuuuuguucuucuucuugaaaagaaacacuaauaguacuuuuguggcauucucuuuugucccucuuaauuguuuuguuugguuugggguuaauuggccuuucauucugucuguauuguuugauugaguuuugugaguaacuucauauucauccuuuucuccccuuuuauucagggaccaucuggacuuccuuuggagaugucuuagcauauuuuaauguagacuauauuuuaauuugcuuuguaacuuauuuuauuggccugcuacaaaguauuaucuucugaagaguuucccuuaagacccuucucaaccugauugcugggggcaauccaguagacgugauuaaagguagauaugaaagcuuuuucucagagcagguauccuuccuuguucuagaauacguuuuauugauuuuuuccccaacaauuuuaugaguaaauuuaauguaugauagauaaaaugaaugacuuugaagggaccuggugcuucauguguaauuuaaaguagcuuuuuuuuugagacgaagucucacucuugucacccaggcuggagugcuguggugcgaucucggcucacugcaaccuccuccuucuggauucaagugauucuccugccucagccuccugaauagcuggaauuacaggugcaugccaccaugcccugcuaauuuuuguauuuucaguagagacgggguuucaccauguuggccaggcuggucccuaacuccugaccucaggugaucugcucgccucagccucccaaagugcugggauuauaagcaugagucaccgcacccggccugaaguagccuuuugacaaggaaguaauaaaaaguuugaaaacuaccauuccagaagauauguuagaauccuucagucaaaacuuuugaccuagaaaacuucuuaaagauuaucuagcccaccuccuuauauuugaaguuacugguccagaagagugaaguaacucaaagucaugaauccccucauuacucucucuuggguggcgggguuugucccugaugagcucgguaucacuaaucuuuaauuucuguggccucgcucuccagaucuguggcuccuaaaagauucugauguuuaacuguucacauguuuucaguuuuuucuguuugaauuuacuuuuacccuuuuccccuucugcccaggggaaaacacacucauccaccuuuaaaguguguuggauugguguauguauuauaagcauguacauauauacauauaaaaacacuuuuaagguccucugcuuuaaauguagguuaacuauuuaagaaaaucuaagugccaggcuuugugucuccuguuguaaccugcuggccagaucagaauacuaggcugaaaaccucuugaggugaaaacuguguuuauauguagcugauuaagaaacauaggauuugaggaguaucagguuuguuaacuguucgugaugaagaaaccuugggaaguugagcuauguauuuccauaugagucaauaggauaauaugguugcuaagagcuaguuacucuugauaaugucuaaagaaauacaaugugagcuggucuaagauguaggcccacuguagucuaugucugucauugugacuggagcacuguauucaauuuugguugugauuuuuuuuuuugguaaggggcauuaauguuaaagugcuuuaugaaauaaaagucauuuuauagguuagauauuaaaagauggaggcuguguucugugcagcaguuguggaaacuagcaauguucagcgcaaaagguaguaaguggguuaucuguaauuaaauguuugaaaauuauagcagacaagaagaaauaaaaggugguaguugacaaggcagcacuuuugguuuaaaaugaaaaacuuuggaacgaguagaauuguccaacaguuagacaggcuaccucucaaggaguuuacagggaagcacuuuugguuuaaaaugaaaaacuugggaaugaguagaauugucccaacaguuagacaggcuaccucucaaggaagugagccucuccacuagagguacucagcagaaguuagaggacuaguuagacugcaagccccuggagaacauggacagaauuugcccaucuucaguacuuauuuaauucaaauuuugggaggaaauugauugagcaaacauuugugcaucuauuagcauguagaugcuguacuguauugaaugaaauugugcuagauaugagauacucucuaagguaacuauuuccaaucucagauuugguuaaauaaaagauaagaauuuugucaguaagaacauguuuaaaaaauuuaaacccuguuaaccucaaaggacauuuauauuuugcaaauauuucuaaauaguaaacugcuauaaauagugacauaaucugcuguuucuuuucucccccccuucuuuuauuuuucaguacguagaaaacaggaccaagagcagggagcauggcauugcaaugcgaaagaaacuuuuuaauccuccagaggaauccgaaaaauaaauuguauuuucacucgaugccuuggcugagagaagaccuaaagacucuggguugauaccugaaagaauccugucuuauuuggucuccauaauccuuugaauggaaagugaccugugagagauugaaccauggagaaauaugaaaacccuggauucugaguauuuguugggcagggcguuuaguacugucuccccuuuaccagcaaaccugacuucaccauguuuauucccuuugccuacaaccaguuaauaucugaguaacuuaucuccuucaauaaaauaauuuaaauaa

SEQ ID NO: 192946 - RNA, 79973 nt, Homo sapiens
cuccccgcgccccgcggcgcgcggccagugcgcaggcgcggcggccgaugcgaguguguaugugcgggcgagaagauggcggcggcgggggaagcagcgugagcagccggaggaucgcggagucccaaugaaacgggcagccauggcccuccacagcccgcagguagccgccggucugcgccuucggccggaaggggcccgagccccgggcgggcggacgccgcggcgggcgggcguccgcgcccugcccggagcgagcgugugggagugggggagggcgcugggacacgcugcccgggccuaggccggagccacccgccgccuccgcgcccgccgcgccuucguccccugagccacccggacccccuagucccggggaggucgaagggcgggggcuccgggccccgcuuggggagggcguggagggcgccgaagggguuaaccucccuggggcuggaccgcggggcgagcccgggguguggaguggggcccuccccgccgcgccggccgggggaggcggcccgggggcuccgggaguccccuggagcgcaggggccccagagcagcucagguugcugccucugccuggagcgagccucagagauuugggggugcccuguugccccuuugccccaagagcuuccuuucucagcuugauugaugaugcggggguugccgauuuucuguuuuuuagauagaaguagcagaguagcggccuugggcugcuguugcaaagaaaacucgaaauaagucgcaaggaccguacuuucacuugcguuugagugacaucccuugcacgaauccaucccagccaggcugacaacuaacgcacccugccugaacaguagcuaaagcuugggggcccuuuacaauaaucccgugguggaaagaaagagcucuuuuugggagaugugcguguagaguuaagcucuuauuccccucucccaccccuucucucacaucuucuccccccuccgccauuauaauuauucuggacaaaaaucggcaugauguauuauuugucagccuugcuuuagacugcuaauuuguugacaucuggucccuauaaauuguugcacacuuuuaaaccaucucauuguguauuuguauuaaauauggggaaaugaaacaaaguagccauucgggaaacugauugcgaguaaaaucauaacccuucaugagcaauuggguuuuguugcccuucugcagaugaagucaaucugacuacaccucuuuugaaacaugauuuucggaacuauuguaaugaaugcguguuguggaaucuaaaaugcgaaaacuuuuuaaaaaauuagaucuuacgacaagcuucaauuuuguuaaauuagcuguaguuuaguuugcaucagaauuucccccuuuaacguuuuguucccuuauucauuuacuuuuguaaguaguguaggucuuugcgccaaaaaagggaucaguaguugaauaauuuuuacaaauguauagcccaaagauuuuaagagauuugguguauuuagcuuuguuuagaccuuucuguuaaaaaaaaagauuugauauuugcuuuuuucucaacuuaaauccuaauuaacuagcuuauuagaauugguaugaacaaguaaaaggcucauuaugaauuaauguguaauauuccuugugauuuugacaugaagaaagcaucuuuaggcauagcucacuuccuuuauuuaauaagcaucaaucacaauucaagguugauugaaauguuaauuaauggggauggauaauauguaaacuuaauuguaauuucguuugcauucauugucccaguauuuacguuuuauacaacagucuaaagcguuauacacaucuuuagaaaauuggaguagcaaaaguuggcggaacguaaauguuagcaacacuuuggguuuauucuuuuaaaguaugauuuaaaugcuuuuaaguuuuagcauggagaaaguagcaaaggaaauaguuugauuucucauaauuuucuucuucuuuuuuuuuuuuuuuuugaguuggaauuuggcucuuguugcccaggcuggagugcugugguuauuaaccuauaaacuuuuuuauuuauuuugagauggaguuucgcucuuuuuuuuuuuuuuuuuuuuuuuuuuuugagacgggagucuugcucugucgcccaggcuggagugcaguggcaugaucucggcccacugcaaccucugccucccggguucaagcgauucuccugccucagccucccaaguagcugggauuacaggcgcccaccaccaugccuggcuaauuuuuuguauuuuuauuaaagacggguuucaccauguugaucaggcuggucucaaacuccugagcucaggugauccacccgccucggccucucaaagugcugggauuauaggcgugagccacuacugcgccuggccgauuucucauaauuuucauuuuaaaagaauaguaaugcaaacaaguaauggaaucauguaugacaggauuuaguuacugguuccugcuccagucauucugagcguuuuaauaaauuuguuuuacuugguugccuacuguccuaagagucuugcagccuuaauggccauucauucauucagcaaauacugauuguuuaucagauauuaagcgucaugguauguauauuacuuguuuauguugggaauaacaacugcaaauugaaggucuuauuuuaaaauugacuuguuaaaguuaaauuugucacugagaauaaugggagguggaaaaaguuacaguuuaaaaauguuuacaggccagcgcgguggcucgugccuguaaucccagcacuuugggaggcgcagguggguggaucacuugaggucagggguucgagaucagccugaccaauauagugagacccugucucuacuaaaaauacaaaaauuagccgaguguggugaagcucgccuguagucccagguacuugggaggcugaggcaggagaaucgcuugaacccgggaggcggagguugcagugagccgagaucaugccacugcacuccagccugggcgacagagcaagacucccgucucaaaaaaaaaaaaaaaaaaaagagcgaaacuccaucucaaaauaaauaaaaaaguuuauagguuaauaaccuuauuuccaaauauuagaaaguguugguugaucccuguuaccuguauugaaguguaauagugaagaauuuggaaacauuuugagaccgguaacucagcauuuuagcaaagacaaauaaaugaacuuuaacaguugaaguguagguccaagugaauauccuugucacugaggggaccgguuaaauuauuugggguaauuaauuugaagcuauuaguuuugccuuacaccgaaaaaauauuugugauuauugaugucauuuauagugaaaucuccacaauaaugcuuccuacacccaauuugaaugucaugcaguuggcuucuguccuugucucugcauagacucaccccagucucuuuuuuagcuuguaauagcagauccuccacauuuuacaugauggaaagucuuggauucccccucuagcauauggcugaauguuacuguauugcugaauaucuguuucuagccaacagcuggauuaguguuaauucuuaaaagagauacauuuuuauuagaaucucaaguaaugagcagcugaaguaaauacaauuguuugaaauguugacagggcauuuggagauaacaguuuuccuuugcauagugacagcaagcuauuuaaacauguccuaagaguagauguuuuaaguuugugagccaguggucaccuuagugguuuguacagauggccugagaaguuugugagccaguggucgccuuagugguuuguacagauggccugagcagccgcgccguaccaggaccucaccaucaugcucuugagcccaucucauugagagcacagcgcacugaaauuccagugaauacuaagcgggccuaccacauucuaaauuccucacuaaagcaaaaguuaggacauguauuccaguguucuguuacguggaacugauaggauuuaagcagugauucacauaggaaaacuuaaaggagaaaaggauuacgaagcuuaaugauugcuguuuaaugccaagccuaagcggcacguugcacugugcugugcucagaauauaacauucaaguaauugagaaaagugguaucaucuccaauugaauuaguuacaucaggguuuuuguuucgguuuuuuguuuguuuguuuguuuuuaaagauauaauuucagacauguagguacuuccuguuaaugguuccugguauucagguggcacauuaaacgugguugcugaggacacuuauuacugguacuauaccaaaauaugaaacguagugggaagagcuugcuuuugaauuuguaauuaggcuguuacuuuucuauuuacugccacacaugcaagaaucaccaucgcacaaaacagauaaaucuguuugcaauggaauuugcuggccuugggccauuggauuacugucauuugucacuuuagugccacuucagcaguguagauguucauuuccagagacuuguaugugcuuggacugcaguuuuccuguuuauugaaguguucucccaaaaggucuuucuuugaccauuucugucaauacaggcuggaugaagaauuaguguaggaaaauaaagguagcccuugggguauguguauaguauuuguuucaaggaucagaaaauguagaauuuaucauaaaccucgauguagaaucuucagauccuagauuuuuucugaacuggcuauuuucuggcuauuugaaagcuccugggccaugaucccauuuucaucagaugacuugagaacccagaagcucuaccagcacugccauucugucccgucuugaaacaucaugcccugguugcccucuccuggaauagggcagguaagguguugagauagaaaugugguuuggggcuguuacagccugaauuccucgacuuucccuuuugggcucacaugagaauuguuaggagaaugugcauguggagugcgggcccagcaccugcuaccgucugcgcuguaaugguggcugcuccuaagaguccucagucuccuccccguugggcuuguguguacagccuuaucgguugucauucuucggauccauucucaguuuauuuuucugguauuagcuggagggacaucuccuuaagccuguacucuauggcucaggagucucaaaaccaguccauuuugaagugagaguaucccuaauaaaaaggugaguguccccacuccugugccuuguuuuuuuuguuuguuuuuuuuuuugagacggagucucgcucugucgcccaggcuggagugcauuggcgguaucuugucucacugcaacuucugccucccggguucaagugauucuccugccucagccuccugaguagcugggacuacaggcacccgccaccaugcccagcuaauuguuuguauuuuuaguagagacuggguuucaccauguuagccaggauggucuccaucuccugaccucacgauccgcccaccucggccucccaaagugcugggauuauaggcgugagccaccacacccagccacuccugugccuuuugaaccugauuuuuacaucuagcugacuccucccuccgucccuuucccucuuucuuucuuccugaucugauggugcuagauuuuuguuuucccauuugucuuuguuuuaugaagaugugcuccuuuccauuuguguauguugaguacagacauaaucaugcccuugcuugcuuuuuuuuuuuuuuuuuuuuuuuugagacagucuugcucuguugcccaggcuggaaugcaguggugcgaucuggguucacugcagccucuaccucccagauucaagcgauucuccugccucagucucucaaguagcugggauuacaggugccugcuaccacgcccagcuaauuuuuuuguauuuuuaguagaaacgggguuucaccauguuagucaggcugguguggaacuccucaccucaggugauccaccuaccuuggccucccaaagugcugggauuacaggcaugagccacugcccccagcaucccuacucauucuuugaaaaaaacaauuuguuguuguuuuguagagacagggauuugcuguguuucccaggcuggucuugaacuccuggccucaagggaucccuucugcuucagcuuccuaaaguacugggauuacaggugugagccaccgcgccuagccucccuauucauucugcaaguaucagucuuuuuacuuuugauaggacauguugaaguuuugguuaaaaauagaagaggauuugaaaaugaaguucaauucuagagguuuucgagauuccugcccaauauaaaaaacuucugauacauuaaaacaauuuuuuuauacuucauuuuuuagagcaguuuuagguucacagcaaaauugagagaaaaguacaaagaguuccuauauaccccuucucuugguauuuuaaguaauaauuucccuuacguggcugcaaagacuauauauauauuuauauguauuuauuuguauauguauuuauauuuauuuauauuuuuauauuuauauauauuuuuauauauauauauuuuuugagacgaagucuuccucugucacccaggcuggagugcaguggcgcaaucucggcucacugcaagcuccgccucccggguucacgccauucuccugccucagccuccggaguagcugggaauacaggugugcgccaccacgcccagcuaauuuuuuguauuuuuaguagagacgggguuucacgguguuagccaggauggucuccaucuccugaccucgggaucugcccaccucggccucccagagugcugggauuacaggcgugagccaccgcgccgggccaagacuauauauauauuuauucaagaccugaaguaggcuuucuggguagaucugaucauuggagaaggagaaacauauuuauuacgagauacuaagcauuguaguagucaucauuugaagccuauaaacucuauaaacugcauaguuuagaaagugccuuagcuuguuugagccuuuacagcaacucuguccuguauuauuauaaccauuuuacagaugaguaagauaagacccagagagguuguggcuugaggucaaauggcugcuggccaucaggaccuuuuaaaagcagguguuuugacuucuaaauccuuugcuuuuucuacuuugccagacugguuuucuggaagagacugaugaaggcauaaucuuucacacugugacuuccccuuaguaguuccuccauaaacauuuacagaaugaaugaaugaaaugugcauuuagaaacuuuaauguuacuaauuacaaaauuuguuacuauaauauguuacuauucacuaaaguuugugugggguacauuuuaauaaagucguuuauuuuauuuucuaguauaaagacaugcuauuuuuaagacacgaaaacagcacagacguauuuaaagugaaaaguagaagucauucccuuccucucugauccuuaaucgucaguuuggugugugucuucuaugcuuuuuuccacuggaguauuuuguuguuguuguuccguuguuucauaauauggucuguuguaucuagucacugaacuuuauugagcaaaccuuguuuucaaaauuauugaaaacauccacugaagucaguuuucuuagguuuaccuaauuuugccagggaaugaagcagauauucuggagauugaagugacuuaucaggauccagugugcaggggauuguggaagugcugccacaacuuauaacauguuguccaaacaauuuuuuuuuuucuuaagaaauauuuugggccaggugcagugagugacucacgccuguaaucccagcacuuugggaggcugaggcaggcgaaucacucaagcucaggaguuugggaccagccugggcaacguagcaaaacucuuucucuacaaaaauacaaaaauucacugggcaugguggugcucuccuguagucccaccuacuugggagguugaggugggaggaucgcuugaaccugggagguggacauuguagugagucgagauugugccacugcacuucagcuugggugacagagcgagacucuuacgucaaaaaagaaaagauaagaaauauuuugaagacuuccacccccuuaguaguagucaugcuguccgguguucauaguguaaaaagaggucuggcugggcgugguggcucacgcguguaaucccagcacuuugggaggucgagguggguggaucaccugaggucaggaguuugagaccauccuggccaacaugguaaaaccucaucucugcuaaaaauacaaaaauuagccgagugugguggcgggcaccuuuaaucccagcugcuccgaaggcugaggcaggagaauagcuugaacccgugggggcagagguugcugugagacaagaucacgccacuucacuccagccuggacgaaagagugaaacuccaucucaaaaaacaaaaaaggaggucugauucacauucagauucuuguccauccauugccuuugcacuagauuuaugagaggacaaacuuuuuauuaguuggagauugguaagucaccugcccuagggaauaaugagaaacuggguaauucaccugaauuuuucuccaucuucuucaaaaucauguuuuugucuucugucacuuuguuucaucagaguacugcaauggcaaaaaacaaaacacuucccaacucaggucccacuccugagagauaaccacauuuaaguacuucugacuuguaauagaaugcaaaaucggggcuuccaagugugguuuacuauuuuguuuagaauuaauuuguagaauacuagacacuuuuuucagaaccacauaugaaggacuuuauaucuuuugugauuguucacagauuuugguggccggacguuaggaguauagagcugaagagagaauuccugugcuuuagagguucgcuggguagugagggagagaagcaggcuaauggcugggugcauccaguuuuagggugguaauuccuguaacacaagugugaacaacauagucaagaacauucauucauucguuuguucauucauucagcaaauaguuaccgaguggcugcuguguaccaggcacugaggagggagugaugagcgaaaacaggcauuguuucucucgcggaggaguuuauggguccauugaggaagacagcuugcuaaucagauaaucacaguuacguacacgucacuccaaacugagagauguuucccaaaggaagggaacacaaucugaagucagagaaccguucccguggaagugacguguuuacagcaugagacaguggggacagcaugugugguggaccuuuggcuggagggaauuuggagcacuuuggagaacucagcaaggaguugugugucuugggcacagagcuggaggggagggacagacgcaccauccaaccuugcagccuuuguuagauguuacugucuuuauucugagaaaaguguggaagagggggugguacaacauuugaccauggaaccucauaaucacauugccuuuugggaucauacucugcccagugaagaauagacucacggggucgcaguggccauaaggagaucauuuagggcaggguccuuggacuuuugacucggagggugccguggagguggagagaaguugcgugacucaggaguuagguauaagguguuucaaaaaaggaggagagugggacugaauguugggcaaagcugggaagacgucucuuguagaacggugacauuugagcuggaguuuuucaggcagagaagcacacggacaagggcauguggaggagacugugcagaggaacugucucaaagccugcagccuguuugggaaacagauaaauuuguggcugaaaugguguguagggugaagugguuagccgggagucuggagaggagagagaaagaauuugguaauccaagcucaggacugagugaaguugguagcaacucuguguuaagauagcugguugaggccgggugcgaggcucacgccuguaaucccagcacuuugggagaccgaaguagacggaucacuugagguaaggaguuugagaccagucuggccaacaugcugaaaccccaucucuacuaaaaauacaaaaauuagccgggcgugguggcgcaugucuguaaucccagcuacuugagaggcuuaggcaagagaaucgcuugaacccgggaggcagagguugcagugagccagacugugccacugcacucuagccugggcaacagagcagacuccaucucggaaaaaaaaaaaaaaaaaagauugcuggguugaguugauugugcaggggucuuacuuagaugcuucgaaaguugucagggauuugauucuuuaggcucuccuccauagcugggacucuacucucugcucauuuuggcaucuuaagccucauaacuuugaggggaaagaaguagggcauuucuuuuggggacuuuugagacagauuaaugugaggcagguagcccuucaguguccucagugguaauuggauagaguaguuagggaaggucauuuagggacauauucccuuuauuuugagggggaggcaccuuuaaaaacaagcaucugucccuugauuauauucguagaaaauauuaaggaaaacuuaggugacuuguuaccuuauuuuaaauguuuccuguaguacuuuugguaguaaacuuuagaaauuuggaaucauuggauuuaacagcguuuuuagguuugugauccucgagugcccucuucuaauaccagaaucaccuggcacccugggugccaccaagagacacugaguaaggaucccugugagcagguccccaggccgucugagccaggcucagguugcaggucguccgcauggguuuguguacagcuuuuuuuguuuuaacuuguugagcccuuucgcaugaauagcaauaacgaaaucguauuuuggacaaaguguuacaucuccagucuagguuaggcgugaacaacaacaaaaauaugaauugugccccucccucugagugugauacucacuuauuuuagcgccgaguggaaugguggaacaguugugagcagaugagaaaccugacauuuugccacuuugaagagcugucaugucgugucuucagaacgagauuucaguuuggcuuggcauucauuaaguccaugauuaugccuuuuaagcaagcauuuacccaguacuugcucugugccagggcccguguugggauuuauaaguugcaaaaaaacauguuuuuaaaaauguaaguacacauguguuccccagaaccuuaagagcugcucuggcuguugcucugcaccccacaucuugaaauaggaccuuuguggacagcaugggaucagcacacucccccacagcucaguguaacugugagcaucugaugucccagagaacuggaacuuuauaauucauccugaagccugguugucaacaucucugaggaugugugcauagcauuaagccaauuuaccaucgggaauuccugcucucuuuugcuguuguugcucauggauucgucaggugaggaaauucuagucucuaguuuuucccaaacuggugcugaaauaauuacgcuugguucucuguugcuucuuaccucuuugcucuucugugccacaacaauguauucuaaguuaggugccagcagcagaaacuuuucuuccaccuauaacuagaguuuuaggcgugaggaagggcuagcuuuuuuuuuuuuuuuuuuuuuugucugagauggagucuuguucugucacccaggcaguggcaagaucucagcucacugcaaccucugccuccggggcucaagugauucucuggccucagccuccugaguagcugggauuacaggugcgugccaccauggcuggcuaauuuuuguauuuuuagcagagacgggguuucaccauguuggccaggcuggucuugaacucuugaccugaagugauccgccugccucagccucccaauguacugggguuacaggcaugagccaccgcgcccgguggcuuuugcuuuuuaagguggacagaaacaccuugcagcugugcuucguugcccuugcugcuuuuggguggaaacauagacuuaaguuagcauauucaucaguugaucucuuuucugugagaagggaaagaaaucgcaguauuuuguguguauggcaggcuuugagggcccuuauacuuugauucuguagaugcccuguccuuccucaggaggcagucagcuguguacagaggcccuugugguccuguccugagaguagcggaaggaagacauggcucugccuggggagacugugccuuaugcagaggccaacaccacauggaugagccggaagcagccgcuggccuggcugcucuuucgggucaggaaggcuuucuugagucugguauggucuggcugccccaguguccccacugccuagcacagugggcacucagguguuugucuguuggaucgguuaauuggcagggaccaguugaagcaaacagagaacagcugguugucauucacuguuuucaggacugcuuaugguuguuuuugguguuucuauaauaguucuaggcaugaaguucaggaccacagcaugcaagaccccgaggggcagauuugccgucuauagaaauaguaaugagagcugaugaagaagagguggcugcuucccacaguaucaccuugauugucauuucugcauuuagaaugcaugagugaccccuaagcugcucuucagguucuucagugcucucuuuaccucuguuguguaguuucuugaauccaggugacugacccgcacgucacauauaaguuauuugguuuuauuccuuggucucuuucucagcaaguguagucuggagaugauaggacacuuagcaaugcagagagaaugccuucaccagaguuaccagcaagugcuuggcugugggggcuccguguacuaaagcucuuccaggauuguuagugggcaugccagugaucuaucuucgcaggccugcuuacagcaaaugcagcugucccccaaaugcaagaaccauggagcagccagccuuuccaguacagggcccaauuaugugucaccagugaacauggaaagagcuuuucgguugguuugccacaguuaguuuaucuuucccccaccuuugugaccuuagauaucucagccaaugccaccauucacccacuaguuauuuauugaacucagcuaugugccaggcauuguugguacagaaauggaggggaacacauugucuguccccgagacccucugucuguagacaggcucgcccccuuugucccugugguuugcuccccuacuuucagugagucucugugccugggccaucuucuuacacccacuuuacccaccuuuaaaauugcgcccuccuucacacuugucacccugucugcuugcucccucuccagagcacuucacaccuaauacccuacauacccgcuauccugacgugugugucugguucacucucucguccucccccaauguaagcuccuugaggccccaauguaagcuccgugagggcagggguuuuuguuugcuuuguucacugcuggggccccuaguccuagaauguggugagugcucaguaaauauuuauuaacaaacaccuucaugaaagacauaccacaguggacauauucagaagcccacagucaggugugggaaagaagcuagagaaucaacuguuaggauccagaauuagagagaccaucacaggagaguccccggggacaccuuggcucauguuugugaggaaaauaguucacaaagaugagccuuuggaacugaguucuauaguuugcagagucagccaggccagcagggucccaagagaagggcgcccaaagcagaaagaccuggcgugugccgugucgcugaagugcauuugggacguggagaguugucggggcugcagcacuggggguuggcugggaagguggaugggugcgucuuguaggcucugcuagagccuuuuagccugaaaaguucugggagacuagaaaggcuuuuccugggcaccagaauaguaagguucaguugagagacagcucugugguggccacaugcaguuuggagggugaggggugagcacagaggcggagguagauuguugcagagacccaguugagaagcguggagggcuugaacagugccuagaggaggggcaggccuuaggguggcgggagguggguggcuggcgggagccagcucguugugguuuguucaugguauaguaguuucuuccuuaaaauguggaaugacacuuguuuaguaaaauguuuuucccacuucuuccucuuuuuuagagauggggucuggcucuggcauccaggcuggagugaguggcacaaucguagcucacucccugcaccaucuaacuccuaggcuuaggccauccucccucuuuagccucccaaaaugcuggggcuacagacgugcgccaccgugcacggcuuugcauuucuuauauuguugaauguuuuuccauuaaauauuuuccuuugcgauuguuuuuuuuuuuagaucucaagagccuuaacuuaaucuucagcauuguuuuuuaaggacugcagcguauucacaaguuauaguuuaugcauacuaaaaaugguaauguuuggcagguuuuuuugguccaauuuuuaguuguuacuugugaauuuaucuuauuuccuagagcaaauuaagcacauuauuguaaacuggaagaugaacguccuuaauucauugauuauuuuuggggugaagggagagagauauuuugcuaagggauauuaagaagauacuuaguggauauuuaaaacaugaauuuuuuuaaauuuuaaaaguaauaucaaaaacaaguucuacauaugaaauguuugaaaaauauuuaaaaaguucugauuauuauuauuauuauuauuauuuuuuuuuuuugagauggagucuugcucugucgcccaggcuggagugcaguucgcagucucggcucacugcaaccucugccucuugugcuaaagcgauucuccugccucagccuccugaguagcugggacuacaggcaugcaccaccaugccuagcuacuuuuuauauuuuuuaguagagaugggguuucaccauauuggccggucuggucucgaccuccugaccucaagugaucugcccgccuaggccucccaaagugcuuggauuacaggcgugaggcaccacucccggcccauuuauaaaauaucaauaagcugacuuauguuuggugaaggccaacuauuucagcuauugcuguagauauccaggaagauaaccaaagcauccuuaccuuuguguauaauggauagcuaaggcauaagaaacaacugggcacguuacaagauguguaauuaagugcugaauuauguggugcauguggcagguucuuuuguaguaauucagagaaugaagauggguaaugagcuagucuugagaaggaauaggaucuccgccucccaaagugcugggauuacaggcaugagccagugaguccaccugggugaccuuacuacuuuauaugaauccucuggucacugcugcccaacuauccuuuuaucucccuuuuugcuuaccccauuuauguguuagggugcccucccuuuuuuuuuuaaaaaaacaaacaaguagagcucagcuuucuaacuggcuuacaccauaaacuagagauuuaguggcucauguaacuagaaauuccagagguagaucaggcuucaaaguugguuuaauucagccguuuaguuacaguuuugaggacguggcuucuuuucauuuuuucacuuuucauuucuucaucuuuucauucugccugucaguauuaucccagggcuaguuucccccacgauggcggaauggccacagcaguuucaggcuucacauuugggcacagccuccgucacaccagccugaccaagagagugagugugcaucccagaauuuuaggcaguguccugagcuucuugcccuuugggucgucccucaaccagagcacuguggcgaggagggugguaugccaagcagggcucccaucuggccuggggguggggguguguugacuucugaacugggugacuacuaucccacaggguaggaaggggagcuggccaguucgcuacugucccacaugagcguaaugucucuccccccucuccuuuuccagauaugccaguuccuccuggacuccucagacuggaagauuguccuuucuccuuggcaaaucaucuguacuaucugauugcaucuuacagucuucuuuaaauauuauuguuccuuaacuguuaaugugucugugccuugaggucagccucagguuccaauccuguuccauuuuguuuguggaaucucaggcaagguugguuucucugaacuuuuaaaguuuuuucaucuucauucagcaaaucuuuauuagauucucaguauugugcuucaguggacgaaauacagacugacacaaggagauaacaguucauucacagagacauagguaaaugagaauuacuaugaaauaugaacagugcuuuggcagaaauaggguuuagaaacacuuccugaggaggugaugccugcguugagcuuugaaggacaaguaggacuucuucagagcaugggggaagagggagcugccugcacgaaggcugaucagcagaauaaugaauaaaugcagaguuacugggaucuuaggugcacgaccuucggcaagguugguaggcagagacgcccauuacaccaaguugaagagugaagauucuaccuuuauauacaccuuacaauuacauggggagugaccgcauguccuggucuaaacuuaucccagcauaauucaucauaaugauccuuucacucugagauaugccucuaauuuggaugauaaaugguuacgcaacuuaaaauagaaguccagagccauagggacagucacugugauagcagugugcuugcuucauaguagagcuucgggauuacaugagauagagcauagcagugcuucucaaacuuaaaaguccguugagaaucagcugcgggucuugugaaugugcacauuuagauucaguacaccuggggugggcccugugcgcugucugagcuccuagguaauuccuaggcugcuggccuggugaccucacuuugaguagcaggucguauugggcuucgggagcuucagagggucugugaaguucugaaaucauacgcagaaauguguguacaugcauucuuuagggggugggccuaauucccuuacaucaguuucucgggaggucugcugccacccaaaaaagauuaggaauccucccuuuuagaaauuuugugcagauuaaaugaaauauguugauuaaaugccuuuaacauugucuagagcauaauggacauucaguacacacuagcuguauguccuccuucccugaccccaguucuuugaaggcaggacacauugcuuaaacauuuuaaacugcuuuuuaauguccuuuuuaugucauuggugcucaauaagugucgauuuagcuuggugacaagcuguuuggugacugugagccauucugucagcauuugcuagucucuuaggugccaagcauuuuacuagguagguaggaggaggccacuaccuagguuauugcagauacccaggcauagguggagucaucagggccugugcuggauaguaacuguagaguugaagaggagaugcaucacuucuuaguaaucuuccugaguuauguguguucaggaaagugcuucuacugccuuugauucauugagguccuagucucugguccucagguguaugugauuucaguacggauuaauuuacuguaaugcuuaauuuaauucauucaguugcuauucuugccaaaugcaguuuuucugaacauuuugauauuuuguugagauggucccagaaauuugggauucgugaucacguuaggguauuugugauggaaaggguauauaauuuaugguauuuucaaaguuccuuaccuaagagauuggaagaacaaugaugagagagagauugggagauuacuugucuuauagaguuguagaugcuucagagaacuugacuacauugcgaagggaaaaucuuggauuggaagguuauuuuugagaaaguggaguguugguagugaaaguuagauuucagugaauuaaaagcaaaugagagaugaguuuaauuacaaaagaaaugucuuuuguucagaagacauuucugaagaguugcuugugaguucauuuauuuuauugagacaggauuguacucugugacccaagauagagugcaguggugcaaucauggcucacugcagccucaaaguuauuggcucaagggauccucccaccucagccuccugaggagcugggacugcaagugugggccacuguguuuggcaggaguuuaauuuuucugucauauuacuucuaauuuaguugcauuauaguuuuucuucuggccgggugcgguggcucacgccuguaaucccagcacuuugggaggccaaggcggguggaucaccugucaggaguucaagaccauccuggccaacaugguaaaacccugucccuacugaaaauacaaaaauuagcccagacaucguggcacaugccuguaauaccagcuacucggaggcugaggcaggagaauugcuugaacccaggagucggagguugcagugaacugagauugcgccacugcacuccagguugggcaacagagcaagacugucugacaaaaaaacaaaaaaaaaguuuuucuucuuuuaguuuuguuguuguuguuguuuuugagaaggagucuuucucugucacccaggcuggagugcaguggugcagucucagcucacugcaaccuccaccuccuggguucaagcgauucuccugccuuagccucccgaguagcugagauuacaggcgcccgccaccgcacccagcuaauuuucguauuuuaguagagacaggguuucacuauguaggucaagcuggucucgaacuccugaccucaaaugauccacccgucucggccucccaaagugcugggauuacaggcaugagccaccgcgcccggccaguuuaguuguuguuguuguuguuguuuuugccuuuauuaacuuguuaaugaucaguaaacccuuaaaagcacuaaaagaguucccauuuuaaagacaucuggauguuguucaucaacuuuauauagugaguaauuaucucaaauuauuuuauaauuucuuuuuuaacugggaggcauaacugaauggagaaguagcuccccucauccuccuguuuucugcuuaguuucucccaccuccucaguugccuguagugauggagcuuuuacuuggaucacgggaaugccccuacacagugauucuaaacuccaacuguaagucagaaucacacaggaaguguuuaaaaugcuaaaugaggccuggacuccacccuagaccacugaagccagaauuguugcagguguggccugaggaugcucugauucuaagguguggccagguucgaggacuguugucuuaggccuuuguccaauaugguuuaugcugcuccccugcuaggugaguaccaccgcggauugguuaccugcuuuuauguggaaaauagaauauaggaagccgauuggguggaaaacaucucuucuaguguauguaggucccauaagggggacuuugaagucuggaguuaacaguuuucuaauaaaagauuucagaccauauccaggaacuuaaauacauaauuaaagaguggaaugcaaauuauuaggauuuuugcugguaaagcaagcuauacuugcauaauuuaaaucuuuggagggcauguuucgacagaucauuaggugaagguuaaacugagacagcaaacaguggauuccuuccuuagcuaguauaccacuuuuugcauucuuuuauuuucaacagauaguaauuuugcagcuuuuuacuucuucaaccaaaccuucuaaguaacuuugcuuuccauuaacaacaaagccgcucauuaagguggaaguucugugcuugaucuuaacaccggaaggagaggagucuauuuaccagcuaauguaaguacuucuuauuagacaguccuagauuuucuaggagauuugaagagucugcugacaguggccagcaaaucagaggaaaaucauuucuguagcuagguucuuuuuucauggauguccuuuaagaggaagcucugccguggcgaugugcguuccuuccuggcggguggccuccaguagcuggccuucuguugguccgguuccagcguauuuuauuaagugaaaaauccuguagaacagauggcacuuacaaguuucugcccauguagcacucuguuuaaugaaauacuauaguuuugcuucauuguuuuuggcaguaauugucuuuguguggaguuugaguacaugguccgagaagcucggcaguaauaaagguugagccaggcaagaauaaucugaagugacugaguaaugaugggacagaggcuucagaguggugcacaguuaaauugaaaacagaugcagaauaaaaagaugaugcccaauuuuuuuuuuuuuuuuuuuuuuugagauggagccucgcuguguugcccaggcuggagugcaguggugcgaucuugccuuacugcaagcuccaccuccuggguucacgccauucuccugccucagccuccugaguaguuaggacuacaggugcccgccaccacacccagcuaauuuuuuguauuuuuuaauagagacgggguuucaccguauuagcggggauggucucgaucuccugaccucaugaucugcccaccucgacgucgcaaagugcugggauuacaguccugggccaccgcgcccggccaaugaugcacaauuuuuuuuuuuuuuuuuugggaaggagucucgcucuuuugcccaggcuggagugcaguggcgcgaucucagcucacggcaaccuccgccugccguauucaagcuauuuuccugccucagccucucgaguagccgggaguacaggugcccgccaccaugccugacuaauuuuuguauuuuuaguaaagacgggguuucaccacuggccaggcuggucuugaacuccugaccucaggugauccaccugccugggccucccaaagugcugggauuacaggugugagccaccaugcccggcaaugaugcagaauuuuuaagaugauguuguguagcacugggaggucuuuggaccaaggaaugugaaacuaaaaaucccagaguguggaugccuacaaauaggguguacugaagaauucuucuuccguagaugagagauuaacaaauagagcguacugaggaauuauucuucuguaaaugaaagauuacaacuguggccauuggucuucaagagcuuugauuaugguacugcuucaucugcuuuacauagauugugcauaacaauuuuuaaaaagucaaccuuauugaaguauaauuuaauacaauaaauguacccauuuuaaguuugcaguucgagguuuuuugucuuuguuuuucagacgaggucuugcucugucucccaggcuggagugcaguggugugaucauagcucacugcagccuugaccuccuggguucaagccauccuccugccucagcccucccaaguaacugggacuacaggcaugugccaccaagucuggcuuuguuuuguuuuguuuuguuuuagagauugagucuugcucuguugccaggcuggagugcaguggcgcgaucacagcucacugcaaccuccgccucccggguucaagcaauucuccugccucagccucucgaguagcugggacuacaggcacacgccgccacaccuggcuaauuuuuuguguuuucauagagacaggguuucaccguguugccuaggcugaucuugaacuccucucaagugauccucucaccuuggccucccaaagugcuggaauuacaggcugggagccaucacgcccagcccaguuugaguuuugacagauguauacaccaaaguaguaacuacuaccacacuccauauauagaacauuuccauugcucagagaguuucuucaugccccuuugccaugaauccccaccuuguccaggcagcuaguggucugcuucugucacuauaggcuaagaaaguuugccuuuucuagaauuacauuggcccagaauuacacaaacuguacucuuuuguuugguuaccuucaccugacccaacuauuuagauuuagccauguugaguguugaguuccagccuuuucaguacuggguaguauuccuuuguggaugucccacaguuugcuugucucuuuccucuugauagacauuuuuguuguucccacuguuugaaucugcuguucacauucauguacaagugucuguguggacauagguuuucauuucuuguggguaaaaugugguaagcguauauucuauucuguaagaaacugcaaggcuuuuucaaagcggccaugccguuuucuaucugcaccagcaguguaugagaaugcuucuucucuguccucaccaacauuugauauugucagucuucuuuuuuugagacagagucucacucugucucccaggcuggagugcaguggugugaucuuggcucacugaaaccuucaccucccagguuuaagcaguucuccugcuagccucccgaguagcugggauuacaggcagacucccccacgcccagcuaauuuuuguauuuuuaguagagauggaguuucaccauguuggccagucucgaacucccuaaccucaagugauuuguccgccucggccucccaaagugcugggauuacaggugugagccacugcguccggcucagucgucuuaauuuuauaguacaucaauuuaaaugauaauuuuuugucccuaggaacaugaguuccugucauugacagcaaagugaaacugaguacaaauaggugguucuuagugaaaugugcccagaaagacaguuugagcagaaaggagggaccaagaaauacaggaugcaugccugcuucacacuggaaaccgguggucuuauuugagggucaaagaugggggguggggaauaaagucgauuuuaaaaggauugaccggcuccgauaccuucugaucacauccaggguuuuuuuuuuuuuggccuuuuuucccccuuauacacuuaagauuuugaaaagugguuucucuuuagcuugggaaauggaucacaugguaauuguuaaugauuuuucuuuaggucaaaauagguguuccuuuaaaguguucugugaagcuuaauucacuuacguugaauaagucuuauauuuuaaaauauaaguuuaaguguuauacuuuaaaaauaaguguuauuucuugauuguauuuauuugaagauuauauuugagaaugaaagauguacuccuagcuggaacaucucuggugauaauaaaaacaugagaauaaaaaccauucagagugaucaaguuaagacugucagcccacugacgccugggaagucacaaugauugcuauguaguuuggagaaauuauuccuuauccuuagauaagcuuuuuauuuguguggguuuuuucaucuuccucuuccugaauucauuuguucaacaaagcuauuuugagcaccuacucuaugccaagucuacugcauuaacuucuggcuaaacaaagauggaucuaacucgauucuuguacuuuaaagaaaucagcuuuauggagguauaacguaugugcggugaauuucacccauuuaaaguguauauuuccaugaauuuuaacagauguauucauuuguguaaucaccuccacaaucaagacaccaguucugucauuccccagaaugacauugagcccccuugcagccucuucuuuuguucguccuuggccccagcaaagauagaacugcuucuguuacaguuucuuuuuuauugguuucaucuuccauuucuuuuuuucuuaaggucagcaccaaggugauuguaaugaauaugaaaguugguggaaucuugaacuucuacuagggcuaucccagauaaaguugacugaauuuacucccuaauuuaucugcuguguuucauacaauagcaauuuuacacaggaaguuauucaauaaugagggcuaucuauauuaccuugcuauuuaguacuaguuaagagcaaagcgaguuaaaauuuaauggccauuuuguaauacaguucuaauauagacacaggacuggaaaguugguaaaaguggguuucuguuaagugaaucauguuuucuaauuuggagauucaaucugaauucaaucuaaaauuucugaaggaaauuuuagcucggaaucuccaugaaagcacuuaauauacagccaaccuguuaaaaaccauacuuugagagguaaaaugauuacuuuuugauagcacuuuaauaguagaaauagaauauacaaacagggaaguagacacucaauugcaguacuuugacauuugaguuucaaggagagaggcugccugugagagugacuuugugauaguuugucuacuuuguucgcuucucaggaccucuuugccccaagaaaguaaagcaaaauuuugcuauagcccuauuagugagggaacaaaacuucucuuccuccuucuuccuuugucugcuucugccauuuguaacacuuaguucagcuugcaguuggcuugcacuguaauaaaacuguaaaugucaccaugcccugaccccuguguguguuguguucaaaguuuuacucucguagucucgcauaguugaguguggauuguugaugcucagugcauauuguuaaauuggcgaacuuccuggugugcauucacuaguugaugauagugucaucuccagauguccucagaaccacccacaccaccuucugaaguugaaagcacacaaugauuguucaguagauaucagcuagcacccauaacuuacugggcuuugauucauaaagccuaguaaagaaauuaaaauuuuuauuuugauauaaguacugaccuuuuuuaaaacuuuauugagauauaauucacaugcuguggaguuuguguauuugaauaaauaugcauuucagugguuuuuaguguauucacaaaguuuugcagcuaacaccguaguccauuuuagaacauuucaucauccccaaaagaaagcucauguucauuagcagucaccgccucccgcucccccauucuccucuccucccagcccuuggcaaccaugaucuuucugugucugguaauuugccuauucuuggcauuucauaugaauggaagaaacaauuuauggcucuuuguguguggcuuuaacuuaguauaauguuuucaaagucauccuguuguagcaugcauuagucugaugacauuuucuuuuucuuuuucucuuucuuuucuuuuuucuuuuuugagacggaguuuugcucuuguuacccgggcuggagugcaaauggcacgauuuccgcucacugcaaccucugccugcuggguucaagcaauucuccugccucagccuccugaguagcugagauuagaggcgccugccaccaugcccggcuaauuuuuuuuuguguuuuuaguagagacaggguuucaccauguuggcagucuguucucugacuccugaccucaggugauccacccgccucggccccccagagugcugggauuacaggugugagccaccgugcccggccugucugacgacauuuucaaacccguguuucuuaauccuuuuuagauccaagagauccuuuuggagaugggaagaauuuuagaaguugucugguccaacauaccuucauuuuguagaugagauuaaggcuuuaaucaugccaaacagucuauugcucuuuucauguuuccccaaauugagcuuauuuggaucaggagaagagggagaauacuuuauacuucucagcuucuuguguauuugacugugaccugguuauaccauuugccacugugaggcuuagcugugcaucugugaaugggagauuguucuuagagauuggucauaguuguccaccugccucggaaacugcagguacaaaugcagcagcaaaguauuuacauucuuacuucagggcugaucuccuauuucuaucaguccuuuugaaggcagagaauguuaauuuggaacaaccugcauauuuauucaaauuuccagagagaugaaacuuucagaaugcugugcugcagcgcccccuagugccgugcuguacugauaguccccagcgucuccugaagccgaaaguggcguuucccgcaguuccggcgggagagcuguagccagcagguugugcaagugaacauuagacaucuuuucuccuucucgccuuccuugggcugagauggaggaaugugucuuuauugcugagggcaaggucuuuguuuuuccuuuagcaggaacacugguuuucccacuucgucuaaaccuuugcccaggguuucucaacucaggcccccugagggccguaguggccuccacacaccuccagaagguaaacugagccagcuuagccaacaggcuaugcuucagggaggaaggugucuuuuguucccaucccugcuguggugugggcuugccccccuuuucucgaaguguuucuuguauauuuuuuuccacauccucuugagaaaggaucagaaaguaaagaugugaacagugagaguuuugaaagcccgggauggaggccggaugggauaugaggggaagugguggaggggaauaaauagcuucucuaguucacagucuuacuuccccuaaaaaggggaagaaaugccugaagcccuuguacuuugcucccccgaaucgcaggcauuucugugccgucccgccccugggcauuuccuaugcaaccacaggacgcgggaaaggagcguuuguuacugcuuucugauaccuccuuuugaccccaguguucugacucuggcagaguugcugaaaccuuagggggcuucccagucuuuccugaugguauuugguguagcugugggaagggcagaguuagccgcagcagugucacaguuucugugguguggcauggcugacagggccuccagguaccugcuuuuauuuuaaugacagccaccaauauguccuaagcucugcacuuucuuugaaauuacaagaaacgaugaacuuacucgugcuuuuuagucucccgugugaacugaauuguucuguauuuuaucuugcucuguuaugggcaaaacuaauucaugucaucaguggcauuucccucuucacuagguuguaaauccugugaagucagacacagcguuauuuucaucuuuauuuuacccaaacaccuacaauuuuccccccucaugugacagccuuugaaauaaguuaaucuuccagaggagagaaaacacuaaacagucaaacauaaggagaggguaaagguuuuccucauaaccucacaauuuucaguguuagcuuuaaaaaaacaaacaaacaaacaaacaaacaaacaaaaacucuuuauuugcaaauaguuugaaacuugaaaaguugcggaaagaaaaauaguacaaagaauccccagaugguccuuuacccagauccaccuguuguuaagauuaaauccauuugcuuaaucauuugugugugcuggaauucucugucugcaaauacacacucauacggauacacauacagacacacagacaugggcuaacaaaugcaaauauacagacauacaauauuuuuccaaacccuuugagauuucagggaagauuacauacacuguagccacuuaauccuaaauucuugaauguguauuuccuaagaauaggcauauucucuuaaauaaccacaguaauacguuaccacuuucacaaauuuacauugaugcaguacuuuuuucuaaccuguccauauucuaauuuugggaguugaccauauaauguccuuucuagaauuuucccuuccagcacaggauccagucuagggucaggaaauguauuuaguuaucaugucucuagcuuuuuguagucuggaaguuucccacagccuuucaggauauugacuuuuuugaacagcaguuucuccuccccucuuuugauaacauuccucauuuuaccaaacaccuaaaauaacauuugauuggaaguuaggaaggcuuuuggagaaggagauggugaaaccagaacauuuuaauagcaguuggcuguccugaauuucugugauaaacuuuuuggugucacaaacaugccuugcuucaacauuuagucagauaucauuuuaguuaaauaauugucacucacugguauuugcuauaaauauauugaauaaauugaauaaauaauugaaauauauugaauaaauauuuggccuuuuuuacuuuuuuuuuuucucgcuguugcccaggcuggaguucaguggugcgaucucggcucacugcaaccucugccuccccgguucaagcgauuccccugccucagccucccggguagcugggacuacaagcaugugccaccacgcccggcuaauuuuuguauuuuuaauagagacgggguuuagccaggauggucucaaucuccugaccucgugauccgccugccucggccucccaaagugcugggauuacaggcgugagccaccguguccggccuccuuuuguaguuuuaucaaaauuauaauuuauguccguccacucacugguauuugcuacugaauaaguauuuggccauuuucccuuuuuguaguuuuaucagcauaugcaaaaauuaccuuuuuuccucccaauaaaguugucauauucuguuuuauaagcagcaccucuucuuuuuucuuuuuuuugagacggagucuuccucugucauucaggcuggaguguaguggcaccaucuuggcucacugcagccuccgccuuccagguucacguaauucuucugcaucagccucccaaguagcugggauuacaggcacccaccaccaugccuggcuaauuuuuguauuuuuaguggagguggauuucaccauuuuggcugggcuggucuugaacuccugaagucaagugaucugcucgccucggcuucuggaagugacgagauuacaagcgugagccaccgugucuggccaagcaacacuuugucuuuuggaauaguguugauaauaaaugcuucuucauuguagugcuuugaaugaugcauaugauuuuguuaaauacaaaaaugaugucuuaaccuucacauuuguauggauuauuuuaucacaucauucauaauccauguuugaaugguuaccaugccagcuuacuuugccaagaaagaaauauuuaucguuuuucaaaaugugcauugcaauucuaagaaauuccguuuuauucuuaggauuccccuagcuugugauaucgaugacuugucuuuuacugacauuugauaguuaacuccccaaauagaggauuccuuuauaugugguuauuggguuguaucagaauuccugcuugaguauaaguuauauuuguauugacacauaggaaaaagauacauguaguuuaucugccaugagcauauggggaauacucauuguaugggagauggaaauucuaaucaaguuccccgggaggcugagcgccuugcagagaugcucuuaaacccuuggcacugacuucuuagcccguuccuuuauuucaguuauaaaaucgaaaggaccgguuuuaaauauugcugaaguguaacugcucacuuuuaaaagcucaugcauuuaaggauuaaaaugugauucacguguauuuugauggaguuguuuuuugagcuaugugagccaguguuaaggaaauuaaguuggaguucaaaacagccguggcuagugauuugucaaguguuaaaugauaguucaguguugcauagcugguaaucagcaguuacuuaugguguauuuuuuugcgugacauguuuucaucaaguccuaagcuguugucaaugagcucuugaaacuaacaugcuuaugaaauuaugucugugcaaaauggguguauuugaagaguuguaaggugauuucuguuguguuuacuuuuuaugauuaauguuuugaauaaaguauguaguccccucccaagaaaacccuccaaaaaacgugcuaggaaauccccuccacuccugucugcguccacucagcguccacucagugcuacugucccaaaggugaagggccacauuuuuucuuguugaucuuuccagugucucuuuaugcagacacaaauaucuauauuauuaacaaacacaaauauguuauuauauagcaacacagauacucuauuuuccuaccuuuuuuacaccgagagugcuuucuucuuuuaauaguauuuugaagaucucucgcugucuguaccuaaaguucuuccucauuuuccccuaguuaauucuguaauuugauugaagguacauaucuguggagaaauuauugacaugaaguuauaauaaaaacacgcuuaaaaucuauaacauuuucucagauacuuuaaaaauaauuaaguaaaacuaauaaauuugaaaauaauaggagaaaaaaaacucagugaaccguuucugagcguuccagcucaugacuugaggguguuugccgcugacucaugcugaagccacuuggugucugcguuugaaacaggaaguguguguuaguggcuuggaaucuuguuuucuccuccucuccuccucugcugccaagauuuuuaucaaaucauuuggauuuguaguguucuuacuggauugaccagcucuaaaaacuuuaggcuguauaugaacugaaauaagaaagugugcuuagaaguaugauuuaaauaaacauuuuuauuuuccauugucuaggaagaaaaccuuccuaaagaaaauaccugauaauccugcagaacauucugauuucuuauccuuagguaucuuccccacauucugaaguaaaaggccuuucuuguuagucauaagauaaaauggauaacuuuuaauauauagcauuucuaccuuuuuuuuuuuuuuuuuuuuuugacacggaaucucucucugucagcaggcuggagugcaguggcucauucucggcuugcugcaaccuccaccucccggguucaagcgauucuccugcaucagccuccugaguagcugggacuacaggugcaugccaccaugcccggcuaauuuuuuguauuuuuaguagagacgggguuucaccguguuagccaggauggucucgaucuucugaccucaugauccgcccaccucggccucccagagugcugggauuacaggugugagccaccgcucccggccucuacuuuuuuuuuuuuuuuaacugcucguugcagagcagggcuacgccauaggcaaugugcacagaguagccacguuucuacuauugauauuaaacaaaacagcaugauuuuaguuuauuuauucuuaauauuugcauuaaacuucacagcugccguguguuucuuguauuuuacuucuuuaucauucuuguauuucucgaauucauuuucuggaauucuuaagcaguuuccuuuccuccccccaagaaaaagguguaugugacagaaaguguucuuucucuuuugcacuugaaaaguaguuuauagaauucuaugaaaaaauacucuggcauucuaggaacaaaauccuuuuuucucgaaacuuucaaaauguugccccauugccuuccauagccuuguugauuuugcuauuaagacguucuguugaguuuuuuaauuuagugauuuaaaauuaguaauuaauuuccgcgaacacuuucaugaucucugauagcucuuuuuuuuuugugauagucugugcuaauuuuuucugcuuccuuuuagccuauagaauuuucccuuccauugcuuugaggguuucuuagugaaauucauaucaucuuuucccaguguuggugaugagaagaagguguaaccuucuauauucuucacugaaaagugacaguauuucagaagaucauuucugaaccauuuugaggcucuguuuauuuucacuguuacugucaauacauaauuucuuuguugacuuuugcaaguauauguaaauauuauaugaaaacuuuuuuguucuuaauguauauuuauaguuuugguagauguugucaaagagcucuccagaaacguuuucccugugcauucuuaccaggaggguauuacauuuaguggccauuuauucacauuuacaauaauaaugaguauuauucauuuauguaauauuuaguuacugguuauuuuugaaucacuuggcuuguaaauuucccuggaagcuacuagacuguuuaguuccauuagaacagaggaaccacacucugcuuaccauuuuuauacccaguacugaucauacgugggcauuuguagguucuaaauaauuauugauuaaaugaaugaaucauugcuucuccguuguggaaauugcuaauucuucucaaugacuucuucuucuucuuuuuuuuuuuuuucuuuuugagauggagucuggcucugucgccccggcuggggugcgguggcgcgaucucagcucacugcaaccucggccucccugguucaagcaauucuccuggcucagccucccgagcagccgggacuacagguacacgccaccacgccuggcuaauuuuuguauuuuuaguaaagauggggguuucaccauguuggccaggcuggucucgaauuccugaccuuaagugauucgcccaugucagccucccagagugcugggauuauaggcgugagcuacugcgccaggccucaaugacuuguuucuugaagcuccauggagaauaugaacugguaggcacuugccagacucacauccgugcaguuuaaccacuucguuuuccagaaaaucacauucugaauuccgugaaaucaggcuugcaacaagggcugugucugucugauaauauguguaucuguguauccuauggaaaugcauuuuuaaacuaagaaguuauauagauauuuuuaaagaucauuaaucaggaucauuaacauuuuccuuuuuuggauuuccuugucuucccauuugaaccacguuuucugcuuuucuuuaguauguuuggcagagaaagcggaaauggagguaguggcaugagucagcagaaagguaaauggaacaacuggcaguauuugugaaccaauaaaaaucuccugcaagcaggacucgacaaguuuggcauacaaaauugauuuguuucaaaauaagcuuuaucaguuucauaguguucuuugacaauuuguaggaaagguucaguaguauuucuuuuauauaaacaaccuagaacucugaguugcagauccucuguuuaauugagaaaggaucuuggggguuauggcccaaauguugcauaggauuguuaaaauauguagcauuuuuucugaaaguauauaauuuguauauuuuaugugaucagugacucucuuauuuuuuuucaguauauuuuuggagauuuuagcccugaugaauucaaucaauucuuugugacuccucgaucuucaguugagguaagacaaaacuuuguuuuagugaguccguggguagauacaauuaauaguuauguuucuauuuuaauuuguuuuuuuaaauaaagaauuccaauguagagaaaaguauggagacuaauaugagaaaugccucaacccaccaacuagauuugacugacauuugauuugacauuuugcuguauuuacuuuauuaggcuuugaaaagcaaauaaaacauuacagaugcaacugaagccuccuuuggaccucucucccaucucuccccagaaguaacuacucugcugaaauugggaaauauugguccugacugguuuucaccuuuuaucauauacguguauaucaccauagucaaucguaguguuuuaugugcuuuaaagugucacguaaaugguauacuauauucaguuugucguuuauuuuaagcuaacguuguauucuuuaugcuaagaaauuuguccuuguucuuugauuuccagugcucaguaccacugauugaacacacugcaauuuacuuacauauuuuccugucgagggccauuuaggucucuaguucagccguuaaaaauauugcacucaauguauuuuaucaugucuccuggugccccucugugggcuccuccgggacacagaccugggaauggaauuacuggguucuguggaccgagccucuuuaguuucacuagagacugcucguuugcuaucuaggauuuuaacagucuucauucccaucagcagugcaugggaguuuucuugcucguauuaaaaaaaaaaucuugcuaacucuugguguuggcauauuuaaaauuuugugaaucugauguguguaguaaauggacucucauuguuuuaauuuacaucucccagauuacaaacagcuggguacuauuucauucucuucacgucugcuggcaauacggauguccucugcugugaauuacuugguuuauaucccuuguccauauuuuuaaaucaaguagcuugucuuuuucuuacugauuuuaggauuaaucuuugguuuuacaggcaucuguuccuagcaugagggcuuuaagcuucacauguuaggugaacccuuuuugggguuggguuuuuuuguuguuguuguuggauaagaggaguacacuuucaacuuuaaugucaacugaauugauuuuuuuuuccuuauaguuuguggauuuuuaguuuuaaaaauaucuuuaggaaauucuucccauccuuuagauaacgaagauauuugucuguuuucuucuaaaaguuuucagauuuuguuuucacgcuucaguguguaauaagcugaaauugaggcacugaauuuuguauaugugugagguggcaucgaacucccugccccuguggcccuggcaggugccuccucaccauucauugggaacucggcccuuagcuguccugucagccccguugggcagugcaucuccccugguuccgagugugcuauucugugggccuauugcuuaucucuguauaaacaccacacguuuuauuuuauuuuuuuauuucuauuuuuucuuuucuuuucuuuuuuucgagacagggucucacucugcccaggcuggagugcagagugcaaucacaauucacugcaacuuugaccccccgccccgccucagggggguucucaugcuucagccccugaauagcugggauuacaggugugugcugccaggcccggguggugugugugugugugugugugugugugugugugugugugugguguguguguuuuuaaguaaggggauuuuguauuuuuucccacaucacacugauguaaccauacguuuuaguugcuacagguuuucucaaguguguacacauguggauggguggguaccuguuugcaagugaguagacaaaaacuugaguuuucaugugauaggaaagugaaaagugcaccguauuucaagucugaaggccuggggucgcuucaguucugccacuuccacaggcucggaggguuugggcacguucuuuccuuuugggccucccauuucuuuucucuuucuuuuguuuuuuaaauugaaaaaaugcagaaugcuuauucacgucacagaaauguugggaaaucagcuaauguaugguccgauaacuagugaguaacagauguuaguagaaauggaugaaaaggguacagaugguaaguuaugccaaaccuuuuauucacagaagacgugacugugucucaugaaaaugagcucaagcuucagaacucguagugugugugggcuuauuugggcuuuucuguuuuucuuauuuuuuaacauacggugaaguuuggagggguauaaaaagaguuuaucaaaaucacaguaaccugcaaaagggaaaugcaggcuaauuaacauaaucggauggaguuguuuuccccaaucuucaggaaucugaauuauaauagcacaugauuacacaggaacucacuuucauggggcggcaugugguugggccugugggugugugaguggcgagggcgugucacuuggaccugugggugugugaguggcgagggcgugucacuuggaccugugggugugugaguggcgagggcgugucacuuggaccugugggugugugaguggcgaggggagggcgugucacuucuacagcacaguuuggccuuuuaucucucagguaacauaauugccgcucaaacaugcaguguuucuaccauguggcuguggcaugaguuacaaucuagucgaauuuuucauaugcuuuuucuccguuguuaggagcuugauaaaauauuguuuucucuacuuggggccaugaauugaaaaaccaaaauuaagaaaugugggauguuaagaugaaagagcauucugccuuccugcagaagcgccuccugccagcggagggcugcuuugucuuuuaguuugcuugcuuggcagcuugccacuggcaagauaagguggcuaguaauuuaguggcaucaggagaaacgaauucaggugaaagguagcuggcaucuuuucuagaguugugcuccagugauuuaaaaauuauuuucuccaguggaaaaaaugcagucaccuuauuuaauaagcauguuuaaaccucagucguaauccuguuauuuauguucagaaagaaagagaaaaugcucaccauucuuuaguuuccagaaucucagcuuuggaaguagcacacaucccaaccaugacugagucaauaagcccccgaugacauaguguuggcagugggcagugugugugguguggguguguguggguacucauggagaguagagaguagagacaguucuuaauuugguguguuuucuuuuuugagagggagucucgcucucucgcccaggcuggacugcaggggcgugaucucggcucacugcaagcuccgccucccggguucacaccauucuccugccucagccucccgaguagcugggacuacaggcguccgccaccucgcccggcuaauuuuuugugguuuuaguagaggcgggguuucaccggguuagccaggauggucuugaucuccugaccucguggucugcccgccucggcuucccaaagugcugggauuacaggcgugagccaccacgcccggccuaauuugguaucuuaaugggauuuuaaaggagggcuuugugguucaggagagucuuugagacggaaagcagaacacacagguagcccagagggagacuucagaacaugaccuuccuauagccacgggcccagguauccuuuucacaaggccgcagcacuguuuucacacugugcguuuagcauaacuauuaauagaugacaguuuuuucccuugcucacuuugcauuugucuagggaauuuuaugucuuugcuuugauuuuugaacuuuguauucuuacaaauaguuauauaguuaaugagugaacuucgaaccauccuggcacuuuuauucuguuguguauuuagauacccaguuaccacagacuaagugcaucugaugugugagggagguuugcugaaugaaaggugcugugugccuguggaauaaaacacacacauuuccacagugccacaacccaucuggcauuccugcaggugcgcucuuuuaucagcuuagcaaaucaaaguaaguguguugagcaugcuuacugaagguggcagugucaucugggaguuugcugguggucgucucaccagaucccugcugugccucuuacuggcagugucaccugcuggcacugucaccuggcuuccucaucugaagcuggcagugucgccuggcuuccucaucugucagagggccacaguaacaggaccuccuccccagaguuguugaggagcaggaugugugccuggcacacccugagugcccagucagugccaccuggugucacugguccagccuuuccagccucuccacccucagucagcgccaccuggcauuaccggccccgccucuccacuuggcuuguccucagcgucaucuguguauuuuucccgauugcugggguuuucuucugcauguugugggaguggcugggaguugagugaguguucacaccccgugguugaauguugaggaaggggacagccggaagauggugagcaggguucuaacagcucucugccuugugaaguggaugggugaagaggucccuucucugaauugugcgucuucccagccugcugcagucucucgggucuggagguuuccuucagcauucucucuuccccgagcagaacagaauacugggaagugugaagagaacauugauauaauagugaugaaacuguuuugacucagaaaaagaugauuucuugauguuacaauaaauuuuguguaaaaauagagugauucaaaacacuuuucaugccucaaaauaacacagcuuucugucaccagggggcauccuagugucauuaacagaaaaagagggcauucuauguaucaguuucuaaacugucuucuuugaccacagaggguuuugaacgagauggaggcuuccugagacacacauggccgcuguguccacugcccuuauagacccaccucucugcuccaggugccugccagcaucaaugcugguguguggaauggucuuugccuugcgggugccaaggcuaguguagcccaucucagcauacagaaugcuuucuucugggugucaacgugaugcguacuagguugcccccuggugguggagauaagugcagcugucaacuccugaagguguuggcuucuuuugaauugcccuguguuuuccuguuugucauaauucucugggaagagaacuuacugcguuacuagcagagagaagcuuuuauugcugugauuauugaauuggugugcugagaucucauuggagaacucagcugaggaagccaaucaagcagcagcucucauacaguauugggcaugagacuuaccuaggagccucugaacuuugcggcccuagggccguuccugcacuggccuuuguacugcagugaacagacuuugggaagugcugcaccagaaugucuuuuuguucuuuuguucugcccucagguagcaguuuaucucucugcuuaccuuaccccuuuucuuccuaaaccuuuuuuuuuuuuuugagacagagucuugugcuguugcccaggcuggagugcaguggcacuaucucggcucacugcaagcuccgccucccggguucacgccauucuccugccucagccuccugaguagcugggacuacaggcacccaccaccaugcccggcuaauuuuuuguauuuuuuaguagagacaggguuuguuuuuuuuuuguuuuguuuuguuuugguuuuugagacaaagucuugcucuauugcccaggcuggagugcaguggcgcgaucucggcucacugcaaccuccaucccccagguucaaacgauucuccugccuuagccucccaaguagcugggauuacaggugccugccaccacgcccagcugauuuuuuguauuuuuaguagagaugggguuucaccauguuggccagacuggucuagaacuccugaccucaagugauucacccaccucagccucccucauugcugggauuacaggcaugagccaccaugcccugccccuuccuaaacuuucuuacacccaauguguccauuggaagcauuuccaacucuuaaauaaauguuauggaauagcuaggaagaagaaaaauuuaaguuauuuuugagauaaccuuucagcuuuuuacaaagaagucagacaguucccauucugcuuucugucugccaaacaaggaaugugacuucuagcuguuaauguaguuaauuaaggcacuguguuaaaaagggagcugcagucaccaggcuuuuuguuuauagugcgcuuuccucugcucuccgaccauggaccuggucccagccucuacuggcuguguugcaauguagugaucgugaauaagaggugcagucaggaagagucaucuucgcuagugcacaaacaaaagugucuguggucuggauggucagucacugacauccuguggaaagaaggauguaucauaagcauuucauuguagcugauuuacauguccauuggaguucauuuuuauuccuuuuggcuucauuuucggaucuguuuaauagugauaaauauuugaaagcauuucuauuguguuuuuuucguuaaaugaagaugauuuagauugcacugacucuucauguauguuauucugcuagaaguaacggcaugcaaaguuguauggauuaagaguuuuaaugaauuguugccuuaauuaaaugguaagcguugguuuuaacauuuuguugaauuaaaauuuguuuucugauuccuugugcagcuuccuccauacaguggaacaguucuguguggcacacaggcuguggauaaacuaccugaugguaagcuaguucucuccuuauuucccugaagggaauuuggccauacgugcugggugggcaggcuaccuguaaacauuguuucccauuugaauaaacauuucuuuguagcuugaaguuuuugcuguaaacuguaauguauuuaauugcugaaucacuuugacuagugaauugguuuuaaagcguauccugugcuucggagugccagccauguaagauuuaguuuaggaaaugguuguugaguucuuuuuuuccuaacaguucugagugcaacagguauguuacucuucaucagcacaugcuggaguugaagcgaacuuugggucuuguugcuaagcagccugcuggcuccagcgccagcuagcuucugagccuguguucuuuguaaacuaaggggcagcuggcaucuguuguucuugcaguucacauucauguccuggucugucgcugacucuugggaacucaggucaacucuucaccuccuggucuguuacuuuuuugggucuccaucacaggcacuaagcugauugccagagauggugcuuauggagaugcaaugauuuuguauugcuuaaguacccagcguuggaauaccaacaagguuguuuaauuauugauugcaggcugcccuugcacaauucaaacuugucgagaucauuuuucaaucugaaucacuuuaaaggcccuuacuggccuccaggaaacugaugccaaacuuuuucuuugagaguuagagguuuggauucccuguucaguuagcauggucagacuuaugaaagggguuuuaauuacaauuuaggcuucaauagaagccuugaaaagacuaaccaaacguuuuaucuccaguaacaucagggagugauuauaucuaaaauuuuagauuuauaagaaaugugggagaccauaagggaaagagcagaucuaacaauagcuuaggacaaguaauaaaaugaaugaagcuugagggaccgggaagccgggcugcucagccuccugagccaccuuuuaauuggcugaugucaaccucucagacaucugagucagugggacuuccucugucacugugugcuuugcacguggugagcaugcugcucauguugaaccagugcuuacaaaugccccaugauguucccaugcacaucacuucuuugaguucacccuccucccugugcagugggcaccaccagcucccccagccucuggaguucugcuucccccucccuccuuccagccugccugcccuuuucagugacugcuucuuggcccuuuuucuccauucuuuacucuguucccucuaaguccugccuuuuuucugccaaaaacacgacuggaaucuugccaccaguuugcacaguuagugacaggccugcuuuucucugcagccuuucuggguaucuuguguuuccaugacauuaguuucucuuccagugccuguucgacuguacagagccugugggcacugucauggaccugccucucuuuccagccugcucagcugcugauggcaggauccauuucucugugucugucacugcgccuguaguaucuggaauguuguaagcccucaguacauuuguuggaugaaugguuuaggaugcuuuauucugcucccucccacuaccuccagcugcagcaagcccuuugcagaggcaccucaucguggcuucccuuuuagaucucggccuuuucuauuuuuguguuuuuuaauuuuuuuauauuuuaauuuuuguagguacauaauagguguauauauguaugggguacaugagauauuuucauacaggcauacaacaaguaauaaucacaucaaggugaaugguuguccuucaccucaagcacugccuguuuuagauguuccuaaagcuugagauaccacuccuucacccugcccuuagcaauucagugauccaucaaguuccacugaccucucuaguuucugauagaaguugaucacuguuuccugcauccagaagaauccuuuuucuaaagcuauucacagcuuucucuccccucccuccauguuuucauucucaguuguuuguauuugucucccuaauaaaugugaacucucugagcagggcccuugugucacuaaucucuguauauuucccucccucgcccccugccuuguaguccaguccucucuacugcauguacugcagugagcagccuuggagaaaugcuguguuaggauucgugguuuuaagagccucugccugcauuaccugaguauugaguuuccaucuuccuaauguauugauuggguuguugaagccaagcgugcaggccguccugcacuucgucugccuggcacauugggcucugagcucucugccaugcggugcaaggcacauggcguccauugugaguguuccuccauaagaagaggaacugugcuggcuaggaaucugccuucuagugagaugaucaaacaugguauugaguaaauguuugauacuaauuauaacauacugaaaugguucuguucacguuacaucacauucuagaauguuuuauguucugauaagauugagaauugagauguguacagcacaucugugucuuagaaauaaucagucuugcauaagcugaaugacacaacacguucuaguuucuaaugugauuucacagccuucaaagggcaggcuccacauggagccuuccgccccaggcacacccguuucaaucuggggagccuugacggccccagaacaucagggaauaggggauguauggaaccaaaaugaacagccagccccuacauaugauaauaaauucauuuccccuugauauucuuuucaaaguaaggaaacaaaaaauaaauaguagccaaaggaauuagauggucgugacuucaugcauaaacuugcuguuagguguaaucgucaucaguguucuuuuccaggaacuuucucuuguuggggcaggauugugcugccaccacccuucaccccccacagucgggggcugugauucuaaagcauacgaagauucaggaggccucgggaggcuguguagcuccagccuccugcacacucacuugcacguaacuggccccucucagcgucuguauuuuuucuucuacaaaaagauuucuagggguccuuucaagguaaaauauauucaguucuccgcaguagaacaccguucuuuggguauuaguuucuuuucuuaagauagaugccuugaaaaaaaaauuggccccuuaaugcuagccuggaagaaaucuucaugcauuaaagaugaaauauaaggcauguguccuucccuuaacuucaaaauguguaacuuuuuaucaaauauaaggugacauugaugcuugauuucuguugaaagacacaauugauucuaaaacuuaaccugauuucagagguguaaacuauaaaaauacgucugucuuagcaggaaugaauuauguggauugugguuaacugggaaggaaguauugaaggcuucccaagagauauuuaaaaguucacaauucuaacuuuuucuuuugguauuuuuggaaggcuuuaccacccaugggguuaauccagugugaauuuauuuagaggacguuugcauguguucaugucagggccauuuuucagacuuaauugaagguuaccagcggaggagaccaagagauagagaauucagaagagugcucugaagugcgcuuuuauauauaggauucuuuguuguuguuguuguuguuguugaaucuuuuuuugacaucuuuuuuuuuuguuuuuaaauuuauacuuucuaauuucuccuauccaguauguauaggauucuuugcguaguucauguuuuuggaauuaaucaaaucacguuaacuacagaagcugauuuaaccauguuuuaagucccuaaguuaguugucaugaucuuuuaaaauuuaaguuguccaaaauacauauuccuuuaucucaggcauaaggcagcuauaagaaagucagauuccacugggggguauuuuuaaaauuggcaaaauauuacuugcuuuuuauuacaaauuuauuuuaauuucuaccuucugaaagccuuccuuagcuagaaagauaaguacaggcuucugcuuuucauauccccaaauuaaauaauaauuuuauaguuguuucauuuuccgcaaauuguucagcguaaguaaaggacguaauagauuuguugauuaggaagagaacuuaagguuuuuauuuucaaagagaaagugaguaauuacugguacuuagaguuuguagaacuggguucuuaacuaauaguuuucuuucuaaacaggacaagaauaucagagaauugaguuuggugucgaugaagucauugaacccagugacacuuugccgagaacccccagcuacaguauuucaagcacacugaacccucaggccccugaauuuauucucgguuguacagcuuccaaaauaaccccugaugguaucacuaaagaagcaagcuauggcuccaucgacugccaguacccaggcucugcccucgcuuuggauggaaguucuaauguggaggcggaaguuuuggaaaaugauggugucucagguggucuuggacaaagggagcguaaaaagaagaaaaagcggccaccuggauauuacagcuauuugaaagaugguggcgaugauaguaucuccacagaagcccuggucaauggccaugccaauucagcagucccgaacagugucagugcagaggaugcagaauuuaugggugacaugcccccgucaguuacgcccaggacuuguaacagcccccagaacuccacagacucugucagugacauugugccugacaguccuuuccccggagcacucggcagugacaccaggacugcagggcagccagaggggggccccggggcugauuuuggucaguccugcuucccugcagaggcuggcagagacacccugucaaggacagcuggggcucagcccugcguugguaccgauacuacugaaaaccuuggaguugcuaauggacaaauacuugaauccucgggugagggcacagcuaccaacgggguggaguugcacaccacggaaagcauagacuuggacccaaccaaacccgagagugcaucaccuccugcugacggcacgggcucugcaucaggcacccuuccugucagccagcccaaguccugggccagccucuuucaugauucuaagcccucuuccuccucgccgguggccuauguggaaacuaaguauuccccucccgccauaucuccccugguuucugaaaagcagguugaagucaaagaagggcuuguuccgguuucagaggauccuguagccauaaagauugcagguauaguugaaaagauacaaaucuagagugaagaugggagcagaccucaucaacugggcuuauagacugugguguuacccauaacaauggcagauuaccuguguguuaauagcaacgucugaaggaugccuaugucuuaaauguucucuaaaaguaagauaauauagaaacaaaugggaggagaggguugucguaacuuuauguuaagugaaagauccaugucuguuagcaguucuuuucuguugacaaguuacauuuccauuucuugccuuuuguucaaguaauucugcuccacgguaugaauguauaauggacuuuuucugugauauaccuuugguaugauaauccugauuuguacucacugugugcuccuuuuuuauauuucuuaagauacaagaaaucauuuugugaaauaacaugguuuuuuuuuuuuggauugaguaaauggauuuuauucagaauuuugauacaccaaggucagcucuugaagagaaaaaaaauguuaaggguucagcccaaaguuaauguuuuauuuuagagugcuaaggcuccaaaguagaaacaauucacaauaaaaauagaaagcugcauaauucacagauuguuuuuaaaaaguuacaguaggaagucagaaaugcagcaggguaugaaagagguauguguccucacauagccacguguugcuuaacuaagauggauauguguuccgagaugugcguguuaacaucagagaguacuacacaaauacaggugguagagccuuaggcugguggugcagccuauuacucccgggcugcaaaccuguccagcguguuacuacugaauacuguaggcaguuguaacacagugcuaaguauuugugugccugaacacauuuagacauagaaaaaauauaguacagauaugguauaaaggaugaaaagugcuucaccuguauagagcacucaccgugaauggagcuugcaagacuggaguggcucuggaugggucagugaugagugcugagugaaugugaaggcccaggacaguacugagcaaagccgaguuuuauaaacagucaacacuuaggcuguacuacguugauuuacaaauuuuuccucaauaagaaauuaaccuuaaccuacuguaacuuuuuuacguuuuauuuuacuuuuaaauuaaaaauucuaaacuuuuugacucuuucaugagaacauuuagcuuaaaacacacacuacagcuauacaaaaauauuuucuuccuuuuuauucuuacuuuccuauaagcuuuuucauauuaaaaauuguuuuuaacuuuuuaaacuuaaaaaguaagacacaaacauuagccugggccugcacagggucaggagcaucaagacgccacuaggcggcaggacguuucaguuccacuagaaucuugugggaccaucauacgugcggcucauuguugaccgaaauguuacgccgcgcgugacuguacguaccuaagaagcagaagcugugucaucagguuggauuccaccaagccuggugaccagaucuucagauugucacccuaguagccaaguuaaaauaagcuguuugguuuaggcuuucuguaauacuuucugaugugaccuuuuggaacaccugacacccuucauuaccaggauguagcagcaagcugccaaaugcacacccuucgauggauggucagaauuguguaaaaaauaaaacacauucuuuggguggcaauagggugauagcaagcaauguauauauauuuuuaagaguauuuuauuccuuauacaaaauacauuaucucagguacucuuguuguucugaaguucucuuaaaugagcaaaugauaggccagacgucguuauuuugggcuucauauauauuuuuuaaagccaggugauuuuuuuuuuuuuuuuuuuuuuuuuugagaugcagucucacucuguugcucaggcuguagugcaggaggcacgaucuuggcucacuacaaccuccgccuccuggguucaagugauucuccugccucggccucccaaguagcugggauuacaggcacaugccacaaugucuggcuaucuuuuuuuguauuuuuaguagaaaugggguuucaccaugcugcccaggcuggccucaaacuccugaccucaagugaucugcucgcuucagccucccaaaguguugggauuccaggugugggccaccgcacucaggccaggcgauuucuugaauacagcuuucagaauguauuuauugcaaggacugauacuguagguggaugacaaggucaggagaucgagaccauccuggcuaacacggugaaaccccgucucuacuaaaaaaaaccuaaaaaucagccaggcgugguggcgggcgccuguagucccagcuacucaggaggcugagacaggagaauggcgugaaccugggaggcggagcuugcagugagccgagauggcgccagugcacuccagccugggcgacagagccagacuccaucucaaaaaaaaaaaaaaaaaaaaaaaagauagauuguguaagccuuuauauagauuacuaaguuaaaaguuuauuuuuaaccuauaaugagaaaugcauggugggguccuguuaaaaaugugcauucuaaguucgaagucaugagaauuuuauuuucuuuucuuuauuuuugagagggggucucacucugucgcccaggccggaaugcaguggcgcaaucucggcucacugcaaccuucuccuccuggguucaggcaauucuccugccucagccucccuaguagcugggacuacaggugccuggcaccacgccaggcuaauuuuuguauuuuuaguagagaccgaguuucaccauguuggccaggcuggucuugagcuccugaccucaagugauccuccugccucagccucucaaagugcugagauuacaggcgugagccaccgcgcccagcugagaauauuauaguuucguuucuaaaauugcuccacaaaggaaaaccucccaucuuagggagauuuucucuaucuuuauuuaaaauaaccaagaaaagcuucauuuaaaauguuuuagaacauucuacuuagucauaugacuuuaaauauaguuugauaaauaguuuguuauguucuguauauguuaaagucuaauugaaguagcuuugucaaacacugaaaguaagggccucuuaaugacugguaguagaggaaagccuugccacacacaguccacguaauuauuuuuguguggacauauuguaaaccccuaccaaacagauuauuuuuuuaauccuauuugguuaggucaguuaugaagauguuuuaauuuucugagcaaaaguguaguuucuuuaaaaauauauaauucuuuucagccuguuuguugaggcuucgauagacagaacguaguuguugacaguuucaggagucucgugagauaguagagcaauagagucacauugaauaacccuugggaucauauagggcuuagggagaauggcauuguuugaaauuuuuuuuguuguuuuauucuccuacuuagggauuuacuuuauaaaagugguaaaacauacucaguuuguuacaagucagauccacuaccacaaauucccuuuagugggcacacuuuuaaguguaggcccacuuauuuuaagcagcguuuaacugagugaaagucuaguuucauuaaaagaucuguugauguggguuauaauagaguuugacuugcauuaguaucuaacuguuucuacugagacagugguauuuguguuauuaacuuuugggaaagagggaguagggaaugauuuagacauuaaauguauuccuuucugccaggcaugauaguguggagauugaggcuugaggcucgauaacuugagcccgggaguucgaggccagccugggcaacauacugagaccccaucuuuaaaaaaaaaaaaaauuauacacacacaaaaugcuuggaauaauuuguguauuuuuuaucucaaguuuguuucaaauacucacauuucuggacuauuuccccuauuguuaagucugcuuaauaaaugccagcuaguuuuuaugccaucagaagugaaauuaagaaggcagauggacuaaaagaaucacguauaagggauuuugaagugaaauacauuaaacucuugauuacucuuaaacuauccacuuuaacggguucuacuuggaccuucuugguggcaaggccaucuccucgguguagguuaugugucaacauuuuguuccauuggcuguuuuucaagugugaacuguuauuugaaaggagaaggacacgccaggggagagcgugugaacugaauacucagugauuuccuuuagccccaagggaaggauguaucuaaacacaaaagcccugucuugccgaggguuggagagggaucuguguuucagugacuggucugagaggagaugguugccauuuaucaguaggagucaacaaaaggaaacuuaauacagcccggcacaguggcucacgccuguaaucccagcacuuucggagguugagguggguggaucccuugaggccaggaguucaagaccagccuggccaacauagggaaaucccaucuuuacuaaaaauaaaaaaauuagauggacgugguggcucauggcuguaauccuagcuacugaggaggcugugucaggagaauagcuugaaccggggagguggagguucagugagcccagaucgugccacugcacuccagccugggccacagagugagacugucucaaaaaaaaaaaaaaaaacccaaaacuuaauagcuuguguuugaaaguaguugcaaaacgcgacacccuuguuaagagugaguauggcagacacguggggagugccuuugcugcugcuucccucauuagcacagauacuuuggaguugacgaacaugugacguuugaaauugaacguaugcuuucauugaacauuguacuuuuccugggucuuuacuaaggaacauuccucauauacuagacgaaauuguaucagaugcuuucacaucacaaauagagccauuuuguauuugauguuuugcuuucaaaauuaugcaacaguauauuuuguuuuaacagaauauaaauaaugcuggguaagaagaguggccaacugcccgauaaguuaaaauuccagugagagagaacuaggaaaacugagcucuugaacagcucugaaaacauugcguugagguaucuagcaaugucauuuauuaugaauuguuagucaaaaccuguuuauaugauuuuucacagugguuuuauaccuaaaaggcauuggaucaagaaacaaaguuauuacaauuugggucuucucuaaugaauuacccuguccguguuuauuuaaguguaaaugaacauacaguuaugugcugcuuuaaugauguuucagucaacaacagaccgcauguacgacaguggucccauaagauuauaauggagcuaaacaauuucuagugaccagugaguuguguuacaguugccuacgguauucaguacacaacaugcuguacggguuuguagcuuaggagcaauaggcucuagcauauggcccagguguguaguuggcuauaccaucuaggcaugugaucccacaaugacaaaauugccuaaugccacauuucucagaacauauccccaucauuaagcauggcuguguauccuaaaacugaucuuuauuuuggcaguuuauaaaucaugcauauauuuccccccgcuccuugggggaaaugguuucucagauauuuugcacuuccucuucaaacucugaaguacacaggcaguggucaugcggcgugaucuaaguuaaaaaggcguggcaccuguuuaccgggauccacccuuguggacugagaguuuaguccacaucugauucgauguuuguagccucacauuuauuauacaucuuuccacuucagaaacauaaguugaucuguagucaauggguagugguacauuuuggucacuuugcuguccuccaccugguuagauaaccaagauaguguguguucuuccaaauugaugguaaugaggaaaagaaaagcacuuggagaauguucuggacaguuagaaugaugacagaaaagcaggucaacaacaccagaaugucgauuacgggccaguuauugagcccuaagaaucagaguucuguaccuugcauuuucagggauuuucaauguuaauaugaccccuaaguccuaauuuuaggaaaacagaauuugauguguaaaauauguguaagaauaaucauagcuuaugaugacauaaaaguuuacgaugcugguauugccuuugaguugauaaacaauuucagugggcugauuuguggcagcccuugugagcuaccaucuagcauguaugucuuaaaauuugaaaaaaggcuauuaagcaacuccauuuuucuguaugucagcagauuucauaagagugaaauuucaguucagccuuuucaugugaguuauuacaaaagugaacuacagguuucaauuuugugucuuuuaugagucauucuggcauuuugugccuuuucucacacauuguucuaggcagccccaccaacuccugugacaaagauggacugggggaggccaucuuccuaaaguugcugucugaacaguuaaguaguaaauuauaccaaccaugaugaauugaaaagaaggcuucuggggaaaguuuguuauuagagccaacuucuauuauaugcccuuaaagaagguaaaauagauacaccaauggcaaugacuuuggaaugcaggucaaguuucaaccuagaaguugccugcccucuauccuugguggcccgccuuccucauuuuuauucuuuuagccuccauaauuggaaugcguauuggacuuuaggcuaggaauaacauuguaaaugaaaauguugauguugaaagaggaauuuaaauagagcgaagagugauauuagaaauuuggaagugguauuaguucuggcuuguccguaagaccugacuuuugcaugauaacaauaggauucauucacuugaacauaauucggucuggucuuaggaggaauuagaacugcuuuugcaccccuguuuuuuucacugcgaggaagaagaggagcucacgaacuucauaaagcguuagugucuccuccaguugaugguuaucgaaaugagucaggauggaaggcuuaguguacgugugagauguuacaaaaguggaccuuaaauguuucuugaguguuuggaucuuaagagaaaaucuuugacaauaaguauuuaaucuucauuucuuacaaucauuccucuuaaaauggagcuuuauuuuuuaaaaacguauuuuuuuuuucuuaagaaacagggucuugcucauucauucaggcuggagugcuguggcaugaucauagcucacugcagccuugaucucucaggcgcagguggucuuccugccccagcuuccugaguaguugggacuauaggcaggcaccaccauguacagcuaauuuuuuuauuuuuuauuuuuuauuuuucauagcaacagagucucacuguguggcccaggcugaucuuggaacuccuggacucaagugaucuuccugccauagccucccaaaguguugccugaaauagaacuuuauuaauauaucuuuaauaugucaagauguuuaaaacuugucaagauuuuaaggaaguugggcuaacauuuccucuugggaugcugaaaguuguugguuuucucagacucucacauaaauucauuugcuuuucccuucuccuuccaccucuauuagcucuuuauuuucuaggggggauucugaugucuguauugagcuggccgucaugccgggaguggucugcuuauguauuuacaugcgugcucaucuuugcuauagcugagcguggugcagcuccuuaccuguuccaggugcggagugaucugccgcacaaugaaugaaguggcagagccagggcgcgaacccccgucuuccugguuugugugccugggcccuugcccuuuacugugcgucuucucaggagcugucauuuagacuuucuggaccaggagcuaaaugaccuuuaaagucuguugagucauuucuaacaaauaugaguggagucauuugccguaaccaacaacuuuaaucuccagauguuuaauugauccuguauuacugucuaaugagaacuuacuguaugccaugcacugucuaguuggaguaaugauuggccuugccuucaggguagucuaaggcauaagaucagaaaggaacagauggcagcuguuuguagggagaagugaucauuggcagagggguguugaggggagaaagcaaggaggggaggccucaugcagcuaguagggauggcaguaacaggcugaggacacaaaaggccaccaaguccuguuaccuuagauggugcggacuuuguugagcaguugaagugugagagucuugucuuuaaggagccuccuguccagagaaggaggcacacagcacuaauaucagguaggcagugaugaggucagcuacuguggagacaguguggagaaucuugagugccuucugucggucuuacucugagauuaggauuuaggaucauuauaagagauuaauaacagaaugauacgguauuuuaguuuaugaaagacuugccacuagauaaaauuuuucuacaguaacagaauaaucauuaagaaaaaucuagguuguucgugucucuucuguauuuuccaagucugaaaagguuuauucugcguuuaacgacgucguaccagaauggccuuucaaagacugucaaaggcuugaaggaaagcuugguggaguacauuuccuaguacacgucccaagggcccguacguauguucugcuguugcagagguugugcucguucgcuuuuguagguuccuugcaguuauugaacaaaccacuggguggugcuagaagacuugauuuuaauacugugcaagaaaaacugaaacugcuuuuuaaccugccugcgccucaaaauaagcaaacuggaagcugguaucgauuuaagggaauggcugauguagaaacuaaagguuucugucugacuaguucaugcugucucacaaauaaaugcugggaaaaaagucgguuuauaguugauuuauguauccuuugauugcauagagauugaauggucaagccuccaggccaugcagauuauucugggccccuaacucaguuaagaacaugaaaggaggccaggcacaguggcucacaccuguaaucccagcacuuugggaauccaaggcaggcggauugcuugaggccaggaguucgagaccagccuggccaauguggcaaaacccugucucuagacuuugucccagaaaaaaaaaaaaaggagcuguguuuucagacagagcuuagugcagccaguucuugauggcugugcaaugcuuuccuuuuaagaguggaguuagccucgucauaaagcguguuuuugagucuguucgaacgggucaacaacgaagggaaguuucaggcagaucuuguaugccuggcccugguggcugcuuucauuuccuuccaguaucagugcuaaacaggaaugaacauguucaagccccgucucacccaccucuggcaucuucgcccuaacucugcccuagaagaccuuuccuuccguaucgucaagaaaacugaaguugcuguuucacuccuucucccacccagaaacuucgcugcaucuuccuggaucccuagcuccuugcacccaugauccugucuccuuccucagcccggcuucuggcugagcagccugcacuugcugucuucacuccuacacgcugcccccacuccuacacgcugccccugcgugcuucucacuucucuacccuuccagcccugcacucuggggaccugugcguauguuugugugauuaucaaucuguugaacccaggaggucgaggcugcagugaggcauaaucacgccacugcacuccagccuggguaauagagcaagauccugucuuuaaaauaauaauuaugauuggguaugguggcacacaucuguagucccagcuacucgggaggcugaggcacaagaauugcuugagacccagaggcggagguuggagugagcuaggauggugccacugcauuccagccugggcggcagagugagacugucucaaaaaaaaaaaaaaaaaucagucacuugcuggucuuuuaauauacauauacgauuuacuggugucaucuggguaucuuuuacuaacaucucuaaaacugagcucauuaccacacuaaacaaaaaauaaccugcucaucuguuguauuccuccucuaguuggauagcacugcugccccagucagugagaaccuucuaguauaucuguucuuccucagcuuccauuugguggcuucaaccccugaccuucccagaguuucugcagcccuuggauugggcuaagcauccuuccccaccccccgccccccaucucccaacaccccuucagcuuagccuguacaguguguguuuggagccagggacaucacaguucgucccuucacuggucugcgagcuugccuagggcaggaccaccuugcauucaucucugugccuuccuuacccggugccuaggcagggcucagcagggguuuacucgccuucagcgaaaggcagcauguuauuuaacaaagguuucagccacacaccauggcucaugccuguaauccaagcacuuugggagaccaaggcagguggaucacuugaacucaggaguucaagaccagccuggccaacauggugaaauccugucucuccuaaaaauacaaaaauuagccgggcgugguggugcacgucuguaaucccagcuacaugggaggcugaggcaggaaaaucacuugaacccaggacacagagguugcagugagccaagauugcaccacugcacuccagccugggugacagagcaagacuugucucaaaaaaacaaagguuucuauguuagaaagauagcaggcuuugagucuuaagguuagguuuaaaaaaaaaagucauuugauauaaaaauacuauggcaaagccuuguuggaaucaugcuggaguuuucauuugagacacuaugccuuuacgucauugaugguuauuugaaaaugcaccuuuuuaacacugcaaugacauuaguugcuguucuguggcacacacuagaaaugauagacuguugugaugauaugguuuaaagacaaauguaaaaauccacugucaauagacuuuaagccuguggggaaaaguaaguaucugaaaccuuggaauaaaagggauuuuuaagugaagccccuuauauauugaggaaagggcucaaccucuugagucagguggacccagguucacaggucauuucagcuguuaugugaccucaguuuucucaucuguaaaaugggguugguaacuaucucugacaguaggguuaugauaauuaugaauaauauacacaaagcuucuagcacagugucccucacaugacaggugcuaucucugcugggugucaucacaugcaggcuugggguucaguucguaacugauccauuauucauuuauuucaaggcccaguucgguauuccauauuaagagagagaggagcuuugcaaacuuagucuaauuaaacagauuccacagaaucuguaauauuuuacuuucuacagaagaagagcuagcagaaauuauucccuacgcuucuucaguuagaaggaagaggacauuuauucauaggaaggagggaaugagagggguggggguguguguguguguguguguguguguguguguguguguguguguuuugaauuuuguaaauuaauuuuuucauuugauuagugccgaagucugggaucugccaguacaauguaguuuagaaaagaaaagcuuauuuuugagcgaugccuuagauggaugcuacuaucaaauguauguaugccauuuugguuuuucuuuccuauauacaauuuguuuauuuauuauacuuuauuuuuaaaugaauuuuugauuuuuguugguacauaguagguguaucuauuuguggguuauaugauuaguauacaauuuaaaaguaaaggagacaguguggauuggcugcagauuauggaguugaggcccuggcuaugcuaccuggcuccugugugaucacaggugaguuagucagucuuugggagccucauuuuccuuauuggugaaagggucaaaguggugguacuccuagauuacuaaggauuaaguccagccaauuaacauuugucaauuguaaagaacgugcuaaguguagaaggguuuauaaauuguagccaucaccauuagaagauucauagugggacagggggagaccuugucuuguuuucaagcauuucugaugguuaauucuauaaagauggcauucacagcuguuuuaauacacagaaagagugauguccacucagggugaaccugaggcugagcagcguguuuguaaauggaauaagggaauuacaguuuauaaaacaguugcuaaauuggauuucuaguggacgguuuaauuuguaggagaccgcugucucugaaaggaguauuuuuacucacugaacagccauugaacacacacagugauguguagggucagcauuagaugcuggggaugcagagaggaaugagacguggguucugcaagauaucuuucuaucuagugucugaggcgccuugcugcugaugagacacaccuggcuaaugguguuuaaggaagaaaggcuguaucucucaaaucuauucucuaauaaugauacuguguuaacauuuuuuuguuucucauuaaaauagguaguucuuguguucccuaauucuguuccccccaggaagauuaaauguugcuauuugagggaaaagauuaguuucaaaaauguucuaauugaauaauguacuugauguugaacugaaugaagccuuaacaguaugcauuuucuuuggcuguguguuuuacugaagggauuuuaaaugcugucccagaguagagcaugugaaaugauuugaauguucuucacuagaugucaucaauuucugaaauaugcuucuucacucuuucagaguugcuggagaauguaacccuaauccauaaaccagugucguugcaaccccgugggcugaucaauaaagggaacuggugcuacauuaaugcuguauccuuccuggacgccguccgcaaggccagcuuguugcagcugucccuccuuugggugcaugugacuuagcucagcuuccgugggccaucuagcucuccauuugaaucccuaagucugguuuauuacuuggucugccuaccuugcuuauaaacaggauuauuccugaccccaguccaucucccucuaaaagagaggauauguuggcacgugaaugagggcugcagacaagcuggcucucauuagaauagucacaaauaauagggcagagcaaccacuuacaacuggaaauuugguuuuaacugauugaacugucuugguuaggucaaguucuugaauacaaacgacugacugcuucguagauccuuauauggacaucacaggacacuuacccuaguaacuauuugguuuauuccuuuucguggugacauaucuaaguaguucaacguccuuagcuuccuuguguuuuuauaaacauucuugugcuucaugugccuucaggaaauguggugugucuguucauuuccuuuacgcuuccuuacugccacuacauagacacugcaggcauugguugcuugcccgccgauguaccaccugaugaaguucauuccucuguauuccaaagugcaaaggccuuguacgucaacacccaugauagacagcuuguaaguaagguggugaaagauguguuaaguggugggguuuuucccgucugauaauuagaauugaaauaguuuaguaaagcucuugauuuccugcaaaugaguccuauaauucugucuuuuuuuaaaaauagacuguuggcgauuuuauauggaaguuaaccagaaauggaauuggagcauugaugaucuguguucuuuagauucaguagaaaauauuuuagcguuuaccagcauauaucacuugaaauagaccaaaaaugcauauagaagagacuugaguucacuagcuguuacagcauugguuaccuaaaaucuacuauacucguauagcugauauucuacuuagccaucaaagcucuuuaguaaaaguauauauuguuuaaaacugcacuauuuaacauuuuuuccccauguuuaguguucggcuaaugaaugaguucacuaauaugccaguaccuccaaaaccccgacaagguuaguaaaaaugaguuuuguugaugcuauuacauauugggaguuauggagacagaugacuuaaauuugguaaauucagucuuguugggaagauagugucuuuacaccuaugccauucucaacauucagccaggugggaggugggggaguuuugaugauguugcuuuuuucaucauuuaugaguucauuguaguuaggaaaaccuguguccucuuuccauugcagcucuuggagauaaaaucgugagggauauucgcccuggagcugccuuugagcccacauauauuuacagacuccugacaguuaacaagucaagccugucugaaaagguuugagacuucucuguugucacuaguaucaaguguugccuuuuguuccaguguuugugugguaacuguugcuuauugauauuugcccucugucuccagcgcuauaaguagauguagguuuauaagaguccauugcuuggaugauauggugcaccaagcacugcucucaguacuuuacauauauuaacuuaguugacucugaauaaaguaugauuauggucuccuuguuacgguuaagagaagugaagccacugucugaggucagguagcuaauguacauggcagaacccagcuuucaagucaguucucuuaaccacugcacuauaugccacugggguagaauggagugcacugggccuggaaugauggcaguauucagaagagcuuaugucuucaucauacuuacaggcuuuaguagcuauuugauguacuugauuccuuuaccuaauuuuuuuuuaaucacauacuuuguuacuaaaggcaugagaccaaggggccagggagcccuuauaaaaggcccuggggcuguugagagugacuugggccgcccuuagcaccguuaacuggagcauuucuuuccucccagauugaguuugugaugaaucaguacaagcaguugaaaugaugcuuagggaaauguauucagagagaaaaauaguugagaaaaugccauuuaagucaaguuuacuugaagcuucauugcuuugaagaagagugaaugucgagggcaucguugcaggauaccaccagggguagcauagggucuuaagcuuuuuaaaugcuuauaaugcagcuuuugguauuggcuuggaauuugcacuucccaaguaaugggaacaugguguuagggaugcagaaauggaaugaagugcgcccucugcccucagugagggaaugaguuaaugaauagucaacaagagaagcacaaagauacagagaugccuuagaacccagaggggcccaccuagcacagguggaggcaaaauaaagugggugcucaggaaccccucuuggaucgugcacagagauaaugcuaugaacaaaagcaucuucuaaagguuacauuaauaggggauguguugggcuccccaagaccacccugagguugggugauucacuggaagaacucagaaaaugcagaagcugguauacccguggcuaugguugcugacagcaaaagcaugcggagcagagucaggaagggaaaggacaggugaggcagggccuaaaggaaacuuccagacuccucucccaguggggccacaaggcuacgcguaacuacuccagcaccagacugugaccacacgugaaaugcugccaaccagggaaggucauuacagacuccguguccagaguuuuuacugagggcuggucccauagguaccaucugccuggcuugaaccaaaaguccaaacucccaaaacaaaagcaaaguguucagcagaaagcacauugcuugcgcaaacgguuuaggcagaaucccguaucaguuauuggaccgaugggaaccuuucugaaauccaaauucccagacaccagccaaggggcaaccuugcaagcaggccuuuccaaggagagccacccaggccugcuaugaaaagucuucagcacacuuuggcugugccaguuuuugcccuuuucugcacacgugcagagcaugcacucacgugaacagcugcuguccacgucuacuaucuggagagggcaaguaaacuuugcaguuuaccuagaugcuucaaacagaacaauuugcagggccuuggaauaggcaguugugcugugaagaaugaaauaugaacugaugauaaguaacagaaucaaacacucgugaugugggauuauuaaacucuugggugacucgucugugaaugauuuugcugauguauguguaacacagcuaacgcucuaaaucaguggaguuuuuccacauguaguuugaguucuuucccauguaguuguccaucaucaaagacagacagaagcagacauagggcugcuuagcucauugcucgaguggugacccuugcaguugaacagugaacuggcccuagacaucuaguucuucgucuucuauuuuguuuacccaagacagaaacuuuuuuuuaaauaacuuuuuugugauaaagguaauguggccaggugugguggcucaugccuguaaucccagcacuuugggaagccaaggcaggcaggucaccugaggucaggaguuugagaccagccuggccgacauggugaaaccccgucucuacuaaaaauacaaagauuagccaggcaugguggcacacaccuggagucccagcuacucgggaggcugaggcaggagaaucgcuugaacccgggagcuggagguugcacugagcugagauugcaccacugcacuccagccugggugacggaaugagacuuugucucaaaaaaaaaaaaaaguauauuuauugaagaaaauuucaaaaauacagaaaguauaaauaauaaaaauccccauuaguccacccauuuagagauauguguuuagucaguuucuccuuuuccuccuacucuugggauuucagcuaugcaagggaaacccaugucaucaugucauuguuuggaaauacuuuacaucuuccauuucagaggaggcaugguuggacuuugcaaguacugcauguccugcaggccuuugacagugaucaguucacaguaacgugauuauauuugaccuuuucagggucgacaagaagaugcugaggaauacuuaggcuucauucuaaauggacuucaugaggaaauguugaaccuaaagaagcuucucucaccaaguaaugaaaguagguuaugguccacuugccgcagaguugugcaagaguucgcuguaaacagguguugcauacucauauguuauguugcuucccugccccucagucguuuuccuuucaaauagcauuuauucccuacgauaacuuacaccaucgagaagguuauauuuagguaaauuacaguuuaucccgaaccucugccauuuuccuuuaacuuuuaauuaggaaaaugaucaagccuauaaaaaagcugaaagaaucguuugaugaauaccuuuauaauugccgaguguacaguuuuaaacauauuuucugaugcuauacacacacuguguauauauauauaugucuuaucuguccauccauauauacauacauacgcauacauuuucccugaaugauucaaaguuaaguugcagcuaacaguuuaguucaucucaggugcuaaagcaucuccugcguaaccacagucccuuaucuaacugagaaaaacaacuguaaugacacgguaauaccgacuuugcagagcaucuucaaauuucgccaguugucccagggaugucauuucuaggaguuuauguaaacaaggauccagugguggugcaccuguugcgauugguugccguggaucaaguggcauugcaauggguugcaguggauccaguggcauugcgccuguugugauugguugccguggauccagugacguugcaccuguugcgauugguugccguggauccagugacguugugccuguugggauugguugccauggauccagugacguugcaccuguugcgauugguugccguggauccagugacauugugccuguugcgauuggccguggauccagugacguugcuccuguugcgauugguugccguggcuccuaauguagaccacacccugauuucauuuuuaaaacugcaaucgacagaucugugccuuuuuuuuuuuugcuguucuugucguaaauaguaguguaagcagaugcucuccuuuucagaacuuacgauuuccaacggccccaaaaaccacucggucaaugaagaagagcaggaagaacaaggugaaggaagcgaggaugaaugggaacaagugggcccccggaacaagacuuccgucacccgccaggcggauuuuguucagacuccaaucaccggcauuuuugguggacacaucagguuugugcuuuucuggaauaacuuaauauuugccuuuucuaggguuuugccauguuggugaagggggaaggugugaggcuuguuuugagacuucuuggacguaaugguuugcaucuugcuccccugccugcucuucucuugcacuuccugaugcuucccuugucagcccccguggcuuauucucucccugcuggcgcaugucugcaggggacagggagcuccucccuucuacucugucaaguucagcugcucacugcuagggaguaagagaaaagccagcuaauuggccauacgcggugguucaugccuguaaucccaggacuuugggaggccaaggcggguggaucaccugagguuagaaguucgagaucaaccugaucaacauggugaaaccccgucucuacuaaaaauacaaaaaucaaccagguguggugacaggcaccuguaaucccagcuauuagggaggcugaggcaggagaaucgcuugaacccaggaggcagagguugcaguggcccagauagcgccauugcacuccagcaugggugacagagugagacucugucucaagaaaaaaaaaagaaaaagauacaggagaaugucaucaugacuuagggguaggcaaagguuucauaagauaggucauaaacaauaaccacgagagagagagaaaaaaaaauauauauauauauauuagacuucaucugcauuuaaaacuugcaacauaaaaccaccuccgggaggcagagguugcagugagccaagauuacaccacugcacuccagccugggugacagagcaagacugucuucaaaaaaaaaaaccagcuaaccaaaccauguguuuugguaagagaagacaguguaucuggaggaauuuuauuuauguuaauaaauuguguauauuuaaaguauacacagauguuaugaaauagagauaguaaaauaguugcuacagugaagcagauaaacauauuccccaucacaguuacccuugugugugugugugugcacauggcaagagcagcugcaguuuuacucauuucacaaaagucccaaauacagugcacuaugaguagcucuuguccgauguuccacaucagaucucuagaccuguucgccuguguggcugcccuugguguccuucgaccgacaucuuccauucccacucgccaccccuaggaaccacucuuuucccuaucucuguaguuucgucuuuuuuuuuuuuuuaauaaagauuccauguauaagugagaccaugcaauauuuuucuuucugugucugacuucuuuaacuuaguauaauguuccccagguucauuccuguuguggcaaauggcagggucuuuauuacagcugaauaguguucccuugucuauauauacacaccacaguuucuuuauccauuggcccauccacagacaguuguuucccugucuuggcuguugugaacugauuggaagcaggugagguagaaagugaagagagugugaagggaggucuuuuuuacacagacagacccgugacugggcuggagucccugggcaccuggcugugugccaguucccuuaagcagcuuuuugcucauucacaaaguccuucggaaagguuuuucuuuauuuaccugagagcuuuucaguaccacugugauguggaauucagcaaaacuuguaccaucuccaagaagguuuacccaucgaaaguacugaagaggccucauuggagccuaauuuccuuucugaggccuugcggcauaacccccaggcugguauuucagugacacucuuagucuguuguugucccaaaugcugcguaccugaaagaaagagcaccccuuuugaggcaucaagacuugauucagucucaguucugagacugaaucaacaacuuucaacaggugaauaauaagaaccucagaaaccugcgcugacgcccucagaagcugguuucccguccucuguggaaguggauuuagaagccaguugagcagccaugugaccuugaacaagucacuucuguguucugcacugugagcucuauuccacuggccccuuucuauucuggugcucuguggaguguccacggcagcuggguggucaguugucaccugggaaacacccagcccugaccacugucugugguuccuugggacacgucguguugggagggagacgcugagguccagguuggcgcgcagcagcgagggaaggcugugcccuuugcuccuucagcccagcagccugguuuaggauugugaggacacccccucgggaugggagagaaagaugaauggacagcucaaauggaggcaucgggaacaugguuuuugugcagaggccggguaucagaauuucaaggccacagagggucagcauacucaaagaucccaaauuugucuaagaguaaccaguggaaaauaccagcguccauuuggaggacuugcuggcucagauugaacagcucugucacagcugcuagccacauccucugaggggucucuguguugaaauugguuguugauguuucuuuuugaaaaacgguaaagcaaagauagggaauucuuacaacguaggaacuucuuuucagccauuguuaagcaugauucuuuauucacaccaauugaaagauuuacuucuaaaacucagccucuucagauguuuuucaguuuccccaggaagacuuccccgccuuucuuccccggugccaccuuugcuaaaacacaggaccacugaaucaagagggcuucuugauucuccaccagcucucaugagcgguuuccccacuacuguaucccucuccagaaccaggggaacuguugucacugaagucuucaaacuguaaaggagcauggagaugcguaauuaaacccuggacagaaaagcuuuuagcgagcucuucaccgcaucuguucuggaaagccugaguaccuguccacacccauuuuauuccguugagaaacuaggucaccgagacugcagaaauagaagcccuuguugaaccccuggaauguuuccuugcugaggcuaaaugagagaugggccgaacacacaauuuuuacucagaaaaacuuagaaaaaggaaaaaaaaaaugaaaugaaaaaccagcuaagaaaacaaggucaaauuggcgcccuucuuggaaggguggcagccuuuuuuccuggaauguuaacuuguuuuuuauucuacacacccuacuccccuucuucuuuuuguaagacaucuuuauaggaggaaaaugccauuaaaaauccucuauuuaccuugggauuuccucuauuuuauuagaacaggcuaugauacuuggagaaaauggaaagcagcagcguuuugaggccauggcaggguggcugccuuuaugaaccggugcaguaaauaacaguguggagaggaagugaaagaauuuggaaaaugaaauauguuuucuuccagagcacuggcguugggaacauuuaucaacugguagauuuaguuguuagaaauacuaaggaggugcuauucagcagaauuauuauuauuuuuuuuaauuuauuuuuuuauugauaauucuuggguguuucucacagagggggauuuggcagggucaugggacaauaguggagggaaggucagcagacaaacaagugaacaaaggucucugguuuuccuaggcagaggacccugcggccuuccgcaguguuugugucccugauuacuugagaucagggauuggugaugacucuuaacgagcaugcugccuucaagcaucuguuuaacaaagcacaucuucagcagaauuauuuuuaaauucaguauauuuuuggcuuuucucuguggucuuuugaaagugauauugaauaaucuuauuuucaguguuuauucccuugguuaaucuuaagggaaaguggcaaggaguggucucuuaauuuuuuuguuuuugcuuucaauucuuaggucugugguuuaccagcagaguucaaaagaaucugccacuuugcagccauuuuucacguugcaguuggauauccagucagacaagauacgcacaguccaggaugcacuggagagcuugguggcaagagaaucuguccaagguuauaccacaaaaaccaaacaagagguauguucacacuugauuuugaaccuuucuacuaaggugcucugguuugguggaaagaacacaaaauuaggaaugaggggaaauggguuugaguuaugccucuuaaaucaguugcuuaaccauuuuguacugaaaguuuuuaugguuuuacaaugaaaugguugaaacgugaucccaagggccucuuuuagcucuaaaucauauuacacaagguaaugaucuccuuuuggauuguuuaucuugagcuacauuuaauuuucuggcaaucuaaugaugauaucacaacaucaauacuaccucugacagaggccaaauagcuuauuuauguucaugauaccguaggguacaacugucauuagauuaguuaggaugucagagagauuccagacacaucuguuuugcauuugauuguagaucuuccaggucauuguaaauauaauauagucauuguaaauauaauauagucauuguucugaugcuuguuacucuuugauuugaucuggaaaagguaagauucuugagucuuucagucuucaugaauuuaagaguaucacauuauagcuugguggaguccuugucaacucaguugggcgagacggauagcauucugcccugugagagcuuauuaguuccuggcuguccagaugugccagcuuauagcuauuuuguacucugcagcagagagugucuucucuguuauauaucuuagguuguggcagugaauucauaaaaaugcacuggggagaugaaugcaggcugauaauuauggacgguccauagcauuccugcaaagcgauauuugaauaaugggcaguggauggcagcuacaagguaaaauaaggugccccaacguagaagaccugucaucacauugcaugacugggauggaucuauccuuggcuuaucuugugugcucugagucagaaagagcaaaguaggacauagggacccuuagcaccuucgggguguccugcuguggacugguucacccaggcucuggggggaucaguagaaguuaugccuaaucuucuaccguauuugcagacuugcaucucaugggugauuuuguuuaaaaaauagaagcaguaggagccagaggcagaaacuugguaguugacuucagugaaugagcuaagaagagucuggcgguggaccucguggaagagagagagggaaaaagugguauuuguguuggggagguugguugggugguucaguugugcauugugggugacugucggcuuggcucacuucuguggcagcugcaacuccagagauagcucccuggcccuggcugcuggugcacucugcuuaugcuguuucuugagccagcuaugggagucuuuggccacccaugcuguuggggagguggucagccuuuccaugggcugccuagggaagacccuuuugugaugugucuguuuuucucuuuugcuucugcugcaauuacaguuugacuuugcuggggugggcugguagggguggcggugugggggcagggguugaggcgcagguaguuguuagccuguuguuagacgguagugaagaaagaaugguuuauccuaaauagcagguuuggaugaaggcuuccagaaagaaggcgggccaggugugguggcucacgcccuuagucccagcacuuugggaggcugaggcaggaggauugccugagcccaacaguuggaggcugcagugagcuaugaucacgccacugcacuccagccugugcgauagugaaaccgugucucuaaaacauaagaagaaauaaaaauaaaggaaagcuggcauuuugguggacuccggaagauaaaaaggaugcugccagccguucugggugcgugguuguggugguguguuaccagaugaggccaggaccacuuucaacagcagauguuucaggaagauuugggacagcuuguauggaaguaucuauaaggagcaaauuacauauuuucuugaauguguuuuuuuuuaaguuuuuaaaaugccaccuuuaacuuuauuauguuuuagaucagaaguauuuuucugugggaacaugugaagguuuuggggaaaauaggauuauaugaaauauuugcuauauagaaaaugucugccuuuguugagugauuagaaauuaagccucaguuggcugggcgagguggcucacaccuguaaucccagcacuuugggaggccaaggcggguggaucacgaggucaggagaucgagaccauccuggcuaacacggugaaaccccgucucuacuaaaaauacaaaaaguuagccgggcaugguggcaggcgccuguaaucccagcuacucaggaggcugaggcaggagaauggcgugaaccugggaggcggagcuugcagugagccgagauagcgccacugcaguccggccugggcgacagagcgagacuccguccccaaaaaaaaaaaaaaaaaaucuccaguggcugaugccuguaaucccagcauuuucggaggcugaggcaggcggaucacaaagucaagagaucgagaccauccuggccaacauguugaaaccccaucucuacuaaaaauacaaaaauuaacugggcaugguggugugcacauguagucccagccucucaggaggcugaaucacuugaacccuggagguggagguugcagugagcugagaucgcaccacugcacuccagccucgaugacagagcgagacugucucaaaaaaaaaaaaaaaaguguuauccaaaugaauaugggaagcaucaaagacuuuguaaguacagagaaugauaaagggauuguuauuuguaaagaugcaucuuagugacaaaaaaccuggcuuuauuuaaaagcagcauucaucagaccugugaaaguacuucaggaacagauuacauugauaaaacucaugauuagaauaaauagcuuuaaagguuauuuaaaacaucuaauuggccuggaaucccagcacggugggagacugaggcgagcagguugcuuaagucuaggaguucaagaccagcugggcucauggcuguagucccagcuacuugggaggcugaggugggagaaucaccugagcccaggaagucaaggcugcagugaguccucaucaugccacugcacuccagcaugggcaaccagagugagauccugucuuaaaaaaacaaacaaacaaaaaaacccaccuaauccuacugguaucaguuuuaucaauacuaucagaguuauuuuaaaaugggucaauacuaggccuagcgugguggcucacgccuguaaucucagcacuuugggaggcugaggcagguggaucaccugaggucaggaguucaagaccagccuggccaacauggugaaaccccuucuuuacuaaaaauacaaaauuagccagaugugguggugggagccuguaaucccagcuacucaggaggcugaggcaggagaaucguuugaacccgggagacggauguugcagugagcgcagaucguaccacuguacuccagccugggcgacagagugagaacucccuccccccaaaaaaggcgggggagucaguacauaaauaaggugguacuaaguuagcuuuuuaauuuuuaugcuaauuugucaguaaugccacagaguaaaguucuuaacuuugaguuuacgacuggacuucagggacccaagaggcucucugcaguugugcuuaugggaacguaugcauuuuucuucuucuuuuuucuuuuuuucugagacaagaucucgcuguguugcccaggcugggguacaguggcgcgaacuuagcucacugcaacgucuaccuccuggguucaagggauucucuugccucugccacccagguagcugggguuacaggcgcccaccaccacgccuggcuaauuuuguauuuuuaguagagacgggauuucaccauguuggccaggcuggucucaaacucuugaccucaggugauccgccugucucagccucccaaagugcugggauuaaugggcaugagccacugcaucuggguaugugcauuuucuuaagaggagcauugguagaucucagagcuucuguggggcaggaaaagccaugaaguccugccacaggacucuugggccucaccucucagaggacgucuuugagcggaagguggaugugguguuagcuguugcaaguaagacagggacgguguguccuggugugcuuugugucuuagguugagauaagucgaagagugacucuggaaaaacucccuccuguccucgugcugcaccugaaacgauucguuuaugagaagacuggugggugccagaagcuuaucaaaaauauugaauauccuguggacuuggaaauuaguaaagguaaugcauacauaaggucgggaguguucguggugacacacuccugcacaucagaagcucaacccuguagcauuucuuuaugaugucaagagugaggacauucucuugcuggacguggacuuguuuuaaguuucuugacuuguaauagaccuuaauacuaaaauucucaugaaaauggccuguugaaaauagaggcaaaaauaacuaaacucuauaaucuuacuagauuagaaaaauagcagcuuuugucuaucaaaaagaacaucacuuuucugugaauauuucagggaugaauggugcaguuugccuuccaccgaguauuaacagcuguguugacuagcccaguuaagugguuuuuagugaaguaagaaugauuucucauaggcagugagagucccuucuaaccucuaguugugguggcgcacaaauaagacguggcacuuaccagccucaagucucugucaggucacgggcucggcacuuuuugaaagcaauuuuaaagagccccagguuaaaggcaucuugcuaaaagcacagcuucaagaagacuuuucuugaaagcuuuagaauuugugaaaacguauaguacaacacugaggcuugauugggacugugauuagcuagagaggauucucagaauaucgagguguuugggaagcagaaaagaggacacugggccucacuccuggguccugcagaggaacaaaccugaaccgagaguccucuucucuccguccccuggcacagcaaccccaccucauaccuccuuccauauagaugacccaggaacugugggcauggcuggcuucuagccggcucccugucuacccuaggggcgcccuauaccuucccgugaagacucagacacugucucucccaggccugcacacaagagcugugcuuucugcugacgggcuuggcugcugugccggguuuaguguccguugcuccucucacacuucuagcugccuuaucacucaucagccgauugcuuuuuaaucccauuugaggaccagcaagaggaagaaagaugccagugagaaucauguaacagauccuccuccccauuuuauucuauccaucgggaaaccuggaaugccggcuaagucaaagaaggcauccucggccucugcuccugcaucuucacucgccuccagaucagcugucugagcugacuuggauguuuugcuacagugauuuuauuuuuauaucuuuucuugcuugcuguauuuuuauauccgcugccaccuccaauacauuaucaaaauaugacauaaaugggggcugggcgcaguggcucacaccuguaaucccagcacuuugggaggccgaggcaggcagaucaccugaggucaggaguucgagaccagccugaccaacguggugaaaccccaacucuucuaaaaacacaaaaauuagccuagcaugguggugggugccuguaauccuagcuacuugggaggcugaggcaggagaaucgcuugaaccugggaagcagagguugcugagaucaugccacugcacuccagccugggcaacagagcaagacuccaucucaaaaaaauaaauaaauaacauaaaugggggacaagaggaccucacuugggucaugggucagaaguacagauggcugccucgaacagcaugccuccgacggacucuugugucgguguaagugguacuucugcgcacaguaagagcagggaguucccgccucguagcagcugguagacugguuccuauuuggagaaaucauguuacuguucuguaacugaaguuuuguuuuguuuuuuuuuuguuuguuuguuuuuuucuugcucugucacccaggcuggagugcaguggcgcgaucucggcucgcugcaaccucugccucccggguucaagugauucuccugccucagccucccgaguagcugagacuacagccgcgugccaccacgcccggguaauuuuuuguauuuuuaauagagacgugguuucacuguauuagccaggauggucucgaucuccugaccucgugaucgcccgucucagccucccaaagugcugggauuacaggcgugagccaccgugccuggccuguaauugaaguuuuaugaucugacgcauauguaaaauuuuaauucuugccuuggauuuuucacaacuguuuuuguuuuuaagucagcagcuuuuuucuuuuccauuuuguagagcaccuguuuuuaaggggccucccacaggagcaucacagccucggccguugcuccuguuucuuuagugagcuggcugcacauuuuguguccuauuacgucacauggcucauuuccuucaugagucaauuuuugugcaacugaagggauagaguguuguuuuguuccuggucugacaggcaguuuacuugcuggggagaauguuguuagccauuuucugcugcuguuacccugaaccuuucuaaaagugcuucaagccauugauauuuuguuuuccagaacugcuuucuccagggguuaaaaauaagaauuuuaaaugccaccgaaccuaucggcucuuugcaggugaguaaauuuguacgacauuacuucuucauuaaaacacugaugaagggguuuacagcugggcacagguuugcugcaacuuagcauagcgaccagaugcuguacucagguaucccuguggccuugugagucggggagucacgugagaguuuuaccugaaacucugcguagaugacggauuaucaucuuggcccugaggacagauaacagaagaccuugcucaaagcgaacauuucugucuuugagucagaggagggaguuucaggcucccaggcuggcuguuugagaaugugaccucucccggcugugcuuguggcaccugugggugacagugcuguggaguuuccacgacaccuggucacccagccagguugggugagcgcgcccccagccggugaucccugcguccucccccacagguauuguuagggcugcuugagagggugggcccgauuacacaagcuccucggcugccaggcccucagucagucaugagaaaucucccaacagggugaauggcacccccuguucccucauggguggaccuugagaccucuucugucuccuggcuuaggcucccugcaguaucauuuuuucugccacaucaucuucccuuuccuuucugccuucccuuuuauccuucuuucucuuuuauagcgucaucuuuuaugccucugagucuuuaccucuuuggauuguugcuguuugccgcacuuuuguuugcuucccaggcuguuuuuacuacauguuucuagcuucugugucuucccuccucugguguggccuuuggugaaccuguuuguaucguaacauaacacugccauuuauugaccuucacacauguauugaaccucuucccaagauauucuuucauuuccuuacauguguccuaggagaugggaggugggaucccuguuuuauaaaagaauaaaccagaacucaaggaagaaaacucaccacucuggccugcaguggcagagcagggcuucaagcuccuguccaccucagcucacgcccgauguuuuaggaaguuuggcgagugggugagggcccagggaugggggcccaggggugagggccuagcggugggggcccaggggugagggcccagugggugaggcccagagccacacugcaaggugccaggcuucccucucuuccucucacuauucauuguuccuuuugacucucuucuuuucuccccccgaucacaauuccuccucaacuugcugggccucagaugggacggccaugggcaccacgcgcuugugggugucuccagcccugucuggaauggaaggucugaguccucagacucugcagccagccauuauccugccuggcuccuuggaguguggcacccaggucccaguggguggccagcaguuucuccgccuucucccugcaccucuuccccuggaggcucuugcgggggacaucacugggcaggggcaggggcuagggauugcuccucuccuggucagggccccagugugagcacacacaccccuccccgacucugcaaccugccucgccccgggaccugggccuggguugcucuccccugcccuccugaauccucauccccuaacccauuauuuuuuugagauagaguuuugcucugucgcccaggcuggagugcaguggcacagucuccauucacugcaaccucugccucccagguucaagugauucuugugccucagccccccgaguagcugggauuacagcugugcaccaccacauccagcuaauuuuuguauuuugaauagagacgagguuucgcccuuuuggccaggcuggaagccuauucugaucuuggaaaugaggucaccggacugguuagaauuaccuguagagugagcaaaggaacacuuuuuaagaacugcugugauuguggggccugggagaagcaaucucgcgcacaagcuuuucaggcgguucucagcgcuccugucaggggggcuugcaggugugagugacacacggcucagcccaggguaguuaacugggcugcugcuuaugaaacuagaauggugacaugcagucccccuugacauuuuagaauggagaugucuugugggaaagacaaguuaguaaaacccccaggcccugcagauucuacugauggucgcuuugaagcaaaacucuuagcccagucaguuaggucugugaggugaagaucuaggacagaagucucaaagugaacuugggauccaggggacaugcugcugucaugggugcuuccugcccuuucacaagauggcugugacuugugcagcacaggaugaagcuaugcccuuggauuggcugugucccuggcucuccgaaguacgggccccacagucuugcugucccuaugcuguucagucuccuccggggucccugcacagaggauuucuuugugcagagcccaggagucugacugguggccucagucauaagcacuguccucuagccagccaaggucccuggcccagagaggacugaggccuccugcugucauuuagccccuccacgugacaacugcgacuagaaccuggugauguuuggucuuguuuuagugcugaaauucccuaccagccaagucuugcaucucuccugguuccuuuucuuuugugccacugauggugggcgcagcuuagcaggcugcccugucauuccccgcggaaugcugccggacagccgccuucccgaggcuggugucugcugcuggccaggcagaccugugccccucugcuccauagaaguggaggauguguucuguggcugucuuaauguuuucaugacaucuucuacagauuuuuuguuuuaggccuuugacuaaggcuucuugguuauaggauuuuuuuuuuaaguaaauaacuguguguguguguguguguguguguguuuuguucuguuaaaacauagaaaaauggguaauuuuuuuuaaaggcaaaugcguaacuaccagcaccaucuccgcagugccccaccacagcuccacgcucaagcaaccgugguuagcagucccagggucccuccugccaugugggccggcaccgggagauugugucccgugucuuuaggauagaugggccacagaaggccuaaggaccuuguuuucucauuuaauauaccauaagcguauucccgcaucaccauucuuaaucuauuccacgaaaaaauaaauuguguuauuuuaauauaauuuacucaucagucauuucuucuaguggcuauugagguuuuccguuuuuucacuguuauaaaugacaucauaaucucuguccaagauucagauaaucucuucaggacagucuagaaguagagucagccacauccaagggcaugagccaggucuguaggccuguacagcugauggcuguguaggagugucugugugaggcgugggacauuuuaaauaugugguuaauaugcguacaugcacacauguaccuaucugacuuacccuuaccuugcaguuauagaaaaguuuuuauuauggauugcuugcguguuugaguugaaauagcauugguuugugugaugacaucucucugucccaccugcuuuggagagggguuuuacacauaggaugcaucccuggagggaagucggcggagaccuguaaugauucgugugcagugcuguucucacucugcugccugcugggcucucuuccaguggucuaccaucacggcaacagugcgacgggcggccauuacacuacagacgucuuccagaucggucugaauggcuggcugcgcaucgaugaccagacagucaaggugaucaaccaguaccagguggugaaaccaacugcugaacgcacagccuaccuccuguauuaccgccgaguggaccugcuguaaacccugugugcgcugugugugcgcccagugcccgcuucguaggacaccaccucacacucacuucccgccucucuuuaguggcucuuuagagagaaacucuuucucccuuugcaaaaaugggcuagaaugaaaaggagaugccuugggguucgugcacaacacagcuucuguugacucuaacuuccaaaucaaaaucauuugguugaaacagacuguugcuugauuuuagaaaauacacaaaaacccauauuucugaaauaaugcugauuccugagauaagaaaguggauuugauccccagucucauugcuuaguagaauaaauccugcaccagcaacaacacuuguaaauuugugaaaaugaauuuuaucuuuccuuaaaaaagaaauuuuuuaauccaucacacuuuucuucccuacccuuuaguuuuugauaaaugauaaaaaugagccaguuaucaaagaagaacuaguucuuacuucaaaagaaaaauaaacauaaaaaauaaguugcugguuccuaacaggaaaaauuuuaauaauuguacugagagaaacugcuuacguacacauugcagaucaaauauuuggaguuaaaauguuagucuacauagaugggugauuguaacuuuauugccauuaaaagauuucaaauugcauucaugcuucuguguacacauaaugaaaaaugggcaaauaaugaagaucucuccuucagucugcucuguuuaauucugcugucugcucuucucuaaugcugcgucccuaauuguacacaguuuagugauaucuaggaguauaaaguugucgcccaucaauaaaaaucacaaaguugguuuaa

SEQ ID NO: 192947 - RNA, 89530 nt, Homo sapiens
gaugguuuucaauguuuuauuucacaaauuguucagauuuguucauaaaagauauguuacaggaacauuuuagaaaucaaaccaguucuacugaaacaauugcaacaacguggccccuguucaugcaaagcacaaaaaacauuuacaauaaaacuuuguacacaggaaguagcaaaauacaucauuuuucauagaaaaaagcacacacauaaacugcgggcugagugagccuacagacaauaugagaaaccagcacacgcuuuggaauacgguagggcaaaacuccuaaggaagccgaaaauguucauccugugggcaggagagccaggaacgccguuggcuugguacaagaucuuuuuaaacacaggguaaguguugguagcacgaggggccucuauuccacacacaggagagguggugcuagggacagggcuuaucauuuauagucuuguuuccauuuucugaagacaaauauuccaguuucaaaauguuuguggggaugauaaagacagccagguccauggccgggcgcaguggcucaugccuguaaucccagcacuucgggaggccaagguggguggaucaccugagguaaggaguucgagaccagccuggccaacauaaugaaaccccaucucuacuaaaaauacaaaaauuagccgggcaugguagcucacgccuguagucccagguacuugggaggcugaugcaugagaauugcuugaacccgggaggcggcaguugcaaugagcagagaucacgccacugcacucuaccuugggcaacagagugaaacuuggucucgggaaaaaaaaaaaaaaaaaaaaaaagacagccagguccugcucugggcaaggacuuucuauccugcuaggaaggcccagugaaggaggcauuaaggaacccggggacuuuauuuuuaaaugauggggucaacucacacuggaaguuucaagucucccuugagugggaugcuuuggaagcgagcccacugggaucguccuggacccuucacuaauucugcaaaccccacagggcgaucuaauuuaucuugcagacacagacacagccacaaaaguccagcagcagagcacccagcacccagaaguuucccagauguuuggugguaacuggacucacgaccugacaggcugaccgaauucuuccucuccgacauuuggggcugaggagucaguaccuaugaauuacgacuagacuacaaugcacaaagcacguaguccugugaauuuuagcucagucaagcuaagaguugaacugcuuuuuaccaacuccuuaaagggguggguuuuuguuuuguuuuaaaccuauuuaccuucagauucugcauuuauuagaaaggcaaucaaagaaagaaggcaucaccuaggugcccagguagaauuucuuguccagucuacaguaucuuaguuuuugacuuucugcuaguucuuucaccuaagaaauauuuugaaucaaauuugaaacuagcauucaccaaagugaucuauuggcuggcccggugguagagaguggaauuuucaccuucugcaaaaaaaugcuauuuacaaaaggguacuucauuucacugugggcuuuuggucugggcucaugaagcacuuuuauagagugauggcagccaggguguacuacacuccuuggcgccucgggaacguuuggcaagagucguuucacgaaaacaggaaaagagauccuucuaguguauucccaucucucgcugucaugaggccacagacgguuucauaaccacaaacugagcugcuaaccucggugaggaauguaccaaagacuccauuccucccacggcugaaaaaauaggucaucgggugcguggggaaucugcacauuuaauugucauuuuuuaaaagcagcaaagagcaggccuucuuugguuguucucagacaucucgucucaguggaaccuuacgagaccaggaguuaagacuugggcuucaaacagguucgcuugcaaagaaaaguccugggugugaaccaggacacguaaaccaguccgaggcagggugggagccacaacggguaggggguaaagaaagggucccgauccuuaguccucaaugggaccaaaggucacggcagaaaacaggugggccaugaagacgaagggccugacaaagacaagauacaucucugaagugacugcugaacucuacauaaaccagcacugcuguguauagagccauccugaaugcggccauugaagggggccuguggcgggccgccagcaaggacacgugccagggcggagccggggucucucauacccgcagcccucuuacucuagcccauuugucugucugaccagcaaacauuaaaaccauuuuccucuauugguagggacggacuguguuuuuuauuuuuaaauaacuaccuucuacuucauuccugaaacucauuggcgcuugcucaaaaggccucuuccgacgccgugaaugcuucacaauugugagcuucaaaugguuuguucuuuuggcagggagguugaaaucaacuuccuccaccaacagaagaacacauagcaaggaacauuuugggcaacuguccccuuuaagagacagcucagaucucuaaaggagagaggacguccagauggagacccccaggccccagcaggaucaggcaccagggaguccggcugagcaccuugggaugcuguugcuucagugaggggaugagaugucaccucacccacaggccacaaagugauggacacugaacaucagucaaaggaaguuuccugacucuccauauaccccgcaaugacaaaauaaaaauaaaagcaaaaccccgaagcccuccugaagacgccccuucuccccuggugcuggaaauucacugccugacagcaaagauccggaaggccuuuccaucccgaggaguccccaggcugaaaaaaagaagaaagagggcccguuacugagagaucuggagggccuccugcagggacucugggugggcagggagaccugggugccuccugcuugcucccguaguggaagagccauggccaagggacacuuccuugaagccgccagacacagagccugccuugaguugagaacagguggcaaaucccauuuucucugcacaugagcauccaucugauucuaggucaaggcuguuaaguuauuuccuuuuaacucagggaucugcuggacccagucugucuggauuggacucacccuccgagaauucugcuugguuucacuaccaccugucaacccgaacaguggugucuugggagagaugaacaggugcuaucucagcacuacugcauaugccaggugcuucaccgccuuccaccuuccuccugagggagcuguuaucgcucguucacaggggaggaaacggagacaccaggaaauaaagagauuuacccagggucccauggcuaguaaaaacugcccucucacaagaggaguuaaauccuucagcuaaucaaagaugguuuuuaaaaaagagcuuuaggccaggcgcgguggcucaugccuguaaccucagcacuuugggagugaggcggguggaccaccugaggucaggaguucgagaccagccuggccaacauggugaaaccccaucucuacgaaaaauacaaaaauuagccggaugugguggcaggcgccuguaaucccagcuacucgggaggcugaggcagaagaaucacuugaaccugggaggcggaggaugcagugagccaagaucaaggcauugcacuccagccugggggacaagaguaagacuuugucuccaaaaaaaaaaaaaaaaaagagcuuuauuggucaggcacgguggcucacaccucacaccuggaaucccagcacuuugggaggccaaggcagguggaucacuugaggucuggaauucgagaccagucuggccaacauggugaaacccugccucuacaaacaauuagccaggcaugauggugugcaccuguaaucccagcuaguugaagguugaggcaggagaaucacuugaacgugggagguggagugugcagugagccaagauucugccacugcacuccagccugggcaagagagugagacucuguuucaaaaaacaaaaaaaaaaccaaaccaacuuuauuaaguuuaacauaccguauaaacucaaccuuucuaaguguacaauucaaugguuuuuagagauuuuauagaguugugcagucaucuccacaauccaguguuagacaauuuuuaaaaauuguuuuagacacaaggucugucaccaaggccagagugcaguggcaugaucguggcuuacuucagccuugaccuccugagugcaagcgauccucccuccucagccuccugagcagcaugucaccaagccugauugauauauuuuauuuuuuguacagauggagucucacuauguugcccaggcuggucucaaacuccugggcccaagugauccuccugccucagccucccaaagugcugggauuaugggugugagccaccgugccuggccuaauggugucuuuuaaggcauaaaaguuuuaaacuuugauagaauacaauuuaucaauuuguuuucauuuauagauugugcuuuuggcgucauaucuagcaaaccauccaaggucaugaaggauuuauacuuguuuucucagacaucuguaauuuuuagcucuuacauuucagccuuggauccauuuugaguuaauuuuuauauauagugugaggcaaagguccaacaucacaguuuuacuuguaaauaucuaauugcccuugcaucauuuguugagaaauuauucucugcccacugaaugguccuggcaccgaugucaaaaucaauugacuggaagugugaugauuuauuuuauggacuuccaaucauuuuuuuuuuuaauuuuuuuuuuaaauuuuuuuuuuuaccuuuuuuugagaccgagucucgcucuguugcccaggcuggaguacaguggugcaaucuuggcucacugcaaccucugcuucccagguucaagugauucucuggccucagccucccaaguagcugggauuacaggugcacaccaccacgcggggcuaauuuuuguauuuuuagcagagaugggguuuugccauguuggccaggcugcucuggaacuccugacuucgugauccuccccuccuuggccucccaaagugcugggauuucaggcguaagccaccguaccaggcccaaucacguucucuuaaucucugugucuguccugaugucagcaccaccaucuugaucacugucgcuguauaggauguuucagaauugggaagccuaagugcccccucccgcuuugcuccucuugcugugggcacagccuucuagaacaccagggacgccugggagccuaccaagggccaccacggcugucucauucucuagauccucccugauuuucugccccagaugauaacugcaccuuuggaccaacuggccuuccugugucuuggccaccagguuugauacuguuccugacaauggccagaggugugugguuuuccucgcucugcuucaaaucaagaaagccgcuggauggcacagccccaccccaguagaacuuccagccacaggagcugguggggugaacaggagcggucccaggcucagacaccacagaucccucuguucuuaucugagguccacacuuuuuugaacaaacaccucccuguucguuguaugacucugugguguauuucuggaguccugaaacagcuguuuuugaacacugcuuuugggaauaagauuucccaugcauccugcuuuggcauucugcaaaucucaccucuggagcaugucuuccagacgcgagucuccaucccuacacuaacguuuaguaacugugugacaaagucacuaagucucuuugggcuuuuuuuuuuuuuuuuaaauuuuaagacagagucucgcccuguugcccaggcuggagugcaacggugugaucucggcucauugcaaccgccgccucccagguucaagcgauucuccugccucagccucucaacuagcuggaauuacaggcaugcgccaccacacccagcuaauuuuuguauuuuuuguagagauggggugucaccauauuggccaggcuggucucuuggccgggcuggucucaaacgccugagcucaugauccgccugccucggccucccaaagugcugggauuacaggcuucuaaggauacuuuccggaauguucugugacagugccgauguuggggguaccuggguucuugggggagguccaggaaggggccaggcuggagaggagacccggaaggugggaggaggggagcauuaaauugacgggaggccauuguuuuggacugggcuaggcccaacagaccaaaccaaaucagaucggagucacccugcuaggugccaccucaucaaacugaacuuagaaaugggcugguuuuaggccaggcacgguggaucauuccuguaaucccagcacuuugggaggcugaggugggcagaucacuugaagucaggaguucgagaccagccugcucaacacagugaaaccccuacuaaaaauacaaaaauuagcuggcugugguggcaggcaccaguaaucccagcuaccugggaggcugaggcaggagaaucgcuugaacccaggagguggagguugcggugagcgagaucacgccacugcacuccagccugggcaacagagugagacucugucucaaaaaaaaaaaaaaaaaaagcaaugggccgauuuuccaaaaaauaggagauacacagcaacaaccaaucaaaagggcccccagucccucugagccagcaggauaguguggccuuccugcuuuaauccuacaagaaaaguaacugggacgacccauccaaauuuuguuguuucuuuuuuuuuugagauggagucucgcucugucacccaggcuguagugcaguggcgugaucucugcucacugcaaccuccaccuccuggguucaugccauucuccugccucagccucccgaguagcugggacuacaaguguccaacaccacgccuggcuaauuuuuuucuauuuuuaguagagacgggguuucaccuuguuagccaggauagucucgauguccugaccuugcgauccacccuccucggccucccaaagugcuggaauuacaggcgugagccacugcgcccggccuguucaucguuuguacucucugcaugcagccuuugcugacucuaaaaccuccccucgcugcucaguucguggaagcaccuuucuauucuguacuugggauauugccugauacaugaauugcuaauaaaagccgauaagaucuugcaaacucgcauuuguuggaauuuuguucuagaaggcagcauggcgccuuguagaccccaaagcguuguucacagugugcaaccagggccaggcgcgguggcucacgccugucaucccagcacuuugagaggucgaggccggcagaucacuugagaucaggaguucaagaccagcaugggaacauggugaaaccccaucgcuaccaaaaauacaaaaacaaaaauuagcugggugugguagcaggugccuguaaucccagcuacuugggaggcugaggcaggagaaucauuugaacccaggagguggagguuacaacgagccgagaucacaccacugcacuccacccugggcgauacagugagacucugcaucaaaaaaaaaaaaaaaaaaaaaaaagugcaaccagugccaggugcaguggcucacgccuauaaucccaacauuuugagagguugaggcagguggaucacuugaggucaggaguucaagaccagccuggccaagauggugaaaccccaucucuaccaaaaauacaaaaacaaaaauuagcuggguaugguggcagaugccuguaaucccagcuacucgggaggcugaggcaggagaauaauuugaauccaggagguggagguugcaaugagccgagaucacaccauugcacuccagccugggcgacacagggagacucugcgucaaaaaaaaaaaaaaaaaaaaagugcagccaggaguguucuuuccacaucaaaauuaaaauggaaaagacuaaucauagccgcacauuuuaguuguugaacacacaauccuuaaggcaaaaaacacucucccucucaacccugucuuucugcaccaaguucuccccagaggagagauguuuagaucuuauguggauguuaacaauuauuauauuuuuucccucacccauuuuuucaacacaaauauuauauacauacugccauagacauaccacucugcacuuugcuuuuuuagcuuaacaauauaucucgggauuuguugcuuuacuauacagaaagaacucauucuuuuuauccacugcauaguauuccauuguaauaaaguguuauauuuaacuggaucccuauugguggacauuuaguucuuucuaaucuuuuuuuuuuugcgugugugugugugugugugugugugugugugcagugacaccaucaugauucacugcagccucaaccuccugggcucaagucauacucccaccucagccucaccaguagcugggaccacgggugcauaccaccaugccugguuaauuuucguauuuuuuagagaugggauuucaccaugccgcccaugcuggucucgaacuccugggcucaagcaauccuuccgucucagccucccaaagugcccggauuauaagcgcgagccauugagcccguguuuucuaauuuuuuaccuuugcaaacaaugucauuguuguccaugggacuuuuugcuuuugugugagggugccugagagugagcgccuaggaguggaauugcuggaccaaaggacgugcauuugcaucuugacagcugccaaccugcccugcauaaagauaacaccugcagacuccccggacaaugacaacggggcugugcgaugccucccagcgcugugugaugccucccagcgcugugugaugucuugcuuuugguucuugaccaauagaagguagggaguggcauccagauaucauuuucauuugcaucuugcucaugaugaaggaguuugaguauaagauuaacagccuagucaccauuucugggcgggguuuccuuuaggaucuccgcuccaaacaaagagagcccccagauuggaaacugccagacuagccaggagaccccggcccucucaggcugcuaagaucugcaauccuccgagagcaggccgcuuggaauuccugguuguuuuuuagcccuucuccauggcagcuucacacuuuuggcuacccuggaauugaacuuuugaaacguguaucagaugggagcacucggagagauggagcugcaaagaaacgccaagagccaagacccaggcagaacgcuuggccgcagguggcuccggaccaagaggaggagaaagaguggccaggggcuggggugacccuggcggcccugcugguuucuggaaaguucagauuccagggcccuccucaggccuugggggauguaagauuucccugaauucucuguccaagugaauauccugggagaaccaaccagggccacaaguuacugugguuauucugcauggggggcaagccacguuggggaaaauuaccaggggucugugucccuccugacuuacuaugggucugcagauucuauggacggugcaguggguucucauguucucagggccccaaacaaccaagggacaagggaaccauucaggcugccguccagauguagacauggccagcccaagggcccuggguaucuugccuggacaaccaugcaccccauuaaacaaccugcucaccuuggagguaagagcaggccccgacaagcugggcaaguauuuccuaacacaucaaagaaugugcugacaccgcccaggaugccaccgugcaacuggcagcaucaacuguuggugccauccaccgccacagguaaaaauucccgcagguuugggcaccaagaaaaauuccccaccuucaguguccccaguuguucaugccucaagcaguuauuaagcuccagguaugcuggggaaguugguaguuguacgugucugaugaauaacgaguguggcuugauaauuauaaaauacccuucccgcccuucuuucccaaaucuugcccucugauucucuuuuuggauuagcuuguaacucccauacaugccugaaggaguauaaauugcugcaguauuucuggguaauuuucauaaaagguauuggacuuuuuaucaaguguaucaagcaacuuucauaaagagcacuaaacaacuuugauacaggguauugaaaaucccucaggcggggcacaguggcucacaccuguagucucagcacuuugggaggcuaacguaggcgauugcuugaacccaggaguuugagaucagccugggugacacagugaccccugucucuacaaaaauaaaaaaauuagccagaugugguggugcacgccuguggucccagcaacuagggaggcugaggugggaggauugcuugaguccaggagugcaauggugcaaucacaacucacugcaguugaggcugcagugagcccaggaguacaacggugcagucacagcucacugcaguugaggcugcagggucucacuuauguugcccaggcuggagugcaguggugcaacugggacuauaagugagaaauaaaagcccucaaccaacucugaaccaauugcucaacucagcaaagucucauucaaccaguguuuacugagcaccugcuaugugccaagugcugggcagcaucagggcugugggguuaacaagaccagugaggcucuugccuucaggaaguuuacagucugggguggggugagaaguagcaaaacauaugcaagaaacaguuucagaaggugaugagucaggggaaaugacacagauccaucagggagcaggagacaagugcaggcuggaugguggagaacgcugccuagggaggggccauuucagucuaaaacagcccaggaacguaugagagcccagaggguaccagacagcagcuacaaaagcacugaggugugcaugaucuuggugcagucaaggagcagagaggccagugagguggaaauguaggaggaagaugcacagagagggugggggagcgggcaggggccgaagcagcugcggccuugaaugggaguggggcggauuugauucuuaguacaauggaaagccacuggcgggggagccuuacacaggaaaggaugugcugacuuuuuuccuuggugcgacacugugcauugcauuaggacagcacuuugguggcuguggcuguucugguaagaggaagucaccuaaauaaaucggcaagaaagugcacaggcuugcgcaaaaauguucuuucuaguguuguuuauuacagugaaagaaaaaaggaaacgaucugagugucaaucagugaugauaaacggaugauggucucuccaugccuccgaaucugugcagccacugaaaccacgguguggcuagacaggcuagggcuugaagagcuagccacaauccgauuaacaaaacaauacuaauagcauaaucccuuuuuaaaaagcguguuuaagccgggugugguagcucacgccuguaaucccagcauuuugggaggccaaggcaggcggaucaccugaggucagggguucgagaccagccuggccaacauggcgaaaccccgucucuacuaaaaauacaaaaauuagccgggccuggcagugggugccuguaaucccagcuacuugggaggcugaggcaugagaaucacuugaaccugcggggcagagguugcaaugagccgaggucaagccgcugcacuccagccugggcaaaacagcgaaacucugaaacuccgucucaaacaaacaaacaaacaacaaaaaaaggcguguuuauauguaaacacagaagaaaccugaaagaaaauacacuggaauguuuacagagguuguuucuggguaugggaaguugagugcuaugaagaucuuaaaauuauuuucacuauauuguugagguuucucuagucuuuuugagacacggucuugcucugucaccgaggcuagagugcaguggugcaaucuccacucacuguagccuccuccaccuccuggguucaaucaauucuccuaccucagccucccaaguaccugggacuacaggugcaugccaccaugcccggcuuuuuuuuuuuuuuuuguauuuuuaguagagaugggauuacacccuguuggucaagcuggucuugaacuccuggccucaugugauccucccaccucagccucccaauguaccuggauuacaggcaugagccgccgcacccggccuagaaaggcccuuuaaaggccagaguaaaggggcaggaacaauccagggacucucugaagagcuccccagaagcacggggcucccuccuagaggccagccagggacaggcacguggggcugcaucccccucaauugccuugaaagugaccugaggaggaagagcuugccuuuuggcaucacccaacacacagacgggauuaaggaggguggacggccgguucugguuccagaggcagacagggaagcugcccuguggaguccugaagccagcacuaaaaggacggcagaagaggaaccccugagugcuuagucuucuggcuuuuaaaaaguguaauuuauuuuuaauuauuaagaaauaucauuuauauguauauaacugucucuauauguaugaguguacauacaugacuguggacacagaugcucccugacuuacggugggucgcguccugauaaacccaucggaagucagaaguccacaucggaaaugcacugaauacaccucgccuccaucacagcucagccucgccuaccuuccgugugcucaggacacugaccuuagcccacagcugagcaaaaucaccuaacacaggccuauuuuacaaggaaguuaguauaaagaauuuucaaucaaaaugcaaaauuugaaguaugguuuuugcugaauacauauggcucucacaccauuauaaaguugaaaagucauaaguugaacgaucuuaagugucuaagacugucuguauauguguaugugucugugugugugugucucucucuauauauagucuuuuuuuuuaaaggauuccaauccuggcugggcacgguggcucacaccuguacucccagcacuuugggaggcugaggugggcggaucacuugaggucacgaauucgagaccagccuggccaacauggugaaaucccaucucuacuaaacauauauauauaugaaaaaaauuagccaggugugguggcgggugccuguaaucccagcuaccugggaggcugaggcaggauaaucacugaacccaggaggcagagguugcagugaguggagaucgcgccacugcaucccagccugggcaacagagggagacuccaucuccaaaaaaaaaaaaaaaggauuccaaucuuguucucccagagucucaccccucuauugaucccucaggaaaauuucaaaguuagacagguacagguuuagcucucaucuuuaggaccuugggcugguuaacccuuuucucugagccucaguuuccccaucuguaaacuggguuccucaaagugcccacuccuuagggacacuguaaaaaguccaugagccucuccagggagguaccugggccagaggcgagcauccagcaggugcucaguagccgggagcuacaaaugccaucgccccugcuagguuuaaaccuugcccucccuucaaagugagaaugugggcaacgcaggcuggguaugcacaaguggugagugaacuauccucacaaagcccacacucuagggaacugucaaaccucuucaucucauuugaugaaauauaucauuauucuuaggggggaaaaguuucagacuagcacguauaauacaaucuccguuuugauuuguaugugaguuuuaugugcacgggggaaaaacaggucaagaaaaguuauaaaucagcaguuaacugagguuaacagggcaccuguugggacucuuacuuuuugcucucuggauguauuauuuaaauaauaaguauguauuucuuguaucguaaagacaggaacaaguauaucuuggcauucaagggucucccuggccccuucuugggaagggucugugccccaaguucaguggccuguccaggcugaggaagucaugagugcugcuuaaaagcauggauucugguacaggcggccuagguuugagucccagcucugccccugguaggcugggugaccuugggcaagucguuuaaccucucugugcuucccuuccuuuacugauaaaauagggauaaugacgguuccuacuuugcagggcuguuggggaaugagaugugcuaacgugugcagagcugguggaaguuuggaauacgaguggaggaggggaaccugccugucugcuaucagcagcuccucugcagagcacagagaaccucaugucccagccucggggcagccuggcuugggggagagugcagggcuccuuagaucuggaaaugauagcuuaguaucuucuguuucucaggauuucuagacccauagcgagaucuucagucaccugacccuugagauucucggugcugaguugucuaauacaguagccaccagccguggguacucacugagacccaaaaugggcucguccaaauggagaugugccuaagggugaaacacacaccagaucuccaagaccuuauacccaaaaaagaauguaaauuucuuauuucuaauaauaauuuucuauugauuacauacugaaauaauauggauauauugggauaaguaaaaugcauccuaaaauuucccuuccauuacuucuuccuuuggcuucuagaaacuuuagaaucccaugugugcucacaucauaucucugcugcacuugccacagcagaccacaccccuaugaggacagggauuuuucucucuucuguucccggcaguguccccagucccuagcgcaggggcugcccaugaguguuaggugaaugaauuugcgauucagauggcugugcacccauauauaccuuuguauaaaggugacauuuuaaaaaaucaaguggccaagaaugcucacugucauuguuuauauauuucccaaucucuugcaaaaucuguguuaaaaaaugguucuggucuaagaaaaauucugaacugacauucacccagauguccggcauuuccccaagaauauucagacaccuucgucccaguauugaaagcucuuccugaugucuuuucuuuccuuugauacccaggugggcaggggugagagagcaggugcuagucucuuauguugccucauuucugcauggcugccuuucaaaacguccaggaaguccucuucuagaggaggaucauugcuaaaccaaaaccacugugaagcagaacugaccuucggccccgugugcugagaauccuguuuggggguuuuggugguuugugugauugaaggauucccuacauuuaaaguacaguuugcugugaacuggucacaguauauacaacaucuacgucucccuugggacugccugugaccgcccccucgccaagggcuuaccagccgucagggacagagccacccucugacuccaggcuggguuuccacagccccuauugggaauaagcuccugggaaauuucccagccucugcuuugugcagagaugguggcugagaucccaccuaaauaaggaaaggacagggcauggccacacccaggugucucugcaggguucucuugggagccauguccccaaggaguccccucuggacaguaagacuagcccucuugaugccucccugaacugucccuccacaacagugacccccugggcccugcugcuggcauugucauuucugcacuguguccucucacuagauggcaaaucccaugacggcagaggucugcuguugugcucccugugggauccugggugccagggacaucgucagcgcucccuaaguguaugaugccugcauggagugagcguuggaaggauggaagcaaggaugaaagaaugaauuccuggaagaucccugaccccucauccugagagauaagucauguaggccauuucuuaggauccagccaccugacccuaugagaaaagaaccauggcaucuuuugaaguuguggcaacaggugccccuggguuucaugucaugcuuacugugagccgcuagccgagggcuggacacacaccucucacauaauucucauggcaacccauuagagagaggagcugccaaggcccagggagacugcccaaggugacccugcuggggacugggggagcaguguccccagugcagcgggcgccacauacugucccggccaucacccuguugggggcuccagugcucacuccccuucugagcugugaguucuagggcucaaucaucugugcccugggucccagcacaggugcgugaugaauauucagugaaugagugacuuuuuuuuuuuuuuuuuuuuuuugagauggagucucgcucugucacccaggcuggaguacagugguggaaucucggcucagugcaaccuccgccuccugguuucaagcgauucuccugccucagccucccgaguagcuggcauuacaggcgugcaccaccaugcccagcuaauuucuguauuuuuaguagagacggggcuucaccauguuggucaggcuggucucgaacuccugaccucaagugaucugcccgucucgaccucccaaagugcugggauuacaggugugagccaccacgccuggcugaaugacucuuaguagcaaaauaauaucagaaucaaggguauaaaaucuugaagaugcgguguguuuuucacacuuaugcacaucuccaaacgggcucaggauaagcccauuuuaggucucagugagcacccaccguugguggcuacuguacuggacaacucagcgcugagaaucucaaggguugggucacugaaaaucccucuauguguccagaaacccuaagaaacagaaacuauugagcuguuauuuccacaucuaacaggcucugcacucucccccaggccaggcuggagcaagggugggacgugugugcugacugacuugugucagguuugccagguucgcgugacucuuagaacggcagcugucacagucgagcaugcagcacgaugcccccgaggaccugcucagacgcaggcugcugggccccucccagagauuccgauucagcagagcuggguggggccggaggaugugcuuuuccaacaagcucuggguugaucuggacacuguuggccuggggaccccaccuggagaccuccugcccugccaccaccccagggggcagguaauauuauuccccccuuuauaggugaggaaacugaggcacagaaaagcugaacccaagcauuaucacagaugccaguccacaggacggaggagcagagagucugaggagcaagaaaagcaaagucuuaacucuggaaaugcugcagaaaaucacuaaaaucuuucuagaguacagaaggcaccagugacaugugugcuugggagggaugccuggaagacaccuacaaagacagcgacaguggcgauuugggugggugucacaggaagagagaaagaccgacagccccccacacccugggugauaguggggcgggugggaaagcugcuucgggggccuucucuccaucccugcccuccccaggggccuaccaauggggcccccacaaugaggucccuguccccagcccacagggcacugcugugauguucucaugaaucagcccgacagggaacaaaucccagcuggcugcgcugcucaggaagacuguuuucucucaaagaggguacaaagagcucaauaaauugauguccugggauuucuuuccagcccggccaggaaauuccuccuaaucagcugcuucauuucccucccauuaaaucaguggaauuucccuucauuaagcuuuucccaaucaaaggccgcacgugcugaaggagaaaacguggaagcugucuacuugggcucuucagggcugccgauggcagagucaccgggcaggggucccgggaagaaugggcacgaucuggguacaagugaugcuguggcaucuucacagacagggcaagcccgcugcacaaagugcccaggaggcuggcaguggaagcaggggccgugucccaggaggcaggaaggccugagcguccaggggcccagggcaaguuacagccuugauuuuauuccuucucuaaagaacgucccucaaauaugaaaucuucaacauugcccuguuacgagcucgccuguggucccucaaaauccauauguuaauguccuaacccucaagugcaccucagaaugugacuguauuugcagaucuuuaaagagauaaucauggcggccgagugcgguggcucacaccugugaucccagcacuuugggaggccaagccaggcagaucaccugaggucaggaguuggagaccagccuggccaacagggcgagauccaaucucuacuaaaaauacaaaaauuagccgggcaugguggugcaugccuguaaucccagcuacuugggaggcugagugcccuuucugaaugacacucaggaaaggccccacuuaggaauuucacuucuagggacuuuguuuggucuuuuuuucuuuuuuuugagacagaguuuugcucuuguugcccaggcuggagugcagugacacaaucccggcucacuacagccucuaccucccggguucaagugauucuccugccucaccugaccucaggugauccacccaccacugcuucccacagugcugggauuacaggcuugcgucaucacacccggcccacuucuagggauuuaaggaaacagucacggugugugcaagcauuccuggagaagacuacuuacuaggggaggaucugcucccugggauggaaaggacucacaccagcuacgaagagaaacgcgcuacagucauucacagucacuaccaaugacuuauggucauagauuuccauaaagguauggucucgaguggaaauacggaguaaucaacauaacccucauuugcagagugcuucuuacugccacuucuuuuuuuuuuugagauggagucucacucugucgcccaggcuggagugcgguggcgcgaucucagcucacugcaagcuccgccucccggguucacgccauucuccugccucagccucccggguagcugggacuacaggcgugugccaccacgccuggcuaauuuuuuguauuuuuaguagagacggggguuucaucauguuagccaggauggucucgaucuccugaccucaugaucugccugccucggccucccaaagugcugggauuacaggcgugagccaccacgcccagccacugccacuucuuacuggcaauagguaggcaccauuuccguucaccucccaacagcccuguggggcaggguuuaugauuaucccuauuucacagaugagaaaacugaggcucaaggaaaucagguggcuuacucggggucacaaagcugguaagaaacagggcccaggucuguuggacuccaggcucccuaaucuuauuuaacucuauguaacuauauuacgauguagcuuuauaugacuaguauguaacuaucauuugaucccauuuuuuugugggaaaaaaaugcacacacacacacacacacacacacacacacacacacaaagaaaaacaaccggaaggacgcacgccaagaaaucuaacaguaaauucucccagcugaugaguuauggaugacuguuuaucuucgggcuuaucugauguuccuacagauuauaaauuuucuacaaaaacguccauugguaauaggaaaaaaaguucuuuuuuuuuucuuaaucccaaaugugauaguagggaaaagcauucccuaguuucaaaaacaaaagaaagagaaaagcaaagaagucucuuaccugggaguccugguaagaauucgugcaagucuacccgaguuuuauuuuaaaggguaaugacucugggccucuucccaggcccccugagggaccauuagcagccgggauugggugucaaggguuggagaacaccacccuaccuuucagacugaacuccauuccugagcgagcccacguaggucuucuuuuuauccacgggcaucacguccacgucacccccacucucguugcugaugacucccgcgugcacggcugucuugcagaugcuugaggucuggaagcacaggaagggcugugaucagcgaugcggauuccagcucaugggucaagccagcuggggcuccaucauucacugcugggcaaccuggcuggugggauguggaccccaucaacccuuaggaaauaaucaucacuaccuugaugccuugggggucucuccagagagacuggacaucaugcauucauucauuuguucaacaaguguuuucuaagcaccuauuauaugccaggcacggaauuaggaacugggggaauucagcagggaacaagauaaagaccuugccuucaaagagucgagugagcaaauaaauaaauacacaaaugagguagcaucggcuaugaagaaaacaaaaccaguucacaagguuaaaugccuggguggcgggggcuacuucagaauuguuucaucagggggaacugcucagggaagacagaacgacauaaaggaaacagucacagccgugggaaugucucugcacagagcaucccaggcagagggaaaggcucgugcaaaugcccugggguggauauaaacucaucauauccaagaaacagacagacagccaggguggcuggaauacagugagucaggcagagcguggcaggaggugugggcaggggccauucaugccauguagacuggacacaggguggcgucuggacuauucuagguaccaagggagcagcuggguaccucgcagaggcaggaugugcugguuucugacaucaucaaggaguucaguuucugggugauaaaaccuuccaggcucaagggauccucccaccucagccucccaaguagcugggacuacaguuguguaccacaacaccuggcuaauuuuuaaaaauuauuuguagggacaaggucucgcuguguugcucacgcugguccugaacuccugggcucaagcaauccucccgccuuggccucucaaagugcugggaugacaggcaugagccacugcacucggcccaauuguugguuuugaagauggaagaagaggccaugagccaaugaaugcagguggccucuagaagccggaaaaggcaagaaaacggauucuccucugaagccucuagaaggaagcagcccugcugccaccuugauuuuagccuggugacacccacauuggacuucuggcuuccagaacuguaaagauaauaaaccuggguuucuuuaagccaccacgucuguggugauuuauucuaacaguaauaggaaccuaacagcuucuaaccacuguccacaaaaaugucccccacuguggguggaucuagcgaucugauuuauuaagucccuuaagucugaugacuucaauuuauuuauuuauuuaucuaucuauuuuuugagacggaguuucgcucuuauugcucaggcuggagugcaauggcgcaaucucagcuuaucgcaaccucugucuccuggguucaagugguucuucugccucagccucuugaguagcugggauuacaggcacgcaccaccacgucuggcuaauuuuguauuuuuaguagagacacgguuucuccauauuggucaggcuggugucgaacuccugaccucaggugauccacacgccucggccucccaaagugcugggacuacaggcgugagccgccgcgcccggccugacuucaaauuuauaggaaauagaauccccaggagaaugacaccauaagugucuggacaacaggcucacccaggcucacggacucgccugaucaguccccggcagcagcuugcuaauuuaaggaaagaugaaaagcuggacccguugucuacagggcacgaagacggacuccggucuugccuccauucacaaccgagugaugucacggccguggcugucaguggacugagcccccaggcacuuugugguucaaggguggggagggugaacggggcagacuccccauauucuguccucccugcacguguaguguagagacagaggccaccaccagcaggucugagcuuaaaagcuuaacccccaccaaugggucacucagcaggagggcggggcugggcuaugucaccucugaaacgcuccccucugcacaauacccgagccccaggggucaucggggagaagaugaagucccagccacugguucaccaagcuggugccuccuucaagaagagagcaagacaugguggagaagaugaagcugggaugauuucauuuauaggaggcauccaaagaagucaaauuccuggagacaggaaguacaggggcuggcggaggggaagcgggaaguugcaguucaguggguacaggguuucagauuugcaagacaaaagaguucuggaggucgaacccauuacaacgugaauaugcuuaaugcuaauaagcugugcacuuaacaaugguuaagaggguaaguuuaauguuauguauuuuuuugucgggggacaggaucucacuuugucacccaggcugaagugcggugauaccaucugggcucaucagagcuuugaccuuccgggcuccucccaccucagcuucucaaguagcugggaucgcaggcaugcgccaccacgccugacuaauuuuuccauuuucuuuagagaugggguuucaccauguugcucaggcuggucucaaacuccuggccucaaacgauccucccaccuuggccucccaaaaccucaggauuacaggugugagccauugccuggcuuauggugaauuuuuuuuuuacuacaacagagaggggaguggggagcuacacccaagcucagggagccauugcagaaguaaucagugcccccucgagagaggccagcccaccaccaucccuggcacagucucauagcuccuuugucccguccuuaccacuguccucggcccauccgggggccccggaagcauugcuaaagccaaagagagccugugucucaggauccacuguaaaagcacaguuugucuggaaaaugcacccugagcugcccuuuaaaugggacaagcaauacaaucuagcagguuccaggcaugagggaaugaagagaggcgggcucuuugaaaauaccaauuuggccggcgcgguggcuuacaccuguaaucccaggacuuugggaggccgaggugggcagaucaccugaggacaggaguuugagaucagccugaccaacauggugaaaccccaucucuacuaaaaauagaaaauuagcugggcauggaucaagaugagccugggcaacauagcgagaucuggucucuacaaaaaauuuaaaaacguuagucagauguuguggcacaugccuguaguuccagcuacacggguggcugaggugggaggaucgcuugagcccaggagguugaggucacagugggcugugauggcaccacugcacuccagccugugugacagagcuccagaucccaucucaaaaaaaaaaaaaaaaaaaaaagaagggauccaacauucccacauuaacaaucauaagccuauucagaaaaauaaaaaacaaaagagaaaaguggagccaaaacacacauucauaucaaagaccugaaaaguggauuuccugcuuuccaggauucauuuaccgaguaacugaaggccacuuucuaaaaacucugugcuaacaugucuucaucuucuucaauaaauaaacuaaacggaugagggcgggguuccuuagcccaaagcggggucccggguaucugggaggcccuggaguugcaggcagaaggccguggaccugcaggggcugaugucagcacaggacacaggaauccccucagcccuaggcaaaccggggauggccggccucccugucugaaccaggacgcauuuucccccuuuggaggaaagauccacaacuucucaauucucaaagagcuuugugcccugcuaaagacuaaggagcaauaacuuugcauccaucucaaagagaagcgaggagacuuuaagaugaagcgaccauuucagaauuccucuaaaaucgccgugagcgggggcgaguuugguaagcgaacacaauuaagcucauuguucuuuccggcaggcggaagccuuggugcuuggauacguucucacacuugugcuuguuucagaauccacccccgccccuacccgagggcuggagcagauuuuugggucccacugucagcguucaggaucaaugguugauuggagccagagaaucugcauuuccaacaacaacaacaagaugaaauaagaccuccaggcuuucugucucucucagcauugcucgcacugccaacugcugcaguaccaggagcaaggcccaggcuguuucccaguggaacgccaggagggacccaucccuucggugucacaaacucaaccucuaaaagcccuggcgggggaggggcacccuccugguugagagcugccaagagguucugguuggcagccccagaggcggugcuuugacucagucccuggaggauuucuggacacaaaagugacacaaaaguuuucugugauaacaucaagcugcagggcgucaguacgaaaagcucacacccauggccggaucuuucucacuccacaggcccgguaccgccccguuaucaauaugcacaucucccacgcaaacaccuuuccuccuuucuuccuuccuccacaccucuccucucacaggcuucaguaaaagggacaaggcauccaauuccucuccucagggcccacugcaacaggaauaccugaguauuuacuaacaauugacauccaugaagcugguaaccaauccugcauccagcgccggcuggcugugugacuugggaugaccugugugaaccccagagccccgccuuucuccauauaaagcagggauggucacaggucauaucuuuacaugucuuuguucuaugcauuucacgugcauugacacagugaucccaguaacucugccggguagguguugucauuaucaaucgcuuugaacacucaggugacugaggggcaggggggcucacaccuugccccaaaucacucagcugauaaagaucagaggcgggacugccacccggagccagcaaucuguccacugucccaccuagggugaugacagugaggaagaagaggguuacugugaagauuaaagaagggcugugugugguggcucacgccuguaaucccagcacuuugggaggcagaggcaggcagaucacuugaggucaggaguucgagaccaaccuggccaacauggagaaacccugucucuacuaaaaauacaaagauuagcuggguguggguggcgggcaccuguaaucccagcuacucgggaggcugggacaggagaauugcuugaacucaggaggcggagguugcagugagccgaggucacgccacugcacuucagccugggugacagaguaagacuccgucucaaaaaaaaaaaaaaaaaaauuaaauaagaccccaggcuuaacgcaggauggcacacagcacaugcucaguaggcgucagucaagacaaaugccaccuccaugauugucauagucaccaccacaauagaaaauucccaagggauugucaucgcuagcccagugguccucaacaugcaguuccagaccagcagguucaccugggaacuuguuggaaugcagauucucuggauccacccagccccacugauccugaaugcugagggugaggccuagaaaucuguuccagcccucaggcaggcgcggggguggauucugauaugugcacaagugugagaacguauccaagcaccaagugggauggggaggacagaagacugagguucagaggaggggaaagguugccuggcuucccacaacuggcaaaugucaccgccguggcucagcucccugggccacaccccgaugcuucugucugcagcucaccacacagcgaggggucugccaggaaaugcaguccuggugaacaggcgggagccgcaggcaggaacaggcccuuugaaggucuggaggcaacucucccaaaaucaaucucuuagcuaaauagacauuuuccaaaagccaucaucauuucccagaauacagugaccuagaaacugaggccagaaaagaaccucucacacggagguggcuuucuuccuucccuccuucccucuucccuccuucauucuuuauuuuuuuugaagagcuacuuaaguacugaguacugcaguaucuucauuuauuuauuccuccaacaaacaaugauugucugucaagcccugucaugagcacaguggucccaaaagcucaaaauccuagugaaacuuguuaaugaagacugcacauagcuuuuuccccucacgccuguucauaucaguguagcuaugaaugcagguaacaucaagcaaggcagcauacaccagggaaagagcagagucgaaagccggacacauguucaccuguuugucaccuuugccacgugcucacuguguggauuuggacagguuacuaugagccuuguuuucuuccuacaggaauaaggauaacgauaccuagagacgguguuuuuaaagaaaggaccuaaaacauaguauguguugaauaaaagguagccuucuggcugggugcagaggcucauguugguaaucccaacacuuugggaagccaagguggguggaucaccugaggucagggguucgagaccagccuggccaacauggugaaaccccgucucuacuaaaaauacaaaaauuagcuggguguggugacgggugccuguaaucccagccacucgggaggcugaggcaggagaaucucuugaaccugggagguugcagugagccgagaucgugcaauugcacuccagccugggcaacaggagugaaacucuugucucaaaaaaagaaaaaaaaguagccuucuauuguugcaaauauccauuaaguucuugcuuuuuuuuuuuuuuuuuuuuuuuugcuuuauugguuuagcugcuauauuguuugguguguacaguuuuuauuccuuuuccuguaaauuguaucuucugugccauuguguaacauuacuuugucucauucaguacauuuaacuuuaaauuccacuuuuucagagaggaauauugccacucuugcuuuucauguguuuguuuguauuuggcugggauugcuuugcccagcucuuuauuuuuaaaucauuugaaaaccucagccucugucucuuaaugguagaauuugguucaaacauuugguguaauaaucgacaauauuauuuuacuccuucauaaaaauucuaacucuuauaacucaauuuuagcugaaucacuuucaagaagaaaaaaagacccauuuaaagaggaaagaaaaaagauggggggagauaagcuuagucaugaagccugcucugaccuuacagagcccagugaccucauauuuacaggaaucuggaacacauuaaggcagacagaggcaaagaugauggcggggaagcgggagagagcuguaaaggaggggaugaugacaagcagcugaguaaagcucuaucuggaggccgggugcaguggcucaccccuauaaucccagcacuuugggaggccaaggagggaggaucgcucgagcccaggaguucgagaucagccugggcaacauagugagaccuugccucuauucagaaaauaaaaaaauaaaaaacauuagcuagagaugaaugaugcugcccuaaucacagaauuuuagaucuagaagauucccuggauuugauaaucccgguucugggccguuccgccacaaggaaacagcuugacaagaucacacagccugcuggcagcagaagugggaccacagucacauugucugggucaccauguccccaaacccuggacaaccagagggaacagacaauguucugcaggauccaccuaagaaaaaccgggcuaaagcucccugguuaaaauucggagggaaaaaacagaggaagagauugguauaaccagaguggcuaucaacaagcaguaaauuaggguggucuguauuaucuucuuugugcuuuuagcuaagugugugcauaacugagaagaaauacagugcguggaccaguuucuauaaaugcauccggagagcugggaagaugacuaaauagccggaaaaaugaacuaucugaagcaugagagccuucaaacugcgaaaacauuuaaguaaggccaggcacuccugaaucugcauuugugaggacagguagguagaagcacuacuaucucuagaaauggggaaauggggaaaauguuugcagaaaugaguggucuaaacuuagcuaagagguuggccggguguggggacucacaccuggaaucccagcacuuugggaggcagaggugggcggaucaucugagguugggaguucgaaaccagccuggccaacauggugaaacccugucucuacugaaaauacaaaaauuagccaggcaugguggugcacuguguaaccccagcuacuuggcagguugagguacaagaaucguuugaaccugggaggcagagguuacagugggccaagauuacuccacuguacuccagccugggcaacagaguaagacuccaucucgaaauuaauuaauuaauuaauuaauuaauuuagcuaagaggcacuggaauaaaguuucaaguauccagaucuuggagcuugcauguugaggucuuuaacaggcuuugcgagauaguuguugaaaaugcauccuacucacaucugcauagauguugguuccaaacaccggagcccaguaggaagguucgucuuugcagugugccggacaauggauucugaaaaacaggaagcauuuaugugaugggucugagcacagaaaaccaaacuucuuaagcuggcucucuuuauuugaauuccaagauuuaaguucguagaugaaaggaaaccgccauacaguuuuccucauuaagaaaaaaaacaauacuucuccccccucagcagagguaaagauauuacuauuuuugcuucucuuaaacaguguagauagaauuuuuaaaaacacacacacauccacaaaagacaugcacaaacaaaaagguaaagagaauaaaaaucuaagagagaagaguguggaauugugaggcugccccucccauucuuggauguuggcuaguucacacuguggguacauuauggagauuagcaucaagagacuuuuucuaaggccgcuucccuguguggaggaggaaaggguggagggcccucaccucgcugagucacagaauauuccaaggcgggggcacugauaaccugggguggaagggguuagaucacugugugucagucaccacagauccuccagggcaugaggaaagcaccucaaacuggaaaugggugaccccugggugguuugacaaacucaagccaggaaagagcacgggcuuuacuuaagaaaagaucuucuguguuuaucuggaacaguccaccgugggcuggagcccagggaccaagaaaccaaaauggcagccggaagccaucuggccccaggcaggcaggauuaugggaaggaagaaggccaggcaaagggacugagaaguugaaacaguucuuaggggcugggaggaagggaaaugaguggguagagagaaaggguguguguguggauuuaaaaaaaaaaaagaaggccaggugcaguggcucacaccugugaucccagcacuuugggaggccgagguggguggaucaccugaggucgggaguucgagaccagccuggccaacauggugaaaccccaucucuacuaaaaauacaaaauuagccaggcgugguggugcaggcccguaaucccagcuacgcgggacgcugaggcaggagaauggcuugaaucugggaggcagagguugcagugagcagagauuguaccaccgcacuccaaccugggcaacaagagcgaagcucagucucaaaaaaaaaaaaaaaaaagaauuggaaagagucuaagaacagucuccauucuuuccuacuucuuuuggaauggcagaucagaaauuaacauuuugcauauugcacugugucaaguuuuucuguuuguauuuucugaaauucuuuccuucugcuucucucuaauauucagggaaaaucuacuaaaaggcuguuauccccacucgaacauucaagggggaucaagacgguggugcggaggcaguggaggcccagagaaagccugaagugggguggcagucaagggaaagcagucugggccccucccaaccagucacccuccugggccuuucccugcucggaaccuuggggucaccaccuauugucccuuggagaauccacaggucuccagcccaggaugagggcucaugagggccacaccacccagccuccagggcagcugucuucauccucaaagcauuucaacccaggguccugggacugucauucuauuucuaauucuacaauggagcuaagucagaaagcgugcucuguuugaagggcagcuuagcauuacagauguauuauaugaucugaacccuggggaacaucuauaaaguggggacgucccagagaccugcggccuuuuccaccugagaaggugccucagccgauucaaauaagaggauguuccuguguucccuucccaagaggaucuaccaggaacuucagcgacagcuguucccaggacacccuuuauuuuaugcugggaggcaucguccuccguggaccacucauuugggguuagcugccuguagaaccgauuccugggacaaacccguugucacguauccacagaauggaaugcugcaugaggauuugaaagaauaaacaaacacgcuccacaacacggcugagucuccaacacaugacgcagagugagaagccagacacccaagaccacacccugccacggcgccauaauuuugcugaaaaagcaaaaucagagcaacagaaagaagcucccuggugcagggguguggccgggagcuggagggagagggacuggccaccagagcaguaaugacauucggugcugacaaugucuacacuuugacggguggugguugugacccuguauaccuuggccaaaacacauuguguacuuuuuucuuuuuuugagacggagucucgcucugucacccaggcuggagugcaguggugcgaucucggcucacugcaagcuccaccuccuggguucacgccauucucccgccucagacucccgaguagcugggaauacaggcgcccgccaccacgcccggcuaauuuuuuuuuuuuuuuuuuuuguauuuuuaguagagacgggguuucaccguguuagccaggauggucucgaucuccugaccucgugauccgccugccucggccucccaaagugcugggauuacaggcgugagccaccgugcccggccacacaucguuuacuucuaauggguggaucguaucauuuaccucaauaaagcugauuuuuaauuuguauuuuauuuauuuugggacacaguuucacucgucacccaggcuggaggacaauggcgugaucucagcucacugcaaccuccgccucccagguucaagcaauucuccugccucagcuucccaaguagcuggaauuacaggcacccaccgccauggcugacuaauuuuuguaauuuuaguagaaaugggguuucaccauguuggccaggcuggucacgaacuccuggccucaagugauccacccgccucggccucccaaagugcugggauuacagcugugagccaccucacccagccuaaaaagcuacuucuaacaucuuccauagaaaagaugacagaucaggcccgccuuaccuugggcagugaguugcuggcuuuucaaacgggcacagcugagcaacggucguguagcaguccaaauccugcacugugaacaggagcaagggggaaagggucaggucccagcacgccugggccucaggcuaccaggcugugcaaugggccacuagacuaccagggccuauggguucccugggcccuugaauagagcugggacuacgacccagcaggcuccucguaccccacguaggggcacuuaagagaugagaccaaacccacggccugcauguguuggcggguugagggcguugucacccccagugguuucucuguggggcugauggugcuuuucaucugaauggugacuuucuuauuuggaagcuuuuccugacuugaucaccuuugcuccucacagcagguguuacucuaaguaggcagaugaggaaauggaagcucagagagcucagagugcccuucccaggacugaggugggagcccagcuuuccagugccugcucuagagcuccuucugacauaccaccuaccuccugccgcuaaucaaggcacauucaucccugcugaggggcgaggggcuuuuaucuucaaggucauuuuguuguguuuaaacaacacagguaaggaaacaguucuaauacuggccaccugugaucucugacagcaugucuuuauuuaguucagggcuaaguaaacuuuuucuuuuucuuuuuuucuuugagacagaguuuugcucuuuuugcccaggcuggagugaaacggcacgaucuuggcucacugcaaccuccaccccugaguucaacugauucuccugccuuagccucccgaguagcugggauuagaggcgccugccaccacagccagcuaauuuuuguauuuucaguagagacaggguuucaccauguuggccaggcuugucucgaacuccugaccucagguaauccaccugccucagccucccaaagugcuaagauuacagguggaaaccacugcaccggccuuuuuuuuuugagacggagucucacucugucgcccaggcuggagugccauggcaugaucuuggcucacugcaaccuucaccuccuggguucaggcaauucuccugccucaaccucccaaguagcugagauuacaggugccugccaccacaccuggauaauuuuuguauuuuuaguagagacgggguuucaccauguuggccaggcuggucucaaacuccugaccucaggugacccaucugccuggacgucucaaagugcugggauuauaggcgugagccaccgcgcccggccagguaaacuuuuucuuaaaggaccauagagcaaacauguuuggcuuugugguccuuauguuugaugucaagauuaaucaacucugcuguuguagcagagaggagcuauagaugauguggaauagguguaacuguguuccaauaaaacuuuauuuacaaaagcaggcaauaggcaggauuuaacccaugagucaucguuugcugaacccugcugguccagucugucacuugaacaggccaugguucuauauagcuauccaacaaaggggacugguuuaguacaucaagggacuucuauucaauggggagaucauucacauuagguuuggaagaacauuuaaagcaaggguguccaggccgggugcaauggcucacgcauguaauccuagcacuuggggaggcccaggcggguggaucaccugaggucaggaguucaagaccagccuggccaacguggcgaaaccccgucucuacuuaaaaaaaaaaaaaaaaaaaaauuagcuggacaugguggcgggugccuguaaucccagcuacucaggaggcuaaggcaggagaaucacuugaacccaugaggaggagguugcagugagcugaaauugcgccacugcacuccaggcugggcgacagagagagacuccaucucaaaaaauaacaaaauaaaaaauaaaauaaaaaaagcaagggugucuaaucuuuuggcuucccuaggccacacuggaaaaagaauugucuugggcuacagauaaaauauacuaacacuaaugauagcugaugagcuacaaaaaaaaaaaaaaaaaaaaaaaguccaugcauaaaucucauguuucucauguuuacaaauuuguguugggcacauucagagucguccugggcuacaugcagcccaugggcuguggguuggacaagcuugauuuaaaggcacagaaauauauuccugacacacacacacacacacacacauauguauauauuuuuuugagacagggucuugcucugucacccaggcuggaguguaguggcaugaacaugacucauugcagccucaaguuuccaggcucaagcaacccucccaucucagacuccgaaguagcugagauacaggugugugccacccugcccagcuaauuuuguguguuuuuugcagagacagggucuugcuguguugccagggcuggucucaaacuccugggcucaagcaauccucccgccucagucucccaaagugcugagauuacaggugucagcugcugcaucagccagacacauaauuauuuaagaaaaaaauuagguuaccaaauuguauguaacuccauuucaaguuuuaaaagucaucgauguauauauuaccaauguacauacuuugaauauguagagaaaacaaacuggaauauuugccaaaguguucacgaugguuaucucuggcugcuggaauuuaggucaucacuacaaaaaaauguuccacuccguguuuaaauuaucuggaauaaacaggcauucuuuuugcaauaagaaaaaaaacuacuacauauuuuaauaaagauaucuaacuagaacuuuugcaugagggcaaaugauaagaguugcugucccaaaacaaaggcauggucugccggcagagcuccggggaggaagcuggaauggcuccuacauccuugcuugccugagauuauucuagucaagggcacagugugggcagcuaugauccaucccuucacuucugguuggagugugcucgcccaucgugcaucccaccuuccaaaugaacauacacuaagcaauguaaaaagcugggccagagauggcaaguaagugccacacacuucccuucacuucccucucuugcucauggcagacauuacuaaucuaucaagcucuguuuuccacuaagcccagauggaggccucagaauccuucuuaacacaacacuccagguagccauuaccaaucgacagaaaguggcacucccagugaaaccucucagccacuuuagccccaggcaucaguaugucugugacauucagcuggcaaccucagcccuguguuucugguucagugaucucaggccaauuuccaguccagauauucuuagaagcugguuaaagagaugacgucuugaaaaaggcuugacaaugaugagaaccauaauguucacacgcaugauaaacauuaaaucagcgacuaaaggaagugaaauuuccaggaaaaucugagauaacccagguauuauggucgcaaaagagacuggcuagcuuaccuuucacuuuugacaccaugaaugagcuggaagguuuguauuugcuguuuaaaaaaaaaaaaaaaaaaaacgggcauuagguaaaugcaaauagaauugcuucuaaaagugaacgcuugcuccuauacuuaucuuauuugcagucucgacuucacacuuuucuacuuguuuccuaucagccugagagcucuuagaauguucuagaccagggcaucuuaacuuuuuuuguaccaaggacucuucugguagccuggugaggccuauagaucccuucuaagaauaaugguuuucaaauguauaagauaaauuuaaucuaaccacagcugcaaaauaaagaaauuuuaagaagauaaauuuaaaacauuacaaagaaguuauuauuaauaucaugaucaaauuauaaaaacacauuugcauuagaguuagagcuguggguuuuuuuuuuguuuuuuuuuuuguuguuguuguuuucuuuuuuuuuuuuuugagacggaguuuugcuguguuggccaggcuggagugcagugacacuaucuuagcucacugcaaccucugccucggccucaagcgguucuucugccguagccuccugagaguagcugggauuacaggugccugccaccacgccuggcuaacuuuuguauuuuuaguagagacggacuuucaccauguuggucaggcuggucuugaacuccugaccucaggugauccaccugccucugccucccaaagugcaggugugagccaccacgcccggccugugugguauuuuucaaaauuucaacaacaccgucauaaacaggaaaaccguuucacagagccccgaucacagaguaguuaccugagggacugcacgccgugucucucagacuucacgaagaaggggaccuucccguuccuggugauauccaccaggccucccuugucauccaggaucccguaguggauggcggcgcggcauaugcuagacgacuggcgggaagggaagagaagaccagaggcacauucucaaccucugucagcaaguuucaccagaaauacccaaacauuuguccucaacucacuaaaagccugaaggacaggccaaagcucacucugcuccugccucucgccucugucuguaaccacauauuuguuccugggguugcuuaccuuaaaaacucaucugaguugcuuuacaaacuaagaagagugacaaacaucccuuucucccugcucgguccagugugugaaugcucagucuaagacggagacuggccuucaggaggauugguccccgaaaguggcuuugcuaguuuguaagcccauaaauauacacccgccccaguucuagaaaugccagguuugacuaaggaguggaaagaaaaucuuuuccuacuaaagccaaccaccugcuuuaaacauaugcaacaggaucccacacaagccauugagaggaggacuggccacacucacgcuuucauagaacagaguuccaaagaucuucgccuugugguucaggcagccugcugggcacugguaccugacgaggaagaaauaaaaugauguucagagauaagcacguugauuacaucucacaaugaguuuaucauuuuuuucaucgauggcucuauuacuaaauauagaaaagcuucauucauguggauuccauuguuuuuggacaagucagacuuuacccaggcgcagacugauucacgcaagcacaauacagucgucccucgguauccgugggggauugguuccagaacuucccuaggauaccaaagucugcagaugcucgagucccuuauguaaaguguccuaguauuugcguauaaccuuugcaucuuuucccauaugcuuuaaaacaucucuagauuacuuauaauaccuaccacaagguaaacgcuauguagauaguuguuacacuguauuguuuuuaaaauuuguaucaguuuuuuauuauuauacuguaauaccacacacuuuuuaagaaauauauuuuugaucugcaguugguugaauuugagguugguugaaucagaggccgguugaauccacagaaauagaaggucaaccauagucuuuuuuuuuuuuuuuuuuuuuuuuuuuuucucauuugaaaaaaaacaaggccaggcacaguggcucacaccuguaaucccagcacuuugggaggccaaggcagguggaucaccugaggucaggaguucaagaccagccuggccaagauggcaaaaacccaucucuacuaaaaauauaaaaauuagccgcgugugguggcaggcaccuguagucccagcuacuugggaggcugaggcaggaaagucacuugaacccuggaggcagagguuacagugagcaaagaucgugccacugcacuccagccugggcaacagagcaagacucagucucaacaaaccaacaaacaaacaaacaaaaccccaagaaagagucugacuccaucacgcaggcuggagugcagcagcgcaaucacagcucacuguagccucaacuuccugggcucaggugauccucccaccucagucucccaaguagcugggacuacaggugugcacaaccacacccaacuaauuuuggggguuuugccauguugcccaggcugguuucgaacuccugggcucaagcaauccacccaccuugaccucccaaggugcugagguuacaggcacaagccaccaugccuggccugcaaggauuuuuuaauaggguaaaacucaaugaugguguugcuguucauggaaguguaaaucacucuaauguuuaagaaaaucuuuaagaaagacuuaaacauucauauccauuagcucuucagcuucccuuguaaauauauauuccaagcaaaaagucaagaaagccagaccugcaagcauaucccaacuauuuauuuaucauuuuuuaauuuuugagacagagucucauucugucacccaggccagagugcaccaguacaccucggcucauugcagccuccaccucccagguucaagcgauucuugugccucagccucccgaguagcugggacuauaggcauaugccaccauguccagcuaauuuuuguauuucuaguagagacaggguuucgccaguugcccaggcuggucucaaacucuuggccuuaagugauccacccgccucggccucccaaagugcugggauuacaggcuugagccaccguaccuggccgcaacuguuuauaauggugaaaagcuggaaauaagccagcagguggcaaagcaauggcuaaacacauucauguacagucgugugucagaguaucaggcagucacuaagcaugaagugcgugaagaauauuuggaaaauacuaagugaaaauacauaagcagccuaggcgcaguggcucacgccuguaaucccaacacuuugggaggccaaggcgggcagaucacuugaggucaggaguuugagaccagccuggccuggugaaaccccaucucuaccaaaaauacaaaauaugagccgggcaugguggcgugugccuguaguuccagcuacgcgggaggcugaggugggagaaucacuuaaacccgggaagcagagguggcagugagccgagaucaugcugcugcacuucagccugggugacagagcaagacuccaacucaaagaaaaaaaaaaaacaaaauacaugggcagcauuagccucaucuguacacagaaaaaaagacuggaaggaaauacaucaaauugcugcugguauugaugagauuuuggaacacauuuuuuucuuucuacuuuuuuguuguuguuauugcuuuccugaauaauuauuaaugagcauagaugccuuuucaagucagaaaaaaaacccacugacuacuauuuuuguaaaagcaccaugaacagaaaacaggugugccagacugugggccggcuucuacagagagaaugaggaugcucccacaguggcacacuggggcugaguaacuuuucuugacuggaggccuuuaagagccuuuguguggacagauucuugccuucucccugcauggggagugccccacccaccccaacucuggaacugccucgauguugucugacaaggaauguucuccaauacgugcucaccuuuuuccacugaguacuacucaggggugaugcuaucgcaaugugcuuagcauucagaaagaugcguugccacaaaaggacaacuccggcuucucagcagcccagacggggcagugcacacggcggaggccccugccaggcgcugccugcuuuuucccaauucgcccagcacagagacaugcaaaugcuacccuaacacugagcgcgagguuuuaggcacuguuauuccacugcugacuguugacacaugaggcucaucucaccaacaaacgacaguaccacaugugagcccacugagccgccucaucccggcugcuccaaguccaucucaucacaguccugccaacgucuaagugaaguguucuccuggcaaacugaauuccaaacccuugcgauauaaaaccgaagauucaaccuucccuuuuuaacaugugcuuuaaauaacucgauucagcuuucggcaaacugaugccagaauucguaggaagacgagcaagguccccucucccaaugacaugguuuucccauuugacucugagggugugcgugcggcggcugcaccuguuggcuguuuacuaccacaaagaacagcccagcagucacacugccaaaaccaaaugcguucuuuuuggcagacagcguucaucaucugaaugacugcaacaacuagauggauuuauucaucuaccauggggggaauauaccgguggcccaucugucugguggggcccacugggagcagccugcucagauccugcagcauucccauaggaucugccaacggccgaggcgaacacaugcccagacacugcccagcccuaaccccuguucugccugcugagagcagcuugcuaaauaugcaacagcaggacagcccagcauaggcccagaggccacagugguaggacagcccagcacagacucagaggcuacaguggcaggacagcccagcacaggcucaccuguuacacguggacccuuugcaccuguccuucaucuuggugucacaucugacgacuugggcuaggagagaaaugcgggaauacaugucacggcacgaaaccaggagggugagaagacccuuccccaugcugagggacauucuggaacauucugcaauccaauccgugcuauacuaagagcaagggcaaugccugaugguugcaggcuuccgcugggggcucagaccccaggcccaccgcuuuacaguagcagugugaccuugaacaauuugcuuccccucucugagguucaauuuccgcauauggacaaugcggacagugacaguacccaccuccaagggcuuuugugaaccuugagagagaaagugaacucuggccuuggcagggugccuggcacacacgaugugccuguggucccacagggcucugcagggcaggacuccugagaggguagggaggaugcugcuccgagccuguggggccggagacccagccaggcucacccgagucaucucccccaucgccaagaugccuuuugcaaagcuuuuugcuuuguuuauuuuaugggaacauaucagagucucggagucguguuauaguuugaaaagggacauaaacguuguauguuauuaaaagaaacaauggcaccguuuugaacuccuggacagacaagggccuccgcagguuuccuggucaaagcaagcuacagaaugcuucggcaucacagggaaagagguuugaagaggacagaaagacuggugggggcaggggagaugguaguuaugaaaagaagagaggggcucugagaaggcgggugugaggcuguuccucaaagagggguccaguuuuagggccuuugaggcuugcggggcaaacggggagagccaagggcauccagcccagcccuccagccccgccugagcaaaaacgccccuccacagcccccggccugcagaaacggcggcugcaaaugaguucccgcagcaguggcuggggggagcugaaggggagcugaacuccacccuggggcggugaaggcagacagaacaaaagcuuggggagcugaggugcccagggagccaaaaggccaaaggugagcaggggaagagucaauauuuuggggauuccuggaagucccagggggaaacaucucccuuucucuacuaaaaauacaaaaauuagcugggcauaguggugggcaccuguagucccagcuacucagggggcugaggcaggagaauugcuugaacccggaaggcaaagguugcagugagccgagaucaugccacuggacuccaaccugggugacaagagcgaaacuccaucucaaaaaagaguuguaggcaacucugcaaugaucucaauguacagggagaccucagcuggcacugggugacccguguugcugcagcucauccuccgggcaaccuugauguggcaucucuauccccuacuucauggaugcgccaacugaguccagacccaggaccuggugagaaaggaguggaaccuuccagagccaggcuggacgcugccugcccucugcagggccagcgcuucccagaggaacccaacuucagcccaggucccuuuugaaaggacaagggaaggucuaaccuuaaaauaccugccuggguguggggaaaaugccacccaagcacaaguccuauaaugcucgcuuuugaaaugacuuaaaaauaucguuuuugaaaaacgucuuaugguugugccuccaugagcuucgccgcacccuguuugccacugccuguggauuugcagaccuaaauccacuagcuccccuccuccacccaccccguccccuuuggagguggcugggagggcaggaggggcggaggacggccuagacucacucauguaguugaccgcagagguuuucuugggcuuggugggucucaucacccucgguuggagccaaacaugguuuucuucaggaaugggagccguuuccaccucauucaucucguccguuucagguuuuggaguguagguuucuucuuaacauuggagagggaggaaaaaaaauaacacacugggauucaacaaaaacgcacuuuggggaaaaaaaagcaauuugaaaacuaaacguguuugagguuugguuuuacaaagaaucauuucagcggcaaagagaaaguuacauuucagaacagaccuggccagguggaauucuaccagcccagaugagacggggacgcucuccgcucacuguguuugcuuuggacccaagaucagccaggcugcccagagguuagcaggccccacgcccacaccuggguuaucauaaugguuucuugucccaucuccuccuccaccugacccucugcccccacgaagcaacuucaagaagcugccucaggccgggugcgguggcucaugccuguaaucccagcacuuugggaggcugaggugggcggaucaccugaggucaggaguuugacaccagccuggcuaacauggcgaaaccccgucucuacuaaaaauacaaaaauuagcugggcaugguggcggacgccugucaucccagcuacuuggggggugcugaggcaggagaaucgcuugaagccgguagguggagguugcagugagccgagauugugccauugcaguccagccugugugacaagagcgaaacuccaucucaaaaaaaaaaaccaaaaaacaaaacugccucggccacuggcccaaagccauaguggacuugcuggaaguccccugucccuggguuuucacuggggaaggggucuuccucaucaugcacacaucacggugcacaaggccagccucagugcuccuagaccccaacugcaccucacaccagcccacuuccaucccuucucuccuccugccagucagggucacuuaaccagcucaauuguugcuucuguacuggaguuuuacuguccaauaaugucagacucaacauguagaacuauccaacuauccgaaagaacaaucuuuuccuuauucaaggacaugguauauuauuauuucuccaacuaugaccaugacccauguuuuaaaacauuuuaauuaaccaaacacauugcacuuaauaaaccugaguuagcuuaucuuccaguuuucauccugaaagacaacuacaaacugcucaccagaaucugcaaucaggccaccaggauaccaauuuguaaauuccagcuaaagcaaagacacugcuauuuucauuugccugagcggccugaucaaagacaaauucacgagcauaucugcuggggacacuuaauaccuuuacuuauggcaugcuccuccuaugccccaacagaagucuuuggaccagaguuggaaaccuguggccuccaagcuccccaagcaaaaaaggcaacagauguauuugggugaaaacaauuucaaggagaauaacuagagcacgcucgcaggucucuuugugguuuuggauuaaaauccaaguuucagggccaggugugguggcucauaccuguaaucccagcacuuugggaagccgaggcggguggauugcaugaggucaggaguuugagaccagccuggccaagagggugaaacccugucucuacuaaaaauacaaaaauuagcugggcaugauggcgggugccuguagucccagcuacuuggggggcugaggcagaagaauugcuugaaccugggagguggagguugcagugaguggagaucgugccacugcacuccagccugggcgacagagcgaaacucugucucaaaaaaaaaaaaaaaaauccaaguuucaucagguguuccucaaucccuaagucuuagcuccacuucuuaaaauacaugagcuuucuuugcuaaaggacacagcaaguauuuuguguccacacaauaccaaacagccaaacgaggggcaaaugccugacucccugacgccuuccugggcugggguucuccauagcugcuucacuggccaauuucacuacccuacaaccaccaccccaggcugguccugucccacaaggggaagggacggguuuaagucagaaggugggaagccauucugagcuccaauucuaaucuuggaugugcucacgggucacccugcacuguuccccagcagcuugcucgcaacugucauuuccccaccaccugccucauccaccagcugcgaaccuccagaggccaggggccagccugccucacaccuggcacccagcacacagcagcugcucaacaaaauucacaaaugcaugaacuaccaaaacccccagagaauccugucaccuaaagaaaagagcauauguccagcaacagagcuuaaagacauucaaagagggaacucugaaagcaccucugguagcaaaagcuauggguggaagcuucaggaagacaccggguuugcagaggcugcccaggcgcgugucuguucuucccgucaaugaggcuauucaggcuugcccucacugagagcgggagcuggcuggagaauaagccggguuuucuuccacuggccuuuaggauguuuagaccucauaaucgcagcuuuauuuagccgaagacaguuugguaaagcggucuaaagcauuugaggacucucuauuuaagaaaaugggcagacagacaguccuggcucucacacccacaaaugaaaaguagaaggcuuuacccgcaggaugggcuggauccgaguaccuccuaaugaagacaccuuguauggcccagcacgggccuggggaaauuccgugcagaggucacggcaagguuauucugugccccauucugcuccgggccagggucucagggcauuguuuaugucacucugcagauucccuucuggcucuaaagcuggugaccaugcccggagcuaauguucacugagcacuggccagaugcuggcugggcccuccccggcaugcauuuuucuuucuuuucuuuucuuuuuuuuucucucucucuuucuuucuuuuuuuuuuuuuuuuuugagaggaaguuuugcucuuguugcccaggcuggagugcaauggugugaucucggcucacugcaaccuccgccgcccggguucaagcgauucuccuaccucagccugggauuacaggcaugcgccaccaugcccggcuaauuguguauuuuuaguagugacuggguuucuccauguuggucaggcuggucucaaacucccgaccucggugaucugcccgccucagccucccaaaguguugggauuacaggcaugagccaccgcgcccggccauccccagcauuuucuucugucaaccucccauuugccuucagaggcaugauuggccacauuucacagaugaggaagaaggcucagagaggguaagggcccugcccaggcucgcacagcugggaaguaccugggcugggugucaaaccaccuuuccccaaagccugcgccuucuaucaccacacaggugggggugagaggggagaauaccucuuuuuuuauauccuuaucccugcuccaucuccguuagaggucaaggccuuaccaggcacccuggauaugcucuugguaaauagcuucugcagauaagcugcuucagaggagacuugcugcgugcuuagcuagagaaauugggugucugccaaggaaaguuggauacuuucuaccaaaaauuuaaaaauaaguacaugaagcuauguugguggagguaaacuggcaucuaagguuucugugcacauuuguucuuugaaaaugccccucuguggcuauuggcauauuuauucaaacaacacauaagacaccccugccaugugccuccggaggcccuggagugagcuggcagcugagacgacaggacgaucaagguucccaaggagucuggggguugaugaacauggggcaggugcacugucuggcugugaaguccaggaaggcucccuggaggcgggggucacaccaagacugcaacaggugauacaugacccagacccagauacauggucugucuuaguguccagaucgcuccuucuuccauccccauccccacuuaggauguccccucuccccagcgggcagucagccaugaacagcuggcugggacaacagaggaccuggcuccucagagggucugggaccacugaucuagcccacuuguucuucacuccagaacccaccagccugaucccacaucuaccccacccuucccugccagcggagcccacccaagucucugcaaggccccucggucauggcaaggcugccaguggagccacguuaaaaaaaaaaaaaaaaaaaaaagccugggccacacgagcauggucagcaccauggaccagccaugccccaucggggacauaacuucugaaagccugaggaaauaucccaagacaugagaaacgcuuuaggcaccagaaaccuguguuauuuauaguagcagaaguggaaacauccuaaaugggaaccagugaagaaauggugggcgggcaugauggugcacgccuguaaucccagcucuuugggaggccaaggagggaggauugcuugggaguuugagaccagccugggcaauauagugagaucccgucucuacaaaaaauuuuuaaaauuaaccaugguggcaugugccuauagucccagcuacucgggaggcugagaugggaggaucccuugaggccgggagguugaggcugcagugagccaagauuacgccacugcacuccagccugggcaacaaagggaggccaugacucaaaaaaaaggugaacuagguagaaaaucgcaccgccccaacagcuccaguucugagagcugugggagugggggcgagaaaccucuagcacagucaggggagcaccagcaagacacaugcauaaaggggaggccaaugggggcaaggacacaggaguaaagggucaaacagcccgggaggacugauccuacccagcuguccacauugcagguacuucccacuagugagcucauuuggaauaucacguuguuugcuuuuacuuucuuguucaaaugucuguuuuauguuuuuagaguuggggucucgcuguguugcccaggcuggagugcaguggcgccaucauggcuuacugcagccucaaacuccuggacucaagcgaucuucccaucuaagccucccaggccacagccaggaccacaggugcacgugaccacaccugguuaauuuucuauuuauuuuuuguagagauggguucucgcuauguuguccaggcugaucuagaacuccuggccugugaugguuaauacugagugucagcuugacuggauugaagaaugcaaaguauugauccugggugugucugugaaggugcugccaaaggagauuaacauuugagucagugggcugggucuuggugggcaccaucuaaucagcugccauagcagcuaggauauaaagcaggaagaaaaaugugagaaggcgagacugccuuagccucucaaccuacaucuuugucccaugcuggaugcuuccugcccucgaacaucagacuucaaguucuuuagcuuugggacucggacuggcuuccuugcuccucggcuugcagacagccuacugugggaccuugugauugugugaguuuaacacuccuuaauaaacuccccuauauauauauauccuauuaguucuguugcucuagagaaccccgacgaauacagauuuugguaccaggagugguucuagaggaacacaauauuaaggauggaguucuuucauugguuuuaggguuucuggaguuggcugcuuaauaugauuagaucccaaaaugcuaaggacucuacuucuaauaguauggagaacacugggaguccuuggcaugagcuauuuggagaguuaugcacaauaaaugcauuugacacuccugauucagcgcuccugagaggggaguucagugacucuagacugaauaccucugacuauauguggagaaccaaggaacauaaugaagcugauugguugcuucuaaguucaccggacaaagugaugaaagaaaaugaugaacucagggauucuaacuuccggcuucagaagcagauacugagccucaaaucugcuaagauuaucaugagugagucuuaucuccuguagagaaagagcugaaauuguggaaaaacagacacaagcucuucucaugcaaguggcugaccugcaaugaaggugcaugcacagacaccucgcuaggugucuacuuauuaaagugagggcauugauuggaaaagaauggggaagugugggaggacccugcugaagcuagggacacugagcuuguaaaugcugauaaaccuuuuuugccagaagaaacagguuccccauccccaguaguggcaacgucuccuccccgacccacgcugcggucagccuuuccaccuuugucugaggggauaaacccugcacugccugaggcgccugaggcagcugccaggcaagauaaugcugauucuccucaggagccaaccccaacaucccuguuugcuucuagaccuauaacuagacuaaaguccuggcgggcugcuagaggugagguucggagugugacacaugcuacacucgaaaagaacugcuugaauuuucaaauguauauaagcagaaaucuggagaauagucaugggaauggauauuaaggguguaggauaaugguggaaggaacauagaguugaaucaggcugaauuucuugauuugggcccacuaaauagggauucugcauuuaauuuaauguugcagcucagggaguuaaaaaagguucuucacuguuuuuauuugcuuuauuugcuugguuagcugaaauauggauuaaaagguggcccacugugagugaacuggaaaugccucaucucccuugguuuaauguggauccaaaggcuuagggagauugggaugguagaguggauuagucauuuuggaccuacucauuccagcugggagaauccagaagauauacccuugacuaaugcuuugugaaauagauuuguaaaggcagcaccugcaucuuuguaauugcuuuuuucuguaugucagaucuaacagugggaaccacagucacucaacuacaaaauuuaaaugcaaugggaaugauuagaucccaagguggcaggggccaaguggcagcacucaaccaucaaaaguaaggugggcauagcuaccguaauggacagcagaggcaaagcagcaaucagaauagucuggcucguguagaguccugucauuggcuaauuaauugugcugcuccuagaggugaaauugacaggaagccuacuacauucccacuuaauuuacauaagcagaaaacuuccagauugaguggacaaaagacuaauuugaauuauaaaaacagagaaucacggucccuccaucaauuuccagauuugagccaguuuacagacccagaaucccuugaaugaaggggaggcuagguccccuugaggaaggaccccacuacgcuacugacaauuuaugcuguucaucuuucucccauacuuccccggggagaccucuggccuuguaccagggaaaccgugcacuggggaaagggaaaugaucagacauuuuggggacuacuggacacuggcucugagcagguguugacuccaggggacccaaaacaucacugugguccuccaguuaaaguagaggcuuauggaggucagguaauuaauggaguuuuagcucaggucuggcuuacagugggucccuagauucauccuguggucacuuccccagugucagaaugcauaauuggcauagacauacuuagcagcuggcagaacccccacuuuggcucccugacagguaagggagggcuauuauggugggaaaggccaaacagaagccauuagagcugccccuaccuagaaaaauaguaaaucaaaaacaauaucgcaucccuggagggacugcagagauuagugccaccaucaaggacuugaaagacacagggguggugauucccacauccccguucaacucucccauuuggccugugcagaagauagauggaucuuggagaaugacaguggauuaucgcaagcuuaaccaaguggugacuccaauugcaccugcugcaccagaugugguuucauugcuugagcaaauuaacgcaucuccugguaccugguaugcagccacugacuuggaaaaugccuuuuucuccauucacguccguaagacccaccagaaguaauuugccuucagcugaaaggccagcaauguaucuuuauuguccuaagcucagggguauaucaauucuccagcuuugugucauaaucugauucagagagaacuugauugcuuucgcuucugcaagauaucacacugcuccauugcacugaagacauuuugcugauuggauccagugagcaagaaguagcaaacacguuggacuuauuggugagacauuugugugccagaggaugggaaauaaauuugacuaaaauucaggaaacuucuaccuugguaaaauuuacaggggucuagugguguuaggccuguuaagguauuccuucuaaggugaaggagaaguugcugcauuuggccccuccuacaaucaagaaagaggcacaacgccuagugggccaauuaggauucuggaggcaacacauuccucaucugggugcguuacucuggcucauuuaucaagcgacccaaaaggcugccaguuuugagugggguccagaacaggagaaggcucugcaacagguccagguugcugugcaagcugcucuaccacuugggccauacgacccagcagauccaauggugcuugaggugucaguggcagauagggaugcuguuuggagccucuggcaggcucccauaggugaaucacagcagaggccucuaggauuuuggaguaaggcccugccaucuucugcagauaacuacuuuccuuuugagagacagcucuuggccuguuacugggcuuugguggaaacugaacguuugacuaugggucaucaagucaccaugugaccugaacugcccaucaugaacugggugcuuucugacccaucgagccauaaagcgggucgugcacagcagcauuccaucaucaaauggaaguggcauaugugugauugagcucaagcaaguccugaaagcacaaguuaguuacauaaggaaguggcucaacugcccauggucuccacugcugccacccugccuucuuucccccagccuguaccaauggccucauggggaguucccuaugaucaguugacagaugaaaaaagacuagggccugguucacagaugauucugcaugauacgcaggcacuaccugauaguggacagcugcggcaguacagccccuuucuaggacaugcuugagggauggcagugaagggaaaucuucccagugggcaggacuucgagcagugcaccuggcuguacacuuugcauggaaggagaaauggccagaugugcgauuauauacugauucaugggcuguagccagugguuuggcuggauggucagggacuuggaagaagcaugacugggaaauuggcgacagagaaauuugggaaagagggauguggauggaucucucugaguggucacgaacugugaagauguuuguaucccaugucaaugcucaccaaaaggugaccucagcagaggaggauuuauuagucaaguacauaggacgacucauucuguggacaccacucaaucucuuuccucagucaccucugucaucgcccaaugggcccaugaacaaaguagccguguuggcaggaguggagguuaugcaugggcucagcaacauggaccuccacccaccaaggcugaccuggcuauggccacugcugagugcccaauuugccagcagcaaagaccaacacugagcccucgauauggcaccauuccucggggugaucagccagcuaccugguggcagguuaauuacauuggaccucuuccaucacagaaagugcagagguuuguccucacuggaacacaugcuuacucuggauacagguuuacccauuuugcgugcaaugcuucugccaagacuaccauccguggacucacagaaugccauauccaccgucauaguauuccacacagcauggcuucugaccaaggcacucaauuuauggcuaaaaaaguguggcagugggcucaugcucauggaauucacugguuuuaccauguuccccaacauucugaagcagcuggauugauagaacaguggaauggccuuuugaagucacaauuacaaugccaacuaggugacaauacuuggcagggcuggggcaaaguucuccagaaggccauguaugcccucaaucagcauccaauaugugggauuguuucucccauagccaauauucacgaguucaggaauuaagggguggaaguggaaauggcaucacucacccucaccccuagugacccacuagcaaaauuuuugcuuccuguuccugugacauuacauucugcuggccuagaggucuuaguuccagagggaggaacgcugccaccaggagacauagcagcaaucccauuaaacuggaaguuaagguugccaccuggacacuuugggcuccuccuccccuuaagucaacaggcuaagaagggaguuacaguguuggcuggggugagugacauggaucaucaagaugaaaucagucuaccgcuccacaguggagguaaggaagaguaugcguggaauacaggagcucccuuagggcaucucuuaguauuaccaugcccugugauuaaggucaaugggaaacuacaacagccuaauccaggcaggacuacaaaugguccagacccuuuaggaaugaagguuugggucacuccaccaggaaaaaaaccaugaccugcugaggugcuugcugaaggcaaagggaauacagaaugggcaguagaagaagguagucaucaauaccagcuauaaccacgugaccaguugcagauaugaggacuguaauuguuaugaguauuuccuccuucuuuuguuaaaaacuugcuugugcauguauacacuuguacuaagaaaauaucuucauguuauuuccuuuuuccuucaucaugggacauaagauuuauuaacuucauaucagcauuuaaguauuguuaacuuuaugucauaguauuuggguuggggauuggugaguuuccaguuuuacgaaggaugguuguauuauguuaguguaauuaugaucuuauuauugucuuuauuugaagauuauguaugaucucaggagauguguauggguucaaguugacaagggguggacuugugauaguuaauacugagugucaacuugauuggagugaaggaugcaaagcacugauccugggugugucugugaggguguugccaaaggagauuaacauuugagucagugggcugggagaggcagacccacccguaaucugggugggcaccaacuaaucagcugccagugcagcuaggauauaaagcaggcagaaaaaugugaaaagacuagacugacuuagguggagacugggagcagccuccaucuuucucccgugcuggaugcuuccugcccucaaacaucgggcuugaaguuguuccaccuccagacucagacuggcuuucuuguuccucaacuugcagauggccuauugugggaucuugugaucacgugaguuuaauacuccuuaauaaacucauauauacauauuuauauauauccuauuaguucugucccucuagagaacccuaauacauggccucauaugguccuccugccucagccucccaaagugcugggauuacaggugugagccacgauguccagcccguggccuauuuuauaugaaacugugaaugcuaacgagggugagcagugcgucugcauuuaaugcuguguccagcaucugcagagcccggcacaggagaugcccaugggaagccaugucucggggcaguggggcucuccaggggccuggaagcugagccuagacccuggagaugaggcucagcucaucacggaggcgggaggaaugugcugagagcgucuuaaauagggccaggaggggugacugacuucuuuaauuccccuguuucauguaacgcugucgcaugacucagacugagggcaaauucauugcaaaaguguugggaguaaauuuccuaccucgguaacacaaguuguuccugcagcugccuccauagcugggugggcacucagagcagggccggccauucuuguagggggcuucuccaauccaguucccccugaggacagacccaaaaacaaccgucagagggaaccacgacgugaggccucgggacugauccucuuccaaggcccacgugagucccugaacaccgccacugacaggucaggggggaagguugugugcugugggaagcgggaaagauggcuaucccaggccucucccgugcacagagagucuagagagcuccagaaucccagcgauucugcagaagggagcuacaagaugcccuuccacacaguaccuuugcccuggcuggcugucagccccguggccccccuuccaccaacacagcucugaacacuguuagggccccuagaucacaacaccuuagcgcugaaaagcugccaggacccccuuuuaagccauuucucaaauguguaaagccagccugucccagagacggcuugcguuucccaguuuuuaccacacaccaucccuggucugugccuucacugcacuccucaccccaucuccccaacaccccaggagggaagagcuggaauucaauauuuuugcagaggaggaaacuguggcacagugagguuaagugacuugccccaggucacaggacaagcaaguggcggggcugggauuugaacacaggcuguccggcucagagccuuaggcacacucuacucuaggggcuggaucaaaggucccucuugggucacaguugcccucugccucccuccggaguucccaggggcaggaaaacuggaggccgcaccauaggcuuucuccaggggccagguagagguggugagcggaauccccaggcccuuccugcggcuccugggcugugaagagcaggcuccccggcuugggccccaggcugccagcaugugcccucggccagccuccuccagccccagccucggucucccuuucuguaaaaugggaucacggcagcagggcugcugugagacugagggagugaccguggggaagcccuuggaccggcaccugacucacggggaaggcugugcucugagcguuggggaaauccacaggcuugugcggggaacgcucugaugcuuuccagggaagauggggaggggcccugccagugcuggccaaagacaaacggcaggaaacacgcucugggucugauaggcauccguccuuacaagaguggccuagaacuucccgcggccccagaagcacccuggccucaccgaggggccugugggcaggggagggacagugggccgugcaguguggggaggacagggcuggccacugucugacugggcacuguuaugacgugcacacagccucuuccacccucucacauuccggaggcagaaugaucgcguccgugccaugccacaagacaucccugcucagaaaucgucuguucagauccccgggggucuucgggaugacucccccaaaaagaacaucaccaagggaccgagaggucccagagcccauccugucucugggugaagcccaguagguuucucagaugaucguggcccugucguggguacgucccacugccccugccaaguuuccccuugugucuacgguucuauauuuccucagacaaaccacaccacugacgcucccagcucaacccuaacacucaggguuggcauugguggaaggcuggcugggcaccagguccugcagacaaauaaucuccuuaauuuuugagacagggucuugcucugucacccaggcuggagugcaguggugugaccacagcucacugcagccucaaccuccugggcucaagcaauccucccaccucagccucacaaguaacugggaauacaggcaugcaccaccacacccagcuaacuuuuuguauuuuucguggagaugggguuuugccaguugccaaggcuggucuugaacuccuggacucaagcgauucuccugccucggccaaaggaggcugggauuacaggcaugagccaccgcacuggccagucuccuuaauuuuugaauagcaccgugaaguaccuucccucacacacaaggcccucuguguacacacccaccccaccccuugucggguugggaaucccccucaagggaucugaccccccccacacccaaacucacccucccagccacccuccucacccuggugccugggacaguguccugcauagcccaggggcucaagcccucucucuaagacagaggccauggacagcacgcaguaauaugcagcagacaaaaggaaagaaccggugaucacgcaacaccacggggagaccucaccaaugugauguugagcaaaacaccauuuggggguacagggagugugcuguguggcccccuucauaugaggucccacaccagacaccacagaccgaugggaaagaugcuagaauggugggcacuuuguagggcacgagagagccucuggggcaugggagacacuguccaucuccaucuggaugguaguuacacggguagagggcuauugccguggacuuucauuaugugucuccccaaaucccaguguugaaacccucacccacaaugugacuguacuuggagacagggccuugaugaaacuaauuaagguuaaacgacgucaacaggugaaguccugacccaauaggauugauguccucaucucucaccaccauguaagauaguggccguuggugagccaggaagagagcucccacuggagcccgaugcugccaccccuugaucugccacaccuugaucugccaccccuugguccaggggacuucuagccuccagaauggugagacauaaaagucugauguguaagcugcccaggcuguggccucuguuguugcagccccaacagacuaaugcaugugagacugugucgcacuguauacuucagaugaguauauuuuaccauauggagguuauuccuucuuuuaaggaagcagggggcagcuacagaaggaaauaauuucauuucugauaggaccuucuagugucuauuuuuuauagagucaagucaaaugauuccucauucaccaccugccacugggccaggaauuccaccaccuuggaccagucugcugcucuugcauggugccugcgucccucccaggcaaugacacacccgcugcgcucauccaugugggcugcugagccgcgccacgccaccgcaggcacaccagaugguuuugagagggcuucuauuuuuccucccaaccucagcgauucccccuucaucccaccuuuucauaacuacuccugacccaaaacaaauaaaugaggucauucccauuucauucagucacugagcaaacaugccccggggcccacucuacacagggcacggggcaagaacggcgguggccagcggccagcaugcaaaccucaggccaugaacugggggagugacucuccaagaaucagcacauauuugucccaugagcaaaugagucaagggcuggacaccacacugaugagcugagcaugcuauaggcggaggaggcaccaugaucaggaggccgcauguggacccucuuuggagggaaacagagaagcuaggcuuugugugaacauguguuuucuagggugcugucuacugcauguuuucagagaaaaauaaucauacugccagggcagaccaugcugguugcccagccagcagcuauucccacuucugacuuuguucaguuggucccagaggacgucuugcaaagccaguuggggcaaucuuuuucccccucaucuaugauuggucuaauucuggcaaagaacauaaggagaaaguaugccagugugcaaaagaccuaaggagagagcccuuugaccauccuuccuugugcuuggggagaugugauguuggugcugugcagccaucuugggaccaugaggagagaaugguacggcaggaagacggaaagaacccgaguccuuguugacacugcuuagcuauuacgcuaacccagaugcacuaaacucuagauucuuuguuaugugagauauuaaagacuucgcugcucaagccaguuuucacugggugcucccuggcaagcaaacacaucccaacccccaccccauacaacggcaucaacuugucuuacuuuggagaauaauugcagacaaaguagaccgcguucucccaaacuucuccccagacagucaucuuccggcagguguucacagcacaaccgaucuuguuggugguggcccaaacuaucugaaaagaugacauuugugugucacagcucgagggauaaggcacaaaagggugauaucauuuggccuggauguauaaggugcuggcacuaaagagguacgaggugaaggguuggggaagcagauauuagucccuaacccauugaagauacauacauuuucuuaaaaagcaaagcaagugggccggugcgguggcucacgccugucaucucagcauuuugggaggcugaggugggcggaucaugaggucaggaguuugagaccagccugaccaacauggugaaaccccaucucuacuaaaaaaacaaaaauuagccgggcgugguggcaggcaccuauagucccagcuacucaggaggcugaggcaggcgaaucgcuugaacccaggaggcagagguugcggugagccaagaucgugccacugcacuccagccugggcgacagagggagacuccguuucaaaaaaaaaaaaagcaagcaaacaaacagacucccacacaaugaaaaugccccacaaugucaaauugccauagaaguuuucucgguugagugcaguagcucacaacuguaaucccaacacuuugggaagcugagcggggaggauugcaugagcccaggaguuugcgacuagccuggacaacauagccagacccaucucuaaaaaaaaaaaaaaaaauacaaaaauuagccaggccucguagugcacaacuguagucccagguacucaggaggcugaggugggaggauugcuugagcccaggaguuuggggcugcacuaagcuaacuaagaucaugccacugcacuccagcccagguagcagggagacacugccucaaagaaaaaaaagaguuuguagugcucacucaguuucugaccuugcugguaacaaacagcuucuucucccagcuguacucuguauagaacugaauuuuuaaaaaugaaggcaacaacagcgcagaggcuuuacagauuugacaaucccccaggggcagggggugaaugacugggauuggggggcagggcugaggucguggcaaguccccgaguuaccuguguguagugcgugcacaugggccccgagcaccucucuggacaccagggguugcacucgcucggguagggguagguguaguccuucaccucgucauaccaggacugcacauggaaccccggagagcgauaccugcagggcagaaaccgcucacucagucccagccccuccccucacccaccaguggagacagcagcagccacgggcagguaggagggagggaggccgaggagggugaauagcggccaauuccaggagcagccacgggcagccgggagggagggaggccgaggaggcggaauagcccccaauuccaggagcagccacgggcagcgaggagggagggaggccgaggugggggaauaacccucaauuccagcagcaccugguacaggugcuuaauaccauuauccuugaggagcucaccuggggucucuaguaggcuccucagguggcucauacaccaccugcacgugcaggaaucucuucaccuggcucuuaaugaguccuuucuuuuuuuuuuuuuuuuuugagacggagucucgcucugucgcccaggcuggagugcaguggcgggaucucggcucacugcaagcuccgccucccggguucacgccauucuccugccucagccucccaaguaaugaguccuuucuuaugucaauuagguguuuauuuucagguacguuggagaaaaacuauccagcccaugaagcccguauuucacagauauuguugucuaagacaaaaccugaugaagacgugagugcacuuaaggccgaacaugguggcucaugccugucaucccagcacuuugggaggcugaggcgguaggaucaccugaggucaggaguuggagaccagccuggccgacauggcgaaaccccgucucuacuaaaaauacaaaaauuagccgggcgagguggugcaugccuguaaucugcagccaccagcugcaccugucccuggacauccuccguggggucaucgcuucaugcccaccacccccuugcuucagccuuggcugccaagguuggcaccauuuuuuuuuuuuuuaauaacuagggagaaaaccaaacuggaggcaaguccacagucacacugucaccagcaaguauaaacaaagugguuucgaugaagagaaaaugcucacgggggaaaugaccauuuuuaagggccauguggucgucgaggcaguuagaggucuuguaacaauuacugucuggaagcggagcgcacggcagcgggcagcggcauuugcagaaaggcgugcacacagugaggaggcaggagcagagggcugcuggccacucauccgcuucccugcggcucaaggucacgcagacucaaggcuggcacuggcauggcuguggggaaaggaacccgcggcugccccggggggccaugcagagucaggggcucuuuugcaaagcaaguuagcaaaauuccuuaagaaagggggaagucugugugcccuuuggcccagcaauccuacuucucaggaguaauccuaaugaaaucauucaagugagacaaagacaaaaacaaaaaacaaaaaugaaucugcaagagccaacgggucaacuuuggucuguccacagagggaucauuagggcauuugcagggcgacauucaugacaacuguaucacugaaaauuuccugauauuguaugaaaaggaaaaagaaaaagauuucaaagugauccaggcuacagucucaaugcuguaaaacuacgucggcgcccagccaggugcugcaaaggagcucagaaaaaugaaaagagccgaaccaggcuaguggaauuccagaucucccugcuuuagacacuucacuuucauguuauuguaagauuuuuuuuuuuuuuugagacgaauucuugcacugucacccaggcuggaguacaauggugcaauccuggcucacugcagccuccgccuccaggguucaagcgauucuccugccucagccucccaaguagcugggaugacaggcgccugccaccacgccuggcuaauuuuuuguauuuuuaguagagacgggguuucacuauguuggccaggauagucuugaacuccugaccuuguauucugcccaccuuggccucccaaagugcugggauuacaggcaugagccaccuugcccagccuguaagauaguuuuuauaaaaagcuaacuucaccaaagaaaaaaccaugguguggauuugccucugugaagucaccgcggucgauccaccaugacaccugcccagguuuguccugaaaacccacggaugcagaggaaggugcggcugcccguggcccagugaaacccaagcuaggaaaucccucugugggaagugaaagcaaacgcucaccuacauuuuaagaggcugucuaaagcccauuccaacuuuucaauaauuagggcaaaauggaugucaauccagguccuggaugggucugaggacgugaauucuggccuugggcauggcacggucacagguuggucguuaagucuuauguggucuuaguuguuauccugggcguggucaaaagacauuuuuccacuuucuccaaugaaaccagccgucagcccccaggaggggacuucuggguucuuugggagcacggauacaugguccagcuuacucuggggaaggcccgucggcugcauuuaacagacaaccgucaaugccuccuaugggagaggggacaaaucgcucccagacagggaaggagaggggacagaacacugccagacagggaagccucgggggucuggagaaguuagugagcuucccgacggcuggaugacgcggggaaggcaaugggcaucuucccaacaggguggaaccuggcucagccuuaaacagugagcagaaccagacagaaaugacccaccaugaacagagcaguucaccccacaggaacggggacucaagaacccugcacaggagauggaauggaaaccccaaacuacaggccaggcgcgguggcucaugccuguaauccccgcacuugaggaggccaacguggguggaucacuugaggccaggaguucgagaccacccuggccaauauggugaaacccugucucuaccaaaaaauacaaaaauuagccaggcgugguggcacaugccuauagucccagcuacuugggaggcugaggcucgagaaucacuugaacccaggagacagagguugcagugagccgagauugcgccacugcacuccauccuggaugacagaauaagacccugucaagaaaagaaggaagggaaggggaggggaggggaggggaagggagggaagggaaggagggaggaagggagggaggaaggaaggaaggaaaggaagaaggaaaggaagaaggaaaggaagaaggaaaacccaaacuacaaacuuuaaucaaucaucagugucuggggucagccaaccaagcuugaauacauuuugucagucacucaggaguguuccuggaugccaagccucaguuucccagaauaucgaugggacggguggucucucucacucucuuugcaggcuaaacuugauaaggggcacaagugcugagcccggcacacggcagugggguccugcggcagccggagaggaacuuguggcucuuaccugccccagugagcgcccagguucugcccgauggacaccagcagacuggugggcccgugcucccagaugcacugacuggcccacgcugcagcagacuucuccaguucgucaucccaggucugcaggagaaggagaaacgggcaccaggaggugagggugagggaggggcauaagaaccauaaauacagcaacgccccagccugggcuccuguggagccuacagccaaugcucugcugcuguauugcuggguuccuaaaucagccaggggggcguggcaggccagacgugccggcuccaagccuauccucaggccuccugcugggccucuaacuugccagagguccugggcaggugccuucucucugggccucagugucugugaaacaggaguggccaugcugagugaccucugaggguaacacggcacgcuguguggaagacaagggaaggucagcagccaucucuagggacggucuuggccuggaagccugucccgaugaccccagucuccucuccuuaugcauguuccaggcacaccaggcuuccucuccuuacuacgcaugauccaggcacaccaggcuuccucuccuuacuacgcauguuccaggcacaccaggccucgggcuuuaccccaaccuuuucauugcauucuaacagggggcuccgaagcgggcccuuaucuccauuucacaggcaagcaaaccaaggcuugaagaagcaaugccauuuucccugggucccacagccagucacagaaccaggaucugaacccaggucuucaggaccuuggacccugagcugucuccauguacgcaguuauguguggaccacagcagguaauaaucagaugcuauuccuaggccaggggcuagaaaucaauuauccggguggcguuggauuggcgcucugaaugcugguccuggaauggcagugugaaccuaggcacgcaguuacccucucugagccucacuguccucaucuguaauguggguauguccauggcccucacugugagcaguaauggggaggggaagccuacaagaugcccagcccagggccuggcugcagucagggaggcuuuauccacgucagcgacacacaggccugcaaagaaaagcagacgagggccccugcaggggauuuuagacucucacuggccacccgcagggcaacacagcaagaagggccccgagaugaauggaugccgcauuucaguuggaagauagaaagugccggagaugggcccggagcaguggcucacgccuguaaucccagaacuuugcgaggcugaggcgggcagaucacuugaggucaggaguuggagacccgccugcccaacauagugaaaccccgucucuacuaaagauacaaaaauuagccgggccuggacaaaguaagacucugucucaaaaaaaaaagaaagaaaagaaaagaaaagaaagugccagagauggauggcggggaugguugcacaacagugugaauguaccuaaugccacagaacugcacacuuaaaaaugguuacaauggucaauuuuauaguccguauacuuuaccacaaugagaagaaauugacaagagacgucuucagcuugcccagcccugcucaccucccagcacggcccauccugaaucaguggggccugagcaggggucugggcagagacucugaagacaggcuggccccaggaacacacaugacuccuggggagagaauuccaugaacagagcaagcguguccuuucuccucuguggaggaacagaugccaggcagcccuggcacagcuggcagcugacgcugcacuuccucccuggaguccucccgacagaugcuccagcuuuaagcaggcagaggcuggccuccugcccucugcacacccagccccgggcacacagcagaugcucagggaagacaguccugucuuagcccugggaccccccagcagggaguaccugcccaacacaaccgcaugccucacuucccucucuccccgugucccagcaagacuccucaacagccaaggggcaacaaaccuugagucuuggagagguuaaguagcaugccugaggucacacaaccaggaagucuuucacaacccccucuugucuggcuacuaagggggcucuuccugccuugcauacuguaaccaagugccagacccaucccacgaaaaucauaaguuacuaaaauaugcuaaugcaacaugcugacugugcaauauacuaaaugauaacagcaucauucacauuuacuuggaacugauuuaugcauuaucucauugccuccuccaaacaacccuaugagaaaggguuucuuguucccaucaugcaggugaggaaauauaaacagaaaggcuaagcaaucugcccgaagucacaaagcuggccagugacagagcuggcuggacggaggcaggcuggcuccagagccuguccacucauaaaaccucagaacgggcugcucaacucuuugggguuuuagaauccaccuuucagugcuaaggcuguuucaaaggacuguggcuugaagccacagcaggcaggguugagcaggaagccacguuuccaagccgcuuucucaaaucugcauugcuuguuugggugugaaccagagcagaggggcaaugcagcgcagugcugagggugccgggcugaguggcagggccccugccaccccauccuuucagccuccuugcuccgagguagccucaguagcauccaugaaggcucagccuccccagcaggccggccuuuuagaccaaaggacccagaucccagcuccaauccugaaacaucaccaaguaaacaaacaggaaaacaugaaaggccugcucugggcugcccgggcggccugacuuucccugcugcaaagaagcuccuuucacuggcacuaagucuugcaugaaaccgggaggaccacacagugcagggacaagaagaccagcaugaacccagccugcuccagaccgggaggcgggaagcaucugggauccugggggucgcagcucagucaagcuccagucccagaugcugacaaccucuccagagagacguggggccucccugccccaugaggaccaaggccaagccaccagggaugcgcggauucaaugggucucaacguucccauggccccuuuccuuucauuucucauaaagcaacucucccaacagcauguuccaacaagcccccucugcucucagaaauuggcggcgaaaaagaaaaacguagguugggcacagugguucaugccuguaaucccagcacuuugggaggcugaggugggcggaucaccugaggucaggaauucaagaccagccuggccaacguggugaaaccccgccucuaccagaaauacaaaaauuagccgggugugcuggugcgcaccugucguuccagcuacucaggaggcugaggcaggagagucgcuugaaccgggaaguggagguugcagugagccgagauagcaccacugcacuccagccuaggcgacagugcuagaaucugucucaaaaaaaaaacaauaagaaagaaagaaaggaaggaaagaaggaaggaaagaaggagggagggagggagggacggagggcgggcaggcaggcaggcggggagggagggagggagggaggcuaacugacuuggaagaggaggggagcguggcacgagggaacgcagugacucugagggaaggcuugcagguuuuccagccucugcucugccccuucagaaacagcccccgggcaggguugcucugcuuccaggagccuuucucacggugcgguguguccagagcuuggagaaagacagaaagcccagccagaaaaccaguguagcccugacccaugggcaaugccucccaggucuccggaacggcucuuuguucuucacuccccgccucccgcccaaauaccgccccgucacuccucaccugcccgucaccugagccgccucccugcuuccugcugcgcccuccaauccccaacaccgcacagcagcaaaaguguuucacagccaggcgcaguggcucacuccuguaaucccagcacuuugggaggcugaaguggguggaucaccugaggccaggaauuugagaccagccuggccaacauggcaaacaccgucucuacuaaaaauacaaaaauuagcuggccaugguggugggcaccuauaaucccaacuacuugggaggccgagacaggagaaucgcuugaacccaggggucggggguugcagugagccgagaucacgccacugcacuccagccugggggacagagcgagacucugucucaaaaaaaaaaagugcuucacagucauaaaugcauccucucccgcaaaaaaacccuguuucuuuuuuuuucuuuuuuacccccauuucagcaauaccaaaacucuauuccucauagaaaaaaaggcaggcuccucaccuagccucaaagcccugugugauuugccccugccugccucucugaccucuuccaauggccucacucccucagaaaugagccauggcccugcuggcuuuuugagagcuccucugagacccgaagcuuuucucccguuaaggaaagagacucacgaggcggugguggcuuucacaccuucuguucccucugcccagaacacccuucccugcacgcuugcuugcucaaccaugcucacucuucaggucuuaacugagauggcuccuccgcagagugggccacccuuacuccucccucucagucaggauucuuccaccccuaacguucuuucuugcagcuccccguauuucuucaucuaacucugcacaacucauaaucaugccucuuccgggaauccaggacagugccuggcacaucgaaggugcuccacaaauacuuccuggcuacacuaguccggaggugccguguggacggggaccucaucugcuuuguccaccucuuuauagcaagaaucucacggggugcugggcacacgggaggcacucaaaaauacauagaauucaccaguugauuaaauaucagguauguggaaggcagagaagcagagccuccuacccacacauucaauaaauauguauaggccgggcacggugguucaugccuguaaucccagcacugucggaggcugagguggguggaucacuugaggucaggaguuugugaccagccuggccaacauggugaaaucccgucucuaauaaaaauacaaacauggugaaaccccgucucuaauaaaaauacaaaaaauuagccuggcgugguggugcaagccuguaaucccagcuacucaggaggcagagucaggagaauugcuugaacccaggagccagagguugcagugagccgagauggcaccauugcaccccagccuggacgacagggcaacacucugucucaaaaacaaacaaacaaacagaaacaauaaauacguauuagcaccuucuaugugcagguuuuggggacagacaggguggcuuugaaucccagcuucaccauuuguacauuuguagcugugugguuuguacaaguccuuuaaagaugaaccucucugagccucaguuuucucuucugcaaauuggugcuaauacuuucuauuuuccaggauuacugucaggauuaaagaggacacaauucacguggcacguaauagccacucaacccucaugccacgacccuccauggcagcuuugugggggagacacgggucaucacccaggccagcucagccuguggcaaaggaacgugaccacagcuuuaaagacacagaugagacggcagcgugucucucagagcaaucacagcagggggccaugggugcauuccaaagacaugaugaugccuguacccacaaaguggcaaagacucagacucugggggagauguggauuuuuuuuuuuuuuuugagacagggucuugcucugucacccaggcuggagugcaguggugcaaucucagcucacugcagccuugacuucccaggcucaagcgauccuccuuccucagcucccaccccccaccuccaccuccaccucagucccacugcagcugggacuacaggugcgcaccaccaugcccggcuaacuuggauuuuuuuguagagacggggcuuuaccauguuacccaggcugggacguggguuuguuuaaaaagccauucauagcugacggauggccaagguggaggcucccgguugguggacgaggagggacccuggaagacugugguccauuccucuguaguucuggaaaaccagccaggaaggaaguuuccacacuggagcuuggggucaaguagcagcaucgcccaaccacaccuggaacacccaucacaaucacccgggaggguugaccuuggcugucuucugucaccguuagcuccuuucccgguuagcaaagccuagggguuggggaggcagggucagucugugccgggcccuucacagccucgacuuaucucacagucauggcaaccacgcgaggaaggacucuccaaguggaaagugaggcucacacgggcuaaggagaagucaggguggugcagcuagcguguggcacagcugagaucagcaucagcaaagcccagcccugggccccuccccacucugccuccaggugggaaaggcugagagcuguguucccaguggagcuaccaagagugacaugaaggcaacgaggcaggcucugcacagggaacccacguguguuguuuuggcagaauguuaagaacagagccagagccagacagggugacucaugccuauaauccuagcacuuugagaggcugaggcaggaggauugcuugagccuaggaguucaagaccagccugggcaacguagcaagacccccaucuccacaaaauauuuaaaaucuagcugggcaccauggugcaugccuguaguuccagcuacuugggaggcugaagcaggaucgcuuaaccccgggagucuaagguuucagggcaugacgauugugccauugcacuccagcgucaguggcagagugagacccugucucaaaacaaacaaacaaaacagaacagagccgggauccuccccugccagaggagacccugagccagccaucacacgcacuggcuggggaacagagcuggcuggggaacagagcaggcugguggcccaggccccacccccggugccagccucugcggccggagccggcgcucaccauguacuccauguuggaggccugaggcugcaccuggccccgaagcuuguugugcagcaugaggaucuccuccuuguccucccuggggauggcucugcggacccgggagugagacucguugugcugguauuugcugagcagcuccucuaagagagugacguugggcaggagguagccuugggauccgcagaccaggaacagcagccccaaggggaugacaccacccaggacgcagcucauggcuccacuccugcagcaacuaugggacucacggggcagccugggcuccucgggcagagcugggcgcuugagcucugaaaggaagcagaggguggugggagaagucgcauuaguaggagccggucacagcgcuggcuggagcagcgaacgcagcacacacgacucucuccauuuuacagaugcggaaacugaggcccacagaagcuaaacaagcaaggucccacagacaggaagugguggagcugggauuuacgccaaggguuuccagcgaggcaagcugucaggauuccaaagaggauaaccuagaacaguucuuccuggacucaaguuuuccuugagcgagucccugcauuuucuaauuaugagucagcaucucuuauucauucaggacucaggugaaucucaggcacaaauuagcuucuaucaccugccccaaggggauugcuaaagucauuucccaucaccaaaggaugcuccguggaccaacguugagagcaaacuucuagucccugugaagucagacucaguuuaccaauagugguugacauauggcuccucuuaucacggcccucgccccgggccccacccgcacaucuguugcacacuaagacacagcugcccagaaccacguccagccaaggccucagccuuuuguucccucagaaaacccuucaucagcaccuacacaggccggucguuuauguuauucucaaucaccauggcaacccaggaggucaggcuguucucauccccauuuuacagauaagaaaccuguggcuggccgggggcgguggcucacgccuguaaucccagcacuuugggaggccgaggcgggcggaucacaaggucaggagaucgagaccauccuggcuaacacgaugaaacccugucucuacuaaaaaauacaaaaaauuacccgggcguggugucacgcgccuguagucccagcuacuugggaggcugaggcgggagaauggcgugaacccgggaggcggagcuugcagugagccgagauugcgccacugcacacuagccugggcgacagagcgagacuccgucucagaaaaaaaaaaaaaaaaagcaagcuauggcuuaguguggugacaagacaagcccagggccggccuccugguaagcagagaugcugaaauucgaaaugaugauuacaaagacccagaguuuuccagcaagcuaccuugacuccucugucccugggggccaacuaccuccccuccauuauagggucacgaaccacagaccuccuccuccuggcuugccaucugaaaaauguaugucauuggcccaagaagacaaggaagggcuugaacgagugcguccacgcacaccccuccucucugcuuuccucgcaggggagagucggggccacccagucaccuccaucaagcgccuuauuuugugcuggacuccgagauggagacuggggaugcgaagaugaagaggacucugucccuggccucaaggagcucaguuaggucggggagauggaggaggaaacccgcaguccccacauagcaggacaaggcugacucuaaagacagugccaggcccucgagggccggaagaagcagcucugucuggaggguugggugguggccgugccucaggcugacccgucggaacuccacggggcucaguucuucacaugaguccucccuggucuucacccccauagcaccaaccagguguuuaccagucaaguuggcugggacaguggcagugcaaggugggcauccucggguggggccgggguggggagauguagaucaaggccuggaggggauagaggccaagacgggcaucccaggaagcagaaacguuggcaacaggcgacagaggcugagccaaagagcuaugggaaugcugugguucccauucccgaccccuggaaacucuccaggguccugacugagccugcgccucagacaaaaauaaccccaugcggagaggagaggcuuggcuugcuuuguagcagggcagacgggcugcccuccuccaaagccgagcccggggcugcguggggaggaccucugcgugcuuacucgucccacugggaagcagaccaagaaugcagaacuucucaggaucccugaucucucucucucagguuagucacaccaccauauaugagcauuuccagcugcaggcggccaggcucaaagaagagaugccagaaaacucugacgcuggguugagguugagagugcgguaaucggcgucacgggguguccuccuggugucaugacgaugcuccgcugauuugcauguacauaaugagauaucuuggggauaagacccaaucuaaacacaaaauuuguugauguuugagauacaccuuauacauguagccugaagguaauuucauccaacauguuaaaauaauuuugugcauggaacaaaguuuucacuauguuuugacugcaacccaucacaugaggucagguguggaauuuuccacacguggcuucagggcagugcucaaaaaguuuuggauuuugaagcauuucggauuuuggauugucagaucagggagggccaaccugugcuuaacaaaauaaaacaaaaugccaaagugagaaaacaggaggagucaaaugcuguuuuuaaaugaguccucuggcacguccuccugagccagcgugagcuaucccaggagaucugacuggccgccuuuguucugaauguuaaagggacuuccacagcuuagaggcugguccuucucuaaggauuccaaagagaaguuaugaagucucagguggagcuuuagaguugggagaaccacgggguuuagugaaaccuccacauuggaagacaacagaaggaaaaggggagaggaaugggaggguuucuccaagugcccucaugugcaccacaaaagccaccagccugggagacacaggccugccaugcuggguggugugccaguacuguugggucugaaagugguuggguuugacuucagcccagagggccugggggugggucggagggucccugcuugggaggggaugaggcuccuccagaucuggauggcuccuacuacauuugggccgcaggagaacacagcagauuuugagcagaaaaguaaccauaggccgggcaugguggcccacaccuguaaucccagcacuuugggaggccgaggcagguggaucaccugagaaguucgacaccagccuggccaacacggagaaaccccgucucuacuaaaaauacaaaaucaguugggcgugguggcgccugccuguaaucccagcuacuuggcaggccgaggcaggagaauugcuugaaccugggagguggagguugcagugagccgagaucaugccauugcacucuagccugggagacaagagcaaaacuucaccucaaaaaaauuaaaaaaagaaaaguaaccauaaaagggccagcaccucauuccaguuuguacccccagagcccagugcugggugcacaggaacaagcacacagcuauggguuugagcugguuuuccccaaacucacacacuggagcccuaauguccaggaccuccaaaugcaauguauuuggagacggggccuuugcggaggugauuaagguaaugugaggccaugagguugggcccuaaccaagcugacugguguccuuacuagaagaguuuaggaccgagacacgcagaggacgaccacaugaggacacagggagaagacgccgucugccagccacagagagagaccccagaagaaaccagccccgccagcaccuugaucuuagacuucuggccuccagaacugugggaaucuaaauuccuauuguugaagcuugugguacuuugcuguagccggcuuaacagaccaacacacaucagauaacacauggcuggacaggacuguuuccaaauaugccccuggcuauuguaaagaggagacacgaaggaggcagacaggcacguuaggaggccaggccaggguccuggcuggaaccugguuggugccaucugccaaagccacaaaccaauuggccgaggcccaguucacaggggcagugcccggcagcccuggcccacacugcccauucuacccucacuucugagacagcucagucggaaccgggaccgaagcacuuccaccccuuuuccauugacaaugaaaacacacaaacucuuuccaaaugggauggaccuccaaguggucccgggcuugccaacaucaagaaggggcucacgccagcaacccucagggcgaagggggccgccggggaagaccugcccugcgcccgucguggugugagcgccugaccuccgugaucuccucucacccuccugacuuuccagagucugggcuccaucacucccacucuacagaugaggaggcugaaguccauggaauuuaaggaaccugcccagggcgagcagcaagucuggagccggaacgcagcucuucuaaccucgaggcccagguaugcccuuggcuuagugcccugcugccucccacggagugggcuucccucuggaugugaaaaucccaagcacccccaccaacccaugcagggggaagggggcucccaaaccaaacaaccgaaucuugcccuaaaguucucuuccacccucuucugccuccugggaaggcugcugggcugggggagucagggcacgggccucccgggucacguggugccucuguugaugagaaggcaccaacgugucacccccaugggagacgacggagacccucgcaucauggugacguuccaccaacacaaacacgcccccccaccaccaucggugcugcccacucgccuuugacccagauaugaugagcugaucucugaccucugaccucuggcagauggaugcccccugcagagugcccuccuagcguccuggaagagcucacgcuuugguggcugccccgagugcacuucgguacccagggugugaggcucccacucuaacucugcucuucuaccccugaugcucccaggcagggccgggugcaugcgccacuccuagagagaugccccugcauccuguccacucagccacucauugauaaugaaauaucacuagggaccgcgggacaacacagcagaaaugcucucuagaagauuuuguucucuuuugccagaguugcaaaacugagcccauaagaccacaaguaagauaacggcuccgagaccucaugaaaacacaccagauuucagcacacagcagaggcugggaggggaacggacagagcuuucaggucccagggucaauggugagacccacagcuggcgaaucaaagcgacgggagccacacuucucccgcgcugcccagagcuuugagaugcauuuggacucuagcagggaggcagcuguuuucagccccauuuuacagaaagugcaacugaguccaggagacuggcauuuaggagacuguguggcuaguuuaaagugaaaccaagacuugaacucaaacuugccaaaaguuuggaggacuuucaacacagcuuguuugcacuaugagcucuccaaccgcaccccucuacccuggccgaggcuuuguggacauuuaggggaucaccaaaccauguguccaaguuuagcgaggggucucccugaugguuaucucuugggcgccaucguacucaacacucagaagugagugagggagaaggagcugggcugaagcucauugcgucauuggccugggcugcaagugccuuguguuuaggagaaucugccagaaagaugaaucucgggacuuagccugucagccgucagcucccagccugugccaagcucccugcuuuugcacaugcuguucccacagcucaucccaugaccccgacaugccccgcuucacuggcccaggccagggagaugaauuccugcucauugcuaagacucagcccgaggagcacggcuuccuagaaaccuccaguguaaucacaccgcagaccugcgggucucguucaccgccgaagcgucgaugucuaagucaguguuugauaaauauuuacgggaugacucuguggcccccuccugcucccagcuagaucagaaaagccauauaaggacuacgucugauuugggcugcuucuuuacugacugcagcaugggcugucggggaagagagaccuggguucaauucuugaccuugccccucacuggcccuuggccuugcccaagccugugucaucuuggacacagcaccgagcuucuugaguucacgucuguggguggaggggagugacaggcccuacggcugugaggaaggaaaaagguccugaacuucaguccccagucagugcacugccuguuauaauaaggaggcugugccagagccuccaaaaaugcaucguuugaagggauuuuagaaggcuggagugaauaauguggaaugcuaugaacagacaauucucucuucauauuauuucaaagcccacguuuaccuuaacaaaauccaauguuuaaaaauccggcuggacauggcggcucacgccugcaaucccagaacguugggaggccaagguggguggaucaccugaggucaggagaucaagagcagccuggccaauguggugaaaccccaucuuuacuaaaaguacaaaccuuagccaggugugguggugcgugucuguaguuccagcuacucaggaggcugaggcaggaaaaucacuugaaucugggagguggagguugcagugagccgagaucgugccucugcacucccgccugggugacacggcaagacucaaaaaauaaaaaauuugaaaauuuaaaaauuaaaaaaaauaaaaauccuauuaggccaggugcggugacucacaucuauaaucccagcacuuugggauguugagcugggaggaucgcuugagcucaggaguuugagaccagccugggaaacauggugagcuccugucucuacuaaaaauaauaauaauaaaaaaauuagccaagcacggugccacaugccuguagucccagcuacucguggaggggcugagacgggaggaucgcuugagccugggagaugcagacuguagaucgugcuacugcuuuccagccugggcgacucuaucucaaaagaaaaaaggaaaaaaaaucuguuaaauguccaaugcuugggggauggcagggggacccucuacugaauuugaaacguauauuagcucuguauauaccuugagcauuggccauuuuuccccagauguccaagaugucaugugccaggucugggggauucaugucaccaccuggccaggugccacccaugcaaauguauuuggugauucacaccgagguuauccugucagaugucauuuucugucauggagcucuguccucuuccauggcugcgucucagcugaguugacaggcccaugggcacccccggcccugggcuccccacccaggauugcagccgcucugacucucagccucccucccuggaccccgagcuucucaagggccggaacaguggugggaugguaaaucguucaccaccagcuuccaaaacaaaaaccaagcaaaaaccagccugccuugcgguguuugccaauucccuugguguaaauacucccaccauggccaacuucaagcaaccagugugaagucaccgagcauggaguuucuggaaagagauccccagaagcacacggucacgcagccuuuccaucacgcagaucccauagacacugauaaucucaagagcagaggccacaguaaaaugcaggaaaaaagucaaaagugauagguuuuaaguauuuauuaccuucuuuuuaaauaugacuuuuuuuuuuuuuuaagacagagucucacucuguagcccaggcugaggcuagagugcaauagcaugaucucagcucacugcaaccuccaccgccuggguucaagcaauucuccugucucaaccuccggaguagcugggacuagaggugcaugccaccacgccuggcuaauuuuuguauuuuuaguagagacaggguuucccauauuggucaggcuggucuugaacuccugaccucaggcaauccacccgccucggccucccaaagugccaagauuacaggcgugagccaccaugcccggaauauaacuuaacuguaaguuuuuauaaucuaacguuuaaugcugguuguguugaacugguucgcaauccauuuuuuacugaauuuuauuuauuuauuuguuuugaggcagggucucacuauuacccaggcuagagugcaguggugcaaucaugucucacugcagccucaaccucccaggcucaaaugauccucccaccucagccucccaaguugcugggacuacaggugugcaacaccaggcacagcuaauuuuguauuuauaguagaaaagggguuucacuauguugcccaggccacccucgaacucccgagcuuaagugauccucccaccucagccucccaaaguguugggauuacaggugugagccacuacgcuggcccugaaaauguaacuaucagcucucaagagcugguaugagccaguccaagcuggcugcaguucaccauuggccagcacugagccuuguucaaucaacuuuaugcccccagcaaauguucaucaccaaacccacgccaacgugggaugaggaaggggcugccgcaggcguggccugggcccucuacuccugcacugaacauuucaugugguccacaaacugaugaggccacugugacaauagcccuauuuuacagacgaugaaacugaggcuuaaaaaagauaagcaacuugccuguggucacacauaaggccugaggacaaugucgauucauucacuacgcccuggucacuuaccaguccugggucguccacgcagcgacucucuuaaacaucagggcaguucugaccuguggcccugcaccacucagcugagacccaugguccacaggagagcagcugaccccagaagccugggggucgggguguucucuaggcucuacccuuccucacaaguaucaaaggagaacucagaucugagcaagaggccaagggcagaucagagucauacccacaaaccacccagaaauuccaggaaugaagcaguggcuggaaggagggguacuccacuccccccguuugugucucuggcagaucccuugacugagcagaacaucccguuagagcgccuggguaagcaccacgcagugagugggggcccuuucuccccuacucacugcagccuggcaguuuuccuuaaacccuucuuggcaggauugaagccagacccaagggaggccacaguccagcuccagcuccuucccuagcugcugccugcacugugcugaauuccccaucuccccaggacagccaacaguccacucagcuuaaaggcgacaccagccccacaaggcaccuucucuccuccugucaccucaacaaaagauaauauucuuuuuuuuuuuccuuuuugagacggagucuuguucuguccccaggauggagugcagugguaagaucucagcucacuggaaccucugccuccuggguuuaagcgauucuucugccuuagccucccgaguagcugggacuacaggcacgcaccaccacguccagcuaauuaacaaaagauauauucuuaugggauuucugagucaauaugucuggaugcuuaauugagcaaaaaaucuauacaaugcuuuucauuguuuacauacuaugcuaagcauauacaaaauucuggacaaaaagaaaauagucauucaacaaacucuuauuuaaugcacuaugugaaaaaaaaagaacugaaaagcaggugcauucgaugcaagccaaggugauauauaagaaaagucacuuuuaagggaccagguaauaaauuaauacauucuuuaaaaccccaggacauaacuccuggggcaccuuucucccuucuugaagacgugugguuguuucccuggaaacaauguucccagcaaagcuuuaaaagauaaacagcaggagcccucccucuccgaagggaaaggaauuacggacucccagaaggcaaugaggaaaggcauagagaagaaugggcagcucuggguucgaauucugccgccacugcauggagcugggcaugccucaacuuccucaagccucuaauuccucacucaugcaugaggcccugaguuucuuccauggcuaggggaggaagggugcuaugacuacccaggaucauguuuauaaagggcccagugacagaaucccaggaacuuaaugguguuuaaugauguuucuuucccuucuccuccugaguaaauucagggccccaggucaucucugugcugggcuccagggcuggcagcccgggccagucucccugccugagaagcgugauucacugacagguggcauccgcgaagaugagucgagagcuggcugcggaaccuccauagcacucugcaggugaaaaucccaggaguccuugggaucugcaagugaaaaagaccgaaucugcccucgggacugggaggagacagagaguaaacaaacgggcagcggacagguaaauaccgaaggugugagcaggacaucccggacacacggauggcgaagaugaacagaggaggggggcagaaccacucugguugggguagacggcaagguccugcugagcucuuaaagaaagggcacuguaggcccggugcggcggcucgcaccuguaaucccagcacuuugggaggcugagaagggcagaucaccugaggucaggaguucgagaccagccuggccaacauggugaaacccugucucuacuaaaaauacaagaauuagcugggcgugguggcacaugccuguagucccagcuacuugggaggcugaggcaagagaaucgcuugaauccgggaggugaagguugcaaagagcugagaucgcaccacugcaguccagccugagcaacagagugagacuccuucucagaaaaaagaaaaaaaaaaaaaaaaagaaagggcacugcaggcagcaggaagggcaaggacaaaggcucagaaggggucacagucgaggcgugaccgugaccgaggacaggcgaaaagcccaugaagcuggggaggaauggggucaggaggcagccagggccagguggugagcagccuugaaggccacggugaggacucuugguuuugcucuaaaugcaaagagggcccucgagggagggaagucgggcggugacagggucugguuugugucgcaaaagccuugcaacacacaacagcacagacaaaccccgcagacacggugcucaaccaacagaaggggccagacuccggggauucaacacgcaugguuucauuuaagucaaguccaaaccaggcaaacccagccugugcccuuagaaguccggaaaugacuaccuuggggggugcgggggcagugagaggggccuggggggcuucugggggccggccaggcucugcugugaccggggcuacggcgcuuugugaaaaucucucugccgguacagagacggcugugcccucuucccugguauguuaagcaucaacaagaaauuauaaaaaaaaaaaauuugauguugcucugaccucuguuugaagacuggauuaagagggcaggagugguccaaggagagagcacaccauuaugcaagagaaaaucccggggccuuucccucaggagucucagagcugaaacaggccuggggccccggcucagcagccuucaaagugaacugcgaugugucaggccccagauaaaguccagcuggcgguggggccucccccuuggacccgcacacgacucuccuagacagggcccaguucaucccaagucugagagagcacuuuguccugcgaugccaaggcccagcugaaaauaccuucucagucccagggcagccccagccucgcaggucccggggaauaaaccgugucuucccucccggggcgaacggacuggcugugugggcagcaggccuggggcaggagggagagauggcagggaagauggacacacaucauagaggugucuucaaugcccuugaggaaacagcucaccccuucagggguuauaaguaaaugugcguagcuggcucuucccaggcacauaggggcaugaaacgugcucugaaggagggugccagcauccucaggacacugacucaggcccuggagcaucagggcgucacagcuucagcacaaagugccaaagggcugaguguucuucuggaagaaagccuuccaaauaugccaacaacuuguucuuaaggggccuuccugauuuuggagggagguggucuuucagcucccaggucacucgugacuucuuucuggucacaccaggcccuauaaccagaaccguccacacagcuccacgcugaccccaguagccagcccuccaugccccaccuuugugccagggccccagggcaagccuucuuuagcuuucuaggauaacaggaugcuuuguuacaacagacugccagccccaccccacagcuucugauccaggucuccagggaagccugaaaaccugcauuucuaugaguccucaggugcuuccaggccaggaacccacuuuuuuuuuuuugagacagggucucacucuguuguucagguuggagugccguggcgugaacacugcucacugcagccucagccuccugggcucaagucuucuaccucccaagaagcuggaauuacaggugugcccuaccacggcuggcuaauuuuuuuucuucuuuuauuuuauguauuuauguauuuauuuuuauuuauuuauuuauuuauuugagauggagucucgcucugucacccaggcuggagugcagugugugaucuuggcucacugcagccucugccucccaggcucaagcgguucuccucccucagccucccaaguagcugggauuacaggcgugcaccaccacgccuagcuaauuuuuguauuuccaguagaaacaagguuuugccauguuagccaggcuggucucgaacuccugaccucaagugaucugcccaccuuggccucccaaagugcugagacuauagguguacgccacugcgcugggccuuucuuccuuuauuuuagaaacauggagaggacaagacacacugagaggacaccagcuaauuuuuaaauuuuuuguagagacagcaucucacuauguugcacaagcuggacucgaacuccugggcucaggcaauccucccgccuagaccucccaaaguguuaagguuacaggcaugagccacggcgccuggcugcuggcccccacucugagaagcacuucucuaaauuauaacagccucucaguucuccuucuuccccgaccuugauccagcauuucccaaacccuguccuuugaauaucccccuucccaaguuuugcccaccuuccuacuguguacugguaccaguacauauuuuguuuuuguuuugaaauggcaucucgcuccgucacccaggcuggagugcagugguggcgugaucucggcucacugcaaccuccgccucccggguucaagcaauucuucugucucagccucccgaguagcugggacuacaggugccugccaccacgcccggcuaauuuuuguauuuuuaguagagaugggguuucaccuuguuggucaggcuggucucaaacuccugaccucaggugauccaccgucucagccucccaaagugcugggaugacaggcaugagccaccgcgccuggccccauauuuuguauuuuuauuuaacuuggcuuguuuuuugcguuccaagaaauuuacuuuaaaaagguaacuuucuaucacucccacuggcagagaaccugaucacuggugccgugaacagacggcaggagugaaauuaaacacaguaaaaacaacaguuacuuccucccagccaggcacugacaccaaccaaaggcuuuguuguagaggaugcuugcucuuuguuguaaaaggagaucagggugugggagaggugauagggacaauuccaccugugacuuucaccuugccauaagcagaaggaccggaagaacagagaauggaaagaacagagaauggaaagaacagcucuuggacuggggggauuugcugcuggaucugugcccgugcucagucaccuuggggaccccuagguauuggcucugcacacuuuggaggacacaguucauucuagagugagcuguucucaaguucucagugccaccguguuacucucuguucaucuugauggugcccacuaagugguacagcucaucacaacaccugcaggacagaccuuugcugcccugagccuggcucguagacuacaggcacaccaaacuuccugccauucuccaagagucccaggcccuucuccaccugcaggccuuugcacacacacggugccucugccuggggcacccucgccagcuccccacccacccacuaucaucuuccccugcucgcaaaacccugccuguuuccucuaggcguuaucaggcucuucucaagucagucucagaagaugccagcuccaugccagcucccaguccuuagagggguccaguugagucuuuucccuauucaaaaaauauuugggguagggucaguuccagcucacuugauuacaagcaaaaugggagcaugacuuuuuuuccugggauguugccauucugugcucaaaauaaaacacguuccagaaauugggauugaaaaugugggauuucauaauuuauaauuuuuaaaaaaugaugguccggaaauugcacaauccucaucaggacguuuuuuuucccucugacucugugguuuuugucuuagcugaugcagcacucaagacaaucaaagauaaaucucccucgggcuggaccaugauguccucgcagccuugcaagaggggucuuuguccaagaguacucgucauuguacagccugggguagaaggcagggcucccccagggcgaugucucaggauucccugccugcugcugcugugacccagguggcacgccaacacugcccacaaaugccaaaugccagggcuucccugcacccauggagaaggccagcaacacauucuggaaugacaugaccugaguugaugcuucaagaaggaacucaaaaaagaggccacagucuccucaauaaguuaaacauaaaguuaccauaugacccagcaauucccucccagguaaacacucaagagauaugaaaacauccgcccucaaaaaaccuuguacacaaauguucacagcagaagccucuguaaaagccaaagguggaaacagcccagauuuccuucaguggaagaaugaauaaacaaaacguggucuauuaaugcaauggaauauuacucagccauaaaaaaggaacgaaggucucauacacauuacaacauggaugaaccuugaaaacaugaugcugagugagaggagccagacacaaaaggccacacauugugugguuccauuuacaugaaauguccagaauaagcaaguucguagagacagaaaggagaugagcggcugaagggaggagaauggcgaaugaugccuaaugggccugggguuuccuuacgagaugaugaaacgcucuggaauuaguggugguggcugcacaauacuuccaauguacuaaacgccacugaauuguacacuucaaaauggguuaaaugguaaauuuuauguuuauguguauuuuuaccacaauacaucuuuucaggaaaaagaaaaacagaacauggcccauccuauuaaccaccacccagaucuaccugucccuugccugucccagaacucagcgugcucuauuuaagacuuuacaacgugcuuuaggucccugucccuggaaggucugagcaucuguuccacucaaugaacugaagacgaagugaaauaugcccagauugaauuuuccuuuccugacaagccgucagcccguuugagugauccuggguuugcacaucugggacugaucaaaaaccagugcguuugcaaaagaagaaaaaagaaaaagaaagaaaaagccuccugagucuggcgcaggcagacaugcagacaccucccacacacagcaaaugacgcuggugacagaggaaagaaaaguuccaguucccacaggccaaagaggucagugcccugccuccaaaaacuuucugaccuccaaagacgucagaggguccugccuccaaaaacuuucaaaugcaacuuacaaagggccacauacuuaauuuguggucuuuugagggaugaagugcagagguuuuaagagaccucgcagucuucuucccuagcucaggccuucccagucaaaccaacucuccucuccaggacagaggcaggacucagaaccagcacugauuuggguccugggacggggcucucaguaccugucagcaauguugagcccaagcccagggucaguugauccccucccagccucaccccaacagggaccagggacccagaucccugccaacguuaaaaaaacucccacauggcacagaaagccucaacuagcagcaagcucugcugggacagucauguggcuggucauuagaugggcaccuucccccagaaucuggggcagggcccagccuggacggcagcucuaccccgcccuggcugugucauguugggcacacaccuuaauaauucugagccucaacuaacuccuuguaaaaagugcccagcuaauagagcaggcagugagcucauccguggaaacccugggcaugucuggucuguacuaagcaucauguaaaugucagcugcuuguauuauuacaaauggcauuauuacuauuccuacucucacaucuuaagaaacucugaaaaaaucaaaaucacccucuugguuucuccucccuggguacauuguccagugguuuuaacuggagccccuguaagacaaaacaucaccugugugaaggucagguucauggguggaguuggcagugggcagggaagugucuuaaagaaagcagggucaagagugcagauaggacccaccugggggugacagcauuccauaccagcugggggaucuuaggcaagcacuucaccuugcugagccucaguuuccucagcugugaagugggcaucaagaggccuacuccccgggguguugcagcgaugacaauacagguaaacugcguggcacagaccgcgugccugccgcacaggcaacacagucacacacccaccccuucuccugagugggaacagccagaucaggggcagaagcagaaaaucaggugcauacaacccaaggagcccugggacagccgacagucacaacucauggccucagucuacuggaaaggaccacgccccgguccuguucugcaggcucuccucacugucagacaucagacccuggauggggaaagcaggcucaccccauucuaccagggcaagagguccaaaggcccaaaggggaaacucacaaccccacucucgguugcaaggcaagcuaggcauuugcacgggaugcuucucucagccagggcagcaacucacauuuuggcugagagacgcccaauucaaguuggacugcgaugagcaggcaucagcgaaguccucccuggcuuguccaccagcccagccuuagcaagggaggcucugggucugcagcacaugagggacuagcccuggcucuguccacgugggacgaccgaucucccccacacuccagagugagcccuccgcuuccaggguaacucuccccacgcaggaguuaugcaggugcccgcucuggcuaaagaaacccagaaacguguucccccagacugcagaacccugacauggccccaagucucuacacauccauuugaagcucuggagacagacagagcuggguuccagcccuggcucugcccggacaacuuacuucaccucucugacccucagcaucuucaucugaaaugugggaagaaggcuaccuugcaaaugaaaucacagaggggcguggcccucuaaacugcagcugaaugcacaugccacuagaucacccugguccuccagacaugaguaggacacauucuaaugccugccauauccaugccaucagcuuuccaguuauugacacccacuacgaacacaggaaugcaacaaaugcuagugaacugcacgaggaaggcaagagaguaaacagccucuaaggagcaggauucugcgcucagaucggcguugaauccuggguccuuggaguccuggcugcgagguccuggacaaaugaguuguccucgcugagccucaguuucuccaucugcaaaagggcaugucgcaaagcuguguuccgcuaugcaagcagagcacucgguguggugccagcacacagucagcccugcgagguggcaucuguccuaguuauuccagcuucucggggggguaacaguuugcaaaagggagaagcauggaaaucacacuuaccuccgcagggcuccaaucaccagcucgcuggcgucucccgcguccagcagacgcgguagcagcggcgacagcgcgggcacagcaggcacagcgggcacagcgagcagacagcucaauaggagcagccggagacgcccugggaugcgagugggu

SEQ ID NO: 192948 - RNA, 37075 nt, Homo sapiens
uugagaacuguuaauugauuacuuuauuucauauaaaaguuacauugaaagaagagguugaaaagucaaguauacuugauuugcacacacuugccaagucucacaggauucaaccacuuggauaauuguuuuauugauaacaggauauacauauuaaaagccucacacugaagcccacacgcauguccaacccagacaacaaugugcaaaugaauaugcagaacaaucucggaaacuggcgucuccaggaucacccacacuuugucccucuggcugugacgcagcucuucccccaacggcgcacacgcuucugcggugaccaaguccacuuccaaacccccugcagguuugcucgcuuggcuaggacgguggcucagguaggucccuuugugguuuugcaucagcagugguagaagcccugauucggaugggguacagaguaauuaaaaacaaaaaacaguucacagaugaacagaaaggcaaaacaauucccaggagggagacgccaacuucucuuaguguggagggcaagcauaaaggaagacccucagacuuugucacagauugcuucuugaugcguccggcaaaaaauguacaaaccaggcaaguuuaaggcaaggccccacgaggggagcuguuggcuuucuggcauaauuuuaagcuccgcaccaaggauccuauuuuaucaccugugccguggguggagaagaaaacguaaaagcuaaccaaaaacuccaacaagagggcgccauccuggccauucccgacuggagcgcugccugcgguggcacagucgccccugccaggggcuggcugccucaugguccccuccccuucccagaggugcccaauggcugggcccugccucuccaguaaggaugccuccccugccccacacacagcaucgggcugccccaaguaucaagucaccgagccgcagcucugcucuuaccuaggugccauuuauacacugcuaauuuggcuggaacaaaaaaaaaaaaucaguuccaaggcccucaagcacucaagauuucuuuaaaaaaugaaagcaggagggcaacgaagggccgcacaggaacggcuguucuuuggaucgagauguccuccaacagcaauacauucauaguaaccacgggcaggaccccgcggcucucuccccucuucccugaaacgucgguuucuaaaaaauagcuuguuugcuguacacagccgguaaauguuacauugccuaaacaacacuggcaauuuugacacacaugcacacacgcgcgcacacgcacagacacgcacacacacagacuugcugagagggucaaaggaugucucuuccggggcagcggggagugugccggaagccaccuucacuguucagugcacagaucuuuugcaacuucagugcaaagcaucggagcuaaucgagaccaaaacgucuuucuauguaaacgcccugcugugauccggggagugcacugcugaguggcggggucagcaggagcccccugaaaugacugcuuggagaaucccuguucacuggauucacuguuuuucuucaugauuggaaacagcagcucaggacccaggauuugaauaacccauguaauaacccgaaguauucuccacagaagccccagcucugcaggaggccacggcguuuggcuucuucguguggccacacaccuuuccguuguuguacagguggggacugagagccucuuccucugccaucugugacuauaaauauauaaaacucugcuugcugcaagcaauugguuuguguagguuccaguugcccuguuggucacagaugagcuguugauauccuucagaccccaaauaaauaacuggaagucugugagcaaguuucagucugaugagccacgccucacacugagaacuccgggccaccuuuucugggucucgugggcagucgccuaaaucggaagcccacaaagggauucauccagaggagugaggggggccccccaaagacggacuucaucccuucccaucgcagccuccgcucccaugugggcuucucacuuuucaaucgcucgaucuccuggaagcagaaagaaaagcaaguggcagcggcuccaggaagcucggcagaccccaccaagccucagaaucacaccgugcucaagcacagugugggcucgauggaggguaggugagugaacucuccuucccagcucugccccgauccagaccccguggccucugugagcccagcccggcugcagccacguggccagcccagacuaccacaauggcccucccagccaggcaccaacauuugucgcucguuaguuacuguguacagacauuuacugagcgccacuccaggccugcagagccaggcccuaaaggcagucaguucccugaaauuuacugacugcacugggagcugggaaucugccuggcucugcugacuugcaaaucaaacugagacuagaaauaugcacugcccagaaugaaagaaacagcaaacacagggagcugguugcagcucaucaagaccgucccauuacguucccgagucaguccacaggcaccuauuguugacauuaggacuuuucauuuacucaagcuuggaccacauaugaaguccacacagccgagaacaaagcuuaccgucucgucguugcauauggaguggauuugggugccaaacauaacugcagugaaagugaaaaacagaagacccucaaggcacaggaagaucaacaggauuacaguuaucggaggugaaaaaucacugcauucugcggacaagaggaaguugguuauaacugguccugaauaccccgaguggcagaauguuuggcucagagaagaauccucuagggccagccccuggccagcuuccagggggaaguuguucacuuucuaaaugggcacauucauuguucuccaaggagcagaggagggccacccuuccaagcaaaaauucauaccaugacuuccuggccagugguuucaaaagagucuguauuuucugagguuucuauugacacuguauuuaugaauuaaauggcaaaugaagccagaccagaagaguugugugcacccauaccagugagcagugcucacaggagucuguucaccauguuccccuggggugggaugagccuguccagaccucacugcauaucuaagguaggauaacgagcaccuauuuucacuacacuugcuuagggucggucacucacguaagcaacgugaagccugcuuugaacaauggcgagcuagcugaccagcagacagacacaagcuuuuggggcaacaauauacuaguaaaauggugguguuaaaacuuaacuaaauucuuuaaaauucaauugcuaaaauaauugcaaugauuuccuucaaaauuggaaaacugguucuuccuuuaaagcuuuccccuuucauccaauaacagcaugcaaagccaggaaugacacauagccagggaacuuaccaguccacugcccucggacacaggagaugaacugaaauccacaaaggaucagagcauggacugaagacagagcuauauacaucuagaaugagggggagauugguuagucacuuuuauuuuuuauuuuuuuuagaaacagagucucccucuguuguccaggcuggaaugcagcggcguagucucagcucacugcaaccuccgccugccagacucaagcgauucuccugccucagccucucaaguagcugagacuacaagcaccaugcccggcuaacuguuuugcauuuuuaguagagaugggguuucaccauguuggccaggcuggucuguaacugcugaccucuagugauccacccagccaguuaguaacuuaaacaagucuuucuaagagcaaaggcugaugacacaucauguguauaccuccaucuugucagagaaaaaaaugagggaaggauuaaauggcagcaguugacauuuuccuacccaagaucauauuagaccaaguagaauaauuuuauagaaaaauauagcugggcaugguggcucacgccuguaaucccagcacuuugggaggccaagacgggcagauggcuugagcucaggaguuuaagaccagccugggcaacacagcaaaaccccgucuauaaaaaaauaaacggccgggcacgguggcucacgacuguaauccuagcacuuugggaggccgaggugggcggaucgccugaggucgggaguucaagaccagcccaaccaauauggagaaaccccaucucuacgaaaaauacaaaauuagccaggcguggugguacaugccuguaaucucagcuacuugggaggcugaagcaagagaaucacuugaacuugggaggcggagguugcagugagcugagaucacaccacugcacuccagccugggcaacaagagcaaaacuccaucucaaaaaaaaaaaaaagaaaaaaagaaaagaaaaaggaaauaaacucuaacauacuuuaggaagauuccuguuauuauuaauaaacaauagcgauugaggacaucugggagagaauuaaauuacagugaacaccuaaaauaauacaagcaacauauuacuuauugggacuacuuccugccaaugacagcacaguauuauaauuugaauccuggagaaaaggcuggagagaaacuggccugacguuaguagauuucucugcuccaggcaagaagcaguuaaagaauuucaaauucaauguaaauucaauacaaaaauauuuuuacuuacagugaagagcacaaaaaaucuuugauucuuuucuccuacacaauuguucacccacgggcagugaugauccauuuuccgaauacaucuuuugcaaauacugaaaaggagaguuugauuuuucaguauuccaugcucugaggaaaccagaguaacacaaccaaauaaaaucaaagguggaggaaaauuagaauguauauucuaauacaacaugucaaaaaauaucauacauucucacuauauuccuuuaagguuuaucauuuuaauuaaaugucuuccguuuccuaaggaaaauacucaauggaccaacagcuuggggcgaaaggucaaacuaagccauacuucacgaguucucagacacucccccaguagagcuggaucauguacaccuaucaguaauguuccuaauuuugcaagcuuacaagucuauuucaauaaaaaacaaaaacugaaauuuuacccucaaggagaaacauucuuuguaucuucaaauaauuccuaccacugaauccauauucacugaugaauaugcaguauggauugcauauucaucuugaaucaucaacuacacacccaggcaugaagucgucuuguuuuuaacagcuguauuuuacuuuugcccaaaacacucuguauguccaauuuuaaauaacuaauuugauuaucgauuacuuuuuaguccaagcuugcaccauuuaauuacaucaagcagacaucgauggcagcagguucgcugcaggcagacuugcuaucauagcgucaccuuuuuuuuuuuuuuuuuuuuuuugagauggagucuugcucugucgcccaggcuggagugcaguggcgcaaucucaaucucagcucccugcaagcucugccucccggguucacgccauucuccugccucagccucccgaguagcugggacuacaggcaccagucaccaugcccggcuaauuuuuuuuuucuauuuuuaguagagauggggguuucaucguguuagcuaggauggucucgaucuccugaccucgugauccgcccaccccggccucccaaagugcugggauuacaggcgugagccaccgcacccgcccauagcgucaccuucuucuuauucauugaccuuggcucccugcccgaccuccacagcaccugacuuccaaaacauucccauuuuaucuucaacagauuuauugaaguauaauuuauauaccauaggucaggcgagguggcucaugccuguaaucccagcacuuuggcaggccgaggcagguggaucaccugaagucaggaguucgagaccagccuggccaauguggcaaaaccccgucucuacuaaaaauacaaagaucagccaggcaugguggcgggcgccuguaaucccagcuacuagggaggcugaggcacaagaaucgcuugagccugagaggcagagguugcagugagccgagauuaugccacugcacuccagccugggcgacagagcaagacuccauccccccauccccaaaaaauuuauauaccauaaaaguucacccauuugcaauguacaauucaaugauuuuuauucuaucugcagaguugugagaccaucaccaucuaauuuuugaacauucccaccaucccagaaagaaaccucaccccauaugcagucacugccuauuucuaaccccagcccaaaacagccacccauuuacucuccgauaccauuucaucuuucuuuacuuucuggccaaaccaugaggauaugaaucucuuaaagcuuucacuccagccauaaagcagucagcacccuguaucuggguuuccucccguuggaggccaucaauggcuuccagccuauucaagcaggccacgaccccccaggagaagggcacuguccaggugcagccugucacacaguacagggacgugugacaacuauuucaaggaauggagaaauacacccagacauucacacuucaacacgugaaaucaacagccagccccuccaggagcagaaaaaggagucaggaacuggcaaaugugggggaagaggauaaaaugcaaccaagaccagcaggggugaggugugagggccaggaaggcuacuugagccaggcagauaacuggacuguggcuuuuaaaaaauacaguaacugguguuugagagcacgcccaaauaaauacaaaaaaacaaaacaacaaaaaaaugagagcacauccaaaagaaccuugcuucuacgcugcaccaccaccccagguaagaacaaaagugaacgcacaacagccucucuggcuggcuggaagaacccagagcaggagugaggggaagguucugagccuuucuucuggcccccacacaggaugugcccaggagcugugagcacacacgugcuggccuguguggcaugugugccacaacagaggcgggaaccuugucaccuccuccaguuguugagccacagcgagucccucgggaaggaggggaucccugaauccauacuguuucccagcucccaaaaagacucuagggcaccggcccuuuacucagcucccuaccccagaaagaacaugacaccuacggccccgcccguacaacguugcccagaugcucgggggccauguaccuacgguggugggcgcacucugguuuaauacagcagcacacguacccgcaguggcggaugcgcucggguuuaauacagcagcgcacguaccugcaguggugggcgcgcucggguuuaauacagcagcacuuggggcacuuguagaugacuuccccgggcuucagcugcaagcucuccauguauucuuucguagcguuuccuuuggguacugcccccuaccauauaagaagaauguacuuuaguuggggagaaugaaaguuaaaaacaucaggccgggcgcagugggucacaccuguaaucccagcacuuugggaggcugaggcggguggaucacggggucaggaguucaagaccagccuggccaacccagccuggucaacauggugaaaccccgucucuacuaaagauacaaaaaauuagccaggcgcgguggcaggcgccuguaaucccagcuacuuaggaggcugaggcaggagaaucgcuugaacucaggagguagagguugcagugagccaagaucgcgccguugcacuccaaccugggcgacagggcaagacuccaucucaaaaaaaaaaaaaaaaucauauauuuucuauaucaucaaacaauuaaaaaaaacuaccuuauuauccuuuugauaaauggcuuaaccaccugcauuuucagaggcaaggcuuauucccagacaagggcacugacuguccccagguggggcagggaaccucuuugcacaccacuucccuguagccccugcugacagggaggugacugauaagcacugcccagaguuuucuuaucgggcagucggggaacaaagaacaaaacaaucucaaaaaggacuuuaauuucguguugcuaaagugacaugauacuuuugucucuuggccaacuuccucaaaggcauucacacacaaaccuggagguggcgguccagaccaccugacccgauucaugucuggcaacgaggccgcccagcggcaucagaaacuugaacaugcauccaucugugccccaagugcuagaggagcuggagaagaugagcaauggcgaagcagcggaaagaggaguuggggaggcugugagcugcugguaaggggcagagcugaaggccaagagucacccuaccagcaccaugucaacugaggacccgcuguagggaagguaaggccagagcuggcugcaacagcagaggcuuuguucuuugggcaguggagauaagucaucaaaaccauguuugugggagacaauucugggagcuguggcaggguggaauaaaauaggcagaccugccuggggguuccaaugccucaagaagaggaacaaggccuugugucugccucuuagccuggauccugcacuucacguagaaaucacagaucuggagaaugagacccacggacacugggaacagcagucagggcugcagugauugugcaaagacaggggauauagguggggcaaauggaaggugggagcuaacagccugggagauggcagagguggugaagggcucugccaacagcagauggcccugcuggagcuccuuaaaaugcaggugccucgcugggcuccggagccacagaucugaaccucugcagggugaggguugacauccaaauuuuagaaaguucagcaggugagcgcccugcagagccagagacugcugcccgcuggauucagggcuaccaacaggccagagcuggagccuugggcagcacaggcaggggggccccagggcaaaugugaguguugacugcccaaaccuccccugagguuuacuuccuccaaacaaggccccgucagucccauggccgcaauauggggaagcuguuuuggucaagaucaaaguguuuccuaacaugcugccuccuuaaagaaguuagaaaaggguuuaaacucaucuuugaaaacuuaaaucagaauaaguaaaacauuuuacuggcugggcaggguggcucacggcuuuaaucccagcacuuugggaggcugagguggguggaucacgagguuaggaguucaagaccagccuggcaaagauggcgaaaccccaucucuacuaaaaauacaaaaauuagcugggcgugguggccugcgcuuguaauaucccagcuacucgggagggugaggcagagcacccgggagguggaagcugcagugagccaagaucacgccacugcacuccagcaaaaaaaaaaaaaaaauuuuuacuuaacuuacauucuacaauuuagagucuuuuuuuuuuuuuucuuuuuguugaaacagaguuuugcucuguugcccaggcuggagugcaguggugugaucuuggcucacugcaaccucugccuccgggguucaagcgauucuccugccucagccuaccaaguagcugggauuauaggcgugcgccaccacacccggcuaauuuuucguauuuuuaguagagacgggguuucgccguguuggccaggcuggucucgaacuccugaccucaggugauccaaccgccucagcuucucaaagugcuaggauuacagguaugagccaccgugccuggccuggagucuucaaucaacuuuccuccaacaaucuagggaucuuaacacugcuuugauuuauaaaauuccacaauguugcauauaugccccaggugacagucgaguguuacacaucuccucagaggaaaugggccagauuuuaaaacuccaaacaccguaauuuuaugagccaugcaugcacuuuuccacagcagcagcaaauaugauacgauguggcacgauacacuucuggaaagcggcuaccccaacgcuaccccaguuuuuggucacuuaugaccaaggaaaggcauuucgaaggggaagccaaguacacauugggugauccucagggaccugagacuaugugggauuucaggcacuugcuggguccagggauuccuuuuugcugcucagaaccuugggcagacaaucagugaaacucuucacgggcaugguguccuggggguuucaaggagggguuccuuccaccugaggccccgagucuaucaccuacauuuucauccugagccuuucgagaugugguuuggcagaaacagagaccauaugcagagggggugugcacggcugcaccaucucaaagggccucgccaggaugugcccacgaugacagcggcaggggcuggagcaccguuuccucugcacccauggggcauucuucuucccaccagaacaaaccuuccaaguaauugagcacauuccucaguucccauuuuaaccauuuucgggacguuuuuuucuaaaacacuucuugaauguuucccacucaucuucuugugggacugaccauaggcuccaggccaugggaugccuucaggcuccucccucccacccaaacacccagcggccucccuucagaggugcucccugauuggcuguucccucuucuggugccccugcccacaucccacuuccagucagcccugaugagacaaagcagccagccaggcccaggcaaggcgcucugugccaccucgcccuuccagggcaguuaggcuucgcagagcaugcuuccgguccucucuccccugcucuccaccccagcucccugucaugcauucuggauccccagggccuaacuaagcggcagguaagaauggggccgggccuguggaucugccuccuaauuuauggaaaaugcuggggacgaggagcacagcaaaacccaguacagggauguaaacugcaaacaaagaacuguguuucuucaacuuaaaccccaagggaaaaaaagacauugcagggaccagagagauuaauuaaaagagaugucagagacacauaaaccaaucacacuguauggauccuuauuuggauccugauucaagggaaaaaaauuauaaaagaauugagacaggccaggcacggugacucacacuuguaauccuagaacuuugggaggccgaggcaggcggaucacuugaggucaagaguucaagaccagccuggccaauaugaugaaaccccaucucuacuaaaaauacaaaaacuagccgggcaugguggcacaugccuguaaucccagcuacucagaaagcugaggugacagaaucgcuugaacccaagaggcaaccguuucaaugagcugagauccugccauugcacuccagccugggcaacagagugagacugucucaaaaaaaaaaaaaaaaaaaaaaaagaauugagacaauugaggaaaucugaacucuaacaggagaggugguauaaauacauugcuuuacaugagcuaccgguauugagguuauguuuuuacaaagagcccuuuuaaaagauacacacguuuacaaaugaaacaaaagaaugagugagauuuaggcggguuaucugggggaggggaacggcgugggcgaggccaccacaugauguggugacaagcucaagguggagcgcucuuuucuuccuaccgugcacauuuggaauuucccauaagaagugaaauuuucgaggccggggcucugaagauagacaaucugguucaaaucccagccuggccucuuacuggcacagcgaggccucguguucucacacggaugcuacaccuacgucccagcacugcugugacggugggaggaaagcacgcuuuuggcagagcuccuggacagcagucgcggccccaugaaggcuaccuccggaaggcacucgcacggcugccgagaaggcucguaggcauccacggggcuggcauugaagacacaggcucuaacaaguaaagggaugcagggcccagggccguggguggccuuccucccucccagcccucucacgaucccaaagugaagccugggaucaaaguugcauccuuccacagcaggguucauugcucuaucaguaggccucugaccccaucuuccccuccacuccucacucaaagcaccaaugacuuuccucaagugacaauacaaaucccaauuuguauuguccagggcaaucccagcgaggacugcccaguccuauugguuuagaaaaaugacaugaagucccacugggguaucugccccaaccccucaacuguucaguucagaggugaugugaugguucuaguucagccuggacuggacccugguaggguaaagacaugaucuguggagagaagaaaucaacuccccacugggagaacagaggugacaccugacccugcugggccaugcccacucuccccuucagaaaaguagaccuggacaucagugacugccacuccaccugcucugaggacugcccuucuucccugggcagcaggaaagccaggacucagagagacagacaaagccugaggacagcugccagccucuccccucuguccaccuuccacuccacagccugccagcagccagaagcauccuugcccuggggcucugcguacucccccuuccucaguuucauuuacagugacuccuggugguuucugucacuugucaccagaggacucaagcagacaugcuuccaaagaagacacacaaauggccaacaagcccaugaaaugaugcucaacaucguuggucauuagggagauacacagcaaagacagugagauacggcgucacaaaagaauggcaauaauguguugaagauguggacacacugcaggugggaauguaaaaugguguggaugcuucgauguuuugggguuuguuuuuuuuuuuucaucauucccuuccccacaagauuuuuuuuccauuuucuuuuuuuucccccaguggggacacuuuagagaauacuuggcaguuccacaaaagguuaaacacagagucaccauaugucccagcaacuccacuccuagguauauacccaagaggaaugaaacacccauccacacaaaaacuuacacgcggccguucagagcagcaugauuuguaacagccgaaaagcagaacucgcccagaugcccaucaacuaacgauggcuauaggugagaaggguccggccagagcauggaauauuauucagccuuaaaccaaaugaagcacugaucaugccacagcacgauggaccccgaagacgcaaugccuggugagagccaggcacaaaaggccacagacgagaugacuaugaaagucccucaacaggcggccaggcgcaguggcucacgccuguaaucaucccagcacuucgggaggccgaggcgggcagaucauaaggucaggagaucgagaccauccuggcuaacacggugaaaccccgucucuacuaaaaauacaaaaaaauuagccgggcaugguggcaggcaccuguagucccagcuacucggaaggcugaggcaggagaauggcaugaaccccugggggcggagguugcaguaagccaagaucgcgccacugcacuccagccugggcgacagagugagacuccgucucaaaaaaaaaagucugugaacaugcaaauuccacagagacagcagaugagugguugccaggggcagagggcgucgggugguggggucggggaacugggaagugauggcuaaggggugugggguuccuuucugaggugauaaaaauguccuaaaaccgacugggugaugguuggacacucuguggaugcacuaaacaccacgggacuacacacgaggauggauuuagugcuaugugaauuaaaucucaaucaaaacaccccugacauccaagaucuccaacuucucccucaguauguuccauucaacauucucugcaguaauacaacaagcaaaagaaaucugcccaccagggcggcagcacgcccugcacacaccuucuacccugacuuccuggccgccuccagcucuccaggcuucuggggccuuuuccgcaggagcaggagcggggugggagcagaagcuggacugcugaguagcuguagagucugagcgcagaggaggaaggggcaagugcgcuugucagcaaagaggagcaaacugcugaggacucccagccaggcugacccucccccaugugccuaccccacacucacaagcaggaggcuuugcacagacucgguucccucaccacaaaugcccacaaggguuggguccagcccaguuuucacugugcaggcagauggucggcagucacuggauuuuuccuacaaggcaauauuccaguaaaaaucgcugagcuggaccuggcccuguagcuggcccucuccuuugucgaagugccugggcacuuugggcaacaaacaagggguuucugcugcagccaaggaaggagagggcggagacacacagggaucaggagcagggucuggcuccuagagggagaccugccgcguaaaaggaaaugacaagacaggcuuuaauucucugaaggcacaaacccaucgaagagacucaguuauggucaaagacuccaccaucagaucaggcuacaaagccacuggcagacuuugcuuccaaguuuguccccaagguaccacuccccagcugcccucugguugggccuauaauacugucccauucccaggacagcugcccaugaccucuacuaguaaaacaggagacaguaaacaauguacauccaaacccugaauaauuaauucagauaaagcaaagacagauaaagccacgugcagaccacauucugugagcugauccguuucaguuuauucucaaaaaagaguccuggucaggcgcgauggcucaugccuguaaucucagcacuuugggaggccaaggcggguggaucaccugaggucaggaguucaagaccagccugaucaacauggugaaacccugucucuacuaaauauacaaaauuagccaggcaugguggugcaugccuguaaucccagcuacucagagggcuaaggcaggagaauagcuugaacccaggaggcagagguugcagugagccaagaucgcacauugcacuccagccugggcaaaaagagcaaaacuccgucucaaaaaaaaaaaaaaaaaaaaguccuuaucuuauuaacgucuggguaccuucuuuagagaaagcuuagaaacagacaagaacccaguagauuuuaaauugacaaauugggagucccuauaccaugguuuaaaaccacuguuuuaaagcaguggaaagaacuuuuuucaaaugaaaaucuacugacugcuaauaccugacuuugcaugccugcagcugcugggcgucuccuccgagcucugugggaagccuggaacucacuuacuagaggugacggauggcugagcugcaagaucuguacgaucggcccgaaugccccucccugauugaaggaugucucaaaacucaggaacagccugaaagcccagcuggaagcugaaucugguggccugcaaggcgucaggaacuagggguauuucacugcgcuaggucuggccuauguuuauucucagccuaaagggaaucugcucccaaaaugagcucaauccaccuuucuuguuccacacccaugucaauaugucccugugcacugcuuccuccaaagggucagccacacccgaggacacuagaccagacacaagagagccacccagagacgcagccaguacucacagggucggugagcaugguucucaggugggaugacagggcaagcacggccaagcaguuaaagaugaccccguugaccacagaguaccagaagucuuuggaaggcagcagcaugacgaaagucaccacgaagucugcauaggcgaccagaagccacgucaugacagcacagaucaugccgcagccgucacggaugaaccagacccggucagccacgucagccucggaggaggaggacgaugaagagucauaguugucauuuucagccaggagaggaugaugcucgacgucccggagccuguguccugauggcugcaugauuucccugacgcacccuggggagggggacgacacagagcugguaaggcucaaaaagcucacaagcuaccuuaaauaugauguguuacaguuuguccuuggccauuucaugaaguuagucuaaauacacauagugggaaagaacauaaaaacauaacuaagaucugaauuuuuaaaucucugacuugauugauugcuuuacuacaacacaguaagucccacaguacagguuaugccuacauauacaaaaccuaucuauggccagccguggccacauacaaagauuauggaaagcacaagcuagacgcgaagucccagcacuggguuccccggcagcguggagaggagcucugcuguaucacugcugcgccugcuccccugagccccaccuguuccugcucugcucagcagcucaccuaaaugcucccaagcaggugcucggcacacacuucagcaagcagcaugaugaaagaaugacgaguaagucacugguucucuauucaucuuuacaccgccucauacacacugaccucauuggucuuaccugauuuuccucaauuugauucucaguuuauccucgcuuaucugugauguuuuuggagcagacucccauuuuuauaucucuguuccuugacacucuacccugcuucuagaaugcccuucaucucuauuuuaaucuuuuuuuugaaaccaagucucacucuguugcccggcuggagugcaguggugcgaucuuggcucacugcaaccuccgucucccagguucaagugauucuccugccucagccucccgaguagcugggauuacaggcgcccaccaccacaccuagcuaauuuuuuuguauuuuuaguagagauggaguuucaccauguuggccaggcuggucucaaacuccugaccucaggugauccaucugccucggccucccaaagugcugggauuacaggcaugagccacugcacccggccucuauuuuaaucuuuuaaaaguuuccuguuuuuguuguuuugggaacacagucucccuuuguugcccaagcuggagugcaguggcacaaucacagcucacagaugaggucugacuauguugccugggcugcucuggaacuccugggcucaauccuccugccucagccucccaaagugcugggauuacagguagagccaccaugcccagccuuuccuucauuuauuaauccauucuuuugcaagccaucauuuugacacuucuucccuauuuccaauagcaucugauuucuaagaacauacaagaucuaaagaaacuaaagaaaaaaguaggaccgggcacaguggcucaugccuguaaucccagcacuuugggaggucaggaguuugagaccagccuggucaacauggugaaaccccgucucuacuaaaaauacaaaaaccagccgggcaugguggcgugcgccuguaaucccagcuacucgggaggcugaggcaggagaaucacuugaaccugggaggcggagguugcagugagcugagaucacgccacugcacuggacucagucucaaaaaaaaaaagaaaagaaaagaaaaaagugggucaggugcggguggcucauaccuguaaccccagcgcuuucagaggcagaggccgguggaucacgagguuacaaguucaagaccagccuggccaagcuggugaaacccgucucuacuaaaaauauaaaaauuagucgggcacaguggcaggcgccuguaccuguaaucccagcuacucaggaggcugaggcaggagaacugcuugaacccgggggguggagguugcagugagccgagaucguaccacggcacuccagccuagugacagagugacacucccucuccagaaacaaaaagaaaaaagugcacuuuuccugguaacuguuuugacugcuucuuugauuguacgcccuucucuuaucgguguuugcucugagaguuguaauaucacagauaaagagccagggaaaggaagagacagucaauuucaccuagcuuugccaugaggagaaaauacugacaaauauuuuaacgaacugacccgggcaccuucucagagcaggagcgcuccucauauuuuaagcaggcagagugcagaaaccauggcuucugaaaugugaauaaaggaguguaguaagaauguucucagaggucaggucacuacaacugaguaacagcacugggugcuguuuuucaaaucugggugugacuuuuucuuuucuuaaaugcaacuggaacauagcaauuaugaaaacauuugccgaaugaacauguggugaggauucauucgccaaauacuuuaaaaaauuuccucucgaugcaaaaaugcugacugguacaagagcaaaaugaaauuguuuuccaaagucaguaaaauagcccuauuuuucaaucagauaaaagcagcuuuaaaaaauguuuaaggcugggugcaguggcucaagucagcacuugggagacugaggcagaaggaucauuugagcccagaaguuugagaucagccugggcaacagaguaagaccucaucucuacagaaaauaaaaauuaaccaggcaugguggcuugcgcuuauaguccccccuacuagggaggcugaggggggaagauugcuugagccugggagguggaggcugcagugagccaugaucaugccaccgcgcuccagccuggaugacagagagauccugucucaaaaaauaaaaauaaauaaauacaugcuuaaggcugagugugguggcuuacaccuguaaucucagcacuuuaggaggccaaggugggaggaucucuugagcccaggaguuugagacuggccugcgcaacaugggaagacccaaucucuacaaaacaaaauuguuuuuuuuuuuuauagucaggcaugguggcacacaccuauagucccagcuguuugggggacugacguggaaggaucgcaugagacuggcagguugaggcuacagugagccacaaucccaccacugcaguccagccugggcaacagaguaaguaagacccaaugucaaaaaaauuguuuuaauuaaaaaaacuuuuaaaaauaaucauuugagugaaauagaaaaaacuaaagaucaaaagaauuuggacagaccccuuagccaaccauuccuucagcauuuucugaaccuacaucuucugcaucugucugcucaacauccccugcaaacaccuuugcagcaccauugccucuacauaaaccucauucacccugcagggccuaacuuuucucucuucuaggcaagccaaccugaaaagggaguucucuucuucugaggagcacuuugcgaagaggucucuagacaucagaugugacuauccggagauaaaggcugaaacugcuucugccugcacuacuaguaaagccugacugucagggggcugagaaaguaccuggaaguuucucugccuccgcugaagcccugggcacgcucaccagcucucccucccagguacuuaccacuugcuaccugagagcucuugcagguccgaccucccggccugaugucagccccuccaggggggucugggucuccuccugcccugucccccucaugccuugcaugcugucuggcgcacagcaagggcauguuugcuaaaaggcagaugcaacaaaaagcaagcagucccucucucagauuccaaucaccuccugcugauuuccaucuaaguuucuuggugaaucguuaucugugggcccagguacaucaaggccguaagcugaaaaauuccucugagcagaaccauuuugcuuuauggugacuucucuaauaggacacguuccaugagaaaaggaagggugcuuuccaggcaguaaaacaagcuauacuuuugucagagcacaauguuugggcagucugagcucucuccagaaagcagggccucuugaaagucuucuaaaggcacacaugugacaccugagccagcucagcuccgccuuccugguucagguccugguaagaccuccacggagugcaggaugcugcuguggcuccaugccugaccugggggugcggauggcaggcacagcuguguaaggagagcgcccacagacaccaaacacuggccauggcaggacguuccuauaagcacauauuagggugacauaucauacuugagggcuuuagugccauaucuguaagauccauuagaagucaacaggaaaauaacaugaaauccaaaaacugcuuuauuuucaacaaagcaacaaacgaauauagcaaaguuaggcuggacaaauacagcucucaguaacacagugcacucacucgugucucugagucacuguauuuacacuugaguaaugcaacaggaagggaggggaagaaaugaagaaaccauuccuuuacauggaagcuaaucuaaaagcaaacagcacagccauuugagaugcgguauuaaaauguacacauuccuuaggagcaagggcacagccuuauucugcacugaauuccaaaaccaccguugacuucauacucaagacaguuucugagggaaccgugaaacacugggcacucucacacagaugccccagcaucacucuucuacccuaauggccgauuuaaugggauuuucucaacacucccgaaccuaagcucuuucucggcauguuaaauaaagcccuguuucccagaacaccaaaagcaacacuacaaaucuccauauuuaaagggacaaccacacaagcaaaaacuuuccguuucaggccgggcacaguggcucacgccuguaaucccagcacuuugggaggccaaggcgaguggaucacuuguggucaggaguucaagaccagccuggccaacauggugaaaccccgucucuaccaaaaauauaaaaauuagccgggcaugauggcgggugccuguaaucccagcuacuagggaggcugaggcagaagaaucacuugaaccugggagacagaggucgcagagagccaagaucacgccauugcacucuagccuaggcaacagacugagacuccaucucaaaaaaaacagacaaaaaaaaccaaaccacuuuccauuucagguggaaagcgggguauuccccucaucuugugauacuggccaagaacucaucaauucaauucauggaguccccuccacagauacacccuccuuuuaggaccggaaggcagcgggugaaaaggaaggcgugccugucagcuuggcaccacgccucugcuuugccacaugcacagguuaccuuuuuaguaauauacaagcuagugucagcugugagaaaggaaacagugauuggacccuaaauaaucacacucuuaccucacaaguuauuucuaaacaucacuugaacauuuugugccguuucuucaggaucuuaaggugcauacuguccuaugugaucggaucugaaagguaauaaaaucugauuagaaaaagugauuuauuuuaugacagacgugugucauauuucuuaggguaugauuaauuuuuggagcguaacauuugacgcaucaaguucugucacucagaacuauccuuaaguaugaaaucauugcucuucuaaguuuugauuacuagguaaauucacaauccuggaaaucaaguaauuuauuuuaaauauuuccauuuacccuccugcucuuuuagccccaguguuaaauacagaucuauaagcuaaaaucccuccagaaaaauccccuagggcagaccaaaucuggguagccugcacuucuaccgucgauaagcugauuuacuggccacauuaaaggaaucacagaacagagagacagagcacuugaggcaggagggguggacuagaauggcaggcccugcugugggaggggcgaggaggugaaggaagacaguggaacccagugagggccacucaaugagagcagagacuccuggcacgcaucucccacguagcuccccgaacccugacagaugggagggucgaggaauccucucuggcacuaacaugacccaagaaaaaggucuaaagacucugcgauguagggaaaacccaacaagaaggucagauucacugucagaccucccuaagucaggggccacagggaaacccccgccacggacacagagguuccaagugcuugucguagcuccauuauaaaaaaagaaaguccaggccaggcgcgguggcucacgccuguaaucccagcacuuugggaggcugaggcggguggaucaugaggucagaaguucaagaccagccuggccaagauggugaaaccccgucgcuacuaaaaauacaaaaauuagcuggacgugguggugggcgcuuguaaucccagcuacucgggaggcuguggcagagaacugcuugaacccacgaggcggagguugcaguaagccaagauggcaccacugcacuccagccugggcgacagagcaagacucugucucaaaaaaaaaaaaaaauuaaauccaaacacgauucaugaaagagcacaaaacagaaaugaaggguaagaguccagaacacgcacaaugcacagagaagaaaaugucaacaaggcauagguaaaauucauauucuucaaaauaagagaagagauugguucugugaaacaaaaagaggaacaguuuaagaacuuccugguuauucuacaacgaaaauacaacagucuauagauucuaaauuuuccuuuuuuuuuuuuuuuuuuugagauggagucuugcucugucgcccaggcuggagugcaguggcgcagucucggcucacugcaaacuccaccucccggguucacgccauucuccugccucagccuccugaguagcugggacuacaggcgcccaccaccacacccagcuaauuaucuuuuguauuuuuaguagagacgugguuucaccauguuauccagaauggucucgaucuccugaccucgugauccgcccgccucggccucccaaagugcugggauuaaaggugugagacagcgcacccggccucuaaauauucuuaaacagaauuggacaaaagaguagaaaugggccaggcacaguggcucacgccuguaaccccagcacuuugggaggcugaggugggcggaucacaaggucaggagaucgagaccauccuggcuaaaacagugaaaccccgucucuacuaaaaauacaaaaauuagcuaggcgugguggugggcgccuguagucccagcuacucgggaggcugaggcaggagaauggcaugaacccgggaugcggagcuugcagugggccgagauggcgccacugcacuccauccagccugggcgacagagcgagacuccgucuaaaaaaaaaaaaaaaaaaaaaaauagaaaugucccagagaggagaacuagaagacagagagaaaacacugagaagagaauguaaaauaaaauuagaagaucgggucuguaaucccaguacuuugggaggccgaggcgggcggaucacgagaucaggagaucgagaccaaccuagcuacuaacacggugaaaccccgucucuacuaaaaauaaaaaaaaauuagccgggcgugguggcgggcgccugcagucccagcuacucgggaggcugagacaggagaacggcgcgaacccgggaggcggaguuugcagugagccgagaucgcaccacugcacuccagccugggugacagagcgagacugucucaaaaaaaaaaaaaaaaauuagaagaucgggucaggagguccaccuuccaaacaacagagguugagcacaggggucccugggagaaaagggcgcaagcagaucuccuugugguagguuucggcucuggcuucggcgccggcugccuggcuccuccacuccaucuguagcugagaugcuuccacgacagugcuuuuucugccugagucaacccccagcuacugucuguugucugaaaccaagagcccugacuaguuucugaaaacauauucuggggugccucccgauaacccgagauggcucgcugucucccgcccuagugugccaagccuccaccugggcccgcucuguggaggucccugugcccaucacaccgacugcaagaucccucaggggucgcuuuucccucaagcuucugcccaggcccuagacaaacacugacacagcacugguuccccaacagagcuccagcucucaaucccuucugaaccuuuuuuuuuuuuuuuuuuuuuugagauggagucucacuccuuugcccaggcuggagugcaguggcgcgaucucggcucaccgcaacuuccgccucugggguucaagcaauucucuugccucagccucccgaguagcugggauuacaggugcacgccaccacucccagcuaauuuuuuguauuuuuaguagaaacaggguuucaccauguuagccaggcuggucucgaacuccugaccucaggugauccgcccgccucagccucccaaagugcugggauuagaggcgugagccaccgugcccagccuaaaugcagcauuuauauauaguaacuuuauucaaacaucuaugcaccagccagaaacuugaaaugcuuaguaauauuuugaacuguuuuccaaugagcuuaucuuagcaaugucuuaaaaucggaaacugguuugcaaaauucaggacugugaaucgcaagcaucaggucuacaccagauuuucuacaaugagaucaaaucuccaauuaauuuuauaaauuuuaaaaaguaaccacuuuggaaagcagucuggcacuuucucaaaguuaaacaaauaccuacccugugacucagagauuccacuuccagguauuuacccaagaaaaauaaauauaaauaugaacacaaaaacuuguccgauacuguucacagcagcuuuguucauaauacccccaaacugaaaacaacccaaacccgucaacaggaaauagauaacaaacauugguguauucauauaauggcauacuucugagcaaaaaagcaggaaaauauuacugauacaagcaacauggcuaaaucucaaaaauauuaugcuaagugaaagaagccagacacggaagaauauauagugugauucuauguguaugauauucuaaaugaggcaaacucguuuauuuagaaagaaaucagaauaaggauuugagcacaaguagaagugacuguggagagggccaagguaacauuguaaguugacagacaugccuguaucuugagagggaagugggugacacaggcauaugcguuugucaaaacaaaauacaauucgcuguuuaaaaaaagcccaauagacuauacacuuuaaauuguggggccgggcacaguggcucauaccuguaaucccagugcuuugggaguccaaggcaggaucacuuaagcccaagaguucaagacuaaucugggcaacauggcaagacccugucucuacaaaaaaaauuuuuuaaaaauuggcugggcagggccuguacucccagcugcucaggaggcugaggcaggaggaucgcuugagucucggaggucgaggcugcagugagcuguguuugugccacugcacuccagccugggcaacaagcaagacccugucucuaaaauaaaauaaaauaaaauugugcauuucacuguacauuaaucaugccucaauuaaaaacaugagcaggagaaaaaauacccagcacagguauguacggccggugugauagugcaagggugcggcacaaggcaagucccagcgagcaguggagucacuuuucuuccuggauaacccgcguuccugaguccagacccugucuuggauuuacuuguaucuguaacuucaagcaagugucuuaagcucuucgccuuuacuuuuuuccuuggcuauaaacagaaaauguauuucucaggaacacacugaaaacaaguaaacaaaagauaccaguauucucuggugaucagugacuacagaaaagaaccaagacauaauuauuuuuaccacugcacugcuaagaauguccacccuagagucugguauccauguuuauauuaaaauacuauuuaaacuugucguugcuuuacuguucauacacccacuucagccccauaaaaaacggaauuaagcaaaccuguuuuaggacagaagguuacaaaacaaacucaaccccugccaugaacaguccacucaauucaaacaucaggcuggggaguuggggggugagcauccaagcacguacucugugcaaggccucaaggaugugcagccaaagacagccugagccacaggagcagagcgcacacagcagcgaggugaggauccaaugugcaaagugcuuuccccaaguuagcagcaaagugugaucagggagagaaaugaaaacagcuacuucuggaagaaccagagaaagugucaauaaagacaacagacagcaugggugggccccagcagaccagaaagacauggacaagagaggacaaucaugugacacagcacagaagggaauucagcauuccagaggggaaugugaccagaaggacaagccugagguccaauggaaccacagccugaaugccacgcuaagaaaccuggaacucuagacuucacucugcuggaaugggaggcaccagaccuuagguaaaccagaugguuuaaaagauaacuggggccgggcgcggugccucaugcccguaaucccagcacuuugggaggccaagguggguggaucacuugaggucaggaguucaagaccagccuagccaacacggcgaaaccccgucucuacuaaaaauacaaaaauuagccaggcaugguggccaguaccuguaauccuagcuacuugggcagcugaggcaggaaaaucacuugaacccuggaggcugagguugcagugggccaagaucgcaccacugcacuccagccugggcaagagagcaagacccugucucaaaaaaaaaaaaaauuaaguaaauggauggcaagagccaggcuucucacuguugggguggaaguuuccagguaagcaagaggaggaagcuagaaugaccuaaguuuuugguuuaaggaagauacaagcaguugcauauggaaauaucuacagauauguauacacacauggguuagcauccacacauauauuuacuugcucugucagcugagacggccuagaagcaacacaccaacagccaccagcacaccuaauucccagaucuugguuuguuguuguuguuuaauauucaagaugggaucuugcuaguugcccaggcugcucuugaauuccuggacucaagcgaucuucccaugucggccaaagugcugggauuauaggugugagccaccacagaucuugguuuuuaauaccauucucuaauaaauaaaaggaaccaggacugaggcaaaaaaaauaaauauauauacaagaugagcuuggagcaucuuguauugccagagaauaaugaaguguucacaauacacacacacaaucauggggacaggugggcucaugaaagggauauaggaaccaaguaaaagagcucccaauggccaaagcuuuuuccaggaaaauaaaauaguauugcuuuauaacccgaagcaucaaguaaacaugcacgaguccagacugauauaaagcaguggcugaauaaacagaaaauagacaaauacccagcgccacgaguccgaggaaugccuguggcuccuccuccuccagcagggaggacgcugcuccccaccccucaaguauggccguucacagggacaguuucuaacgaguggaguacggaaaggaggaaaauaacuuuacugaggagaaacuuggcaaacaccaccucagucagccagguguucaaggccacauccauagcaaugaguccuguggacagaacacagccuugacaggcuguggcgagacaggcccucuaacugcaucacccaagucuagucauaaggaaaauaucaaacaagucccaagagaagagcauccuacaaaaaaaucccugacccacagcacugcucccaagugccagucauccaaacaaggaacgccugagaaagcaccacagccaagaggggcugacgagaugugcccacucauguccugugugauccugggugggauccugggacagagaaaggacauuaaggaaaagcugaggaaaucugaaucaagugugaauuuuaucgauaggagaaagcguggguggaguggggggauggucgacaaagcggaaugauccuuccucccuggaggaagaaaggggaaacccgggcaugaagagaagugaaagcaguucacucaggaagacgagugcugagugucucagcagagaggaggagcggggcugcggcgcugggagggccuauggagaccgcaaaauggaaaugggguggagaggcggcggccaagaggggccugaacugucacccugcagggcccagacaaugcugacaccuuaagugucucauagaggaugggaauggcugguccuuuuauccaaaagcccagcccagcaccauaaacuuacccagggcuggagauuagccaggaugaugggcuagaaaagcagaguaacgaaggcaagaccaagaugcaagcgggagaggccaaccucagaguccagggggcaggaggagaggccugguaagccaagugaccgaaacucagggcacugagggcccgaggagccugagaaacagacucagaggaagugaggggcaggacugaggcuggguccaggggggcgcuguaagauccggaggcagugguuccuaugggccgugcaaacggggccacaucccagguaugccaccagcccggaugagucagggaaccugagucaagguggggaaggcuacagagggagcucacguccucccucaacucacaaaaggagcgcagcacucagcugacccacugcagugagcugauggcgacugcgcuccuaagugcucuugccaucaacuggcaaucaugaaauauucaguuuguccuuucaaauccuaccauaggaaaugaugcucuaagaaaccaugauuuucuacucaaauuacugaauccaaagaucagaauauuacuuuuaaggaaaaaaaaaauccacaccagaauauuaacccaacucaagccagaucucaaugauaugcuggcacguaagucauacggugaauagugacauugccugaccuuucuagaagggcauuucauauuaaaauacuuaaucacucuacaguaggaucagaacacugcagaucaaaaacauggcaaagugggggaacacacacagcacacaaugaaccguggaagugggagagggaacaccagucucaggagugaggggccugggggacaacacugacuucccuucccccuagccacacccggucucugacuggauacuucuccuccacccauguaaacgccgggagcacccgggcuuaguccucggccuucccuucaucuacaugcucuccacaaaggagcuaauggggaaccucaguuucacgaaguuuaaacaaaaaaagauaucuggaaaacucucaggcugacgaugcaucccuaagggcgucuauccaacuggccacuuaacaacuccagggcaggagggucaaagcagaaccucccccacucagucacgaccccacucuuucccaucucaaucaacggcacaccacacccaaaaaaaaaggccccgcccuucauguaucucauuccccaccucuccacaucuagcugaucagcaaguccuauggggugcaccucuaaaccuaccccaaauccgaccacuucucccaccuccucacccgcccagaccaaggucccaugagcucucaccuggggagugcuuagaucaccugcugaccaguccucucucuacucucaugccucugcucacccaacaguccagucccccaugcagcacccagaguggucuuccacagacguaaaucagaucaugucacuccccucccuaagcucaugcaaucacugccuuuucagugcgaauaaaaucccaccccaccccccacuccaccccaccaccauggccuagaaagccccacuccaucuggagccugcuggccucccuuccuagcagccucucccuggcugcuuguucugccaucaccucaauggaauguuacucauaguauccccagcacucccggguucaccacgcacuccacaaacauuucuugagugaauaaguaagggaaggagggugcuugagggagacaagaaaaaguagaaaggaaguccacaggcaaacgacaggggcgugugauaagaucugccaggggagugggccagaggcccaaaggagccuggcagaaaaggaguagaagagaaaugcacaaggguuauagagaaagagggagacgggggugaagagaaaaaccccaccuguaggcaagucacaacuucagguccagaaaacaugugcgcgggaccucacuagagcacgcaggccagaugagguggccuccaaggaaugcuuacucguaccccaaagguuccccuuucaucccuguacgagagccacaaccuaacuuugacagucaaauggagcagcuauuuuuaaaaaucccagcaugguaacuaaacccucaagaaaucuaaauccagaaauaaaaagaacucuagaguuccaaaccucauuaagcauccugucccagggaagagcagagccucaaucaggcugguauucccaaccuccuucccugucuuccuagaguuucccuguuuaauacaaaaugagcuuuuauaaugccagauuaaccagaguucaaaauacuaagaaaauaugacaugcuaacaauacauuuagcccucaauuacaaguuaaugacaacauaaaacauuugaaggugagaagaaaggcuauuuacugagcaucuacucuguuugucaggagauuuacacacgugaccaccacccuaaaagccaggcguaucacgagcucauuuucaggaugacaaaauugagucuuagaggcuaagugccuugcucagauccacagccaguuaggguggagucagaacuguuuugauuccaaagcccguguucuuccacuaaaauacacuggcuuccagagcacucaguuuaagaaagugcauucuguaaugaauaaauugaauguuggaaauauggaaucuaagaauucaaaacauuucagugaacucuaaaagcuggucuccaaugagacuggaagccucucuagcugacugccccuccucacgcagugcugcaaaugaacggcaguguuucccggugaaccaaaccaccagcuuaacauagagcuagcgucuuuuuccaaaucagugacauuccucaugcaaccaggauugauucaccaccuuuuagccucuggacacaaaauuccuccauuccuacauguaugacgacacuucccacuuacagcucugauccuucucaccuuucccacaacccaaauuuaggcagcccucaucucuagccuguaccucugcagaacgcuaacuucaagggucacuagauuccaaugacucuccacauggcugcaggaaucaccguucaaaaucacagcacaggccagagguggcggcucacacuuguaaucccagugcuuugagaggcaaaggcaggaggaacacuugaguuaaaagaccagccugggcaacauagcgagacccuaucucuacaaaaaaaauuuuuuaauuagcugggcgcagugguacacagcuguagucccagcuacucgagaggcugaggcaggaggauuacuugagcccaggcguucaaggcugcagugagcuaugacugcaucacuguacuccagccugaguaacagagagagacccugucucaaaaaaauuaaaaaccuaaauaaaaauuccuugaaaaauaaaauuaaauaauuuuaaaauaauauauagggccaggugcaguggcaccggucuaccuguaaucccggcacuuuaggaggcugaggugggcagaucauuugaucucaggaguucaagaccagccugagcaacauggaguucaagacaggccugagcaaccggccugaccccauuucuguaauuuaaaaaaaaaggagccaguuucaguggcaugcaccuguagccccagcuacucaggaggcuaaggugggaggaucgcuucagcccaggagguugaggcugcaguaaguugagaucaugcuacugcacuccagccuaggugacagaauaacaccgucucaaaaauaguaauaauaaaaaauuaaauaaaacaaaaccacagcacaggucacaaaaucaaccuguugcgaaaccuucuggcucucccaaccuuuccaggcucaacauuccccacucucuuccauauggugcuccuuuggauuccccuuaccucgccuuucauagcucugugguuuugcuccuguuuccuccaauuagaauucuuucucugccuugccaaauuauucauucaccaaacaguuuucaagcacccacuaccuauaagacaccguagaagaacacgguguuuucaaaaccguaagaugcugaaccaaaauaaggcauugucugggccccauauggagucuggguuugauuagaggauuaauaggauucuacugaaaaguuuuucaagaauggaauggaggcugggcaagguggcucaugccuguaaucccagcacuuugggaggccaaggcagguggaucaccugaggucaggaguucaagaucagccuggccaacaugguaaaaacccgucucuacaaaaauacaaaaauuagccgggcaugauggugggugccuguaaucccagcuacucgggaggcugaggcaggagaaccgcuugaaccugggaggcggagguugcagugagccgagaccacgccaccgcacuccagccugggcaacagagcgauacuccaucucaaaaaaaaaaaaaaaaagaauggaauggaauggaacucagaagcaagcagggccaagauuacuaagacaaggauauguuuguaaauagaagugaagaaaccagcaaauggaaaaaacaaucaaaaaggcaagagauaguaaaugauaauucacagucccauaacaagcagaccaaagcagacacaagcguuaacaucaggaaggagggacugucucuuccucagaggcaaagcagaagaaaaugacugauggauauucgaagacauuuuaguuaaaagggaacuaagguugagagcucucccuguggccugugucuccuccauguucuagaagggacagucauuugucaauggcaaagcacaguaguauacaggauuuucaaguaggaagggaccaggaaagaaguaggauauguaguaaauaauuuaaccaggccaggcacaguauaacaugccuccgggcggccaaggcagguggauugcuugggcccagggguuucagaccagccuggguaucauagugagacccuaucucuacaaaaaauaagccggacaggguggcguacaccuguggucccuguuaaccaggaggcugagguagaagaaaccacuugagcccaggagaucaaggcuguagugagccaugauugugccaccgcacuccagccugggcaaaagagcaagacccucucaaagcaaacaaacaaaaaacaauuuaaccuuauuuaaucuuacccaaaaagaggucugcccuuuguccucagcuaacaauaugauguagggugaggggggagcucuucgucacaggguaucagucuaucugggaacuaauaucaaccaugugggcaaucaaucaaucaaucaaucaugccugcauaauggggccucaauaaaaacugacuacaaagacucaggugagcuucccaggcuggcaauacuccaugcauacugucacacaucaaugccaaaaaaguaacguguucugaguccacagggagaggacaaucgugccuuuggugcuuccccaucugguacuucccuggacuccacccaagggugguuuugggaaccaccaccuacacccccccccaaaaaaaagccaacuugcaguugguaucacaagugagggcaguccuguguggacuggcacuauucccacucaacuuuauagcuagcuaacuggcacaguccagcuaaacucuucucagauguuacaaccgaagggucacacagcaaguuguuaacacugacccuggagacuaacuuugggaauaagauauuucagugaaaaugacaguuuugacuuuauguucugcucuaggguuugaagaaaaaaaaaaagggucaggcacaguggcucacgccuguaaucccaccauucugggaggcugaggcaggcggaucaccagaggucaggaguuggagaccagccugaccaacauggagaaauccugucucuacuaaaaauacaaaauuagccagccacgguggcucaggccuguaaucccagcuacucgggaggcugaggcaggagaaucgcuuuaacccaggagguagaggcugcagggagccaagaucgagccacugcacuccagccugggcaacaagagcgaaacuccgucucaaaaaaaaaaaaaaaguacuucuaaaguuaaaauauuacagaaacauaccccaaaaagcugcuuuaguaaaauuaucuuguauaguuguccaaucacgaaaacuauucaauguucaucccaaacauuaacuuucuacaugaacuuauuucuacacccauuuucuuuguuaauuuaacaaagauuguauuauuuauaucaacaaagcauccaagccagcagguaaguuucaguaagaauguaaaaguacguucauacuuuugacugaaucaagauuguucuuauauaaaguucauuucagugcuuucuuucucacugagagggccauucuauucaugcuaauacucuucuguucuugaagaggauuuguuuuuacaguucauugauuagcagggcuguaaaguuucaauucauuaaucugucaacugaggcaggcucugagccaaugguagcagaagaguucccauuguuacuuagcgaauccuuugggaauuaccuuuucaaauagucuucuucuccuucaacucucaaaucagaagccaaugugggccccuaaccuauuuuccagaauguucaagaauugcaauuuaguuaauauuucaguuccauuccauauuucaaauaucccaagagccuuucacuuuaaccaaguucugacuuuuuuucuuuuuuuuuuuuuuuuugagacggagucuugcucugucgcccagacuggagugcaguggcgcgaucuuggcucacugcaagcuccgccucccggguucacgugauucucuugccuuagccucccgaguagcugggacuacaggcgcccaccaccaugcccagcuaauuuuugguauuuuuaguagacaugggguuucaccguguuagccaggauggucucgaucucccgacuucgugauccgcccgccucggccucccaaagugcugggaucacaggcaugagccacugugccuggccaaguucugacuuuuaacaagcgaauuuaacaaagugacuuuuuuuuuuuuuuugagauggggaucucacucuguugcccaggcugcagugcuguggcaugaucucaaacucaagugauccccccaccucagccucccaagcagcugagaccucaggcguguaccaccauauccggcuaauuuuuuaauuuuuuuguagagaaggggaucucacuauguugcccaggcugcucuccaacuccugggcucaagugauccuccugccucagccucccaaagcgcugggauuacaggcaugagccacgagccaccgcgugcguaccaggccacaaagugacuaaaaggugauuucagguauguaaacacuguaaaacauaacaaaaaagagauucuucaucugugagaugaagaguucagaaagaaauauuaauacacauugaccuaaaucucuaaaccccuugggauaguaacaguaaaauagauaaauacgugcgcuuaagugcauacacuaagcagacugaaaaugcaacacuguagcagcgauuugcccagcacuguauacagcccagacaguaaaagaagcuacaaggcagguagccgcaucaacacugucucuuacacuccaauuuaacggccacaauaaacugguucuucauaagcuaauaaagugugucuaucuaacugagugugacaaaguuguagaaggaaccacaccaggagaggugagccuuacugcccugaaagcuuuacugucccagaugcccuuucaggcaacuaacacccaaagaugacugacguggagcaggagggaagauaacuaggaagaugggcagagaauaaaagagaaaaguuuacagcuuaagaggaagagaagccacaacgcgaagugcgagacugcucauuguaauaccugccuauuaaaaaacucuuuacagcuuacacaggguuuauagcugcucuguaaccaccaccccgucauuagccacacagaaaaccagggcucggagagcugagugucacgcccaaggucaggcaaaaagcuggggcugcaauccgggcccuaucccgagagagcaacuaaggaaugacaagggggcaccuggaagggaagucaggugcgggcacggaggugccccuaggaacuccagaaggucgcaggugugcggcgggguggagacagagcggcggaaccgacggaaggacagggcacgccgggggccagaaguggccgggagacccgggagugagcagcccgcccggcccagcccgccgcacucacccgaggcccgggcggggucgcccggcgcugcggcuccucccggccugcggcggcggcggcggcgacugcagcggccgaggcagggacgcaucaugcggccgcgcucauggccgggcuggagcgggccccgcggcucggcucggcuugguccccugggucccgccgggcaggucggaaggaggcugcagccaagcaaaugccucagcccggagccuuggcuggagagcggggcggugcgagcgccggaagu

SEQ ID NO: 192949 - RNA, 39472 nt, Homo sapiens
cggcgggcggcgcgcacacugcucgcugggccgcggcucccgggugucccaggcccggccggugcgcagagcauggcgggugcgggcccgaagcggcgcgcgcuagcggcgccggcggccgaggagaaggaagaggcgcgggagaagaugcuggccgccaagagcgcggacggcucggcgccggcaggcgagggcgagggcgugacccugcagcggaacaucacgcugcucaacggcguggccaucaucguggggaccauuaucggcucgggcaucuucgugacgcccacgggcgugcucaaggaggcaggcucgccggggcuggcgcugguggugugggccgcgugcggcgucuucuccaucgugggcgcgcucugcuacgcggagcucggcaccaccaucuccaaaucgggcggcgacuacgccuacaugcuggaggucuacggcucgcugcccgccuuccucaagcucuggaucgagcugcucaucauccggccuucaucgcaguacaucguggcccuggucuucgccaccuaccugcucaagccgcucuuccccaccugcccggugcccgaggaggcagccaagcucguggccugccucugcgugcgugaguacggggcgcgggccggggguugggaggucguagucucugggucccugcauccuugcaucacuacgccccuggcucccacaucucuacaucuuuacguuccuggaccaucccggcaguucuaggcuaaggucauuggucccagaaaccacgugcguuucuuucauucauucuuuuacacuucuccccacaggcugggaauaucuucagugacgggacagcagggucccugcccugcccuucggugggcauuccauucccccacuuaagcgguuuaggcaagugccacccucccguuggccccgcugagcaauacucccagccucuugcguggcacccacguggaguaacugagcaaucgguuuacuguuagagcuccgauugcugacugguuggugagaaggaaauugcaguuaaaaaaaaaaucauucauuucugcucuccacaccagcucgucaggaaucagugacacgggcugacucauaagaaaacaguaguaauaacaucgugugcggguagugacuggugcugauuuaggcuaagggauccccccugaggguucccaguagugagagagcggagcuuggcugcagauucagucuguguugcagugaauggacgugcgggucccagguuucucugggaaacagccauggggcuccuguuuuggugggcauggugcugguguguucuucaccaggccagagauaacugcuuuucaaaauaguuuucuuuuucuuuuucuuucuuuuuuuuuuuuuuuuuugacacugagucccgcucagucgcccaggcuggaguacaguggcacgaucucggcucaccgcaagcccgccucccagguucaugccauucuccuggcucagccucccgaguagcugggacuacaggugcccgccacuacgcccggguaauuuuuuuuguauuuuuaguagagacggcguuucaccguguuagccaggauggucucgaucuccugaccuugugauccgcccgccucggccucccaaagugcugggauuacaggcgugagccaccgugcccggccucaaaauaguuuucuugugggauuucagggggaaaaucacuuguagcagaugccacaugauuugguuggguggcgugggaaggugggucuuggcaauucucagauucaucccauggcauggaucggccugcaucucaauaguguguguacacauucaaggugggaagggcuaauuuauaguuggggucuugagccaugaaaucaggggaguggcuucugacuggcaggaccuguuggcgcuguuuucugccacaccguacuuugggggggagggggagggggaggcauuucuucauaaaugugagaaugccccgagggcaagacucagcagggcucugugugguuucucugaggcucugagucgagcagccgcaccaccaugcaggucaaagccgggaaaaaucguagcaggacagcaguggggagagccugugccuuccagcugggcguuggagaugugaauguaggggaugacucugauuucuuuuuuugucauuagaauuucacugguucagucucccucccgccuagguacaugucggcccgguauguaacgacauggauaguagcuuacgcagccugcacucuuaucuuuaaaaaaugaaccccugguuggcugggugugauggcccacgccuauaaucccagcacuuugggaggccgagacgggcggaucuaccgaggucaggaguucgagaccagccugaccaacauggugaaaccccaucucuacuaaaaauacaaaaauuagccgggcagaguggcucacgccuguaaucccagcugcuuaugagucugaggcaugcuccgggauguggagguugcagugaguugagaucccgccacugcacuccagucugggugacagagcaagccugucucaaaaaaaaaaaagcagccccugggugcugagucucugacuuccugcuggugccaggagugagucgugggaaaugcuucauuggccaccaggaaggagacguaggauggggcgcugccuaguuuucucuuucuaauaaaaaucacaucagucauacaugaauucaucaucauuuaaaaauucaaaccagccaggcacuguggcucacaccuguaaucccagcacuugggaggccgaggcaggcggaucaccugaagucaggaguucgagaccagccuggccaacauggugaaaccccaucucuacuaaaaauacaaaaaauuagcugggugugguggcagaugccuguaaucccagcuacucgggaggcugaggcaggagaaucacuagaacccaggagguggagguugcagugagcugagaucgcaccacugcacuccagccugggcaacaaggcgaaacuccaucucaaaaaaaaagcaaaaaucagcugggcgucauggcgcacaccuguagucccagcuacucggaggcugaggcaggagaacugcuugaaccaagcauggugccacugagcuccugccugggugacacauuucuccuccuuuaccacccccgacccccagaguuucugcggcugacaguguaugcuuccggagcugcuucuguuacaaauauaucgcuggccuauuuauuuaaaagaucauaauguacaacuuguucuccaccuuuuuuuuaaagccuaaaaugguuuugccauguucccaggcaguacgcagaggcugcccucuuuagcugcuaagaagacuucccugugucggcaggaacaagugugcucaccgcacccccgcccccccauagaacccuguggagggcauuugggguuucccagcuuugugcaaaugggaaaaggguaugugguuuuuugcuuuuuguuuuugauuuuguuuugagacagagucugugucuguugcccaggcucguugcucacugcaaccucugcuuccuggguuuaaacgauucuccugccucaaccuccggagcuuagauuacaggcaugugccucagccucccaauuugcugggauuacaggcaugagccaucgcacccggcgggguguggauucuaauguaauagcuaaugugccuuccaaagaggcuguaccaagucacgcguuccuggauuuauuuugugguaauagggcuuuaaaaaguauuuuuuaaauuuauuuuuauuuuauuuuaucuuugagauggaguuuugcucuuacccaggcuggaguacaauggcacgaucuuggcucacuacaaccuccgcaucccggguucaagcgacucuccugccucagccucccgaguagcugggacuacaggugcccaccaugcccagcuaauuuuuuguauuuuuagcagagacggggcuucaccauguuggccaggcuugucuugaacuccugaccucaggugauccacccgccucugccucccaaagugcugggauuacaggcuugagccaccacaccuggccuaaaauagcuuuccaagcaguccuuuuggucccaguagguaaagcuucaaggcaggcccuagagugccaacccucucugacccagaggugaggguuaauguuaauagggucccuuucagcgaaaguuagggccacacuucucaugucccuaagccauuuguacuuguuuuuuuucucugacccaccuguguguguggugaguauguguguauguguugcuuuuuuuuuuggaaagugauuuucaguaacagaaagggauguacucucugcaagagugaaucuauucuugccccuguguguaaggcaagaaagagaagcuguguucucugaacaggcagacccugcugagagagggagguguguugggguucaaucauucuggugggaaagauauuagagauaguuauagaaauagacacaaaucuuggaaggccgagaaguuggcauaacuucgguaauuagcucuggcugaaggcggccugaucccuuuaccuuuaauuaaacaaauaaaaauagugauaaaagaaaggcagcguaguuuaccuagcuagcuuguuuacucgcauaaucuuaagaccguggguguuuaagugcuuuuuacuugggaaguccacaaugucuguuacauucuaaugguguugacucaagcuuuuguuaguuaaucauacugaauaaaugcacgucugacuagcugaucagggccaaguagcaacuguuuacaggacucagcagggagccuauaagcggcugggacccucagcuggacuggcagagcagaauaucugugugucuguacuuuauucaucugucaccgggucaggggucugcaaggagugcugucgcagaggugggcuuugcugaggcugguagaacuccaagcugauucucaggucauucugacuucagcucggagaagggcaguggaugucccgggaagggagacccugcccuuauaggggggcuucugacaggugcagggggcagccuggagcccggaccagugggcaggaugggcgcuccagggugugaaggagaggccgggcguuugaucuguggacauugcuccuggagcagugaaaagccauagaaagugauuuauuuuacuuauuuauuauuuauuuauuuauuuauuuugagguggaguuucgcucuuuuuguccaggcuggagugcaauggcacgaucucggcucacugcaaccucugccuccuggguucaagcgacuguccugccucagccucccgaguagcugggauuacaggcaugcaccaccaugccuggcugauuuuguauuuuuuaguagagacaggguuucuccacguuggccaggcuggucucgaacuccugaccucaggugauccgcccaccucggccucccaaagugcugggauuacaggcgugagucagccuacucggcugauauauauauauauauauauauuuuuaaaugaucacacauaagguuggguucuggaauuuucugcuuaggaagggaaagggcaccuuuuacccccuuauuccuugagccugauccuacagaagguacaguggcuuucgggucuggauccucagcccucgggccucugaggcugccuugggagaggguauagauuugagaacaagguucucaguuuugcuggcugucuuuucagucgcccaggcacgucccacagaagguuucuuuuugugaaauaaucgugugaaauggguuggccucggugcuuagaaccaucccacugacggugagugaaaaaaaucccuugcuugucagucuggguaggagaugagguccuuucacgcgugucuucguguuggugcgcuuuucacuggucauaaaggugagaggaaccagcuccaugugucucuuucuggauggccauauggaacuuggcaugacaguaggguugugugguuauuuauugcuuaacgaagacuuggcagcguguacuggaaauucaagcgaugcuggguuuuaucagaaggcgcaaaggcuggagcugagauucuggcugggccuggauuugguuugggcaguuuaucugaccucccugggccccagcuggcucugcauagcgaguaggguagcauccacucaaagucccgguccacuguggcccggcacugauccaggcgaguucucaguaagugggaacucacagguucagaagaugcugugggccucaggggcuuccaccuccagggaggugcucucagaagaagggcccgaugggcucacugcaucguggagaagauacccuggcucagucucagucacuucuccaagcgcauagguguucgggaaguggccugcagacagcuccuccaugccuugaaagcagaaguagcccccuccuguuucccugucccaguugggugaagcauggggggcugcugagacagucccaggcgugccgucacgcaggggcaggccguccgucggucucgcgggacucuggcugcggguggcugaggacaccuggccucaugggagacggugccagggucccuggagugagguggcucuccuccccauggcugucacuccucagcagauuggugugggcggguaugcguuuaggaaccugugagcugagacacuguccagcuagcaucaggccaaaagcaaccaaggcuuugagaaauccaccuggccccgccgagccuguuucugacuguggaaugggauuggccccagcgccaggugucugggaaucccaggccucugcgugugaaggugccaguugcacgggcugugaccgucccuccacgugccuguaucuccugcucacugugcacauggagcagcccucagccucacugucuucuccucuggcaaaagaaggaaggagcaagggaacaaagagagggagggaagagccagagacaggagccaggguuuccuuuagucuggagcucugggugcgagaugaugucacccacccacgcucggcacaggcccagggucggggggcuauggguggaaguaggaaucgccacaacugucucugagccccucccuaaagggugaaggguguaagggguggguuuugauggcugugggcuuagcuguggucaguggacucaaaggccaguuggccaguuagcagugaccagagagcagagggggccuguguguguuuugccccagggucuucaggcugccuggcugccucuaucugcccccuggguguccagcaccacccccccaaccgcugggguauccagcaccuguaaccuguagccccgcuucucaguccaggccuguuccagggccccccugggguaucaagcaccuguagccuguagccccacuucucaguccaggccuguguaaaaccuggccccggguuggguuuugggaucccugcaccccuccacccccaaccccccacagcugggauccuggcucagcuggcaaagguucugcguguuuaaggagcugggugggccccagagcucaagccgugggcucauugcaggcggcagccagugauuagugcugaaaucugacuuucccagccgcacaugaaagugccgccggcaccuaggcaggucacgcugcaucacgggauucggggcaaggccguagggggagcucacagaagcacaugaccugagccacacaggagagccuaacgggcacuugugacccuuuuuucuugggucacagaccucuuucauaauccagcagaaugugcagaaucuugcccagaaauguguaucagccgccuucacacagaaggguggguugcgcagacccccgggggcccaggccagguugagagccacccccaggagagggguguccaagguagggcacacucuuggaccaccucuuggcaccucuuggccaccucuuggccaccacuuugcacuccagccuuugaagccagugauaauccccaauuuacagcuggggaaacugaggcaggagcgagccaggagccaggggccacagugcccaccucuacacugaggccaccauuugucaucaggcauaggggagcacaaagccacgccuggggagucuggugggugccaggggucuggggaggugucagucagcaagacuggguggcccagucggcccagguaaggacacaggugggucagaggcucaucuguguuccccagcauccccuaggggcccuuugcgcuccuccacccuucuccauccuucccagacucacauccagguacccuggacagccacaggguucugccccccaguaggccuggcccucccuggagcaucaccuggauagcuggccaugggcaggccuugccuggcccgucugcagggacaggacacguguaugcaugcagauugguacugugugcccgcacgcuccccagaggcccuguggcagcacccucuucccgcugcugcccuuuuccaacaggagggccccccacagcgucuccuucccugauacuggccgaauccugaauucucccucuggaaggcggacccuccgggguggccacagcacgugcgugccuccgggagugugggaggcgucucucccugcaucccuggccgucagaccaccccagguggggaccguucucuggcauugcccgccccuccccugcccuaggauuugcccacuacgugaggaaugagcaccgaccuccuauucugggccuuggagcgugacgcccgcaaacucgaucccugcugagucauccugaccucggggugggccagcaucugucacuacugagacacuguaugugugagcugcuuguuaacgagaaagccagacucuguaaaauguuugaagagauuuauccggagucaaaugugaggaccaaggccuggaggcccugaggacaugugccccagggggugggccacagcuggaguucauaccuccuacaaggacagaaguuacaggcagacaucagucaguacaugaaagguauuuguugguucugccgagaaaggcgggacaacuccaaggcggggaugggcuuccuggucacagguggguucgaagauuuccuuuuucuuuauauauauauguguguguguguguguguguguguguguguguguguguguguguguguguguguguguauuuuuuuuuuuuuuugagaugcuuuuguuacucgggcuggagugcagugguaugaucucaguucacugcaaccuccgccuccuggguucaagugauucuccugccuuagcuucccgaguagcugggacuacaggcaugcaccaccaugcccagcuaauuuuguguuuuuaguagagacggggguuucaccauguuggucaggcugguuucgaacucuugaucucaggugauccgcccaccuuggcuucccaaagugcugggauuacaggugugagccaccgugccuggcaaaagauuuucugauucacaauugguugaaagaguuauuagcuaaagaccugguaucaauagaaaggaguaucuggguaagacaggagguuguggagacgaauauuguguuuuguuuuguuuuguuuuguuuuguuuuugucacccaggcuggagugcaguggcaugaucucagcucacugcaacccgguucaagcgauucuccugccucagccucgcaaguagcugggauugcaggugccugccgccaccaugccuggcuaauuuuguauuuuuaguagagaugggguuucuccauguuggucgggcuggucucgaacuccugaccucgugaucugcccaccucagccucccaaagugcugggauuacaggcaugagccacugagccaggccaagaucuguguuugaguguuagugcugguccgcuguaccugaauuccagagggaggggguauaacaaggccugugugacccccucuucccaucgugaccugagcucguuuuucagguuaacuuuggaauaucccuuuggcaauaggaggggucccuuuagucaguuacggggcuuagaauuuuauuuuugguguacgugcucaaacugcagcugcuacaaaaccaaggccauggugaccccggggccaguccagcuuugucccugugcucucgagcugcuggaggccaaugcaggauucuguccacggcucucauguguggcuucagagccugaggguucuuggggcccugucuucaccugcuaccguguaggggccuugugagcugagucaacuggaagagcccagggccucugcagaaggccugagcagggcccgggcacugucccuggagcucugagucccucaagcuguguggcccggagccaggcgcuugacuucucuggucguuugcuucagagcuggaagccuggggugacgugggucuuuggcaggggucagguaggggaggggccagccaggaaucaaacaucccugacaggugagggggcaggugaggagggcagggcaggagccccuggagcacuugugcagcagcaucugggccggugcaagcccugagauggcuucagguccugcucagagcuaagggcuccccgucaccagggauucuuccaucacugcaucugcagagcccaucgggauuggggagaggcccuggccuuagcuuggaacagcugcauccuccugucggguguacaggcugugcacugguuaagccugagcgcagagucuguucaacgaguucauugugugguauuugcuuccgcuugcuguugaguuggacuggcuuggacgcuggccaggagcccaaguggacuuggugcuucucuuugacagccgggauugaaaaucccagucaaguggccagagcacgagggugagauuuaggagaccuggauguccucacuuugccgcccaggaacugcugugugacuuucaccaagugggacaaccucucugaacuacguuuaccccggcuauaaaauggagguguuggauuggcugccacaaguguccuuccaccuccacaauaccgugacuggagcggguuuucacuccuuuuucuuguuagcauaacuguuggagcuguagaggguuuggaguggggcguggguuuccggaccacagaugugugaggcuccgcacuuagccagcaguggcaacuccuuaucacuggugcccacggcuucaucugugcccugaagauacucaugcugcggugacuggucagauuaauggugaugcuuucauggggcgccguaagacacguccgcgagguauuucgcccaugcagcaggaggcaguuguuccagucuguuggaaacaggaaagggaggcucagucccugcaaaggaacuugccggaguucacacagcauuucagcaccggguggccugguuucagaguuucagagggagcgguggcccuuccugucagcccugggggucuccuggagucaggacccuugggaaacccaaauccaccaggacgcuugugucaggagaaccugaccacaugagaagcugcccuuuuccaguucuccugcuuacccuggacuugggauguuggcaaauuucagagcuugccaaaucugcaucuuccuggccuguuuaaaaugaaugugucagccccauucuggacagcagcugacaccuccucccccgugccagccaggacagugugguugggcguaacucagccccgguuaaaaauggaaaaaaguacaaagacauguguucaagggcuggugacagaauuugaaaaugugacaccagccuguuaguaauuuguuuucacagaaaucuguuucaacacugagcagacagguggggccagggccuugggaucaucucucuguuugcccagggacaucuguauguccggcccaaagguggggccuugugcucugcagagacugggcaucaaaauugagccauuauaagcagaccaucccggccaggcgcgguggcucacgccuguaaucccaacacuuugggaggccaaggugggcggaucgccugaggucaggaguucgagaccagcccggccaacauggugaacgcuugucucuacuaaaaauacaaaaauuaggccggugugguggcaggugucaguaaucccagcuacugaggcaggaggcugaggcaggagaaucacuugauccccagaggcggaggcugcagcuacucgggagguagaugugagagaauggcuugaacucaggaggcggagguugcagugagccaagaucguaccacugcacuccagccugggcgacaagagcgagacuucgucucaaaaaaaaaaaaaaugugaacgcugccuuugcuucccugccccggaacugcuucauuuuccuugggguuuccggaccacuuugaccucucucucuggccagcaguggcagggaggcagguggaucuggagccggcaugggcaggcuuggcauuccagcccauucuggggugagguuggccuugggugaggacaggggucacugggucagacacauucauuuucuggagcccggggcggugacguguccaucagggaagcacgcgccugugcugggggcgcuccccaggccggcagcaccagccucccugggaccuuguucugugcagauguguugucuccaucucccggaccugccugaucagaagcucuggguuuccauccgccucccccaccacugcuuuuauaaguucccccgggggaugacacgggagauggugggggcugucugucgguggagaagguggaggcuuguacucagagcaggggauauuuagacuugaaggggccagggaggaagguacugguucuacuaaagccccaugugcacugggcagccaccaaguucggggcccugugcguaccgaguggauuccgacaaagaagcugucucaggagccccagccagcugcagaggggggcccaagcuccaaggcugggugucagguuugccaggugcuggcuccgcuaggggccacaggcugcacugggcgggacugggcugggcugguaccugugcccggugucgggccagcuguaguugcuguggucagcugccgcucuccggccccgugcgaacugcugugcccggugcacccugggggaccaggcugccugggcuuccuggaacugaugaagcugccggccacuuccucugugcugucuccagcaggcaguucuggguaaacaaucgucauuugccuauaaagcugcacagcucacaggccuuggaccaucucugccccagccccagcauuggcccucuggacagacucugaaaccgugcgcggaacacagccugucauuacagaugacuccuggaggcaguccucgggggccuggcaggagcacuucuguuucuguugggucugaaaaugacagaagggacugcaggaugccugccugggcuggacgccugccuggggcacucacaguggcuguguuugggcucgaaggggcccgggaggaucauguucacuggguacucccacuuacagacaggccaaggugcugagcccugcaggacucacugcugugccuggcucgggggcaggugaggaccggcggcccagggagcagccucuguggccaacagagaggauuuucauuguggcugacccugaacccuauccacggaugcuccuguaccugguacauguuuauuaccugaaagaaucaggcauuaguccgugugggguggguucauggggccugcgggguccccacccagccggggcccacaggucccaccugcucuccauauugaacacaccuguuacuggcccuucccccaccccucuccuccaacacuggacccugggggaucaucccuuugcuuguagcgggauuuuaucaggagcuggacagaguuggggccaggagaccaagaugccagcaucaggggaggugagcagagccggcugccgcagaggugagcguucacgggcaucaggcagggaggcaccucagagagucauccccccgaggggagagggguaaggccaggggccaggagaaggcagccuccugguuuacaaguugugggggugcugugcgugugugugcacgugugugauugagcagaguuggggggucagccagcgguaugcaccugucccgucugugggcccagccagcaguaugcaccugucccgucugugggcccucccuguucaggugccuucuugcauggucucugaggucaguaucacugccggccccaccccagagauggggaggcacaagggggugggggugucccccaccucaugcugggugguggcaaccuccccgggacgccccagcucugagcagcagggcacguggcgagagcagugggaggccuuggugcccaccccaggguccugaggagaaaugggcuggccgcguccccaaucccuccugcgugagccucaggguaucugaaguggcuuuugagucaggaccaggaccacagcuugggccucacugugacagguguccuggccaaggcccuggcgcuggcucuggguauggccagggcuguccuuccuucaccgggcugugggccuugcugucaaugcccacccgaagaugaggauguuucuguggcugauggcccugaagggugguggagacacaggugaagggaggaggagggcagggguuccuccaaugcacugcccccaaggcaccccagcuccucuggagccccugccagccagccaggugggaggcagccaggugaggacggggaagacagcaccccagacugggaggggcccccagcucagccugcccggcuaucugccaaucaagccaagccacgccacgggguauccccggacggguuuuaucuccuggcccagcuguccccgcaggcuggcgcggccacacuuaucuggggguggcuggcccugugugcucagcccccucacucugacucagggcacagcccugucgaucucccugcugugggggcagccagcagccccuccaugguguggacacugaggcuugggagagggcaagugccagcagggacugagguucaaaccccagacuuauccugugacugccucgccuccuuaaggucgaaagguacugaacccagaugaauucauguauuuguuuaagauuuuaucucaucuuaaaacguaaaaaaaaggacacuguggagaauaaugaaaccuuuguuuacucaucacccaaagucagugaacaugaaaauuuauguucuuguuauaaaaggaauaaauauaagguccccuuuguucuauggccauuuugcuccccaccugacuucaagacccggcccccgccugucuguccugugguuauuuccaacgucaggagaugaucuggugaacccucccgguggcacccgucagccccuccagacuguuuuugguuggggagcggcuggguuggaacugggcaggcagggucaggcuggcggugggggggggggcggggggguccuggccucugucccacccacagugacagcccugauggcgucauuacccagcaccacgucaguguggcaggacagcccgugguugggcaauucugggcaacucgcugcccuuccuggaccccccaacccccuagcagacgugacagccgcagacgugacagccgcgagggcagugcucagugucuccgcagcgccugucuggugucuggaguucagugguggcagcgugccucucucccuuuuggggagaggcagccucgagugcggcuuggccacacccacuccccgccucccuccgggcaugaaugagcgagugaugcaaucagccggccucuugcgaauccagaaagcucuccagaagccggcuagguccccgaggcucaguuucuuuuauggucgugcuccccccaaccauaaggaaaugggacuggcaagccaggaccugccccuugcccugugcagcggacaaggagcugccuagacccacugaccugacccugcugagcccugaggguuggacuggagagcucuggacugguaacaucuccaugucccugggagcccugggaagaggugaagaaucaccucuucaguuugggugaggaguggaaguuccggaauuucaaguauuuuauuuuaggaauagcagcgaaaacacugacuuucagacauuuuucaaccagacuuuccugguguguaguagccgucuccgcucuggcauccacagaauuguagcggggugguuaauuucugagagauaggcaggcggcagcccgucccgcaccucaggacguuuccggugucauuaguuaauuagcauggaugucuuuccucggggucuguugcuuacauuguaagauuccacaggauuuguucagcuggggaaaagccacuggaguccucaaggccuuggcuggccagaccuuucugagcguuacucccaaggggaaagagagaagaggagcccacggccuuucugaugcucucaccuuccugcagucuuaguggugcggugccgggagggcugugagaucugagcuguguggguggcccgugcugggccuuugcccacuucugggguguagacguucccacuggcagauuucaagcugcugacagcgacagauaaccucgugagcagaggagugaaggguagugcagcaggcagugaggggugucguggagucagugccucgggauuaauaugauuuuacuucauuuuaaguuguggggguggcuguuuccccaccagcucacagaucccugaauaguggcucagcgugcgcacauauugcaacagaaccccccaaaacacacacacacacgcacacacacacaguggcucagcgugccuauauauugcaacagaacccccaacacacacacacacacacacacacacacacacacacacacacacacacagaggcucagagcugggugccuuacagggcccaggaggacgugcuggugucuggagaccugucugagcgugccugaccccacaucucagcgccuccuggggcaggcguucuggccaucuguguggggucacucaggcuucugaagcacacggugcuauuuuggguuucaucguaugcccccaaagcagcagggcagcagggucugcucugcucaccacaggccccuguggccccucccaggcugccguccccaggugacuggccagguaguuccgggaaagcgggacaccccacuucuguuggaauccacagaagauccucuuugaggaaagggccccgcccucauggaguccggcagucgggcugugcgugggucucacagucaggucagggugcugaguagguacaaaaagguguaaugggcgccuuccaaguggcagggucaccuugcucaccugggucucuggaggcagugaccccacuugaaguccugacuacaggugggacuccauggccuggugugguggggggugaggaaaggucccuugcagaucuuaaggggcaccugggauccagcccuuagaccugaaaggacugcgaaguuuaucaaaacaggucucagaaagucagaacgugcccuaagggcuggcaggggacuggagcuguuuaaggagcuuguuuuucugguggaccuggcccugggguggggguggggucgucaccucccagccuaccccugagcuggcgucugucugcccguggaacucaccgcugcccucugucuccacagugcugcucacggccgugaacugcuacagcgugaaggccgccacccggguccaggaugccuuugccgccgccaagcuccuggcccuggcccugaucauccugcugggcuucguccagaucgggaagggugaguacgucccccaggccccaccggcggccccucgaggcuuugccuguguguccuucacagggcaugaggucccguccccgggugccucccaguccgcagcucugcagugcuguacaacguggagauuucccucugggaaaaucacccagcaagugaaauccgacccagagggggacacaggagugcucccgugggacagcguggccaccacugggaggggcucuggcaguuuuucuuguuuuuuacgcugcgaugucugugaaucuugagagcccagcugaugcguuguaaccucaccugggggcgauguggaacauuccaggccuggcaggggcuaugccugccaugcagaccucacccgagccaucucacccugggucugucagagucccacgugcugucgccccucacccacccccgacggggccaugcuccuggucaugcugugauucauucaucauuccaugggcaggugugggauugucucuguguuucugucugcuuuuuaaagaagaugagguaagcauggaaaacaaaacaaacgugguaaccccaucacucagacguguccacuguuagcauucgggaacaggugagagcagucuggcgcacagguuuuaaggcuggcuggcccagacuuuggucuugugcugugugaucuuggggaaaucacugauucugagccuuuuucccagcugcuuuuucucuuggggcugguagaaggaauaaagagagugagugugaaacagcccccgccccuuugcaccuguguucucuguugacguggacugacacaguugguauuuugcugggugucucuggacccuuuaacacacacuccauagaucuguguucugugucugccugcagagccuccacccuuuccacacugccauuccgcggugaggucgggcugggguuucauaagcaguucccauuuguguggucacagacccugggacacacuguccuuggcacuggaucccacccgugguuggguacaguugaaguggggggcccuguugcuugaguccagcagggaugccucugucugcaguuccuucugaguuugucuccauccauguuggagccagccuaggagcagagcaguuaggagcuggccuccuucucuucucucccagagccucagguagagaugaucccaguccuggagcuguggagcuuucgcugagugcaggcacccggcggaugcacgcucuggugacucgcagucaccgauggcugcagagaggcugccuggucccacauggcuguaggggaggcagguaggaccccagggcugcagaggacagggcaaggaccuugcuccuagaggcaggaagguccucacccagcaagcugugagcugccccgcccccaugcacggccaggccaaaacaugcagacacaaggacgcugccuccuccuguguggggcccugccucagggcugggaggcucuccugugugcaccgugccacuggugggcugugaacugaacagugccccgcagcacccagcacccagcacgcagcuuuagcugagccuccgccuugcuccuggcgcccccugcuggcuguacguggcacuucgccuuaggacaaagucuggcugcagcuggggaggggucuccacaccaagcagguaaccugggccugcagggggaugcagugccgggcuauacugaccucaccacagcgaggcgagcuccaggggcuggggccagacugucuuuaucaaauguaucaaucuguacaaagucugcagcagguguuaguuaccugccucaucgucgaggggaagucccacuugauucccagguggcucuggaagguugcccaggucaauccuucaggagcucgagcccaucccccaugcaugugucugaccagggauucucagagucgcccgggguaccagagccacccaagagcuggcaggacagggcuggcaggaagucccaauucugaaccuuccugggaccucagguuccggcaccuuacucaaggcaagacgagcucauuccauggcucccgggcacucagaaguugcccagggaggugguugggccugagugacauuuuacgggcaggagacaaauccauccugugccucccagaagugggcacggaaggggugcuuugcucgugaaggccuuugcuuggcugcgcucaucagauagccaggaaagauuuaggaggggaacgugauuuuuguaaaaacaaauuucgguagggagagcaaagagcuuuuguucgacuugaauacauaauagguuuauaauuccguuagcuguugaaagcguccucccaccgugcuccccccagcaauucccuucugagcuuugggauacagugcagugucugcagaauuccugucuccuguuuggcuucaacagauuuauuuuguuaccagaugaaugccuugcuuuuagaagauacauuguguugaccccuuucucccaaagcaguuguccaacuuuauaccccccaguggacgcaaagcccuugggcagcugcccccuccccucgcuggcaccuggcagcagcgcccccagauacuucaaggcagagacuccggccucaauuuugcaacgacuggcaaguggcccuuuccgggucuggagaaugcagcgaaaaucuggcagagcaggccuggcccacgcaccuguuccugccugucccgcacccugggugcccugcuccauuggggcugaaaaggcuccuccuugcugcccuuggcccccaggugggcccugugcuauggaaaggcacuggcccuaggguccuguaggccuuggcugaccuguuuccuccucgucagggaaguuuguaaucaccccuucccaguuggccauccgcagaaccaucuucugucccgugugccgcaucuaugccgggucccaaugagaacauggccccgcauccagagcucauggggggaccugagagccauaggcacgugaaugggagagucgcaguggggaauaagcggggcccuggugcagaccagaaaagcccuucugagggguugggccuuuccugagaugcgggcugggaggggcagcuggcugagugacaggggcgacucugcaggggccugaguggucgggagcccuugccuccuccgcgucuugggggagucauggcugccccuaggcuggggcauggggacacgcaggcuuaggugucacaugagguucuacaguuagucccagccuuuucgaaagggagacaguacucaugaggguucagaucugacccaccgucccaugaguccacucgcaggcuguugccuaaggagaggguggcugggccuucgccugcagggcggagggugggagcgagggcacaggcucugccgucccagcccagcagcagcagcacgucccuccuggaggacacaauggggcgcuuugugcuuugcuugggcugcagccgucagcggcagaacaaacuaaucucuccuugaacaguuacagauuggauaguugggcagauuuaaaaaaaagguugcauaaaaacuuucuuuuccuucuccucccacauuguacuguuggaggucaguauuccccuggagcaaauuugcccuuucacucuguccacaaaaaggaaagaaagccgcagccugccagggcggcgugccucuugcuguccuucaccccaggaggggaaaaugcuuccccugggcagggcucagaccccggcugaauggcuuugcugagcugcugggcccugggucccgguggccgagaccccuggaugugaccuacaccuaugaguagggcacuucuggacggucccgugucccaggcgguaaauacgugugugccacugggcuguggggcaggggccugcauuugugugucacgugacaguuuugaaaugaugguuuuccuuugguucuucagcuaguagggccccuuagacucagagaaguggggugcccugccccaggucccacagccgugagcagugggcaggucccuccccacccccacugugacccugggugcagugugcagggucaugcgcugcuggggggaggcccacaccucuguucccaaggugcguucggguggacagcacugggcccaucugcucuugggagguucacguggggugucauguguuacgggaaaagcugacgggacaguuccugaguaacacguccauccugagaggguggaggucuggaggacauuccuuuucagacuggucucugagcuucacugagcuuccuugaaggcagcccccugagccccucccgaugucccuccugaggagcuuccuggaggaagaggugccgccucccucaucuggcccucaucuggcugggggugugcggcccugucuuggucuccucuuccugugggugggggcguccagcccccagacgauguuucugacaaaggcccccucaguggucacagcacaugcccagcugcugggcuguucuggugagaaaaacguuucacccacaccuuggcugucuguggcucugggguguggaggggucgccucguggacugagaagccccccugggcuguggcuuagagcuguuccuucuucugggccuggcuucaccugagugugugcguggacccauagcugggcuucuaggcgcucccagcagagcucagcccagccugcucuccgaaccccagaucaggacugugggcuucuagggugcccucccggagagagggcaagggcaggugcuagaugugcagcugccuugggauucuaguuuugccgccccccggccagggugucugagccucggugucuuccccugggaaaugggcuguccucccuugcagggaggaggccaggcucaccgcguccccggcacgggagccacugccaugcaggguccaacagccccuuuuccucaccucacgcccugacugccgcuuucuccgggggugacagcaagagcggagcaggccugggugggugggucucagcuucagagggucuggugccagggcccugcuaccuggaugccggcgggagagucggugagaggccccgccaggccagggacccugaugcccugggcggggugcucggccuccuggcuccuagacacccccucgcuguguuuccuugugggagagugagcugucuggggccuccucuuguguggacaaggauccugucagaucaggccccacccugaggaccccacuuacccuuaaucuguagaggccccauguccacguacagccacaccgggguuagggcuuccacgucugaguuuugggggacaggauggagcuucgggccccgcucuccuggcaggaaauagggcaagccccagggccucaaagugaaucccagcuggguacaggcuguguuaaccaagggaggagucggccacagcucggccucgagcugccaaagcucacuuuccagagaagcuuccaggcuggccugccugugggggacuccagggcaucucucugugaggcaucucagacagucucagggucaugcagggacagacaggacauugcgcucaggagcucccagauuggugccaggcucgaguguggcuccacuccggacaaccugggccuggagccagggcugcggcguuggcugccccaaggguggguacuucgcgacucagggcaccucuuuugggccucgaagaccucgcaguugauaaaggaugcuugacccgccgcuugcucugggagcucaguguguccugggccugccauucuucugugccgucggccucgggaggaugacaggcuggggaagcuggggcucugccggugccgugugcugggacagaaucaaaggacgggagcggggcuuguuuucccgcggccuucaccucccggugcccuucgucagacgcauggacagaggccagggcagccacagcccugugcuggggacaguucucagggucuuuccccgccuguggaguuggaaaaagcuuuuacuucuggugugagguuggcagcucuaagcaaagggcccacuccuucaugaguuuccaagaccgacagacacugcuggugguccaaaagugccaucugguugccgccagaacccccaaacccaaauuccugccccaucacgguucccaggcauuagauggccagagcgaaacaggcaucugaaaagcggcgccguggccuagggugggcguggacuccguggggugggcguggacucugccuggagugggcauggacucuggggugggcguggacucuguggggugggcguggacucugccuggagugggcauggacucuggggugggcguggacucuguggggugggcauggacucuggccugggcucuggacugaacccauguggcggucacugcacgacuucccugagcccacagggcagcuagcuccagggugcugaccacaugggacucacagcccccucuuagaugaggugccauuggcugugcacucggcuggugacugagaaguggggugugagcugcagcuguccugccccugaccaugccugaugcacugagaagccgggaggucuccccuggguggcacgguuggccccucauguguggugacagaugccuacagacuggcuuuagcaacagacaugcagacgguccugguccuggcagccagagguccagacccaaggugccaccuuccccuuccagcugcccguggcuccaggcauccugggcuggcucuggcucugucuccccuggaucugucucugugucgcugaggacacuugucgucggccuuagugccuacucuaauccgggaugaucucaucucaagguccuucgcuaauugcaccugcggagaccgcauuugcagcuaggacacaucccgcagcuccacuggacgugaauuuuggggacacuguucagcacacuccaccuagagccccaaggggccagagugguuggaaggcggaaggccccagcacaguggaaaguccgcgcuugaggagugacucucuugucccugagguguuuccagggcuggggcaggggcccgucagcccugagguuccgggaugcccuccaucuccacauucccauguuccccacgcugggcaggcucuucucuccagggacacugcguucauggggagacaucguccucugagucaggagccagaggcuuggaggguuggccgcaucacagaggagggggaagaucccguucccacgugcguuuggccacugggggcgucccugggccccgucagcaggauggcuuuagccaccggcggagucuccccuccagccucgggguggaugguucccauggccgcaucugccugacucagggaucaaggccacuuuucccugaaaucaucuccccagggccuuuggagcgcucguucccaccgcaauuaccccgcucucgggggaauccugcugacagggcugcugugccggggucgccgcggcguuugcaguuugccuuccccccacccgggguuuggcugugcguuugcuuucauggcagcuccaccagccccugaggaagaugccucuuagggacaaggaaggggcuggagggccccacucaggcucugcgcugagucuguucucgcgucucugugggcucuggcagaugucaccgucuguccacggugauucucuuccucacuucccugucacgcuguccccuccuuguggguggaggcugacuggauagcagacugucagguguggaggcuggguggcugcuggaugagugggccgcucagccauuccuuccaguccugcccagugccuggggcuucaugucgaagccaggaccacgcccgagucuaggguccaugggagagaaagcugagaggagcugguccuguccucccggcagggguagaggcucguggcugaugccuugucauggucuucuugcacagggccucagccuggcaccucugccaccgugggcucucuguugugugggggugucccgugcauugcaggacauccagcagcauccccggccuccugcuccgugccaguagcgccgcaccccgccgucgugacagcccaggucucccggugugcagaaugcccgcuggucaugcugagagguacaggggugcugcccccaggguuugaacgcugucuaacucccaccucuggugugucucuccccuguguguagcguggagucacuggaugaguguggugaccucccuguguccagcugcccugggcugcaagcaggucccuccugcagcccuccaggccacccuuaagcagagcuggaccagccuggccaacauggugaaaccccaucucuacuaaaaauacaaaaauuagccaagcgugguggaacucugucucaaaaaaaaaaaaaaaaaaaaaaaaaaaaaaaaaaaaaaaguuacucaggccuuagggcugccaauaucuggcuccugacugaagaccucauaccaugucaagccucgguauauuguccuuagcaaaagcagccacccucuguguaggaucagccgccuuucugucaugaggcuggaggucagcuaugaggauugaugugucuggcggggaccuuggacugaggccuccuguccaucagcucaggcugaguccggggguggucacagugaauggggcacguguuucuggccuccagggcucaccuucacccccucccaccaugagugccagaugggggaggcaggaccuugauucucaagcagccuggcaggucugcauucccccacuuguaggacagaugcuccccccagcagaaguaagugggcgagacacaguagggcuaugcagaugugaagggucugcacauuccagaacauuccaucagagagcagaugggagagaggccagaggggcugugccgaggugcugugcaaagugcccuguccugagcugcucugagcugcccccgcuccaggccugcagagucaagcuccgccugcugaccaccuggugaccagaauacaucacacgcaggcagugggcccuggagcuccuucucaggagaucaaggccucagcagggcaggguggcgggcagcccucagggaacccaccagcacccccaguguaggcugaagaucaaaggccccagcacaccuggcaucugggacagacagagcuggaggcagagccgcaggcauccagcacgccacggggaagcaggugcaaaacaggaacuggguccacccaucaggaagggaccccaccgugggcucugccguaggaaaucuggugccaccuuugaagugcgcacuuuguuugggguaauugccaaggucuuaugggaaccucccuucacggguccccuuugaaauuugcucaccucgucacucugcgguguucccuggaccaccaaggugguuccccuucuugggcccccauggugaccugugguccaaggccacauguugggacacagcagccccagggcccgucccugccuggcccugugagacgggcuggugacuuuccagcaggaaggauacugucacacacgguucucuaaugaacuaacaguccacagccugaccaagauuuccacuugugccuccagcuguauaugcaccuggcagguaggcaggaggggacccggcuccuuuguuccgguggugucuuuggucuucuuuccaaguucuccuuccugaagcgcaguggucugugagacugaugucugggcaauauauuccgggcucgaacacaccaggcccauuucacagaggaggcaacagccacagaaagggccagugcugucccagcagccacgugaccuuccggagacaccccuucccccaaaagacauguccuccuggggaaccugugaaugcugguggccuuauuuggaaaaagggucuucgcagaugugacugaaguucaaguuuugaaaugagguccuucuggaauaggguggagcagucacgaaguccagugacgcguguccucagagggcaaaggagagagcucugcacacagcacggggaucguucucggcccuggcagcccugcuccugccccugccccggcugcagcuggccacacacucagcacgguccaggacaaaccuauguucuugcccaggccuguccugccagcccuggagggagggcagucuguuccgagcuccucgcaccccaagaagcagggcccuaguggcucugggccuuccuuguugccguagccaggaugcaaaccgaggucuccuggcuuuauacugccuugacacucaugucgugaggucucagggaaccuucuugaaggcaacuggggcugguugaccccuccauccugaccuccuguagacaagcgucugaggagcccuccugggcaguggucagaacugccugugcccucucaggugggcacagggccucuggcagggccacaucccccugguugugguuggaacccugcacccuccauguggcucagcagguacauaccauuugucacagugaaaagccuucacuccagcauuuuuguuugcuauguauuuugcuccaggaacauucuagaacugguagcaugaccucuguucagcgcucucuaacccagcauuccuuucuuuggcccugccaggugauguguccaaucuagaucccaacuucucauuugaaggcaccaaacuggauguggggaacauugugcuggcauuauacagcggccucuuugccuauggaggaugguagguucuggaaugucugggucccuuggucuggggacauacagucccugacguguccaggaaucccaaaucucccagccaucaaggggcaguuaaagggaguggacugccccucccuuuaacugccccuuggcaguuaaagaguggcaggugacccuccagagucacccacaucccgacgaagcguggggaggccgcccgcugcagcccuacucuggcucuagcuccacgucgcagucuuggcgaagguggcagguggaggcggcugagcccugcggccccuuuccuccagguccccagccugacuccugcgcucaggcgggccucacagggaccugagaaucaccccaguagggcgaacaggcagggaaugugcgggagggccuggaagggguagcagggaccccccggaacacgcaggaggcugagcucccucccacuccagguccgcuuuccagcccagcgagcagaccaccggggggcaggcucaccagcugcccugggaugcucucuccccggugauuuauuuucccugaugaggaucauauaauuugaacgcuguucucuaaauuuuaggaauuacuugaauuucgucacagaggaaaugaucaaccccuacagguacgugcaagaauggauggagccgucuuuuuucauuauuuuaaugugaggcaggaagcagccacauuccacucgaagccuguuggucggcucaggccaguucacagucgggccgugauuggggccucuggggccagcaggauguggggcggguggcuucuggccguguguccuugagcacgguuucuccagagaacggguggcaagugagggccccacucagggcgggacgguacagaggagcugccugggcucucggcucugguccccggcugugcagcucgugggcagagccuuagaauucagaccagguggccugacuuaacucuccugagcccuugaggucaccccgaagaauccccauuucucagguggggaagcugaggccgcggccaaggcaccagccagggcugugcagugucccgcuccaggcacagccuccugccgccagccuguguucucuugcugcuucccaccuuccccgagaagcccagcacagaggcuggagcuacugcuugcgaggagcccaccuggcuccugggcacaggguuuggccuucagcccgggcugcguugggugacaugucgucccuguucuuuccagaaaccugccccuggccaucaucaucucccugcccaucgugacgcugguguacgugcugaccaaccuggccuacuucaccacccuguccaccgagcagaugcugucguccgaggccguggccguggugagccgcuacccgccagcuuccaccaggggccugagaggcuguggccagcccgucccuuccagaccggaguggugccccacaucucuaagccuccccuacgcagagggggccccgcgucucuaagccuccccuacccggagggguggagugguggucuccccucacagcgaccgcagaggaagugucuggggaucauccucaagcucagcugcugggggagucaaaggggagaaggguuuaaaaucugauaccaagccacacccagaaccagcuauaagccagaaugccuggggaguccagggcagaggucauuuuaaaucugaguacagaaagauuggagucugccacagagugggguucguuagaaggcacggcugcugcuggcuuggcaggcgggaggccaggcccgggcggugucaccgggcagcucagccaggcuggccucgcaguucccgaggcuucucccacugcccucccagggcugggggaacagggagugggugcucuggccagcuuccuacugaacaagcucugacucccagcccgcugccggcagggcaccgugcugagccuguggaggaccccacgggggaaggcaagauccccaccugcaggccguagcuugcuccagggagucccagaggagggggcaaaucaggaccagcaagggcuccccaacaagcaggcugggcaggggucacuggaaagcccuguccugggaaguccccccagaggccagaauccagccugagagguccucugcagagggcucuugugagcacagagggcgagggcuggcccggugcagagggcucccagugagcacagggagggcgagggccggcccgguggggcccagcucacugguugugccugccuaggacuucgggaacuaucaccugggcgucauguccuggaucauccccgucuucgugggccuguccugcuucggcuccgucaaugggucccuguucacauccuccaggugagcacagcccgacccaccacaggugagggaggcccaggccucauggccagguucaacauguuccaugucuguaaaagguuugucucugugauacuggggaugcauaauugcucaaauaggccaggcaugguggcucauaccuguaaucccagcacuuuaggaggccgaggugagcagaucgcuugagcucaggaguucgagaccagccugagcaauauggcaaaaccccguuucuacaaaaauauacaaaaauuagccaggcgugguggcacgugcccguagucccagcuacuuggggggcugaggucgaaggauugcuugagaccagaagauugagacugcagugagccgagauggugccacugcacuccagccugggugacaaagugagaccaucucaaaaaaaaaaaaaaaaaaaaggcagcagcaagcccaaauaauacagaaauaaaggaagcaugaacuuuggcccucgccuccccacuccugccuggaggugacacagcugugguguccuagaugcccuguggccgccgcuugaccccccgggcuggagugagcaguggcucccaaguugcuguccuugccgaguugguugggggaacugagaggcccacagccagcggcuggaggggccugguucccacuguggccagagaggcccagacaagccaggcacaggcccugccacuccccagccugcguguccccuguccacgugcugaguuguggggcgguggcugacucugccacucuugucuguccacaggcucuucuucguggggucccgggaaggccaccugcccuccauccucuccaugauccacccacagcuccucacccccgugccgucccucguguucacgguaagccugcugcacggcccugugcccuacaucccuggggguuguccgggggcucccagagggaggcugccacagcuugcagcucugucugggguguggacugggugacagcucaaauguggccuccugccgagcuccgcugaaugccagagagcgcuggaggggcuuuagauuuuauuccaaaaauaauauaugguggcugccacaaacgauucagaccaucggaaaugcgggaggcagaagcugacccggggugcugcucugccagccgccuggcucacugcaccuccgugggcgcccacucuguucguuucucagcggggugcaucacacacaguuuccuuccgcuucuccugcaucuuuccgugccagcccgcgugacugccuuuguucccucuggcugugucacacaucacuccaaaauguaguguucuaaaaggaaaagcacuuauuaucucacaguuuccguaagucaggaauucagggagcuggugccugaagcuguguucucaucguagggugugaccagggcuggagaggccacuccacaguggcuuccuccagggcugugggcugcaggccccaccccugagcacacugggcucccccaacaggcugcuucccccaaagccagugagauacagcagaggaagcuggggucuggcagcugugggcuggccucagagguccuggcccuugcuuacuacuccuucccugaguuagaagccagucaggaagggcagcaaguccuggacucuuuggcagcugcacgguccucgggagcacggcugugccggggguuacagaaacuguuuucuuggugaccacuggguuaggucagguuguggcccucgcacacagagccacaguccagcagagcccagcuguguauguacacuguguucuucaccuguccuuaacccaaauguggucuccauuuccuccucuccucccuccuucccuccucuccucccuccuucccuccuccccgccucuucccuccuccucuccucccuccuucccuccuuuccuccuucaagaccuugcauguugcucagaugagguuucuccuuuaaaacaaaauucccuggugcucagcugggcccagccaggcuggacaguccccgguggccaccacggccguccacagcccugcucgugggccccagggcucagccagccgccucucucuuccagugugugaugacgcugcucuacgccuucuccaaggacaucuucuccgucaucaacuucuucagcuucuucaacuggcucugcguggcccuggccaucaucggcaugaucuggcugcgccacagaaagccugagcuugagcggcccaucaaggugagcccggggccucccgcucacccaggcacccuucacagaggcaggguccguggguccuaaggacccugaguugggagccagcaucccagcucagccucuggaccugccccugccugcaugcaccugggucgacuaauuccggugaugacuugaccaccagcuacgagggugccaagugugacugcaggagccgggguuccucaaaggacagcagauggcacagagcuugugcuccguuggguggagggaagcagauaaggacacugcagucauaggugggcgguggugagccccggcaggggcggggcagagccgggccuggcgcagcauucaaagggccgucggggcugugcuggcaggaggaaugcagggaacccggcccgaggagcgccugggcccagcuggacucuccuggacucuccccguccccagcggcucauucagagggguagcuguuauccgugggcugccuucuccaaaaacggggccguccagcagaggccaugcucuugccuggggcccagcaagucccgccgcccuggcccugacacagaacaagaggccagagccccugguggcugcuagccagcagcuuuugucacucagcuggccuauggcugucacaguagccccugcuucccugcccggaccaucucucccucuguguucccgaagccugggggccccgggggugccugugaaugcuguugaacgggcuuuaggcugggcgcgguggcucacgccuguaaucccagcacuuugggaggccgaggcgggcagaucacaaagucaggagauagagaccauccuggcuaacacggugaaaccccgucucuacuaaaaauacaaaaaaauuagcugggcgugguggcgggcgccuauaguugcagcuacucgggagguggaggcaggagaauggcaugaaccugggaggccgaggucgcgccacuguacuccagccuggacgacagagugagacuccgucucaaacaaacaaaaaaaacaggggcuuuaaaauacagucagcacaagaacccagaugcugccccaagagaaggcugcagagggcagggaggagccgcccuacaugggcaccagcuugugccugcugugccagccuggggcagugccuagggcacagggcagucacugcgcacagcgggggcucagcccccauggggaccugggcaugggguaggcucuacccacuguugugagccugggcacggguuggcgucuguucccuggggacagggcagucaugcagcccacacugaugggcugggaccuguggucagcccugcaucucccagggugcccuguccaaguauggauucaggacagcugagucaaucccccagccaugccgagccgcagguugcggccugcaggcuccuugcagcccugccuggcuucugugccggguggagcucaucugcugaaggugacaguuuaggcugcagcuucagggaugggcuuuugcucagcgcuguccacagcggcgucuccaagaggguggucuccuggcuuauuaguggguggccacugucuccuggaagcaucaggccccugugcguccuggcggcucaggguuuccaggccugugaugugggaauggagccgugaccuucccugcccgugggaggccucgggagacgaagcugucuccuuccaucccucaucauaagccgccugagccccuggcaacaugcccagcacuguaugcagagucgagggcgggacagcccggugugugaggcagauggagugcagaucgcaucuuggugaccuggaagucagcagccguggguguggagggcccaggagggcugaggaaccucggggcaugggggagggaggcuggacaggagagggcucacccaggcccuguccucugccccaggugaaccuggcccugccuguguucuucauccuggccugccucuuccugaucgccgucuccuucuggaagacacccguggaguguggcaucggcuucaccaucauccucagcgggcugcccgucuacuucuucggggucugguggaaaaacaagcccaaguggcuccuccagggcaucugugaguaucucgcuggcccacagcccgugguacccucugcccugggcagcgaagggaguugagaggcgucggccgucuccacccacauggggcgaagcguguuggguggcaggaggguucaggucacugcaguguccgccagugacacgcagcccacaugguucagggauaagacacacagcgcagcaccagcuaaucucucaggacgagggauuccggaaaaccaggcuacugcugccaaguaacaaaauccugcuggcugccaccagcggacacagcagacuuacccagaaaggcagaaagaggcagaggcaggcggaucacuugaggucaggaguucaagaccagccuggccaacauggugaaacucugucucuacuaaaaauacacagaucagcuggguguaguggcacacaccuguaaucccagcuacucaggaggcugaggcaggagaaucacuugaacccgggagacggagguugcagugagccgagaucgcaccauugcacuccagccugggcgacagagcgagacucuucucaaaaaaaaaaaaaaaggcagaaggagaaacccgccccccggcccugugugcagcggcagccccaggggugcuuugucaccaagcucaggaccccguccucagcgccugcaaauguggccaggcucguagaaaaaggccggggugcuugcgggccuacaugcugauccccaugucacuggguggcuuggagaauucccgggauggcagcaacacaggcagggagaccccccaccccuaccccacacucugaucaccgccagggucaugguagaacauuugccucaagcuuugcagugggaucugcauuaacugucauucaggacaccaagagcuuaaagcaaacccccgucucuauccugaaagcagucccccuccacagagugaugucucuguagacagucccaggcgcgacaggucuuccgaggacccguuagcagauuggccccuccggcccugccugcugugaacaguccaggcauguguccaggugguggcccggguguggaccugcaggaaggccugucauccccccguugcacuuugcugagacaccagggccugguucgugugccccaggggccgcacucugccuccccaggguucugaagcaggcgaggggugggccgagugggauguggcacuuccgcauuucaguugaagacagcgccucgggcacccggcacccacaugcgcaaguacacaagggaagguuccuuaaaaucccagcgcugggcagcggcgcuggguuuggugacagcagggcugggggagccccagcucacgcccccgugucccacgggugccuacccagcccccaggcuaacacagcugucuucucuccugacagucuccacgaccguccugugucagaagcucaugcagguggucccccaggagacauagccaggaggccgaguggcugccggaggagcaugcgcagaggccaguuaaaguagaucaccuccucgaacccacuccgguuccccgcaacccacagcucagcugcccaucccagucccucgccgucccucccaggucgggcaguggaggcugcugugaaaacucugguacgaaucucaucccucaacugagggccagggacccaggugugccugugcuccugcccaggagcagcuuuuggucuccuugggcccuuuuucccuucccuccuuuguuuacuuauauauauauuuuuuuuaaacuuaaauuuugggucaacuugacaccacuaagaugauuuuuuaaggagcugggggaaggcaggagccuuccuuucuccugccccaagggcccagacccugggcaaacagagcuacugagacuuggaaccucauugcuaccacagacuugcacugaagccggacagcugcccagacacaugggcuugugacauucgugaaaaccaacccugugggcuuaugucucugccuuaggguuugcagaguggaaacucagccguaggguggcacugggagggggugggggaucugggcaaggugggugauuccucccaggaggugcuugaggccccgauggacuccugaccauaauccuagccccgagacaccauccugagccagggaacagccccaggguuggggggugccggcaucuccccuagcucaccaggccuggccucugggcaguguggccucuuggcuauuucuguguccaguuuuggaggcugaguucugguucaugcagacaaagcccuguccuucagucuucuagaaacagagacaagaaaggcagacacaccgcggccaggcacccaugugggcgcccacccugggcuccacacagcaguguccccugccccagaggucgcagcuacccucagccuccaaugcauuggccucuguaccgcccggcagccccuucuggccggugcuggguucccacucccggccuaggcaccuccccgcucucccugucacgcucauguccuguccugguccugaugcccguugucuaggagacagagccaagcacugcucacgucucugccgccugcguuuggaggccccugggcucucacccaguccccacccgccugcagagagggaacuagggcaccccuuguuucuguuguucccgugaauuuuuuucgcuaugggaggcagccgaggccuggccaaugcggcccacuuuccugagcugucgcugccuccauggcagcagccagggacccccagaacaagaagaccccgcaggaucccuccugagcucggggggcucugccuucucaggccccgggcuucccuucuccccagccagagguggagccaagugguccagcgucacuccagugcucagcuguggcuggaggagcuggccuguggcacagcccugagugucccaagccgggagccaacgaagccggacacggcuucacugaccagcggcugcucaagccgcaagcucucagcaagugcccaguggagccugccgcccccgccugggcaccgggacccccucaccauccagugggcccggagaaaccugaugaacaguuuggggacucaggaccagauguccgucucucuugcuugaggaaugaagaccuuuauucaccccugccccguugcuucccgcugcacauggacagacuucacagcgucugcucauaggaccugcauccuuccuggggacgaauuccacucguccaagggacagcccacggucuggaggccgaggaccaccagcaggcagguggacugacuguguugggcaagaccucuucccucugggccuguucucuuggcugcaaauaaggacagcagcuggugccccaccugccuggugcauugcugugugaauccaggaggcaguggacaucguaggcagccacggccccggguccaggagaagugcucccuggaggcacgcaccacugcuucccacuggggccggcggggcccacgcacgacgucagccucuuaccuucccgccucggcuagggguccucgggaugccguucuguuccaaccuccugcucugggacguggacaugccucaaggauacagggagccggcggccucucgacggcacgcacuugccuguuggcugcugcggcugugggcgagcaugggggcugccagcgucuguuguggaaaguagcugcuagugaaauggcuggggccgcugggguccgucuucacacugcgcaggucucuucugggcgucugagcuggggugggagcuccuccgcagaagguuggugggggguccagucugugauccuuggugcugugugccccacuccagccuggggaccccacuucagaagguaggggccgugucccgcggugcugacugaggccugcuucccccucccccuccugcugugcuggaauuccacagggaccagggccaccgcaggggacugucucagaagacuugauuuuuccgucccuuuuucuccacacuccacugacaaacguccccagcgguuuccacuugugggcuucagguguuuucaagcacaacccaccacaacaagcaagugcauuuucagucguugugcuuuuuuguuuugugcuaacgucuuacuaauuuaaagaugcugucggcaccauguuuauuuauuuccaguggucaugcucagccuugcugcucugcguggcgcaggugccaugccugcucccugucugugucccagccacgcagggccauccacugugacgucggccgaccaggcuggacacccucugccgaguaaugacguguguggcugggaccuucuuuauucuguguuaauggcuaaccuguuacacugggcuggguuggguaggguguucuggcuuuuuugugggguuuuuauuuuuaaagaaacacucaaucauccua

SEQ ID NO: 192950 - RNA, 88034 nt, Homo sapiens
aaccguccccaacggucgccagcgcgcggcucccgggcccccucgcuccuccccucuggccccuccgagcgcugggggugcuucccuccccgccuccucgcacucccacucgcgggcacgccgguggcugugccgccaugccccaccacaggcugcucacgggccuaggcgcggcggcccgagauaggggccccugagccucccgggggaggagagaggcagcgagccgcgcuccgcccccuccccccgggccgccgccgccgccgccucgccgccccagccuggcgggagaaggaggaggagcagcaggccuccgggcccggcgccgccgcccgcagguaacggggaggggagggcgggcuccggucgcgcgggggacggccccugcacgcugcccguggcugacaccgcguggcccccaccuggcgccgaagggagcggagagccgggucugucagccuaguccgcgccgggagacaccccacgggauccccucgguggcauuuaauccuucugggaggagaccggccuugggccccgcggucccggagcaguuaccccgaccuuccagggagcugcccguccuuugcacgcccauuugcccaacacccuaacccggagcggccggaguguugccaccucucaccuggucgaacccgggaggcucagaccuguuuuuuuuccuccuuuccccuucugcuuuuucucugguacagaaagaaaaagauggcacuucuuuaaaaaaauauauauauauauauauacacacacacaaacacacacacacauacacacacacacacaccucuuuuccuuuccuuccugaggaucacucugcaucuagucguuuuauugcuggccuaaucagaaaaagggguuaccucgagaaaugacagguacguuagaacugauuaaaaggaaauugcguccaugugaguucuaugaauccaagcagaauuuacaauaaaaccccguaauugugugcuuuuuuuuggaacuuacaaaaaugaagacaaaaacuuaauuucuuuuucagcguguaaguagauaaucucuugaagucaggaagaaauucuccauaacuuccacuuauuuucuuaaugcuuuauuuggagaucggcugauaccggaagcaagcugcacgauuuugauuuccuuuucucuagguguucaguuggaauucuuggguuuaaaaaauacuguauaaaucuucauuucccccauuacuucacuuggacugucaguggauuaauaauaauuuuaccuaauguaguuuccccuuaucauagaaugugaauauaaugaacguaguccuuuaguuuuguauuuuaggauuauuaguaauguacugauuaauuaugaaaaccagauuauucauuuugugcaguacugcuuggcauuuuugcauuuguaauuauuuaauucucagaacaaccuaaugaugcagauauuauuacuugaauuuuauagaagugacaaacuuagugauacgaagaauuacaacuugccuuagggcacacaacuaguaagauaguuuagauuucaacccaaauauaauuccaguauagauguacuuucguguacuuucuaccguacuucucaauagaaguacaauuuuauuaacuuuguuaugaaaaauuuuagucguauagagguucguucuauacaauugugaucgguuauucaugcaaugaauaaaaaugcuaaucaaugcaaugaauaaccaacucagugauuagcauuuuugccauauuguuuccugucuuucucuguauguguguaauuauuugaaaguaagcugcaaacacuguaauccucaaauauuucggcauguguuuccuaaaaauagggacauucuccuacuaaccccaguaucauuauuaaugccuaucaaaauuaacaacuccaucuucaaaauuccucaguuguuccaaagugucuuugaggguucugcccccaguuguagucagucaagauucaugcauugauugcauuuggugauuaagucuuuagucauuuuguaaaaugaagaguauccauccccucuucuuuuugcaggggaaauuaaauaggaugaauauucccucccuucuuuuuuucugacacguaauugaccaaaccaguugucuuguaaaauauacccacauucuggauuugugcccuccuaaugucauuucguuuauuccucuuucucccugaauuuccuauuaacuggaaguuagguguaaaggaaggcuuaauuagcuuaaaguaaaacuuccuuuggcaagaauauuuaauaggugaugcuguguaccuccuguugcauaauauaggaggcacacaaugucagauucccacacuauuaaugaugcuaaauguaaccauuugauuaaagugcugacuacugaucuguuguaaaggugugguuugccaguuugugauuaauauguaaucuugggguaaaacuuggacacuaagcaaauacccaguuucugacaaucuuuugcuuagugguuuuuagcacccaugaugacuuuugcuuaaaucaguuauuggagguucucuguaaggaagagauuuccuucauuaagugcagguaaacuauuguucuuccccaaaaugcaaauuaaauguuaaauuuaaucucuuuacuuuucaauauucauaguaaagagcuggagaaauagccacccccaaugauguuuuuuggggcaggggugaaugauaccacuucagacucucauggguuuuaauuuauuccuuguuuuauaaccaguuacagucgucuuucuuuuuaaugaccaaauugucccagauuuggucaguaggaaccauuucaagcugacuauugugugucuugacaccccugcuccccauuaaucuuggagugcuuucugacacgaguuacuccaggguuuaucuuauacuuucuuugcucaccucuggaaagagcuguuuauccagggagucuugguucuuuuuaaugagaaaucguauauagaaaccaaguucuggauguuuggcauauucguugcugcugcaguaucauugcuucuaggugcuuugagaggagagaacuaagaaaaagguuuuugcuuguuuaaucaugaguucagagugauauuccaauuccuauuuaacaagcagacuuuuucuuccuugacucuauauuugucucuugucuuaaaugaaaaucuugguuuuuaauacaguuaauaaacuggccaagcacaguggcucaugccuguaaucccaggacguugaaaggccgagguggaaggauugcuugagcccaggaguucaaggccagccugggcaacaugaugagaccccaucucuauaaaaaauaaaaaaauuagccaggcgugguggugugugccuguguucccagcugcucaggaggcugaagcagguggaucacuugagcccaggagguugaggcugcagugagccauguucauaccccacugcacuucagccuggaugacagagugagacccugucuccaaaaaaaauaauaaacuuauuugcuuucucccacuguauacauaaaaucauuuuaaaauuauagugcugguauugcuaauaccaauaagcuucauguaguuuaagauuucuuugcauuuauuuucguauuuagacuauauugcaugaagaauguauaaugaguacuguguucaaaagucacuugaaauacuuuucucugguuaugcuaccaauuugauaugguucauagguuucaguuuuuacuuaggauuuuauuuuugaauauguaaaguauguacauaguguagaagucaaaauaauguuuuaaaacuauacuuggauuagccgggcaugguggcacaugccuguagucucagcuacuugggaagcugaggcaggagaauugcuugaaccggggagguugcagugagccaagauugcgccauugcacugcagccugggugacaaagcgggacuccaucucaaaagcaaaacaaaacaaaaaaaaacuauauuuggauaaaccucauuaaaauuaguuuuuaaagaugaaguauuguuuaccuuuaccauacuccuuuuaguaucuacuacauucucacaucaagcucagaagaauuagcaauagacaaauuauguuaugugaagccacauagaaguacuuuuaaauuuuaaaauuagauucugcuuccucuggcaaagagaacuaagacuaguuuuuagaaguuagcagagaaguggauuccaugcuuacuuuuuuuuuuuuuuaaagacgggggauuuacuguguugcucaggcuggagugcaguggcuauucacagaugugauccuacuacugauaagcacgggaguuuugaccugcucuguuucugaccugggccacuucucucauuaggcaaccugguggucccucacucccuggaggucaccauguugaugccuaauuuagugcagacacccaaucggcauaggauacuacaguccagaacuucugggcucaagggaucuuccugccucagccucuugaguagcugggacuacaggcacacaccacugcgcccagcucuuuuucuuaaauagugauuuaaaauagugauagauucucauuauguuguccaggcugaucucucaaacuccugagcucaagugauccugcugccuuggccucccaaagugcuaagauuacacauguaagccuguagccguaggccuagauaccauauuuuuaaauaaaaauuccauaaaaauagaacuguagcuuuuacuuaaaucaugucuuuaaagaggcagguaguugguagagguuuuaugacuccaucuacuuuuuuaacuuuuuuuuuuuuuuuuugagaugcagucgcccucuguugcccaggcuggaaugcaguggcucgaucucagcucacugcaauccaccucugcccccuggguucaagcgauucuccugccucagccucccuaguagcugggauuacaggcauguaccaccacgcccagcuaauuuuuguauuaguagagaugggguuucaccauguuguccaggcuggucucgagcuccugaccucaagugauucaccugccucggccuccugaaguguaauccuggccuccuaaagugcuggaauuacagacgugagccacugcgcccaggugacuccaucuacaacaaaacuggcauaaauaugcuauguacagauaaaaaggcauuuggauaugugaucaguggagauaacacauuuuguuuggguuggaccaaauuugauauaaauucauaauuaugugaucucaaaugaaguuuuaagagggagcaguguucaucuaaaguaagcagagcacaauuaggcaguuuaucagccuccugucaaccaagugcugaaaagcaaaacugugccuguaguguguuuuccuguguucauccucacugucauaggucacacuagcugaggcuggcguugcaggugguaaaggaauuaccaaggcaauuguagguaaagaagggcagauuuauuagagaaaguaugaaaguagguugguugcaagggugcaacgggcagaucagcaagagagaagcugacugccaggagacaauggcuugcugggcauguuacaggaugaugcuucugcugugugcugcagagagggcuaugugcaguacugauaaggccaagguugcagugagcuaacuugcauuuuucugucagcugagagucuggugauaaguugagugcagaaagcuugugaguuauuugugcaagagggcugugugucuuggaccaugaagaaaggcagacuuauaccuuaucugcuuuuucuuuuugcuguacccuuuucccacccgccugacuccuuuucccuuacuaggacuccacaaucacugcuuucaauaacagagugaacaucuaguuccauuagggaguggagugggaagauggagaaugcuugcacuuggacccauucacccucauucugucuuuaaucucaguaaaauacauacacuacccaagguucuuagaacauauaaggugaugaagaagaauacuauaaacaguugcauggguauguguagccauguagcagcuagaaccuguuguguaggcugaaugaacuaauacaguguugauaauaaugcuaacauuuguuaugcccuuucuguaugccagcugugcuaaacauuuuauacauuaucuuauuuaaaucucacauuaacacuuugacauugcuacuaguaucuuauuuugcaguaaggaaacugguaucuaaaagcauuaaaugacuugccuagaguaucacaauaaguggccgacccagguuucaaauucaaggcuguuuagaguuagcacuuagcugcuuugcuccaccucacaacuaaauguaacaagucauaaaaauugaauaaauuuucagucaccaugaauacggaacuacaugacugaugcuguaacaaccucagagauugcaacggggauauguucugagaaaugcgucguuaggcgauugugucauuguaugaacaucauaaaguguacuuagacaaaacuugaugguauggccuacucuacaucuagguuauaugguauagccuguugcuccuaggccacguaucuguacagcauguuacuguacugaaugcuguaggcuuuuguaaugcaguggaaaguauauguauaucuaagcauaucuaaaccuagaaaaggugcaguaaaaauaugguauuacaggguugcgcacgguggcucaugccuguaaucccaguacuuugggaggcggaggcggguggcucaccuaaggucaggagcucgagaccagccugaccaauauagugaaacccugucucuacuaaaaauacaaaaauuagccaagugugguggcaugcaccuguagucacagcuacuugggaggcugagacaggagaauugcuugaaccuggaagguuacaccaguaccaugcuguuuugguaacuauagccuuguaguauaguuugaagucagguaaugugauuccuccagcagugagcccagauugcaccacugcccuccagccugagcgacagaaugagacucuugucucaaaaauaauaugguauuauaauaugggacgguugugguauuuguggucuaucauugagggacacaugccacgcaugauuguauaucauuuuccuuucucauaggugcgggaguuucugaccccuugcuucagaaacugcauuuagauacuacuuuaaaaggcauuuuaaaaguagaguaaaaaucaagauggauugauggauggauagguaugugauaaaacaauaacaguagacuuuuuuuuuuuuuuuugagacagagucuugcuguguugcccaggcuggagugcaguggcacgaucucagcucacugcaagcuucauccccuggguucacgccauucuccugccucagccucccaagcagcugggacuacaggugccugccaccaugccuggcuaauuuuuuuguauuuuuaguagagacgggguuucaccguguuagccaggauggucuuggucuccuuaccuugugaucugcccaccuuggccucccaaagugcugggauuacaagcguuagccaccacacccgggcuacaguagaauguuaauggugggcuuuagguauggcuauucagguauucaacuauaauuuuuuuuuuuuuugcuuguucuuugauuuuuuuuuuuuuugaauguugauaguuuugggggugcaggugguuuuuggcuauauggauaaguucuuuaguggugauuucugacauuuuggugcacccgucaccugagcaguguacgcuguacccaauguguagucuuuuaucccucaccccacuugcacccuucccuccaaguccccaaaguccguuauauccuucauaugcuuuugcguccuuguagcuuagcucccacuuauaagugagaacauacgauauuugguuuuccauuccugaguuacuucacuuagaauaauggcuuacaacuccauccaaguugcugcaaaagccaguauuucauucaguuuucaugguguaaauauaccacguuuucuuuaucugcucguuguuugaugggcguuuagguugguucuauauuuuugcaauugugaauugugcugcuguaaguguguguacaugugucuuuuucacauaaugacuucuuuucuuuuggguagauacccaguagugggauugcuggaucaaaugguaguucuacuuuuaguucuuuuuuuuuuuugaguggaguuuagcucuuguugcccagguuggagugcaguggcgcaaucucggcucacugcaaccucugccuccuggguucaagccauucuccugccucagccucccaaguagcugggauuacaggcaugcaccaccacgcccagcuaauuuuguauucuuaggagagguggguuuucuccauguuggucaggcuggucucgaacucccgaccucaggugauccgcccaccucagcuucccaaagugcugggauuacaagugugagccaucgugcccagccuacuuuuaguucuuaaaggaaucuccauacuguuuuucauagugguuguacuaguuuacauuuccaccagcaguguaaaaguguucccuuuucaccacagucaugccaauauuuauuauuuuuaauuuuuaaauuauagccauucuuacaggaguaagguaguaucuaauugugguuuuaauuugcauuucccugauaauuagggauguuaaacauuuuuucauguguuuguuggcuguuuuuauaucauuugagaauugucuauguuuuuuuuaacccauuuuuugacaggauuggugguuuuuguuuguucguuuguuuuugcugguuuguuuguauuccuuguagauucuggauauuaguccuuuguuggaugcauacuuugcaaaaauuuucuaccacuuuggguugucucuuuacucugcugauuauuucuuuugcuauguagaagcuuuuuaguuuaauuaggucccauuuauuuuuguugcauucgcuuuugguuuuuuggucaugaauucuuugccuaagcuaaugucuagaagaguuuuucugauguuaucuuccagaauuuuuaugguuucaggccuuaagauuuaagucuuugauccaccuuguguugauuuuuguguaagaugaaagauaaagauccaguuucauucuucuacauguggcuugccaauuaucccagcacuguuuguugaauaggguguccuuucuccacuuuauguuuuuguuugcuuugucaaagaccaguuggcuguaaguauuuggcuuuauuuugggguucucuauucuguuccaucggucuacaugccuguuuuuauaccaguaccaugcuguuuuggugacuauagccuuguaguguaguuugaagucagguaaugugguuccuccagauuuguuauuuuugcuuagucuugcuuugacuaugugggcucuuuuuugguuccauaugaauuuuagaauuguguuuucuaguucuauagaaugaugaugguauuuugaugugaauugcauuaaaucuguagauugcauuuggcaguaaggucauugucaccauauugauucuacccauccaugagcaugggauguguuuccauuuguuugugucaucgaugauuuguuugaacaguguuuuguagucuuccuuguagagaucuuucaccuccuugguuagguauauuccuaaguauuuuaauuuuucuuuggcagcuguuguaaaagggauugcguucuugauuugauucucggcuuggucaucauugguguauagcagugcuacugauuuguguacauuaauuuuguauccugaaacuucacugaauucauuuaucagaucuaggagcuuuucaaaugaaucuugaggguuuucuagguauaaguuuguaucaucagcaaacagcaacaguuugacuuccuccuuugcagcuugguauaaaauucuuuaaauuuugcuguaucuaaaaguuuucaaaauaaaauguuacugacuaaaaauauauucuuaggacuguacuuucagggaucauuucuauaguuuguuucuagagaaguuucucugaauauguagagcacuggaaaaaucaauauuuuuuuuaaaaaagagaaaaauauauguauauucuuauuauaaagcaguauuggcagcuguguaaaaaccaguaacaugcuguauccuccaugucuguguacgaugauccucugaaaaauuuauuaacucuuccuagucuuuuaucacugaaaauggucaagcauuaaagacuguuguaaagaggguucccucauuacuuaggaggcuucuaauuaagcuccuuccaauaugauuuuuuaauacucuuauaaauauuucauauaucaaauuuccgccugugguuuccugacauuuuguaaccccuauugaauacacucuauauaagcguuaugggguguuuuugcuuuuuaagugcuaccacauucacaacuguaacggauaguccuugguacuucagaauaauuguuuaaaauuuaucuccuguuaagcuaaaaguuacauuaguuuuucuuuguucuuuauaguagaaauacuucaccccauuuuaagcaaugagcuagaaauauuccaagccauaggauuuaaaauaaugauuguaugugugccuuuaaaaauuaaaaaaauacauuagauuuguauuaugcuugaaggccacauugaguguuaaauuaauuuuuucacuaauauuauuaguuacaauguugauauuggcuggcacaguuuuacauaacuuacccuggaguaaaucacugacuuguauuaucauguuguuucacguugauaacucugucuugcaagagugaaauggguggcugaagcuuauuaauuagagaauaacauccuucuuugucuccacauugaauauucuucccuuuuaauacuuuccuuauauagcuuuaaaaaaaaaacuuaaaauuacagauguuugauaccuggccuuuuuacaauuuugauauucuuuuacuucaggauauugcuauccuucuacagguauuaaaugauauuuuuugggggguguuuuuuuggguuuuuuuguuuugguuuugguuuuuuugagauggaguuucgcucuuguugcccaggccggagugcaauggcgccaucuuggcucaccacaaccuccaccucccagcuucaagcaauuuuccugccucagccucccgaguagcugggauuacaggcaugcgccaccacgcccagcuaaguuuguauuuuuaguagagacaggguuucuccauguuggucaggcuggucuugaacucccagccucaggugauccacccaccucggccuccuaaagugccgggauuaaacgugugagccacugugcccggccuugguauguauuuuuuaaugcugaagugauuugcuauugauuugguuuugauaguuuuuuacgcacucagcauaacuacaaacaucuuggcaacguguaacuaagacugugagucucuggaaucuaguuuuuguggaacuacuacccucuagcuucugaaacaacuuuagaugauuccuuuuaaaaauuauuuucuuuuauuccaaucuuaaccuguuagguaucugauccuugccuauucuuggcagauaagcauauccaauaguguauuuuauuaaauaaucgugcucuuugauaagaaaauaaagaauaaguuuuucagggacuuagauuuacuuacuuugcuuuaauuucacuuuuguguaugugugggugugugugauggaguuucacucuggucccccaggcuggagcgcaauggugugaucuuggcucccugcaaccugcacuuuccagguucaagagauucucccgccucagccucccgaguagcugggauuacaggugcgcaccaccacacccagcagguuuuuguauuuuuuaaguagagacgggguuucaccaugucaggcaggcugaucucgaacuccugaccucaggugaucaccugccucagccucccaaaguguugggauuacaggcgugagccaucacgcccggcccucauuucacuuuuuuacugguggugguuacuguuguguguauguguuucuucuacuuacagcuuuuucuccuuuuuacauuuuuccuggguuuuacuuuuucuuuggcucuuugcucuucuuacuuucugcuuuggaccuucccacugcucauuuccuuuuuguggcuuuccauuacugaaucaggacgguuucuuuugucuuuggugcacuucacaugcuguauaaaacuaacccauucuuccaagagaauuauuuuuauuuacaggaaucagugcuucucuuugucuuuguguccacuugguauuguuuuuuccuucuuucuacuuuccgccacuaguuuuaccuaacuucacuuugagaggcaguauagcauaguguaaggagcaccaguuagcaugcuagcuggguucaacucuugacucuguuaccuguuguguggcuaguuccuuaacuugucuaugcugccuuuuccucacugguaaaugaagauaccuggugauagcuaucacaaaaguuuaugugaaaauuaaguuacauaauauguaaagcguacuuagaacaauacuuggcacauauuggguacuauguaaguauuaacuauaaacuaaugauuauuauuacuuuuuuuuuuuuuuuugagacagggucucccucugucgccuaggcuggagugcaguggugugaucguggcucauuauggccucgaucuccugggcucaccggguucaagagauccucccaccuuagccuccugagugacugggacuacaggugcacuccaccacucccaucuaauuuuuguacuagagaugggguuuugccauguugcauuggcuggucucaaacuccugggcucaagcagccugcccaacucagccucucacagugcugaaaucacaggcaugagccacugcaccuugccuauuguuacuacuuuuaauauaaaaugguucaaagcaguugggucuucagugccucuuaucauacauccuucuacuuuuuucuccacauuuauuuauuuauuugagacagaaucuggcucaauugcccaggcuggagugcaauggcacagucucugcucccugaagucucugccuccuaggcucaagccaucuucccaacucagccucccaaguagcugggaccacagaugcacaccaccacacgcagcggauuauuauauuuuuuguagaugcccgcaucuacgugaucuuaccauguugcccaggcuggucuugaacucuuaagcucacgugaucugcuugccuuggccucccaaaguggugggauuaaaggcaugagccagcauacucggccuccacguguuauuuuucauguuucauuuucuuaaaaauucuacuucaucaucuuuucucucaggagucugccucuuaaaacuugaaagaggaguaaagccaaagccagacaagaacucuagcuacuucucaccacgccaccaauaaacuuaacuauagcuguacucuuucuuuccucuccccaucuccccagccugggccuccgccuguuuaaggcuaauccuuucacucauccucugaaucccauuuccuucuaccuaucuagggaccuuauaccaucuguuaucacccguuuccuguaucuuuaaccuuucccucuuuucugugucuuuuccaacaaaaaucaaaacauucuguuuauauuuuacuuuaauaaaaaaaaaaucugagagaguaacaagggaaaaaaacauuuucuagcuuguccauucuguaaaaaaucaguauccucgccugaccccuuacuuuuguccagcuaacccccuugcucuauuuuuagaaccuagcuacuuuaugaugaauuaucuuuacucacaguuuucacuuccucaugucuguauauucuuucuuuuucuauggcaaucuugcuucuaauucuacuuuuuucuuauaugcuauuauaaggucaucagugauuccucuguggcuaaaucaaauagacuuugguuucuaucuuauuugaccagucagcagcauuugacacugucaaucaccacuccuugaaauaccuuguacccuugguuucugaaguaacuccuacuaugcugguuauucuguguaucuaucucuuucacagguuucccuucugauaccccgccuucacuuuuuuccucuuuuuuuucuuaauuggucuagcuaaagguuuaucaauuuugcuuauuuuuuucagagaaccaaguuuuggcuuuaauuuuuccuauggcuucucuguuuaauuuaugucugugcuuuguuuugucuauuuauuuuggguuuucuuugcucuuuuucuagcuaagguagacacauagaccauugauuuguguguguguguguguggugaaauacacguaacauaaaauuugccaucauaaccauuuuuaaggguacaguucaguggcauuaaguacauucacauuauuauacaaccaucaccaccacccaucuuucagaacucucuucaucuuucagaaguguaacugugcucguuaaacaguaacuccccaucucugucuccccacauccccaggcaaccacccuucuacuuuucugucucugaauuugaguguccucuaaguacaucguguaaucggaaucauaugguauuuguuccuuaauuauugguuuauuucacucgcauaaugucuucaagguuuguuuguguugcagcauguaucugaauuuccuuccuuuuuaaggcugaauaauauuccauuguguauuuaugccacaucucauuaauucauucaucucuuguggacauuuggguugcuucuaccuuuuggcuguugugaauaaugcugcuuugaauauuaauguacaaauacugguguguccuugcuuucacuucuuuuggguaucuacccagaaauggaauugcuggaucauaugguaauuucuauuuuuuauuuuuugaggagccccucuauacuguuuucuauaguggcuaugccauuuuacauucccaccaaccaugcacaaggauuuuaauuucuccacauccuugccaagacuuguuauuuuguuuuuuuuuuuuacuauuacauuagacauucaaauggguaugaggugguaagucauugauauuuagagaccaucauuuuuuuuuuuuuuuuguccccgagacgaagucucgcucugucacccaggcuggagugcaauggcacggucucggcucacugcgaccucugccuccuggguucaagugauucuccugccccagccucccaaguagcugggauuacaggugcgugccacuaugccuagcugaauuacaguuaaaaauauauuccaguuuccuuuguugauuccuuauuugaccagcccauggguuauuauuuagaagugcauuguuuaauuuccagauauuuagggcuuucuugauauuuuauuacuuauuuuuuucuguuuuggugaaagaacauacucugugcauucauuccuuuaaaauuuauuaagauuugucuuauggcccagcauaugaucuuucuuggugaacauaccacuuugcacuugaaaagaauguauauucuguacuauaaaugucaauguggugacgaugauugcccuuuacaguuuuuuuuaauguuuugagacagggucucacucuguuacccaggcuggagugcaguggaucgaucuuggcucacuguaaccuccaccucccaggguuaacaaauccucucaccucugccucccaaguagcuggcacuauaggugcaugccacuauguguggcuaauuuuuguauuuuuuguagagauggguuucaccauguuucccaagcugcagaucuuuuaucuuuacugaugguuuugugugugugugugugugugugugugucugggugucugugugucugugugguucaguucuauaauugcagagaggugauauuaaaaucuucaacuauugcugggcgugguggcucacgccuguaauccuagcacuuugggaggcugaggcaagcggauaaccugagguuaggaguucgagaccagcuuggccaacauggugaaacuccgucucuacuaaaaauacaaaaaguggccaggcgugguggcacguaccuguagucccagccacuugggagacugagacaggagaaucgcuugaacccaggaguugaagguugcagugagccaagaucaugccacugcacuccagccugggugacagagcgagacucagucuuuaaaaaaaaaaaaaaaaaaaaaaaacuucaacuuuuggccgggcaugguggcucacaccuguaaucucagcacuuugggaagcuaagguggguggauucguugagccccaggaguuugagaccagccugggcaacauaaugaaacccugucucuacaagaaaauacaaaaaucaucugggugagguggugcaugccuguagucccagcuauucaggaagcuaaggugggaggauugcuugaguucgggagguccaggcuguguguguugugauugugccucugcacucuaaucuaggcaacagaguaagacccuaucucaaaaaaaaaaaaucaucaauuauuauuguggaauuaucuuucccuuuaauuuugucaguguuuuauuuugaagcauacacauuuuuuauuacucaccucuaucuuugauaauacuuugucuuaagucugcuuuaucugauauuaaaguaagccaacuccagcuuucuuguacguacuguuugcaugauauauguucuuccauaucugucuuuuuuuauuuaaaguguguuucuuauaaaaaacauauauuugagaaugcuuuuaucucuucugacaaucugugacuuuuagucaaaacauuuaguuuauuaaaaagcaacauguauuaguuugcuagggugccguaacaaacuaugacgaaguagguggcuguuaacagaaauuuuugucucauaguuguggagccuugaaguucgaaaucaggcauagguaggguugguuccuccugaggaccaugagggaagcaucucuuguuccacgucucuuugcuucugguagugccuuggcuugucuucauggggcauccucccuaugugcaugucugucuacaaauguccccuuuauacgaggacaccuuaaugaucucccuugaacuugauuaccucuauaaagacuccauuuccaaauaaggucccauucugaggcacugggguuuaggaccucaacguaucuuuuuagagaacccaauucaaccccauaccaagacauauauaaaguuaacugcuugugcagagguaaguuggcgaaagccacaguacuuguguacauauuuuuuuaaaagguacaaaaauuuaauuauauuaaaacaguaacauacauuuguguguaugagggagggauauuuaaaauuaaaauauuauauaaucacaagaaagaccuaauauucuugcucugcucuugggcaaccaagaaaauuagagccuguuuuauaucccaaaaauaaaaagagacuugauagaaguuacagugcucagugcuugcaacccaagucaauuuaugcucuuguuagauaaguuuaaauucuaaaggcuacaaaaaucuuauuaaaucaaggggaaaaaauucauuuuagaacaguuauucaagaugaaagaaaggcaugucuucaaugagagagcugccugcuaucggaugauuucuugcuaauguguuuaaagauuuuggacuucucaacuuucuugauuuucugguagucaaauccaccaccaccuccucgcuuuuucugcuugccuucauugccauugacauucagaucaacaaaggcaggcacuuugaaaucaaauggcagagcaacuugaggcaaauuuaaguuauuuacauuaaagaucuguuucagagaaugggaaucauaaccucauauguaugacuuauaugcuuccugggcugacuuacaaagaaaguaguucuuuucaaucaauuucucaagcugagacugaaugucagaaauuuuagaccaggaaaagucaaauucacuuaauggaaccuuggauuguuucaaguagaagaaaacccaauuauucugggcccaaaaugggcaaggcaugucuucucccauuuaggccucuggcuguucuaccuacacgaugaauauauuccuuagggucauccggauggucauagugaacaauccaguugacuugaggaauguccaguccucuugccaccacauccguacacaauguguucccaaaucuguguugcagaacuggaagaauguggucguacauuuauuuugcuuuugcuuuccaugaauggccaagacgggcaaaucaauguaguucagcaacucauagugguauuucacggacauacaagaugaaaagaagaccacgagcuucuuucgguucuucuuaaggaauguaaagagcagaaggaaucucuuuucagaaggacaaacaacauaucccugcucaagaccauccacuguuguauuagcuuuaucaucaucaacacuaacauacaauggcuccuuuuuucagagaaauccuugccaaccuucaaaacuuuucgaguuuggguggcagaaaagagcauagucugucuacauguuggcaaaaguuuaauaauuugcuuuaauuccucuucauacccaacauccaagauacgaucagcuucaucaauaaccagacacugcagguuuuuauacauaaacccugggauauucugcauaugauacagcagacggccugguguggccacagugauguugaucccauuagcaaguuucugugcuucagcagauccguuacugccacccauuaucaacccauagguaugcacguggugagucuuuagcuccuuaagaacaccaaaaauuugcauggcuaauucucuaguaggugagagaacaaggacuccgcaugcauuccugggcaugaauuuuaacaaugaguucuacugcagguuugagaaaagccaggguuuuaccacugccuguuuuugcagcugcuagaagaucccugccuuccagaaguggucugauacuuucaugcugaauuucagucauguugguaaaacccauuuuuuuuuuuaacuucagaguuuucauugacaauauuauguagagaagcaaaugaaguauccucaaaugcuccugugagucccaggggcaggcugggcaccucacugucaucuucaucauuaucuggcuucucuacguuauuuucuguuucuuuaggagucucggcacuuucuucucagauuccucuuuguuuucaguuuuugcuuuuuuuguaucagucccagcaucauucaccauuuuucucuuuugauucugaauugggagacugcauugcugcuucuccauugguuaauacgguggauuucuggggagauuuuuuagguuuuauaucuuccacugccucuugagacaugucuccauuuggagcuucugauaagcccacauucauagaauguuuucauuuuuuaacccuucuaccucucauuguuucuucagacacaucugcauuuugaguuucugacagggucagauuugaggccccugcaacuuuagguucuggugccgcaguuugaguuucugcuucuugaucuucuugcgcaggaguuuuucauuggcaggugagacauugcuguccaagaagugccuagaucacgacgucacacaguacagcuacucaguucucggggcugacguugcuuccacuuguauacauauuuuaaagcguauaugcaguugaacucuugaguacuugguguggacgcuuaaaaacucuuuagggaaaauaaggagcucuuuaaaugcuaguugacuaaaacugacuugaauuuuacuugcucauguaaggagccaaauggaugaauaagauagauaggcccucuauucagucuuucuuucuagauaaaauaauaugaugugaauagcagauaucccuuaaguacucugauuaaccuguuuugccuaccguuccauuauuggaacacuaagcaugugggaguuauuucuguccugcucaaggucaucgcuaaggucugauugcaaaaauucaaauaauugcaaccucuggcauaaauggguuaaauuauuauaaacaacaacauaaugggguggggagaaauaacugggaauugaagauuuuuuuuuuuuuuuuuuuuuuuuuuuuuuuggucauauagaccuuuguguaaauccugguuuuguuaacuuaguuauagggaaauggacaauuuaauuugauuuucugucuccucauuuaacacuggauuuauuuuuauuuuuauuuuuauuuuuuuaagacagagucucucucugucacccaggcuggagggcaguggcgugaucucagcucacugcaacuucugccccccagguucaagcaauucuugugccucaggcgccugaguaguagcugggguuacaggcgugcaccaccacacccagcuaauuuuuguauuuuuaguagagacgggguuucgcuguguuggccaggcuggucucaaacuccuggccucaagagauccacccaucucggccccacaaaguacugggauuacaggugugaguuaccgugcccggccuauaacuggauauaaaaaauccuuuuaccagaguuugugaguccagagugagauagugacacuuggugggaguuauucaauguacauuaauuuaucuucucuugauguagaaaguaacaaucagcaugacuuggugacuacuaacaaggagaggaaauucuaaucauuuaauguuucugauuuaauugauuuauugauaacucuccauuacuuuuucaaaucucugaacuagaaagggcuuauucauagaguaaaaugauuagaaucuuuguuucauugaaaaacaacuaguuauaaaaugguuuuuuuguuuguuuguuuguuuguuuugagauggaauuucgcuuuuguugcccaggcuggagugcaauggugcagucuuggcccacggcaaccuccgccucccagguucaacugauucuccugccucaaccucccaaguagcugagaugacggcgugcaccaccauacccagcuaauuucuuucuuuuuuuuuuuuuuuuucuuuaaguagagauggaguuucaucauguuggccaggcuggucucaaacuccugaccucaggugauccaccuaccuuggccucccaaagugcugggauuauaggugugagccaccacacccggccaaauggucuuuuuuuuuuuuuuuuuugauacaagaucuugcugucaucccggcuggagugcaguggugaaaucacagcucacuguagucucaaccucccaggcucaagugauccuccugccucagccucuuguguagccaggacuacaggugcacagcaccacacuuagcuaauuuuuuuuuuuuuuuuuuaauuuuuaguagagacaaguucucucuguguugcccaggcuggucuugaacuccuaggcucaaaugagcuuccugccuuggccucccaaagugcugggauuauaugcaugagccauuguuccaggccuaaaauuaucuuuuuacaacucagauaaaguaguccauuugaaauucuccuugaaaacuuaaaaaacacuuaagggaaguaaacuagugugaaauaaagaucacaaaacacuuucaguaguguucagaaaaagaaaaagcauguucccaaauaugaguucucauguaaaucuaaucuaaaaacuugguucauaucaugggaaaaugccuuuacuuagauugauaagagugacaaguuuagagcaaaauauaaaauaugagguacugcucuauuuguaaaguaaaaaagagucuuaauagugagaaacgucuuauuuuaauaacuuuugguggggugggugaguuguaauuuucacuaguuugaguacacguauacauuuuccauguaaguuuaacaugaaguuucuacguugagcugugguucuuccauuccuaaaucaauuguuuuaacagguuuccugcaaaacguuuguauguuguguauguuacacucuuaaaauacuaauuuauauguuuuguuuaucauuugcaauuaagcuuuuaauaauaaugugauugaacauaaaagaauaauacgcuuaucccaaaaauaagcaccguaaaucaagaacauuuauucagcaauuuuucaaugcacacuuuuauuuauuuuuuuaauuuuuaauuuuuuucuuaugaucuuguugcauaccaguguauguacucuuuuaggcaguuauagaauauagacaaggcucagccuuuucugucaagucucauuaggcccaugggugagcaaaaucuguaaacuacuuacugaucacuuguauguaaaguauuauacugguggauagugacuuuuuuuauggaaucacugcaguauaauaagccauauuaagaguauaacacauaaaugguauagaaacagaaauaauuaagaacaucugcugguuuguccacacaaaucuuguacacaaaugugcauagcggcuuuauucguaauagcccaacugcaaacaacucaagucuaucaacaauuaaaugauaaacagauuguguuacauccaugcaaugaaauaguauucagcaauaaaaagaacaaaaauccuuacgcucaacagcauggaugaaucucagaauaauuauguccaugaaagaagccagaaaaaaagaguacauacuauauaaucccauuuauauaaaauucuagaaaauggagcuacuaaaguguaaagcacauugauaauuccuggcaaggacaggaaggugagacugcaaagaaacuuacagaaauuguggcaguauuccuuaucuugauugugguggugauauauauguuauaacucaucaaauuguccacuaugcaguuuauuguacaugaauuauaucaggaaagcauucauaaagugauuuuuaaagaaccuaugcuggaaguacagaugugauugauuccauaaauauauuggaauaauccuuggagagauuagaguguauacccugguaaaccuaaauugauaugcuaucaaacacaggaucagugagucccaacagaacuaccaccagaguucaguguagagaaagacagcuugguuuaaugauaaaaugaggauaggauuuaauuaaagucagaggcucugaauuugaaucccuguuaggccauauuuucucuaaucuuuauuuuucucaucuuuaguuucauuaagauuuuaagauccaaagaauauauuugaaaguacaucugaaagugacauaaaaauggaaggcuggccgggcgcgguggcucacaccuguaaucccagcacuuugggaggccgaggugggcggaucccaaggucaggagcucgagaccagccuggccaacauagugaaacccugucucuacuaaaaauacaaaaauuagcuggguaugguggcacgcgccuauaaucccagcuacucaggaagcugaggcacgagaauugcuugaauccgggaggcagagguucaagcaauucaagagccaagauugcaccacugcacuccagccugggcaacagaaugagacuccgucucaaaaaaaaaaacaacaaaggcuuuccugacauuuagcuuagaagggaaaacaaaauaaaguagaauuugaccuguggagaucagugaggagggaauuccaaaaagggaccagagcugggagagugggaauauguaugauacauauggaaaaugaugagucaaaagcaguuuagggcaaagaguucauuuugcagagcagggagggagagauagcagccuaaaguaucuaaaagcauaauagagagauuauaaaauagcgagaaaguuuaccaucaggauauaaguugcuguuacuagcccuguaagcuuagccaagucauuuaauucucugagccucaauuuccccaucaauguaaugggagauaauaauaguucugccagaucucaaggauuuuauguauuuaaaucaguccaugucagaugugauagaguguaggauaguacugaaaaguaccaaguacuguugauaguucagcgugauuaucaagcugugggcuaauaagugucuggacucagauaauuguauuuuagagacaguuuaaauaacaguaaagauuaauauaaggccggugagacugaaggcaaggaaaucaaucaggaugcuguuucaguaguccaaggcagaggcagaggcaguggcaguggagaaaggaagggauggauuugagauaggucuuggugaccaggucuguguuaggaggaaaaggggaagagaaauuguauuaguuuucuguggcuguuguaauuaauuaucacaaauuagauggcuuaaaacaacgaaguaauuuccucacagaagcuugaaauaaucauaacuggguugagaucaagauguuggcaagugcuccuucccuccgaaggaucuaggagagaaaccauuccuugccucuugcagcuuaugugggcugcaggcauauucaucuugugacuauaucauucaucacuggucuucacguugcuacaccaccuccucuuccccacuuuucaccuucuccugugugugccaagucuacaucugccuuccuuguauaaggagacuugugacuguauuuagggcccaccuggguaaucugggauaaucuccccauuccaagauauuucaucacaucugcaaagccauaaagguaucauucacaaauucaagggauuagaacauggacauuuggggguuuuagcuuuuuggagcugguccugucauugaccagaguacuugaaaaagaagaaugcauuuuugagagaugauaaugaauucacuugggaucugcugaaguaccuaugggccauguguaugaggguauucaauuuauguuaucagaaaaccucgaaucagguggcuuaaacaauacggacauuuauuuaaaacaaaaaacagccucagaguugguuaaauuagcaauucagugacauccuugaggacauacguucuugcuuugccauccuuaggcuggcucuccuaugguaacaaaacgauccccacaauucuaggccuucaauacagauaugcaaauuuaguuggcuuguuuugugugccccacccccaccuuuuuuuuuuuaaagucugcaaggaaaccuaacuucugaagcuacccauuagcuucuauuuuucuuggccagauaaacauucucuugaccaccgucuuuuaccuaaaucuuuuuuuuuuuuuuuuugaggcagagucuugcucuauugcccuggagcuggaagugcagugggaucucggcucacugcaaccuccaccuccgaguucaagcaauucuccugccucagccucuugaguagcugggauuacaggcaugcgccacugugccugacgaauuuuuguauuuuuaguagagacgggguuucaccauguuggccaggcuagucuugaacuccugaccucaggugacccacauuccucagccucccagagugcugggauuacaggcgugagccaccgcacccagccaccuaaauuuuuuauaucuacguugcagauuuguucagguaagggaccccugccucaaauacacaaacauuacacccauccaucuucagugacaaauggcaaaacagaccucuugagcacuucccacaucacauuguuuuacuacuuuuugcuaugcagauuugguagaaucuugcagauguggaacugucuuucugugguuuauuuaaacagcaguccauucaccuugcuuagucuuguuuuaaguucuugucuacaaauuccuaaccauguccucauuuucuuuuucuuuuuuuuuuuuuuuaagacggagucucgcucugucacccacgcuggagugcaguggugugaucucagcucacugcaaccuccgccucccggguucaagcgauucucgugccucugccucccaaguagcugggauuacaggugcgugucaccaugccuggauaauuuuuguauuuuaguagagacaggguuucaccauguugagcaggcugaucucgaacaccugaccucaggugaucugccugccucggccucccaaagugcugggauuacaggcaugagccaccgcaccaggccuguguccugauuuuuaacauuaaacuugaaagcagugguuaauguagucugaggacucuccuggggaucccgagaaccuuuuagagaguacgugagauuaaaacagucuucuagcaguguuuuaagacacuacuugccauuuuucuuucuuauucuuagauauacaauggaguuuuccagaggcuaccuacuugaaauguuauuuuuuuauuuuauuuuauuuauuuauuuauuuuuuucccgagacagagucuggcucugucacccaggcuggagaacaguggcaugaucucggcucacugcaaccucuaccuccuggguucaagugauucuccugccucagccucccaaguagcugggacuacaggugugcgccaccacacccggcuaauuuuuauauuuuugguagagacggggguuucaccauguuggccaggcuggucuugaacuccugaccucaggugaucugccugccucagccucccauagugcugagauuacaggugugagccacugugcucagcugaagugugauacuguaacagacuuaacacaugugagaauucagcugauuuccaauaagccagacuuaaagagauuuucaaaaaucagugcuacucuugccuuuuucuuucuuuuuuuuuuuuuuugucugagaaaauuuaguuucuugaaaacuauguugucuuaaaauguacuguuauuuuuaggugaauaauuuuuuaaauuucuaaguuuuaauuuauaauacgguaaauauuuuuagauauaguucauguaaauaaaagcucuuuuggguucucaauaaauuuuaagaguguaaagaggccugagauucgaguuuaaaauccgcugucuaguguuaaucccacucuaaccacauacuccaaaguuuuuccauuucuccaaucauuauuuccuucucuuacuauuaucaguuaucauguagguauaucaucuucauauguugcaggauuuguugcaaguacuuuagagucauucauucuauuuaauauugaucccauuuaugggagcagaagcuuucuuauucuuuauuaauaugucucugcauuuuauuuccaacacuuaccucuguuuguuaguacuuucaccauucuuacuguuuuugugcuuaucgaacaugcuggauuuaguaauauaccucaaaacuaagcacagagaaaaaacuaaugaagacuagagagcuaagacuuacaugaccacacaaguccauuauuaucaucucuugguaauaggcauaguuaacacucuugcucugagaaaugacuuugauuuaugauaaacauuuauaaguggggaguaucuguaauuuuuauaaacuuggcugugaagggagagugccugauggaugauacccaguuuugaugggaggugagggauggggcauggagaaucaaaaaugaguacuagauuuuaagcuaugggugacugagcaauugaagguguccaugauuaacagauuaagaaauucuguagugguauguuaguuggguaauaauuugaguuuguuuucagacauugaauuugcaagauggcgaacacauucagauggaauugucuagcacucuagcuggucaguagaagcccagaauugacauucagagggauauugcugagauuuuagucaaaggugguagagucagagaucugucaauaaugauagcuuaucuguuaaucacugcugcaccauauucuuauauaaacagucugugcugggcacugggcucuuuacauagacucaucucauugaaucuguaugacaguccucagaaagcucacuuguuuaaggucauccagccacuacagucauauaaccaugauuaacaugcaggucugucugaacuaaaaagcuguuguucuaccuaguggacaugcugucuccaggcaacguuaauauauucauugauaauugaauugaaugugaaauacucaaagccuaauuaugcaugaggugaagaaaucugucacugaguuuuggguaauaugaaaagacuauaauucuuuuaauuaaugcuuaguaaugugucagaagauucaaauguauuuauccuuggagcaaucuucuguaguucaaagggacagggauaccacgagugucuauggcagaucuagaauuagaaaccuuaauaggaauugaguaguuauagugugagauauaauuuauggggaaaauuucagguaguaaguuucagagacuauucaaauuaauagauuuuuuuuaaguuuauuguaauuuuaaaaauacauuuacaggucaaaaaguauguauuuuucugggauauucagauaaucagaauaggcuaauaucugucauuuucacagucacuuuuuucucuuuagguuguuaggcagcaaauaacuacagcuaaggacucagcuuuuaauauucuggcccauuggugauuuuuucauuuuuuuaaagaucacuuuguuacagaauuugccugauuucgucucagucugauaauuuagaaaggaauugacuguaaugaguccuaacauuuuuccacaucaaucuuuuuaguuguguaguuugucacuuuucggauaguugauuuacugcuuugaacagaucgaauaugaguuuuagaaguaguaagauuuuuauuccaacaagaacaguuccuuuauagaaacaaguuuucuuacacuauuaucaaaucacuagaaagaauacuuguaggugggcuggaucaguggcuggagcauuaccccugcugcauacuggcugcuagcaguucugagagcagaguggacagcacggguuggucucaggauuuguugugugccuuguggauaucacugucaaaagaaguauaggagcaugugggcaugaacugguuugggaacaaauacuacucuauuccagaguacaagaacuggagaggugaggacaaacuauucaagagaaaagaauuguagaagcagcaaauaaaaaauuagacugugaaguaggggauauuccaacagaaugggaagcuuagaucagaagaacaaaaaagaggcugggugugguggcucacgccuguaaucccagcacuuugagaggccaaggcaggcagaucaccugaggucaggaguucgagaccagccuggccaacauggugaaaccucaucucuacuaaaaauacaaaaauuagccagucaugguggugcacgccuguaaucccagcuacucaggaggcugaggcaggagaaucacuugaacccgggaagcggagguugcagugagccgagauugugccacggcauuccagccuggccaacgagagcgaaacucuaucucaaaaaaaaaaaaaaaaaagaaaacaagaauaacuccaccuacgauggaggaaauacuaaagaaugaaaaauacagagaagaaauuaaaaagcaaagauuuuuaugaaaaccaaaaacuccuuaguaaagagacuagugaggaacucuuggcuccaccaguucaaacucaaaggacauggcuuugcuccauacuucggaaaggaagaacucacugguucccaccagcacugguaaaaccuuucagccagaaucccagaugccgcaagauagaaggagccacagucagugacugcauuauggucagaucguuuuguguauauggaugugaugauuuucacaaagaaaagaagucaaaauauacuuaaaauuuagagagauuggcccccagguccuguuuuuaacagugauuuuuguacaaagcaguggacuuuuuuuuuuuuggagacguagucucgcucuguuucccaggcuguggaguguaguggcaugaucucagcucacugcaaccucuaccuccuggguucaagcgauucuucugccucagucuccagaguagcugggauuacaggcacgugccaccacgucggcuaaauuuuguauuuuuaguagagacgguguuucuccauguuggucaggcuggucucgaacuccugaccucgugauccacccgccucagccucccaaagugcuggaauuacaggggugagcuaccacgcuuggccaacagugcuuuuuguacaaaguaguggacucuuaagaaccaagucaucugugcuccaucccuagcccugacauuaaguaacugacaucccuagcucugacguuaauaacugacauuaaguaacugacuugguuuacuuuucugggcuuuagcacaaguauaugccaccaguaaauguuuguugagguaccaugaacaguugugguaauuauacauuaccaaaguguuugugauuauuaguuacuugaauuuuauuuuaccaaugaauaaacuuuuaauaagaggaggaugacugcaaagugugaguuguuuguccguauugccuaugagcaagaaugauacaaugaaaaaauuugcaauuaacaucauauacaguauaauucuauaaauugcaugaauucuaauauuaaaugugaaaaaauuuaccuaccuguuugcuugcuugccuuuuuuguauuuuuaguagagacgggguuucgccauguuggccaggcuggucuugaacuuccgaccucaggugaucugcccaccucagccucccauaugugcuuggauuacaggcaugagccaccgugcccagcugcuugccuuuuuuuuuuuuuuuuuuuuuuuuuuuuugagauggagucuuacucugucacccaggguagagugcaaaggcacaaacuuggcucacugcagccuccaccucccggauucaggagauucuccugccucagccuccugaguagcugggacugcaggcaccugccaucaugcccagcuaauuuuuuuuuguauuuuuaguagagaugggauuucaccauuuuggccagguggaucucaaauuccugaccucaggugauccacccaccucggccucccaaagugcugggauuacaggcaugagccacugcgccuggccugcuuugccuuuuuaauaucaagaaaaaaaaucaagaugccuucucauugucgaauaaagcuuaauuuuuuaaaaugagauugaacauauaauuguguuuauuaaaaaugaaaaucuuuugauauaaauuuaaauugaguaauucuuacauaagauuauuuugcagugaucaugccaaaauaaagucuggugcgcuuugcuuuuguucccugcaguucuuuugaguuuuguaaaaaucuggccuugcugaugaaaaauuuuggaaauaggaaaugguugcacaacagugugauuguacuuaaugucacugaacuguacacuuuaaaaugguuagaaugggccgggcacgguggcucaugccuguaaucccagcacuuugggaggccgaggcggguggaucauuugaagucagaaguuugagaccagccuagccaacauggcaaaaccgccucucuacuaaaaauacaaaaaaauuagccaggugagucccguacaccuguuaucccauccacuugggaggcuaaggcaggauaauugcuugaaccugggagauggagguugcagugagccaagguugcgccacuacacuccagcagucugggugacagagcgagacuccaucucaaaaaaaaaaaaaaaaaaaaaaaagguuagaauggcaaauuuuauuuuauauuuuuuuuaaccacaauuaaaaaaauauuggagcuagucacagugguggggaccuguagucccagcuacuuaggagacugauaugggaggauugcuugagcucaggaauuggagaccaauguggguagcauagcgagaccccaucucuaauuuaaacaaaaaucuccuugcccagggaggugugucacacacaugacaucugcugucgugugucguggcuaaauaaaauacaggugauaauugccaacguggaagagagaaaugugaaccguuuaaggugguagccacucuuacucaaaauacugcaaaauacagaauucuauguuugggguaacuucagucaagugauuuaauuaguagaaggcuguagggcuagguggccuucaacauugcucuuuaccuggaaauuaaguuugugauucaaaccuuuuauugguuaagucagggauuuaaaaucuguagaaaagacucaaguguccagcaugaguagaauggaugaacaaaaugugguuuauauucagcuuuagaaaggaagaaaucuugacacaguaguacauuguggaagaaccuugagaacacuucgcuaugugaaauaagccagaaacaaauauugaaugcuuccacuuauaugagguaccuucaguagucaaauucauagagacagaaaguagaacagugacuacaggaacauggggaugggaagaauggggagcuauuguuuaaugaguacuguguuucacugugggaugaugacaaagcuccagagacggauagugauggaugguugaaccacagugugaauguauauaaugugaacauacaaacuguaugcuuaaaaauaguuaaaacaguaaauuuuguguauauucugccacaaaaauaaccuuaacugcugcuuauuaaguaacuuagaugauguaggcuuuaguuuauaauaggguguuauguuucauuuuaagaaauugggucucacuccaucacccaggcuggagugugguggcaugaucauagcccacuguaaccuugaauuccugggcucaugcaaauaggguauuggagaacuuuuacaaaauaaaaugacaugggcacaucaucaaaacaauaggccgggcgcgguggcucacgccuauaaucccagcacuuugggaggccaaggcgggcggaucacgaggccaggagaucgagaccauccuggcuaacacggcgaaaccccggcgaaaccccgucucuacuaaaaauacaaaaaauuagcugggugugguggcgggagccuguagucccagcuacuuggguggcugaggcaggagaaugacgugaacccgggagguggagcuugcagugagccgauaucacaccacugcacucuagccggggugacagagugagacgagacuccaucccccccccaaaaaacaacaacaacaauaaaacuacuuuuuaaaauauuuauuuauuuauuuauuuauuuauuuauuuauuuauuuauuuauuuugagacagggucucuguugcccaggcuagagugcaguagcacaaucacagcucacugcuguuucgaacuccugggcucaagccauccucccaccuuagcuuucuaaguaccuggagccacaggcuuauguuaccacaccuaacuaauuuuuguauuuuuuguggagacagggucucacuguguugccuaggcuggucuugaacucuugggcucaagugauccucccaccucggccucccaaagugcugggauuacaggcgugagccaccgcgcccggccuguuuucuggcuucuuaaggcagacacuuuggaugauuaauuugagaccuuacucauuuucuaauuauaaucauuuaagggaaugaauuucccuauaagcacuacuuuagcugcauuccauaaauguagauguguuucauuuuuguucauuuuaacguuuuauagcuucccuugugucuugccuuuugauuuauggauuguuagaaguguguuguguuaaugagagaacuuccccaaccuggcaaagggcaauuacaaaaaaccuagagauaguaagacuggaugcuaaaaaggcgagauuguccuuucccucaaguucuauucccaccaauccuauuaaacauuauauuaaaaguccucacuggugcaaaaaggcaagaaaaauaauaggcauagagauaugaaaggaaaaaacaaaacuucuuauugagagaccugauuauuuacacccaaguaauuuuuuaaaaauacaaaaagcgugcuagaacuaaucaaugacaggaacaagucaacguaaagaaguuuggugauuuuuuaauuaccuuucuguuaccaauuuuuguguuguaauuccauuagggucagagaacauacauuagaaagacugacuauucuucuguuacugcauagaauguucuauaaauggcaguuagauccaguugguugaugguguuaugucuuugcuaauuuucugccuacuaguuuugugauggcugagacaggaguguuaaagucucuaagauuagggccuuguauauuuuuucuuucauuucugucguuuuuacuucauguauuuugaugcugucuuuuaagguauauacacagaauuguuucacuugaugaguuaauccaguucagcuuucuuuugauuaguguuuaaaugguauguauucuuuuccaaccuuuccccuuuaacguaccuaagauauguuugaaguuaguuacuuauaaacagacuacauugagaucaugguuuuucucuuuuuucuccucgugcugucucuguguuuucauuguugugauuaaaucauuugcauuuauuauaauugcaaaugcacuuuagagguagaggcucccuucuuacacccauccccugcuaaugaaaugaaggcuguacuuugggcuugacacccugagaauacugggacaaaaauugccguugcgcuggcuugugaagcaaugauugagucaagccuagaagucuucagguugcugucccccuuucugccaaguacucagcuccuagagcagggauuucauucugagagaaucuugcaauuauuuccauccccagcuuuagagacuuggcucagagauuuuuugugguggggagaaguagaccaauaguucuuaaucucuucugaaugcagcuuacuuaauugggaagauaauguguagaauuucaaagcuaagggcacucucaaaaauggugguaguugugggagaggacuauagaaaagaccagaauaagacagcuaagugaagcucuacuguagcaagaagaaauaucagauagaccucaaacuguuccuucaaaugagcuacgguugguugguugguugguugguugguugguuuugagacagagucucgcucuguuguccaggcugaagugcaguggcaugaucucagcucacugcaaccuccaccuccuggacucgagcgauucuccugccucagcaucccgguuagcugggaccacaggugcaugccaccaagcccagcuaauuuugguauuuuuaauggagacaggguuuugccguguuggccaggcuggucucgaacuccuggccucaagugauccaccugccucagcuuuccaaagugcugguauuacaggugugagccacugcacccaaccugagccacauuuugauuucaauuaauuuguagaauauaaacccagggcuuuuuuuuuuuuuuuuuuuuaaauaacaguagaacaguuaguggaguuuaacaccuuggugugauaagagcuagaauaucacuguaaguccagggugacugugggcguacccaaaaauguaccucucuguggaucaacauccaaggcuuagcauuguggagguuggggaaguggggaaauagacuuugcuaaaauaauucggcuagucacuaaaaaauaagcaagaaacaguaagaagcaccaagaaagagggagguagaagaaaggaacaguaacuggauuugcuauacuauauuaucaaaaaugucagugucuagcaaaaaauuaugaggcaugcagagaaaaaagaaauuaugacucaugcaccagaaaaaaagcagaccuuauaaacugccugugugagagagaccacaugucagauuuaacagaaaagacuucaaaauagccaucauaaguguguucacagaacuagagaaaaagcauaaagagguaaaaguggguauagugacaauuuugcauaaaauagaggcuaucaauaagaauauaaaaauuauugaaaaaacaauuagaaauucuggaauugaaaaaaauaauuaaccgaaaauucacuagcagugcucuucuucacuggcagaagauggguuuagugaauucgaacauagaucaauagaaauuaugcaaacugaggaacagagauaagauaauaaugaguagagcuucagcaaaacauaagacaccaucccacauaccauuaaacacuuaagaguaaugggaguucuggaaggagaggaggaagagaaagaagauaacaauagaaaaugauauagcaauagaaaaaaacacucaaauaguggcagaaaacuucccauacaaacgaaugaugguuugacuuacaaguuuuuaguguaugauagcacaaaagugaaagugauaaagcauucaguagaaaccgugcuucaaguacccuuacaaccacucuguuuuucacuuucaaugugguauucaauaaaucauaugagguacugaacacuuuauuuaaaaauacuuuguguuagguuauuuugcccaacuguguaagcuaaugucaguguuuugagcacuuuaagcuagacuaagcugugaucuuuaggaagguagguauauuaaaugcauuuucgacuuugauauuuuuaacuaacaaugggcuuauuggauauaauuccauacauuggagcaucuuuacugaaaaucuuuuucuaaguaagaaaaauguagcaauuuaaacauacaguaaaaacgcuaaaaguuuaaaaagggaaaaucuuuaaaauaguaagaaaauaacucacucaaaauggaaccacuguaggauuaauggcugacuucuuauagcaguggaggccagaaggcguugggagaacauauucaaaaugugcaaaggacgagggaagaaaacugucaaccaaaaaucuuauauccaacaaugcuaucuuuuuuaaaugaaagcaaaauaaagacuguccuagauaaaaacgaaaauuuguugcuagcugacccacuuuacaaggaacaucaaaggaauuuuuucaggcugaaggcaaaugacccuagaugguaauuugaaugcacacaaaaaaauagagcaucagaaaagguaauuauauaauuacuuuaaaaaaaagaaauuaacauuuuucuccuuucuuguuauaaguuuauuaaaaagcaagcuauuuuauauguauauacauauauguaaugcugaucccauaacaaagaaauguaauaaaucuguaauauaucugccaguaacagcacaaaaauaaguggguaggagcaaagcuguguugggcuaaggaaaugacuacagaugggaaagcaguaaucaugaccacauauuguguuuguaaucaugagcagauaugauaucuguaacaaugcuacuauaaaugggggagggaauugacauauauaguagucauguuuuugucugucacaagaauuaagcuaguauagaucugaagcugguucugguauauauucuaaaaccuugagcaacuacuaaaaacaacucaaaaaauauaauuaaaaaucauuuuaaaccugcagaugcuacauuagaaaauaauacaaaaguaagcacuaaaggaauaguagaggaacaaaacagacaugggacauagaauugcacguuugaaucuaacuauacaaauaacauuaaaugugaacggauugaaaucaaaagacagagauugucagacuaaguuuauaaacagcauuauccagcuguaugcuagcuaaaggagacauaauugucauucaaagaaaaauagauugaaaguaaaaggauggaaauaaauauaucauguaaacagcaaccaccagaaagcgagagugguuuuacucguauccagcaaauagacuuuauaacaaaaaguguuacuagagacguuuuauaaggauaaaagggucauuucaucaggaagcuguaacaguuauguugcauauauguaauaacagaauaccaaaauacaugaagcaaaaacagaaaugaagaaacagacaauucaacauuaguaguuggagacuucaguauaccgcuuuuaauaauguauagaacaggccgggcacaguggcuaacaccuguaaucccagcacucugggaggccgaggcggacagaucacuuaggaguuugagaccagccuggccaucaugguaaaacccuaucucuacuaaaaauacaaaaauuagccaggcaugguggugcacuccuauaaucccagcuacucgagaggcugaagcaagagaaucacuugaacccaggagguggagguugcagugagucaagaucaugccacugcacuccagccugggcaacacagcaagacucugucucaaaaaaaaaagaaaaaaaaaagaaacguauagaaaauuaaaaggucaacaaguaaauagacgcuauaaaccaacuagaccuaacugacaucuauggaacacuucacccagcaacaauagaguauauguucuucucaagugcacauggaacauucuccauuauagaccauaugcuagccaugaaacaaaccucugauuucuuuuuucuuuuuuuuuuuuuugagacagaguuucacguucacucuuguugcuuaggcuggaaugccaaggugugaucucagcucacugcaaccucugccucccgaguucaagcgauucuccugccucagcuuccccagucacugggauuauaggcaccugccaccaugccugguuaauuuuuguauuuuuaguagagacgggguuucaccguguuagccagacuagccucaaacuccugaccucaggugaucacccgcuuuggccucccaaagugcugggauuacaggcgugagccacugcaccuggccaauagauuuuaaugcaaaugaccuggcgcgguggcucaugccuguaaucccagcacuuugggaggccaaggugggccgaucacgaggccaagagaucgagaccauccuggccaucauggugaaacccugucuuuacuaaaaauacaaaaauuaucugggcaugcuggcacgcgccuguacucccagcuacuugggaggcugaggcaggagaacugcuugaaccugggaggcggaaguugcagugagcuaagaucaugccacugcauaccagucuggcaacagagugagacucugucucaaaaaaaaauggagauuauguucugagaccauauggaaugaaauuagaaaucaaaagcaggaaaaaauuugagaagcucacaaauaugugguaauuaaacaaugcauuccuaaauaaccaacagaucaaaaaagaaauccaaaugaaaucagaaaauauucuagaguggguuaggcaugguagcccacuccuuuaaucucagcacuuugggaggccaaggcaggagaaucgcuugagcccaggaguuugagaccagccugggcaacauagugaaucccugucacuauuuuuuaaaauguauuuuaaaaaagaaaauguucuauggugaauaaaaaugaagauacgacauuacaaacacucacgguauguaguuauagcagugcuuagagggaaauuuauaguuacagaugcuuauauuaaggaagaagaaagaucucaaaugaaugaccucgccccuccaccuuaagacacuggaaaaagagcaaaccuacuuaaggaggcauaaggaaggaaauaauaaagaucauaaaagaauacuaugaaaaauuuuauagcaauauaauugucauaugucaaaugucagaagcaguagacaaucugaauagaucuauaucaaguaaugagauuaguaauuuaaaaacuaccuucaaugaaaagcccaggcucagauagcuuuacagugaauucuaccaaacauuuaaagaacuaauaccgauucuuuacaaacucuuccaaaaaacgggaggggagggaacugcuguucccauaucauuuuauguggcugguauuuacccugacaauaaagccagacaaagacgucacaagaaaacuccagaccaauaucucuuaugaauaauggaugugaaaauccucaacaaaguacuagcaaacugaaucccacaacauauuuuuuuaaaaaacaaacuguaucauacaugaucaacugggauuuuuuccagguugccaaggcuaguucaacauuuaaaauuaauuaauggaauauauuaauagaauaauuuuuaaauuacaugauuauaucaauagaugcagaaaaagcauuugacucauugaauucccuuuagugauaguaacacuguagcaaacuaggaauagagaagaguuuccuuaaccugaaaaggggcaucuaugaaaaccucguagcuaacauaaucagugauaacagacugggaauuuccccuucuaagacuaggaacaagacaaggauaucugcucuugcuauuucuguuuaacauugcacuggagacucuagguaaggaaauuaggcaagauaaauaaaaggcaucuaguuuggaaaggaagagguaagacuguuuucagaugaccugaucuuauacacguugagcaucccaaauccaaaaauguaaaauuugaaaugcgccaaagugcaaaguguuuugagcaccaacaugacgcucaaaauccucauuagagcauuuuggauuucggguuuuuggauuuaggaauguucaacuaauaacauguaaugcaaauauucuaaaauucaaaauacuuucggucccaaacuuuuuuuuuuuuauuugagacaaucuugcucugucacucagauuggagugcaguggugugcucuuggcucacugaaaccuccgccuccuggguucaaauuauuuuccugccucagccccccuacuagcugggauuacaggcaugugccaccacgucaaacuaauuuuuuuguauuuuuuauagaugggccgggguugggcggguggggucucuccauguuggccaggcuggucucgaacuccuggccucaagugauccaccugccucagccucccaaagugcugggauuacagaugugagccaccaugccuggcccccaagcauuuuggauaagggauacucaaccuguuuauagaaaaucguaaggaauucauuuaaaaaguauaggacuaauaaacaaguugagcaagguugcagaauauaaaaccaguauacaaacaugaguugucuuauuauacacuugcagugaagcauuaaauuaagaaaacaggcuggagguaguggcucaugccuguaauucuagcaguuugggaggccaagguggguggauugcuugagcccgggaguuugagaccggccugggcaaugugucaaaaccccaucucuacaaaaaauacaaaaauuagccaggcauguugguggcccaugcccguagucccagcuacucaggagacugagguagggggaucaguugagcccagcagaucaaggcuucagugagccgugaucauaccauugcacuccagccuggggcagcagagugagacucugucucaaaaaaaaaaaaaaaaaaauuaagaaaauaauuuuauucauggugacaucaaaagaauaaauuuaacaaagaaaaacucauacucugaaaacuuacaacauggcugaaagaaauuaaagacaaucuaaauaaauagaaaaacaccccauguucauggaucagaagauucaacauuguaaagauagcaguauucuccaaacuaaucuauaaauucaaugcaguuccuaucagaauccuugcugacuuuguaaagauugacagucugauucugaaauuaauauggaguugcaggggacccagaauagccaaaauaguacugaaaaaggacaaaauaagaggacucagcuucuugacuucaaaacuuacugcaaaacaacaguaauuaaagcauugugguacuggcacaaggacauauaaaucaauggaauagagaguccagauauaaaccuauuuguguucaacugauuuccaacaaggaugccaagaucuuucagugguaaaagaauacgcuuuuuaacagaugguacugggacaacuaaauagcuacaugcaaaagaacgaggugggaccauauacaaaaaauaacucaaaauagguuaaaggccugaaacuuuaaaacuccuugaaaaaaaaaaaaagauauuaguaaaucuucaugacuuuguauuuggcaaggaauuuguagauacgauaccaaaagcaugaacagcaaaagaaaaacacugaacuucauaaaaauuaaaaccuucugugcuucaaaggacaccgucauaaaagacaacccacagaaugagagaaaauauuugcaaaccauuucucugguaagcaacucacaacuagaauauauaaagaacucugacaacucaguaacaaaaagacaacccaaugggcagagcuccaaauggacaaggaagauacacuaauguccaguaagcacaugaagaugcucaacauuguuacuuaucagggaaauguaaauuaaaacuacagugagauaccacuucacauccacuaggaugacuagaaacaaaguugaaucauaaguguuggugaggauguggagaaaucagaauccucauacacucuuuuuuuuuuuggagacggagucucguugacacccaggcuggaguacaguggcgugaucuuggcucaccgcaaccuccgccucccagauucaagcuauucuccugccucagccucccgagcagcugggauuacaggcgcccaccccuacacccagcuaauuuuuuuguauuuuuaguagaguucgggcuucaccauauuggccaggcuggucuugacuccugaccucaaguaauccacccgccucgaccucccaaagugcuaggauuacagaugugaaccaccgcauccagccuccucauacacucuugaugggaauauaaagguguggcugcuuuggaagacagucugacaauuucucaaaugauuaaauauagaguuaccauaugacccagcaauuccugucuuacacauauacccaacaaacugaaaacauacauccacacaaaaacuuacacgauuguuuauagcagcauuauucauaauagccaaaaacuggaaacaacucguguccauuaaccuguagauaauaaaaaugcggaauauggaguggaguauuuuuucagcaauaaauguaaaugaggcaugauacaugguagaacauuauacuaagugaagugagccccaaacguccacauuauuauaugauuccauucauaugaaagucuuggauggggaaguuuauagacaaaaaauagauuagugauugcuuagggcuggcaggaaguuggaggggguucuccuagguuugucuguugggaaccuccucaaguugacuugagcuuugacauaccccgaguaaucuuugguagcuuccuuguuaucuggucagauauuccagaaggcauuuacugccugagacauggaaucagccauuucucuaaggacccaugaguuuauaguuuuuuugagaugagaaauggaauuuagaagccauucugggugcuagccauauucauugcuagagauuaaguacauuaucauuucauacugaugcuuuuaaugugaaauucaagacuguaaacucaaauugcaacuuuuuccuuuaacuauuuauaaugaauagauauaggcauuuuauauagcaaaaccagacagaaauuuuauaacauaaauuuauucauucauauauuucacucuguuguauguuaugugcaauacuggacagggucgagagaaauuagacacaaaauguuuucaccaaggccuuuugcucuaucugcuccaagcuucuaacaacgugccuuucugcccuucguccccguacauucuuuacaugucuucagcucugauaaauucagcagaaugaaauuuaucgugacuucuucccugaacugcaggccagaaugggcaacuucauguauaaauuuacauguggauauucuucucagguauuuuaaacucaguauauccaaaauugaaacauuucuuuccccaucaucaaccccuaucgaaaccagcucuucuuuugucuuguuuggugaaaacaaaguuagagauaaaaccaucugacucuuuuagcuacuguuccacccacccuuaguacaaaaucaugccuaggugguuuuccauucuaaauauuucucagaugcauuuucuuuauccucacugcugccaccaagaaaucuucuuaaaaggcagauaggacucuucuacucccauguggcuaccuguacuuuuugaagaagauuguaggucugaagcuugguauaaacauaaguggucuugaaccaaauaauuuucuggccucaguuuccucaucuguaaaaucaggguauuauaauguaaacucaugugagauagcauaucuaaagccccuaguguucuaucuggagcauaguugauaaaagccaauacagacaaguuuauguauaaauuuccaccuggauauuccucuuacaggcaucuuaaacuuauaugccccucuccuuaaccuuuucuguccuucauggguuuuaauuagaauauaagcugcgagugagugaucucaguucaguuuuagcauaauuaaaaccugguuaguaucuuuugaaaguuagcuuccaguuuugagauguggcugcauauuuaaauagauacauucuuucaaauaucaacuuuucccauccaacuaaaauuacuuccaagguuaacagucucauuacuuucucuuucaucauguuaagcagccacgucacuuuauaugcuaagagcuacuucguuuuaaucucaaaucuucugauaauuuuuaucagcuaaucuauauaucaaaauacagguuuuuaaaaugcugugaaaaauagacauuuuaaaauuugaucuacauuuaauuuuuguucacacuuuuucuagugugaauaaauagcuaacguuuauugaaugcuugcuuuaugccaggaauugugcuaauuuaauccucuuggcuaucuuggaaguauaauuucuaugauuccuguuuuucagaugagaaaaaaaacagaagcaucauuagagaggugaacaacuugacucagauuuaaugccuggcugguaaauggggaagugaaaauuuaaaaccuaagauuugucuaacuuaaaccaaucuacuuuaucaacuaggcuguauaccuuauuuggcaaaauuguuucaacccaacuguaaaaaaaaauuguagguucuuuuuuguauucccuuaaauuauauguuguuuagcaacauaccacuuucacaagaaugugugauagcaguauuucaucaguaauuuggaauaaaaugggugggaaguaaacuuccugaauuacugaauaguucaaauugcaaacugcuacaaguacauuuuuauuacuuguaaaugcugcacaaagucuaaauuaguaauuguaguuaauacugaucuuuacucaagaauuuuaaaugaccuccaaauuaaacuuauaacuacacauauacauauucaucuacacacagagauaaaugagauuaauuaauuaauuauuuaguggaguuucacucuuuuugcccaggcuggagugcaauagugugaucucggcucacugcaaucuccaccucccggguucaagugauucaccugccucagccucccgacuagcuaggauuacaggcacacaccaccacucccagcuaauuuuguauuuuuaguagagaugggguuucaccauguuggccaggcuggucuugaccccugaccucaggugauccacccgcuuuggccucccaaagugcugggauuacaggcaugagccaccgugccuggcgagauuuuuuuuuuuuuaaagagacuuggcuaacuuauaaaaacuucagguuauaccuugugguuucucaacuguccauauuauguaugacauuuucuuuuuuucucucucucucucucuuaaaauuugaggccgagcgugauggcucacaccuguaaucccagcgcuuugggaggcugagucagguggaucacaugaggucaggaguucgagaccagccuggccaacauggugaaaccccaucucuacuaaaauuacaaaaaauuagccagguguagugucuggcgacuguauucgcaacuacucaggaggcugaagcaggagaauugcuugaacccgggaggcggagguugcagugagccaagauagugccacuguacuccagccugggugacagagugagacucugucucaaaauaaaauaaaauaaaauuugagacagggucuugcuguguugcccagguuggagucaagggcucuucccaccuuaacuuccugaguagcugggauuacagcugcaugccacuauacuuggcacauuuuucaaauaucuuaaaaauacuuuguugcuaaaaaauucuagcaauuaucugagcuuucagcaagucauaaucuuuuuguugguggaaggucuugccuugauauugaugggugcuacugcucuggauggaggucacugaagauuggaguuguggcaguuuguuuaaugagacagugaugaaguuugccacauggguugaaucuuucuuccccuaccccacuccaccccccgcuuuuuuuuuuuuuuaaauuagacgugggucucacuccauugcauugagcuccugggcucaaguagucuuccugccucagccucccaaagugcugggauuacaggcaugagccccugcacccaaccuggaucuuucuuucgugaggauuucucuuuuuuuuuuuuuuuguagacagagucucacucugucacccagucuggagugcauggcaugaucuugguucacugcagccuccaccucccggguucaagcaguucugccucagccucccgaguagcugggauuacaggugccugccaccacacccggcuaauuuuuuguauuuuugguagaaacaggauuucaccauguuguccagguuggucucgaacuccugaccucaggggauccaccugcccuggccucccaaagugccaaagugcugggauuacaggcaugagccacugcgcccggccuucacgaggauuucucuacaggaugugaugcuguuugauagcauauuacuuauagaaggacuucuuucaaaaucagaguugauugcuagguguaguaguucaaaccuguaaucucagcacuuugcaaugcugaggccaggaguucgagaccagccugggcaacauagggauaccccuaucucuaccuaaagaaauaaaaaaauuuaaaaauuagccaggcguggugauacacaccauaguccuagaugcuugaguggcuaagacaggaggauugcuugacccuaggacuucaaggcuacggugagccaugaucaugccacuguacuccagccugggugacagagugagacccugccucuaaaacaaaaauuauaaucuuaccuagcucuucuggauaacuugcagcuuugacaucaguacuugcagcuuuaccuugcacuuuuaugcuaugaggauggcuucuuuccuucaaccucaugaaccaaccaaccucugccagcuuuucugaauuuguuuuagaggcagggucucacucugucgcccagguugauguacaguggcuugaucucggcucacuguaaccucugcuucccaagcucaugcaguccuccagucucagccuccugaguagcugggacuacaggcaugugacgucacacugagcuaauuuuuguauuuuuuguagagaugguguuucacccuguugccaggcuggucuugaacucuugagcucaagccauccacccaccucagccuccugaaguacugggauuauagggugagccauugcgcccagcuaaaaaaaauuuuuaauuaaaaauuuuuuuaaauuggacuugauccucugaaacccugccacugcuuuaucaacaagguguauguaguuuucuaaaucauuuauugucauuucaacaguguuccuaguaucuucaccaggaguagacuccaacucaagaaaccacugucuuugcuuauccacaaggagcaacuccuuaucuguucaaguuuuaucaugagauugcagcaauucagacuccauuuugaauucuaguucucuugcaguuuccaacucaucuguaguuacuuccuuugugaaagucuugaaccucucaaagucauccaugaaggcuggaaucaaucuuguccaaacuccuguuaauguugauauuuugaccuccucccaugaaugucaaacagucuuaauggcaucuagaaugaugaaucuuuuccagaaaguuuucacuuugcuuugugcagauccgucagaggaaucaguaucuauggcagcuauagccuuuugaaauguauuccuuaaauaauaaggcuugaaaaucaaaaugacucccugaucuauaggcugcagaauggauguuauauuagcagccaugaaaacaacaucagucauguacauccucaucagagcuccucgaugaccagaugcacuguuggaaagcaguaauauacugaaagcagucuugugagcagucggccucaacagugggcuuuuaaaacauucaguaaaccaugcuguaaauagaugugcugucaucaggcuguguuguuucacuuacagagcacaggcagaauagauugagccuaaucguuaaggggucuaggauuuucagaaugguaaaugaauauuggcuuccaguuaagucaccagcugcauuagccgcuuacaagagaggcaucccguccuuugaaguuuugaagccaggcauugacuucucucuagcugugaaauuccuaaaugugucuguuuccaguguaaggcuguguugucuguauugaaaaccugcuguuuaguguagccaccuucgucaaugaucuuaacuagcucuucuggauaacuuguugcagcuucgacaucagcacuuguggguucaccuugcacuuuuauguuauggagauggcuucuuuccuucaaccucaugaaucaacuucugcuagcuuccaacuuuucuucugcagcuuccucaucccucccagccuucauagaauugaagagaguuauggccuugcgcuggauuaggcuuugauuuaaaggaauauugugguugguuucaucuucugugcacaccaggcaaacuuucugcaugucagcaauaaggcuguuuuacuuucucaucauuugugugugcacuggaguagcacuuuuaauuuccuucaagaauauguccuuugcuaucacagcuuggcuagcuguuugguauaaaaggucuagcuuucaggcucucucagcucucaacaugccuuccucacuaaacuuaaucauuucuagcauuucauuuaaagugaaaaacaugaggcggguggaucacuugaggucaggaguucgagaccaggcuggccaacauggugaaacccccucucuacuaaaaauacaaaaauuagcugggcuuuguuguaugcaccuguauuuccagcuacucuggaagcugaaaggagaauugcuugaaucugggagguggagguugcagugagccaagauugugccacugcacuccagccugggugacagagcaaaauuccgucucauaaaaaaaaauaaagugagaaacgugcagcucuuccuuucacuuggucauuuagaggccaucguaggguuauuaauuggucuaauuucaauauccuuguuuuucauggaauauggagaccugaggaggaggagagagaugggggaaugacuaguggguaaaucagucauaacacacacaacauuaaguucacugucuuauaugggugcaguuugugguaccccaaaacaauuacaguaguaacaucaaagauuacugaucacagaucaccauaacagauauaauaauaaugaaaaauuuugaaauauugcaagaauuaccaaaaugugacacaaaugugaagugagcacaagcugguggaaaguggcaccaguagacuugcugacagcaggguugccacaaauuuccaauuuguaaaaaacacaauauuugcaaaguuuaauaaagcaaagugcaagaagaugagguaugucucuguauccaaaauauauuuguccauauaaguuuguauuauggagcauaucuugggccugaguuucugcagacauauugggaaaugcaugugauaaauauaugguagagaaugcauuuccucaucaucaccuucuucucaucccauacuucuaaguauaucagacuucguaccauauaugugaacaagcaugacuuacgggagguacucaugagccauuuuauuucuucuguggaguuaguucuccagcuuccuggagaguaaguuuuaauaacuguucugaucacuuucaggaaauaccagcaaucuuuucaagaacuaauaaacuuagaguaaaagcuuucccuccuuucccaccucaggccuacuacaggccugcaguugaagaguuaggugugguuuaccuccuuuuucuuucuuucucucuuccccaacuuucuucuuucacuucucuucauuugcuggcugugguuucuggcccuuucaggaagaaaaggucuuugauagcaauguuaguagcagcagcaacuaauguuucuauagcauugauuauguuacuaguuacuauucuaaacacuuaacauauauuaggucauuuaauccucagaacucuaugagguguguuguguuauauuucuuauaccacugaauauaguaagauacagaggguuuguuuaaugacuugccuaaggugacacagguaaaaauagcagaaccagcaugcagagugagcauucuggcuccagagucugugcuuucaaccacuccacugugaugccuuuauauacuguugggagauaguaggcauacgucuuggccuugauuguuguuuaaaucagacuuaugugcccuucagaguuuuuucaguuguaacauauuuuccauagauuugagguaaaggaucagcaugccuugaagccccuuucccugcaggggaguaagcagggaaguagaaugggguuugcaacucacaacaaacugauuacucucagcaaaaauccuuuucauaucuacucuuugaacacggaagaugacugaagguggauguaacucaagguugaaaauaguuuuccacuaccccuuguauaaggugcccuugugccucacuugagaacguaguacauuaucuguuguuuggggccuauucaagauggaaaugguuucauuuuaauacuccgaugcacaugucuuccaaauaugcuguuuaauuucuugccuucacaccuuuguucaugcagauggucccuggauuauaacuaauucacuugcucugaaagcauguuucuucccucagccacaugaucccaaaguaagcacucucgaaggccaugcuuuaaaagcagaagcuagucuccugggaugcaauaaaugaacaaaacgcuuuauauauagcccucccauuuucuuucuuucaucucauuuuugugagaccuaaaucagcaaauauguuacaugaugguuugcguagaccagucccuggcugucuagugucucauuguggucaguugacuucaggaaggguauguggagcacucaguuuacauucgaacuucuguuacuaauuauggucaagauaauuauuucaguagcuuuaccuggcugcuuuggaacagagauuuaugccuuauccuuuugugaagucugacauggaacagucucaaauugaucauuuugucuucucaaguuagaauagucugugacuuauauuuuuuuagacggggucuuacucugucaccaaggguggagugcaguggugcagucucggcucacugcaaccuccaccucccaggcucaagugauccuuccacaucagcgucccgaauagcugggacuacaggcccaugccaccacacccgccuaauuuuuauguguuuuuuuguagagacaggguuuugccauguuggccaggcuggucuuggacuccugagcucaagcaauccgccugccuuggccucccaaagugcugggauuacagacgugagccaccacaccuggcaaccuuuuuaaauucaucuugaaaucuuuuuuuuuuucuuuccacuuccuuuuuuucuuuuucccaucuuucuuuuccucuauacauuuaccugcauaaaacauuaacagggaugauuauguaauggauuguucaguguuuacacuggcauugccugcugcaugcucacauuuagaaacaggaaugauaauacgccuacugauagagauaugaugacaaucaacuaacuauuaaaugugaagcauuucaaauacugucuggcacauagaagacacucuauaauugucauuauuuacaaacuguugcagcccugcagcucauuaaaacgcugguucacaggccgggcaugguggcucacaccuguaaucccagcacuuugggaggccuaggcaggccuaucaccugaggucaggaguucaagaccagccuggccaacauggugaaaccccaucucuacaaaaauacaaaacuuagccaggcaugagggcgggugccuguaaucccagcuacucgggaggcugaggcaggagaauugcuugaacccgggaggcagagguugcagugagccaagaccaccccgcugcacuccagccugggcaacagagcaagacucugucucaaaaacaaaacaaaacaaaaaaaaacauugguucacagacuucacugauuggacaguuuggaaggcagauaaggagaauauauuucuauacagucccuaccuugaaguuucucugucacuaccaucuuucagcuuuuuaauuuaguacaguggccacaugaaaaugaucuaaaucacauuuuaaaccacuaaaauaucaauuaaugcuuuauuuuauguauuuuuuaggacauuucugauuuauuugcauccuugaagagcaucuguagaagaggaaguaaaagaugggugugaaaacauuuacucauagcuccucuucccacagccaggaaaugcuuggaaagcuaaauaugcugcgaaaugauggacauuuuugugauaucacuauucguguccaggacaaaaucuuccgggcacauaaggugguacuagcagcuugcagugauuucuuucgcaccaaacuuguaggccaagccgaggaugagaacaagaauguguuggaucugcaucauguuacagugacuggcuuuauaccucuuuuagaauaugcuuacacagccacucuaucaauuaacacagaaaauauuauugauguucuagcagcagccagcuauaugcaaauguucaguguugccagcaccugcucagaguucaugaaaucaagcauuuuauggaauacacccaacagccaaccugaaaagggucuagaugcuggacaagaaaauaauucuaacugcaauuuuacuucucgagaugggagcauuucucccguguccucagagugcagugugguagaaagaaccauuccugucugccgagaaucccggagaaagcgcaaaagcuacauuguuaugucuccugaaaguccuguaaaguguggcacacaaacaagcucaccccagguauugaauucuucagcuuccuacucagaaaauagaaaccaaccaguugacucuuccuuagcuuuuccuuggacuuuuccuuuuggaauugaucgaaggauucagccugagaaaguuaagcaagcagaaaauacccggacuuuagaauuaccuggcccaucugagaccgguagaagaauggcugauuaugugacuugugagagcacaaaaacuaccuugccuuuagguaccgaagaagauguccgggucaaaguagaaagauuaagugaugaggagguccaugaggaagugucccagccugucagugcaucucagaguucgcugagugaucagcagacaguuccaggaagugaacaaguccaagaggaccuucugauuaguccacagucuuccucuauagguauaaugccuucuguguuuuucuuggugcuauaaagucaauucaaacauuuuuaaguuccuguuagauaaaaaguuuugugcucggucauauaggaaauauaaagaagaguaaaacaugguaacuggauuugcuugagaugcuauuagcacuaucguuuauuuuuuacaaguugcacauuggggaagauaaaaauaauugaaugguaucugcugggacaaaggcagauacacauacacaaaaaagcaguuaaauccaguuuguguuuuauucuucauuaaaauauguauugaaaacuuaccaugugccaagcaaacauuuaugauacauaaagaaaaacacauagucccugcaaugacaauuagguuaaucaucuaauuggggaagcagauaugaaaguaaaugauuacagugaacuaucaaaagugcucaucuggaggugugaacaaaguaguaugguugcaacaaaggaaagagcaaguuacacuauauguuugagugggucuuaugcaauaaguaagaguuuacccaagugugggaaugucauuucugugaaaacauaaaaacacagaacauauaugcaaacacagagguauggaagagcauuguguguuugguaaacagugaauucagugcaaaaugauguaaguaaguacagaugccugaaacuguagggaauagugggagaucagacaaaaggagugguugagcgcaggcuguaaagagccucgaauccuaguuucaguagggguugcauuuaagugcaggugauggaaucccuucugcaguaacuuaacuguagcagaguuuuauuuauuuuuucuuuauuauuuauuuauuuaucuuuuuagauugaaaauaaaaugauuuauaguuguuuucucuggcaguauuuuuuucuuuuuuuuaauucaaauucugggguacaugugcagaacguucaguuuuguuacauagguauacacaugccauggugguuugcugcacccaucaacccuucaucugcguuacguauuuauccuaaugcuaucucuccccuagccccccaucccccaacaggccccacugugugaugucccccucccuguguacauggguucucauuguuuaacucccacuuauuaguaagaacaugugguguuugguuuucuguucuugugauaguuugcggagaaugaugguuuccagcuucauccaugucccugcaaaggacaugaacucauucuuuuuuauggcugcauaguauuucaugguguacaugugccacauuuucuuuauccaaucuauuauugacagggauuuggguugguuccaagucuuugcuauugugaauagugccgcaguaaacauaugugcgcaugugucuuuauaguagaaagauuuauaauccuuuggguguauacccaguaaugggauggcugggucgaaugguauuucuguuucuagauucaugaggaaucgccacacugucuuccacaaugguugaacuaguuuacagucccaccaacaguguaaaagcauuuccuauuucuccacauccucaacagcaucuguuguuuccagacuuuuuaaugaucaccauucuaacuggugugagaugguaucucauuaaauuuccauaugaaauuuaaaggaguuuuuuccaauuccgugaagaaagucaaugguaacuugauggggauagcacugaaucuauaaauuacuuugggcaauauggccauuuucacgauauugauucuuccuauccaugagcauggaaugucuucccauuuauuuguguccucucuuauuuucuugagcagugguuuguaguucuugaagaggucuuucacaucccuuguaaguuauauuccuagguauuuuauucucuuuguaguaauugugaaugggaguucacucgugauuuggcucucuguuacuggugcacaggaaugcuugugauuuuuuaucacaaaguguucaggaauaaaaguccagggcugguacagugaaucugcaauauaaucaguggccuaggcaacuuguauauuuauaaacugccaucuuuacuuuguugguuucauccauaagaugcucauuucaucuucagcuuuguauucuagaaaggggcaaugcuuuguaucaagaaagcaccuauguucucagaaaucccuaaaaaacuucugcuagucugugucacauagucuuuccuagcugcaagggaaucugggaagauaauguauauuaguuggguaccuaaaugccuugaacaaaauuagagcaaaauggauauugaguaugcaacuagcagugucugccacaaguaggccaaguaagcuuggauuuuaucuuagugguagguaguaaggagucuacauuaaagggauaaaaacaaaaacaugcagauauuuuaggaaaacuguuauugacaugcagugaguuugguuuuacagagacagucucagagaccaauugcagugcacuuaucuuggugugaaugaagacuuaaaaccaugugaaagaaaauagauauuacaagacuuuguaaagaaagacuuaguaccugaugauacugaauauguauauugaaagaacaggagagguuaaaguacucugaugacuaggaaauaaugguaacacuuuauuauauuccauugauucuaagucacaauuuuucauauuuuguuauuucugaauccagauaugucuuacaguuggcagucuucuacaguugcuuuuuucuuccuuagugcuauagagaauaauggcaaucauaugaaucaauagcauuuuagcaucuauuaaauguaguuagugccguaugaaaaucaguggaagguggugggaauccaguuuugagaguaaauuaucaaggucacuucuguguaaauugugcuuggaugaugaucaagcagugucauuucaaaagcaguagaaaagauaagugagauucccaacuugggacuuuucuacuaguaguggcaaauucaaucucaauaggaaaaacagaagagccaaaaccaaggggauaccuuggggaauaccuauauucagguuugggaagggauagaagaaaagccacuagugaauaauaaagauuuguccaaaauauuggagaaccgggaagaccauauuaacuuuguuaguuucuugugcuuuuacccucugugugaguuucccugggcugcugcaacaaaguaccgcaaacugaaugguuuaaaaaaaauuuauucucucauagucagaggccagaaaucugaacgacagguguuaguucccuuugaaggaucuuucucucuuugaagauuguagggaagaauccuuccuugucucuuccagccuguggcagcugcccacaauccuugguguucuuuggcuuguagcuccaguauaugauauugugcuuuaguauaugcguucgucuucacaugaccuucccugucucucuguuuugccacuggcuucaaaucucucucucccuaaaaggacaccagucauuggauucaggucccacccuaauccagcaugaccucaucuuaacuugauuacaucugcuaagacccuauuuccaaauaaggucacauacauugguagcaaggauuaagauguacuuuuucuuuuuuuuuuuuuuuuuuuuuaagaucugggaugcaugugcugaacaugcaaguuguguuuuuggguauuuuauuuucuuuguagcaauuaugaauggaaguucacucaugauuuggcucucugcuugucuauuacugguguauaggaacgcuugugauuuuugcacauugauuuuguaucccgagacuuugcugaaguuguuuaucagcuugaguuuuggggcagagacagugggguuuucuaaauauacaauuaugucaucugcaaacagagacaauuugaccuucucucuucuuauuugaauacccuugacuuccucucuuccuauuugaauacucuuucuuucucuugccugauugcucuggccagaacuuccaguacuguguugaauagggguggugagagagagcauccuugucuugugccgguuuucaaagggaaugcuuucugcuuuuacucauucgguaugauacugucuauggauuugucauaaauagcucuuaauauuuugagauauguuccaucaauaccuaguuuauucagaguuuuuagcaugaagggguguugaauuuuuauuuuuaauuuuuauuuauuuauuuauuuuugagacggagucucacucugucaccaggcuggagugcaguggugugaucucagcucauucaagcaauucuucugccucagccuccugaguagcugggacuacagacgcaugccaccacacccagcuaauuuuuguauuuuuaguagagaugggauuucaccauguuggccaggauggucucgaucucuugaccucgugauccgccugccucggcgucccaaaaugcugggauuacaggcgugagccaccacgcccagccaggguguugaauuuuauugaaggccuuuucugcgucuauugagauaaucgugguuuuugucauugguucuguuuuacgugauggauuacguuuauugaucugcguguguugaaccagccuugcguuccagggaugaagccaacucgauccugguggauaagcuuuuugauauucugcuggauucaguuugucaguauuuuauugaggacuuucacaucaauguucaucagguauauuggccugguauuuucuuuuuuuguguugugccucugccagguuuuggaaucaggauguugcugaccucauaaaaugaguuagggaggagucccucuuuuucuguuguuaggaaugguaccagcuucucuucguaccuuugguagaauucagcugugaaucugucuggugaaucugucuggugcugggcuuuuuuugguugguaggcuauuucaggagaguuuauagcaugaagggguguuuuuuuuuuuuuuuuuuuuuuugagguuuugccucaacuuuagaauuuguuauuggucuauucagggauucagcuucuuccuaguuuagucuugggaggguguauauguccaggaauuuucgucuagauuuucuaguuuauuugcgaagagguguuuauaguauucccugaugguaguuuguauuucugugggaucaauaaugacaucccuuuuaucauuuuuuauugugucuauuugauuauucucucucuucuuuauuaaucugguuagcagucugucuauuuuguuaaucuuuucaaaacaccaccuccuggauucauuaguuuuuugaagggcuuuucgugugucucuuucgguucugcucuguucuuaguuauuucuugucuucugcuagcuuuugaauuuguuugcucuugcuucucuaguucuuuuaauugugauguuaagguauagauuuuacaucuuucccacuuucugaugugagcauuuagugcuauaaauuucccucucaacugugcuuuagcaugucccggagauucugguaccuugucucuuuguucucauugguuucagagaacuucguuauuucugccuuaauuucguuauuuacccaguggucaugcaggagcagguuguuuaguuuccauguaguugugcaguuuugaaugaguuucuuuuauuauuauauuauuauuuacuauacuuuaaguucuagggaacaugugcacaacgugcagauuuguuacauauguauacaugugccauguuggugugcugcaccuauuaacucgucauuuacauuagguauaucuccuaaugcuaucccuucccccuccccccgccccacaacaggccccagugugugauguuccccuuccuguguccaaguguucucauuguucaauucccaucuaugagugagaacaugcaguguuugguuuuuuguccuugugauaguuugcugagaaugaugguuuccagcuucauccaugucccugcaaaggacaugaacccauccuuuuuuauggcugcaugguauuccaugguguauaugugccacauuuucuuaauccugucuaucauugaugacauuuggguugguuccaagucuuugcuauugugaauagugccacaauaaacauacgugugcacgugucuuuauagcagcaugauuuauaauccuuuggguauauacccaguaaugggauggcugggucaaaugguauuucuaguucuagaucccugaggaaucgccacacugacuuccacaaugguugaaccaguuuacagucccaccaacaguguaaaaguguuccuauuucuccacauccucuccagcaccuguuguuuccugacuuuuuaaugaucaccauucuaacuggugugagaugguaucucauugugguuuugauuugcauuucucugauggccagugaugauaagcauuuuuucaugugucuuuuggcuacauaaaugucuucuuuagagaagugucuguucauauccuucucccacuuucugaugggguuguuguuguuuguuuuuuucuuguaaauuuguuugaguucuuuguagauucuggauauuagcccuuugucaguugaguagauuguaaaaauuuucucccauucuguagguugccuguucacucugaugguaguuucuuuugcuaugcaaaagcucuuuaguuuaauuagaucccauuugucaauuuuggcuuuuguugccauugcuuuugguguuuuagagaugaaguccuugcccaugccuauguccugaaugguauugccuagguuuucuucuaggguuuuuaugguuuuaggucuaacauuuaagucuuuaauccaucuugaauuaauuuuuguauaauguguaaggaagggauccaguuucaccuuucuacauauggcuagccaguuuucccagcaccauuuauuaaauagggaauccuuuccccauuucuuguuuuugucagguuugucaaagaucagaugguuguagaugugugguauuauuucugagggcucuguucugguccauuggucuauaucuguuuugguaccaguaccaugcuguuuugguuacuguagccuuguaguauagcuugaagucagguaguguggugccuccagcuuuauucuuuuggcuuaggauuaacuuggcaaugcaggcucuuuuuugguuccaugugaacuuuaaaguaguuuuuuccaauucugugaagaaagucauugguagcuugauggggauggcauugaaucuauaaauuaccuugggcaguauggccauuuucacgauauucauucuuccuauccaugagcauggaauguucuuccauuuguuuguaucaucuuuuauuucauugagcagugguuuauaguucuccuugaagaguuccuucaugucccuuguaaguuggauuccuagguauuuucuuuucuuugaagcaauugugaacaggaguucacucaugauuuggcucucuguuucucuguuauugguauauaagaaugcuugugauuuuugcacauugauuuuuguauccagagacuuugcugaaguugcuuaucagcuuaaggagauuuugggcugagacgaugggguuuucuaaauguacaaucaugucaucugcaaacagggacaauuugacuuccucuuuucguaauugaauacccuuuauuucuuucuccugccugauugcccuggccagaacuuccaacacuguguugaauaggaguggugagugagaaagggcaucccugucuugugucaauuuucaaagggaaugcuuccaguuuuugcccauucaguaugauauuggcuguggauuugucauaaauaggucuuauuauuuugagauacaucccauuaauaccuaauuuauugagaguuuuuagcaugaagggcuguugaauuuugucaaaggccuuuucugcaucuguugauauaaucaugugguuuuugucuuugguucuguuuauaugcuggauuacguuuauugauuugcauauguugaaccagccuugcaucccagggaugaagcccacuugaucaugguggauaagcuuuuugaugugcugcuggauuugguuugccaguauuuuauugaggauuuuugcauugauguucaucagugauauuggucuaaaauucuuuuuguugugucucugccaggcuuugguaucaggauggugcuggccucauaaaaugaguuagggaggauucccucuuuuucuacugauuggaauaguuucagaaggaaugguaccagcuccucuuuguaccucugauagagugaguuucuuaauccugaguucuaauuugauggcacuguggucugagaggcuguuuguuacgauuuccguucuuuugcauuugcugagguguguuuuacuuccaauuauguggucuauuuuagaauaagugccaugcggugcugagaagaauguauauucuguugauuugugguggagaguucuauagcugucuauuaggucugcuugguccagagcugaguucaaguccugaauaucuuuguuaauuuucugucucguugaucugucuaauauugacagugggguguuaaagucucccacuauuauugugugggggucuaagucucuuuguaggucucuaagaacuuguuuuaugaaucugggugcuucuguauugcguauauauguauuuaggauaguuagcucuucuuguugcauugauccgucugccauuauauaaugcccuucuuugucuuuuuugaucuuuguugguuuaaagacuguuuuaucagagacuaugauugcagccccugcuucuuuuuuuucuuuccauuugcuugguaaauauuccuccauuccuuuauuuugagucuaugugugucuuugacccacaugagauaggucuccugaacacagcacaccaaugggucucaacucuuuauccaguuugccagucugugucuuuuaauuggggcauuuagcccauuuacauuuaagguuaauauuguuauaugcaaauuugauccugucgucaugaugcuagcugguuauuuugcacauucauugaugcaguuucuuuauaaugucauuggucuuuguauuuugguguguuuuugcaguggcugguaccaguuuuuccuuuccauauuuagugcuuccuucaggagcucuuguaaggcaacccuggugguuacaaaaucccucagcauuugcuugucuguaaaggauuuuauuucucacuuaugaaacguaguuugucuggauaugaaauucuggauugaaaauucuuuucuuuaagaauuugaauauuggcccccacucucuguagagagauccgcuguuagucugauggcuucccucuguagguaaccugaccuuucucucuggcugcccuuaacauuuuuccuucauuucaaccuuggagaaucugaugauuaugucucuugggguugcuauucucgaggaguaucuuaaugauguucucuguauuuccugaauuugaauguuggccuguguugcuagguuggggaaguuguccuggauaauauucugaaguguguuuuccagcuugguucauuucucccugucacuuucagggaccucagucaaucguagguuuggucuuuucacauagucccauauuucuuggaggcuuuguuuguuccuuuucaaucuuuuuuucucuaauccugucuucaugccucauuucaguaaguugaucuucauucucuguuaucuuucuuccgcuugauccauucagcuauugauacuuguguaugcuuugugaaguucucgugcuguguuuuuuagcucugucaggucauuuauguucuuccguaaacggguuauucuaguuagcaguugcuguaaccuuuugucaagguucuuagcuuccuugcauugggugagauagaacaugcuccguuaguggagaggaguuuguuauuaccgaccuucugaagccuacuucugucgauuugucaaauucauucucuguccaguguugugcccucgcuggagaggaguugcagucauuuggagaagaggcauucugguuuuuggaauuuucagcauuuuugugcugguuuuuccucaucuucguggauuuaucuaucuuugaucuuugaggcuggugaccuuuggauggguuuggauggggcgucuguguggagguucuuuuuguugauguugauguugauguuauugcuuuuuguuuguuaguuuuucuucuaacaggccccucuuuugaaggucugcugcaguuuguuggagguccacuccagacccuauuagccuggguaucaccagcggaggcugcagaacagcaaagauugcugccugcugcuuccucuggaugcuucaucccagaggggcaccggccugaugccagccggagcucuccuguaugaggugucugucaccccuguugggaagucucucccagucaggaggcaugggggucagggacccacuugaggaggcagucugucccuuagcagaagucaagcacugugcugguagaacccuccuugugaguauccgcugcucucuucagaaccugcaggcagggacguuuaaguccacugaagcugcgcccacagccgccccuucucccaggugcucugucccagugagaugggauuuuuaucuauaagcccugacuggggcugcugucuuucuuucagagaugcccugcccaaugaagaggaaucuaaagaggcagucuggccauagccacugugccacacuguguugaguucugcccaguuggaacuuccaggccuuuuuagcgcugucaggggaaaaccaacuacucaagccucaguaauggcggaugucccucccccgaccaagcuugaucgucccaggucaacuucagacugcugugcuggcagugagaauuucaagccagugguucuuagcuugcugggcucugugggagugggaccugcugagugagaccacuuggcucccuggcuucagcccccuuugcagggggcugcaaagguucugugaaugguucugucucacugugguuccaggcaccacuggugugugaaaaaagaagagcuagcuuggugucugcccaaacagccgcccaguuuugugcuugaaacccggggcccuagugauguagcacacgagggaaucuccuggucugcggauugcaaaaacugugggaaaagcguaguaucugggccagauagcacagucccucacugcuuuccuuggcuccuugcacuuccugggugagguaacgccccacccugcuucugcucacccucugugggcuguacccacugccuaacuagucccagugagaugaacaggguaccucauuagaaaugcagacaccugccuucuguguuggucucacugggagcugcagacuggagcuguuccuauucggccaucuugccagcagccaagacguagugucuuucugggggaaauaaugucacccacagcagccacugaaguucauauuccugaauuggggucaaaauaguugugaagaauuuacaugaacacacauccaacaaaauauuuaauuucaagaaaucauagcuauuuguugauacaaccaaguuuuuacuaaacuaccagagucaguaauugaaaacaccuugguaccuucugaguaacgaacugccuacugaauaauuauaauuuuaaucauuuaagaaaguaggaacccaaauauuaaucugucuaaauaucuaagauauugaguuaggcaugugaaauagucauccuuuaccacucccaaguauauauaaucaguucagguuuugccuuuaugauaguuuuguuuuuguuugagacugagucucacucugucacccaggcuggaaugcaguagcaugaucucagcuuacuacaaccucugccuccuggguucaagcaauucuccugccucagccucccaaguagcugggacugcaggcacacaccaccacacccagcuaauauuuguauuuuuaguagagauggaguuucaccaugugggccagguuggucucaaacuccugacuucaagugauccacccaccucagccucccaaagugcugggauuacaggccugagcuacugcacccagcccuuuaugauguuauuaacaaguuaauaaguagaacaaaucuuucaguuauauaaguagaaucuguuaccuauauauuauuauaaauggauucuauaaagcagacaugggaacugcucugaaucagauaaucccaaugugguuuguuucuuguguuuuuuuguuuuguuuuugugguuuuuugagccaguaucuugcccuguugcucaggcuggagugcuguggugugaugucagcucacugcaaccucugccuccugaguucaaguaauuguccugccucagccucccaaguagcugggauuacaggugccugccaccacaccuggcuaauuuuuguauuuuuaguagagacaggauuucaccauguuggccaggcuggucucgaacuccugaccucaagugaucgccugccucagccucccaaagugcugagauuacaggcgugagccaccaugcccaacuccaauaugauguuuuuuccuugccuucauggcaaauguacuaaucacucucaacaaaccaaucuuaacuccaaacuugcauacuaaaacaaagccauacagaaaauuccuugcgguauugaaggcagucaguaaauuugagagggagaaaaggaagaugugcaugguacuuuuuccccuguaaguuccauaagaguauuuaauuuuacuuacuaauuuguuaaagaacaucucugagagguaucuugucuuucuagggauagaaaauauaauguuuaguguauuauuuucaaauuuccaaaauaauaauuugauuauccaugaaauuaguucagauaggauuuuaccugcuguuuuaaguuccuuuuguuuccacuugcccauggaaagguuguaaaauucaguaucaacuugcagcaaauaaaagcaauaaauacaacaaauuuaaaggagaaaaaagacugcugguuuuagguugggccuuguuacuuaaaaagauaacucucuaguccuucuaaccccauccccacuccuaggcaaaccacuguaaauauuaauaguugccuauucuggauauuuuauaucagugggaucaugaaauacguggguuuuuuuuucucacuggcuuauguuuuuaccauaauguuuucacaguucaucuguguuauaccuuguaaaguuuugaaaugguuuugccagucagagaucugaacuuggccuccagggccaguucagaugaacuaauccaaccuauguucauccucucauuaucguuuauuucucuuguaggccguuaacacagcaggcaggcaggcagaugaucuucagagcagguguuagccuagaaaacaguuucaccaaggagcaacacaaucugaauaaccaaaauauuuucaaaagacuguuucuaggaaaacaaaacaaaccugacagugaagggcuucauugaacuauuugagcuuaauucagcaugaacuuacaucccagccaagggcagguggcaccucaaaagggauuuuauaucugcccucucauccaggaucccaggacgaagcaacaaggaauuuagcugaaucucaguggaucuuuauuucugccugggcccuauagccaaagaccaccuaugauugaacagguugaguuuguugcucauuugcaacaagggagauuauacaccaugggguuuuuagggcugguugucaguaagaagguguuaaaaaggccuuagcgcaggauuuggccuuguguugggugauuucagggaugcuuacucuccauuagggaggguucaaggaagugagguuugcucaggacuggugaugucagaaaggagagagaauucuguuauugaauaucuuaauaaauacuaucuaggaaugcagacuaaagugaaucuauagcaguagugacucauuagccagcgagagauggggaugacugguauguuugugauugcacaaauaaaaguguuuuuuagucucgcuuuaaauaagggucacagagugacuugauuuuauguuguuuugugagacuguuuauguuccccaggagaauacuguggcuguaaggaccaggccccaccccuaaaugagugccaagccuguuucugaauguuggaagauguuucucuuuuucaaguauaaauugagaucuuauauugaaaaccuuuuagaacaaugccuggcacaugguaaauacucaguaggagaugaccacuguaauugcuuuucaauuccagagggaucuuuguaaguaucuugaauaccugaacaguggcagcagcaacuugaguuugaugcaacagaagcuaucauacagcacuucuaauuggggagagagucgacucugucuugauaagcuagcccugacccauauaaagcugauugucucugugaaucaguuuuacuguuucacaaggugaaaagugucugaccagaauucuuagccucacuaccacugagaacagaaucccuauaggguagaaaggaaacuucauuuuaauaauuuaagaaacaucacugucaccucaggaaaguaauauugugcauauauauguguguguauauauauauguguguguguauauauauguguauauauucugcuguuaaaucaguuuaacugaaauuccaauucauaugauuacuuguguuauuugcaaaaaccaucauuucaagaaaaacaguugcacaaaauuuauuuuuugcugauaguugcauaagugauauaacacuauguguuuaccuccacaguauacauagaauuccaaaagucuguuuuaacucauuuuagcuuggaguggcuuucauuuuuagcuguuggugcauucaguagccaugggugagggaaaauaguuuugcuuugcuuugcaugcucacuauccauugaaucaggggaucuagacauuuuagaauguagagauggauuuguuuuaagaagggccaucugcuagauguaucuuguacugcauuuuaguucuuuucaaccagcuuuuuaaacaaaccuuugacgguacuagaaucggucccagacagugugguuuuuauucucaccucaccaagaguccauucccuccucgaaagaguauggccugccugauagugagaagcagaugccagucuucuuggccuacccuucucacaaccugauagugagaagccgaugccagucuucuuggccuacccuucucacaaccugauagugagaagccgaugccagucuucuuggccuacccuuaucacaagcugauagugagaagcagaugccagucuucuuggccuacccuuaucacaacuccaggcguuuuggggcaagccuuugucuguacgcuuuaauacugucugugcucugaauaaguucagagcaccgucaaauaggucuugauguccaugggaccaacgcuaaauacugguguuuuuccaguuucuuagcccaggacugauugaaaaguuaauguuuauuuuucuuuucuuuaaggaaaaaacugagaaugggaagauacugacaaguaaacaguucuuucuuaaaaugcagcauuaucugguucucuguccuacaucuggauuaaaaacaagucagaagaaccugggaguaacuugcauaaguagacauaggggaaaagcaggaaugccguuugauagagaaagaaaaagaaaagacacacacagaaaugcuacacauacaccagaagggauggaauggggagaccagaaagaaugggggugcaauugggaaugaauguaaacacacauaguccugcguauuuucaaaagccucagaguauacccaaguauuagaacacuguauaguaaugaguguucuuuaugauuguggugagucaucaagaaacaaaaaauaaguucuauaugguguccuucauuuaagaagucaaggcaaaauguaacccugucacaaguuuuccaguacaagugauuaaauaaaguuuggaugccuuaaaauuuaguuuuuuaaaacgcuuuuuacuuaaguggaugauguaccuguuuccuaaugacagcaauucaaguguuccaaagagggaaacuuaaguauuagauuccaaaucuucaucagaaggaaauuucaucccguauguucauuagcagaugauacuuauuaaauguucacauguauguagugguguacaaacuguuacaguuaguacauuuucuuucuuuuuuuuuuuuuuuuuuuccagacagagucucucucugucgcccaggcuggagugcaguggcgcaaucuuggcucacugcaagcucugccucccauguucacgccauucuccugccucagccucccgaguagcugggacuacaggcacccgccaccacgcccggcuaauuuuuuguacuuuuaguagagaugggguuucaccguguuagccaggauggucuggaucuccugaccuugugauccacccacgucggccucccaaagugcugggauuacaggcaugagccacugcacccggccacauuuucauuuucauuaaaauauuauaaccaaaagcuuguuugcuauuaaaagaccgaaauucucagaggcucagauuuguucauuuggugcaacacagcugguuuguguucaguaaagaguucauuaccuaaugagaauaagcuagguuguuugagucuacugucccaccacaaacaacaaauuuuaaguuuuuaaaaauucacuuuuaaacuguuugaaaagcugaaaagauggccaaggaacugcaagguuaaauuaggggagaaagccuggcccagggagguaaguagaucaucagagcacuaaaaucaguuuugccuuuaagacauuugccaaaacacaaaugggcuuugguugaucaacucaaagagcaggagaaaugaaacugaaagcucagaguguguaaaaguuguaaagucuuagaaaaguugccccacacguuaagcagggagcagguuuacauuagaacuaaaccugcucccugcuuaauguguguauuguaacacguuccugauugguaauaauuuaaaaauccugcaauaccaaguguugguaaggauauggagcaacacaacucugauauacugcuagcagugauguaaauuuaguacaaucauuuuagaaaagaauuuaguauuuucuaauaagguugaagauaaauguauucagugaccuagcggcuccauuccuacacauauaccacuuccauuccuaaguauauacuguggagaaaagcaugcucaugugcauuguccuuugggauuguacugucagaacuaaaccugcucccuguccuccaaacuccaggggacuguagaaaaaccugccuuggcaaugagcggacuagaaaaggaaaaagagaggaaaacacaucccugagaaguuacugcuagaccacuuacaaauuguuacaacacagacuuugaguggguaggccaaggaaucucaaacagugaaucucauauagcuaaugcugcccaggaaccuagcagaagcaaacauaaaacuucucuggaaaagggcauuauguauccugaccucagcaacucaauuuccuacaaauaauuuucaagggcaauaaccagucgaaaaauuaccagagcacucaagaaaacaaggcagagagagaaccaacaggaaaaaaaaaauguguuuuuuaaaugcagcagaaauauauuggcauugccacuuggcguaguuuucaagcacagauauaaaguaaauaugcuuacuguauuuaacaaaauaaacaugaacaauaauugcagagaacaguaaacuauaaaaagugacauagcagauuuaaggaguaccaaaugggacuuuuagaaaagaaaaaugauaaccaaaauuaaaaucuccgugaacauuuuggcagcacauugcacucaacagaagagaauuaggaaauuaaaagauaaacuagaagaaauuacuucagugcuacacagagagagacacagugguggaaacugcaguagcaaagaggagaagggugcggaagacaacaaauguagguuugauggaagcucuaaagagagaggagagguuggcugagaauuuuccagauuugaugaaagacaccagucccaaacaggaauaguaaaaagaaacacagaccuagauacauuguagagaaaauucagggaaaaaaauguaaaaagacauuaccuucaaaagaauaugacuuuuuaccaccaccagaaaccagugggaugauauccucagugugcugaaagaaaauagcucccagucuagauuucuacacaggguaaaaaugucuuucaagaaugaauuauauuugaaaaauauauaaaugaaauauuuauauuugaaaauaaauauguuuucaaacaaaaagaauugaucaucagcaaaucauugccaaaaaaguuauaaagaauggacuuuuggcagaagugaagugagcauagaugagugguuucauuugcaagaaugaacagcaaaggcagagguaaaugugagaacauguauauaugauaauguuuguggggcuuaaucagaacaaagaaguaaaauaucagacaauuuguaaauggcaggauggaaguggugggaaauggaguuaaagcuucuaggaucuuuguauuauccagaaggaaguaaagguuuuaacuuuagacuuugguaaacaaaguauaucucuaauuucuaaggcaaccaauacaaagaaauaggaaaauauuguguaacuucuaaacaaauagaaggggagaaauggaauauuuauuuccacuuguauucagcaagcugauucucaaauguauacaggaaugcagaagucaaaaaauagccagaauguucagaaagcaaaugaacaagggcagagaacuuucucuacuugauagcaagauuuauuauaaagcuacaguaacuaaagauuggcauuaauacaaggacagauaagcagauggaacuaauagaaaacccgaaaacagaccuauguauuuauacaugacauacaacacaggaggcacugcagagcagagaaggcagaccuuucaugacauucggucacaaagucaacuccaauggguuaaagaaaaaacauaaggcacaaaacaugauacuuuucauaagauaauuucagacagggaaagauuuuuuaaaaacaagaccaaaaagccauaacaaugagaaaaggauuaauuaaauuaaaauguuaaacuuuguucaucagaagaagccauuagaaagggugaaaaaaaaagccaugggauggggaaagauauuuguaguauguaucacugaccaagggcuuauauacaaauugugaaaagaacucuuaugcuaaaaaggcagacaacucuggcauuucacaaaagagggaggaagggagauuccguaaauaugugacacuagauucaccccaguaguuauaagggaaaugcaauucaaaccaccaugaaauauuguaagacauacaccagguugguaauaauuuuaaaaaccagugguaauaacuuaaaaauccagcaauaccaaauguugguaaggagguaaggauauggagcagcacaacucugauauacuagcagugaugugaauuuaguacagucacucuggaaagaguuuaguauuuucuaauaaaguugaagauaaauguguucagugaccuagcaauuccauuccuacauauguaccaccuccauuccuaagucuuuaccauggagaaaagcaugcuuaugugcauuaaggauauucacagcagcauuguucuuaauagccaaaaaacuguccaucaagaguaaaauggauaaugaugaauauuauaaacaaugaaaauaaacuuugguuacacguaaaaacgaugaguccacaauguuggaggaaagaagcaagacaaaagaauacauauaguaugacccgguuuauauaaaacagccagacaacacuaaaaaguauuguuuauggcaagccuuggcaaacuuuccuuuaaaggcaaaaugauaacuguuuuagacauaacugccacauggucucugucacaaccaaaagcuacuaaacucugccacuguaggcagaagcagcccuaguccagccaaaguuguguuccagcaagaacgaauaccuaccuuauggauacuuguauucaagauaaaauuacuuuuaaaagugagagaaugggaggaggaaaaugauaaccauaagaagcuuuuggagaagggagggguuuaugaucagggaaggaugaauggggacuuccaggaugcuggccgugcuuucguguggcuuguguguggagguugccuggguguucacuuuaucuguuaaauucuguauaaaaguugugcaacaaguuguaugucuucaauaaguuuuaaaaaauaagaauuucaguguuuccuuaaaugguuaauuacucaguuuuauguggauuuuuguucgcuuuugaauugcccugcuugcuuucugaaaugugucaaagaaauauuucuaaaagaacuuaaauaguaauauaagacuauuaucuuacaugugguuuuucuuuaaaaucacaaacauuuaaaaauauagaacacggcugggugcgguggcucacgccuguaaucccagcacuuugggaggccgaggcagguggaucacaaggucaggauaucgagaccauccuggcuaacacagugaaacccugucucuacuaaaauacaaaaaaugagccgggcguggugucgggcgcccguagucccagcuacucgggaggcugaggcaggagaauggcguaaacccaggaggcagagcuugcagugagccgagaucgcgccaccgcacuccagccugggcgacagagcgagacucagucucaaaaaaaaaaaaaaaaaauguagaacacuacuuuggauuaauaauucaggauaugaacacuagauaauauaugucagaggcuuagauauaauauagcuuucaguuacaaucuuggcuuauucacaccaaaggauuacagugguccucuuucucuuauucacaggcucaguagaugaaggcguuucugagggcuugccuacacuucaaagcacgucuagcacuaaugcuccuccggaugaugaugaucggucaguacuaacauagcauuucguuaccucuuaaggguuguguuuacaacuccaaauucaagcauuucaucucaagaguuguagaaguuuauuacaaccucacuucaguauacuuuucaaaguaaugaaguagcaucaucacauuauaaauuagaguaccuauacaaggcuuuuuuuuuuccccagcauuuccaaaacuaccuagucccauugcuuuaaaucguaucuguaccaaguguuggcaaacuaugaaccacaggccaauuccagccuaccaccuuuauuuguaaaucaaguauuacuggaacacaaccaggcucauuugcugacauauuguuuguggauggcagaguugagugguugaaacagacuguauggugugcaaagucagaaugugugcuguacggacugcugugaaaaacaucugccaaagucugaucuguauacccauaacucccucccugcuugauauuuccacauaaauguauaaagggcauuucacauuuaacaaggccaagacagaacucuugauuucuaacuccuugucugaauccugcuucuccagccuuucucccauuucaguaagcaucaucauuauccccuaauuucucaagcaaaaucucugaggauuguucuuaaucuuuuuuccuuaccacucuucaucucccucguaguuaauccuuaaguccugucaacucugccuauaaaauauaucccugucuacuuuucuaaucuguacuguagccacccuacucuaagucaccaccaucuuuugccuugacuacugcaauaaccuucaaaguagccucugauugcauucuuccccuaauccauuuuccauguagcagccaaaaucaucuuuucuuuuuuaauuaagucagauuaugucacuguuuuaagcuauagauucuuaacauucuuuauucauaccuaaaaucuauaggccuugcuaugccuucuaaagcccuacacgauaugacuucugccuaacuccgucucaaaaaauaaaaaaaaaaaacaaaaggcauucuggacauuaacauuguuuuucauauuguuaaaguaaaacuugaagucuaacaguuaaacuguuucaaaaagucuuuaaguguuuuaucuuuuuucauuuaaaauugaccuauagcaguguuuauucaguuuaaaaaucagagccugguugccuucuuuggucuguuuuuuuuagauuggaaaauguucaguaucccuaccaacucuacauugcuccuuccaccagcaguacagagcgaccaaguccaaauggucccgacagaccuuuucaguguccaaccugcggggugcgauucacccguauucagaaccuaaagcagcacaugcucauccacucagguaaugucaccuucccuguuggugcguaagugaacgcucuaaaacauuuuauuuugcagucccaguuaaaauagaaaacaggggcuucugaguuuuaaaaaaaacucugggaagucaaaugaaaacagauuagcuaagguuuauugcugaaaugaugcagugucagaaagcugcuugccacggguguugaguauucugauuaaaagaacauaaggugauauggagugaguacuuuguaaauaaaaagacauauuaggugugcacauagaggugagauagagaaucacaaacacagaugguaaagcaaauaggguuaaaagggucuguauggguguucuuugugcuguucuucuuauaaugucucuuuaaguuugaaauuuuucccaaauaaaaguguguuuaaaaauguaauauuuucuugcuaauuuacuuucaauucuacaguccuaaaucucugugugcccugaugagucagcuuuguaguuuguauuuuuuuaaacauaacagagauuuuggauaaauguauagaggggauuugaaauuuuaguucaguaaucacaugaaggcaacaggauucuuguggguaaaacacugaccucugacgaguaagagaucuuugcugcuguuuucagcugcgugaguuacuaucucacuuuccccuucuguagauaggucuuacagucccuguccuagcaccaauucucugugacuuuguucaauccguagacuguguuuugaaagguuuuaaaauuuuuuccccaaaacacugugauaaugaauuugaggagacuauuaauacacuuuauaacucauuuauuucuaucaauauuacaucauauuacccaaaaaaacccauuauaucaaaugaugguucugucaugcucauuacauucagagauguuaaaauuguucuuucuucucguuucucugugagauagggaacagagaguagguacugaugauuuucauauccguucaauguaaaccucuaaugaaaugaaauaauaugugcuguuaguggggauuuggguucugucuacauacuguaguuaaauuguguuuugaaguuaguaaaauagaugaucuagaaaagcauucaaaaaucagcuucaguagacguuaccuaguuugccuccccuacugccuuuuuuucuuuuccuuuuuaagcacuugugacuuuucacauauucugcacauuuucugagauacucaauuagaauauguuuuugcugguaauucuugccuuuucagaugaucuguugcuacagaaauauaguucagaaauuuguaggguuuaugacuuuucaguuuauuuuuguuuuuagauauuuuguuuugcuuuauuuacaggaauuaaaccauuucagugugaccgcugugggaaaaaguucaccagggcuuacucgcuaaagaugcaucgccuaaagcaugaagguaaacgcuguuuccggugccagauauguagugccacuuucacuuccuucggggaauauaaacaccacaugaggguuucccggcacauuauccgcaagccucggauuuacgagugcaaaacauguggcgccauguucaccaacucuggaaauuuaaucgugcaccugaggagucugaaccaugaagcaucagagcuagcaaacuacuuccagagcaggugaggugcacaacgaaaacccaaccaggaaaacugcuuucuaaacucucuuuuccugcuuuuagggcagccuucuguguuuuuacaucagguugccagcuagucagucacauuuguuacggauucccacuguucauacucuaaucuccugaucugauaaaauuuugcugagucuucuacguauauaaaauuauaaacauuuuauaguugguauuaaaaauauuuuccugcagaaguagacuacuuguccucuugagauauuuuuuaaauaauacaagguuuaaguaauucuguaauggaccuuaaauagaucuuacuggaaauuuuaccaugucagaugaugcuuagugauacuggauuacuccagacucuagauguuaauaaaauucuuuaccacuucucucuauuuaaaaauauucuauauaaaggaauagccauuggccaguaagaaaaauuucaaaggcaacuauagugggugugaugguuuagaucaugaagucauugcuauuuucauucaguuuagagcucuauucuuguaauauuaauuuauaauagaauuaccuuucugauuuauagggcaucccaggaaaucagcuucuagaucuagcucugccacuaacugcuguugauuaaaccugucacuuuacacaugaaaaagcuugaaacuuagagaaagauaaaauguaagcuuuaaacgaugguuucuaaggccuucucuagauauaaaacuguuguuuuaaauuguuuauaagaauuguacuucuguaggaauccuuaguuucucauaaaaugaaauuuuuacaaaucuuucuuuuuuuuuuuuuugagauggagucucacugucacccaggcuggaaugcaguggcacgauuucggcuuacugcaaccucagccuccugaguagcugggauuacaggugcccaccacuacacccagcuaauauuuguauuuuuaguagagaugggguuucaccauguuggccagucugaucucgaaccccugaccucaagugauccgccugcuucagccucccaaagugcugugggauuacaggcgugagccaccaugcccagcccaaaucuuuacauuuuaaaucacccuuauuuuuaaaaccuuuuuuuuuuuuaauugaauagauagggucuugcaguguugcccaggcugaagugcaguggcuguucauagacacaaucauagugcacugcagccucgaacuccugaggucaagcaguucuccugcuggggcuacaagugugggcaccaccccugacuuaaaaccuuauuuguaaacaaauuccaaauuauuccugcguagauuuuguuuuucccuucaaaccagacauucauuuuguuuaaugcagucaucucuaauucugaaugugugguugccauaucacuaaaccuuagguuauacauaucauauuaaacauaguuuguucaggacuaaaauaguguuccuguuaacuacucauguuaucuuuaucgucccuguacagagcccuguauucuccauucuucuucucuaacaccugaaugaagacuuuuuagaaaauauaacauagggcauucuaaauuacuuugcagaugaacagauuuuaauuuuuuauuaauacugaacaaugaaauuauaaaauaaccuuaucaagucuaaguacauauauuauugacaauuaugguauaaugaaguucuuaguucaguaauaaagauuuaaauaaagccucuaagauaagacuuauuucacauacuuaguuucaauuaccaaaagaugcuuauaaguaggaaauuuaggaaauacagaaaaguaugaagaagaaauuuaaaauauuuucuauuucaucacuuaaggaaaguagccacuguuuuuaguauauuuuacuguccauguugccuguggggaccaauaauugaacacguuuugaggauuaucacauaaccaaucucaaggcauucauuuccaaauucuuuauuaguauuuucauauaccaaauguaauagcaggauacacauaaauuacuuucuacauuucccaacuuuauaguagauuauguaucaggucauuuaugcauaaggacuuaguuucuuaacuaaccuaugucaaguuuaguaauacaaagcuagguuuauauaucucuuacucaauguauaaucaagaaaaguuuagcauuaaaguuacucagaugaucuuuguuuaagugagcaugcuacauuuguuuuguauauagaaacuccucuacauagaacaagaaaggcuguuaagguguccagaguuauaaugaaagugauaauuaaccugauguauuggugguggggaagauugauacauuuugguuuuaauggauguuuugguucauauuuaggaaaguuuauaaguugaaaguuccugaguuuuaaucuucacugaacaauuagugaaaugaagagucccaauuuuguuguauaaaucagagcuuuuuacuguugcuuaucuauuacugguuugaaaauuaauuccauauuucauccuuugccucuuaucuagugauuuccuaguaccggacuacuuaaaccaggaacaagaagagacccuuguucaauaugaucuuggagaacacgguuuugaaagcaacuccucuguucaaaugccugucauuucacaggucuccucaacccagaauugugaaagcacuuuucccuuggggucucuuggugggcuggcagaaaaagaggaagaagugccagagcagccaaagagcagugcuugugcugaggcaaccagagaugaccccccaaaaucagagcugucuucuauaacuauugaguaguuuugugauuuggcuucaguuuuguuuuuuggaaagugccugugcuuggucuuguacauuuaaauuuaauuuaauuuuuuaaacaaaaaaagccgggugggagggagggggagauugggaaagaauuucccuuuuuacuuucugagcccugaaacugauuuuauuuuuccuaacugagagauugcuucuguaaguacacaauaacaugauguugaaacagaaacuaugagacuuaaggagaacugguugacuuaaaacauauaccaguuccuucuuccauuguuaaaaguaggcuaacaacagaucauuagcuagagaggaaaucagaugauuauugaccuucuugagacaagaggguacaugagaaacuaauuacuaaacagcuugacaaauggccugaguagauacuuacugcuguacacaggauguuguauaauauuuuguaaagccuguuguuuuuggaaguauuuaugguaagcuuucuuaaaaauuauuaugguaaauacuucugaaauccggcguacuuuucuuuaagcuuugucauuucuguuaugauuuuucauggugaaauuuugguacugagaugggcauucucuguaccuuuauaguaccacuccaaaggcaaggaaccaugauugacaacagucaagcuguggaugaaaugaccaggaacggagaaugaaguauguaaaucccagcuucauaggaacucuucucauacugcuuuucagauuaaaauugcuguuuaccuggucuccgaauguaaugccugacugugucauugcccggaucaguuuucccccugccccaucaauauguucucuugcauauauuggcgugcugccauauaaaguaaaaauacuggagauauucuauauuuuauauauagguuuauguguuguuggggauguuuucauugugcucuuuuggacauaauaaauaauucucuauugaggcuacauucuuuuuuuuuuucuuuuuuuuuaaaagaauggcaucucacucuguugcccaggcuggaguauaguggcuaagucauagcucacugcagcuucgaacuccugggcucaggccauucuccugccucagccucuugaguaucuaggauuauaggcaugcuccaccacaccugguuaacuucauuuuuauuuuuuguagagaugaggucucacuauggugcccaggcuggucuugaacuccuagaccaagugauccuccuccuuuggccucccagacugcugggaucacugcaccggccaaggcugcauucuuaacccaacuagauuguuuacugaaucccauaugacagcgauacauuguccuuacauauuuauuuuuagacauugcaaaguuauuaaaaacaguuaacuauaguuuuuacacaacguaggcaacaaugaagaguauagacuguaagauuuucaucuaugacucauaaaucugggagaaaaaaauuauuaagacuaaugagaaacugaaaaccuuaaacuaaugaauauuauuucugcugcuaaaaauaugaaacuuucuggucuguaguugaaauuuguaugauccucuagacuuggguauacuuuucaucuggugccauuaaagcaucucuaauauugauccuaaauauuuguaaguccaugagcagugaacuuuggaauaaguuucuguguagauacccaaaguuuaauaauuaugagagcaccugauuugauagacagaaaauacaguucuuuagucaaaacacaagaucugaauuuuguucaggugcuagaccauacuaaauguauauauuuuuaauuauagugauuuguuucauuuuuuuagauuggcuaauucuguaauuuuuuccccaaaaacaugugaagaaaggaaaaguaaauuaaauuccuuagaacuguuuuagguuaagauucucugugucugcccauauucugcaguccuuaacuuguuuucaacucuuuaccucacucaugaacuuguuuuuacccauuugcugccaaacauagguguguucccuucaggagaaucagcauauacagguuaugauaggcucccaccauuuaugcuucuucacugauaggguugcauuacuuucugcagcagacuauaauacuucauauaguacugcugugucucaacuggaaaggucaggaauuuuaauguuacguuguggucuuugaaaacuguuaggccuagcaauagauaaaucucaaaauuaauuuuaaaaucuguauugacaagaauagguaaaauuaugaccaggaaucauuguuacccuuaguuccaagaggugguuuuugaaagagcaagaggaaagaaaaaagaaaagaaggaaagaagaauaaagaagagaaacguguaagaaugguuugcagauugauugguuaaaaguguuuuuagcacauccccaacccugaaaacuucgcauuaagagccaagcacaauguugguagcuccaagauauucugacuguguucucagaaugagggauuacccaucacuggguauuccuucccaaguagaaacuuuagauuuucacugguaauacacauugccaaguuuuaugggaaaucugaauauacugugaaaaugcauaucugguuaguugucugcugcccagaucuuaucaauaccaguaacuaaccaguauuuaacauaaaaugauacaaauaaaggccuuuuucuauuucagugaggguacauuuuucuugauauauauguacuuuaaggauauuggaucuguuuauggaucuguuuuaggaaacagauuugcaagggauaauuguauauauaguaguauuuagguuuauuucaaauucaucuuagggaugccuagaugcauaauuuuuaccaggacauauugaaaauauugcaaagagauagccaguuauauuaucccauucauuagaaauuaccaguguaacuaaacauaaauauuccaguuuagagugcuuaaacguagcuaucuuucuuaaggccaggaggguaacuuugugguaucuaaagggcuuaaauuucagaaugcagaauaaauugccuuuuuaaaaccaagcauuuuguacaagcuuuuauuuucaguuuuuuaacuaccaaauaggugugauguacuuuagaaguaaacaaagauguucacccaugauaauggauguuaaagcuccugcaguuguucuuuucguguuuaaaggguauauucuaauaguggaagcaucaaacaugucagugauuucaucucauucagaaauaaagagauuaauauuggucuuuauuuuuuggcauuuuaaguuuuauauaaauggaugcagauggagauuaucacccacaaauauauuuaaauggauuuuucuuaauuugaauuucaaguaaucuuuuuauuucaaguaauuaguuacgcauuuaguuacauugccaguuuuuuuuuuuuaucaauuucaguaagacaaaauauacuaaaauguuuaaauagccucauucaaucuuacauuuugacauuucagcaaucauucuggcuuacaguaauuagauccccuguuacgacacaugcccuuuguucuuaauaacuagcaaaaaaaaaaaaaaaaaaaaacuuucaucuuguuaaaauacuuugccaaaugaaauagacuagucaauacaucugauguccauaauuauugguaacucaguuaccuucuaacuaauaggcugguucaggagacucucccaguuuauaaaugguucucuugggagccuuuggaagcuguauuaaaucuuucagucuuuuauuucuaauuuuuucucuuaaucuaaauagaggccaguuaucuauuuuaucagcuuuuauucuugaagauucucagauuauguuuuagucccuuuuagcuuuaauaguccuugaaaaauacauuacuguauaauguggcaauucuguaacagagacuuauuacuugaaugaauaauccuaaaauuuuaauauuuuagcugaaguuugagauuuguggaaugaacaaaagaauuagaaacuuucauauguuacuuuguuucagucaucugcaaaguaugaagcuguaauucugaaauacacauccaagugaaugagaauuaaaaauuuucuaaauauuaauacuaacugggaaaaaaaaacuagugugaaguuuacaguuagaagaaacagacccaaaguugccagaagguaauaaauaaauguaguuuucacuguaaguaaguuauugacguaagaugcuuuauuuguaauauauuuagauuuugaaaguuauugagagaugaauguauaaaagcuaaauuuucuuuucugaagcagugaaacaaaauugggguaacaaggaagcucuguuguggcaaacaugucuaugaggaauauuaaaacuaagcauacucccacaggcuuuaaacucaaacuaugaacauuuaaauuaaguuguuccuuauuuugccuauacccauuuuuaucuuucauugucguuuuugcuugacaguauggugacagaguauuuuuauuuggaaaguccucagcaagaugaauuagccaaaagcaauaaugguucagauuaaacaauaaaguggaauugauucaaucccaggcucaacuaagaacagucgcucucuggauguuucauuuuagacgauagauaaguugagauguuguaauauuuaugggggguuaagccugugucaguuaugggaugaagacuuguaguaccaguaccaucaguggucauacuuuuuuuuaacuuuuuacuaaacuaauacaguuagacauuuccacucuaucgugauuauauuuuuaugaugggaaaauaaaaacacuuccauguuuuuauaaauagucucugcaaagauuucagauguuauugguaucucgguuuggcaguaucugaaaaauugagauugucuuugaaauguuugugcuacuuuuacuuaaguaaacccccacugugcaagacccaggccggcuucagcuaauaccaagguuucugugugcauaauaguuuacagagaacuuaagaguaaggacugcggauuaaaaacaaaacuuuuuuuaacuuuaaaauuuuuaguuuuuguucaaaguaccugguuuauaaagucaaauucuuuuauuaguuccuuucucguuuaaauugacugauguugcugaugaagcuuaaagucccaggcacgguuguggcgauauacugauaaaauuggugccuaguggugggaggagcuccagugucaggacuuuuauuaaaaggcccuuguuuucccaaaugccaaucuagccacauuuagauuucauuauucaauaaaacagaugaaaaaucaucccauaaaugaauguugagguuaccaaaguacaucaccugcugaggaaggauaaaucuuccugcuuuaagggagcccugucaucucuccucuuaaugcacguuucccuugguauuaguggaagcuguguucaagaugggaagccuuuccugcaguucuuagaaacaccugcuuucuaaggagagccuuuucuaggauuagcuuauguguguuuucucuaggcgauuuuuuauuucaguuaccaauuuaauuuucaaguugacagaugcuguguaaagucucucauaaugagaguaguccauuaaauuguugaaaguugcacugcuuuucaucuuucagguaccugaaaugagugacaucagguauuuggaaggaguaagaucauaaacuguauucauuuucuuccuuguacaaagugaugacuucuaaugcuuauaucucaagguauuuuuuaaaaaagcaacggucccuaauagaguaaaauuugguuuugguccaaguucccaauaauguauuuaauguuucuguuguuuacuggugccucccguugcaucagguagagauugccugccucuuuguagggcagccuuguggcaccuuauguccaacuuggaggauaguauauggcuucuuugugccucuacuaucuuuucaaaagccauuuuauaaaaauccuagguagccuauuuuaauauuuaaauauauauauuugugaaagaacuuuuagaacagaccuuuucuuuuuacuuuaaaauuccuguauuuccauuuuuaagaguaaauuuaaucuccaggauuuagaagugucuuuccagagaagcauaaugagaaagucagacugagguaauaagaccagaauuaagugauagaagaaacuguuguuugguuaaaggacacagauuugaaggaaaaaaauuuugauguaacaauuuuuuaaauaaaauuuuguuuuucuguaaugucauauuugcugcuacaguagcucaauauuuuacagggcuaacauaaagcuggcuccauuuaaaaacuggaguacuuccuagugcagccagccuaggcggaaacuguacaccauggucuuccagaugggugacugauggcuuuggguagcugaugcaugcuuuaauauuugccuauagcccggcagcaaggaagucggggcggggggacuuuuuuacccugccaguuauagcauugugauucuuucugggcacuggcauuuugugaaacucucaagggaaggugaugcaggggagaaaaugugaauuaaauuacauagauggguguuuuuaugucuucuaccccuuuccuagaauuaguacaacucuuaacugugccaguccccaguucaccagcuuuguauccagucgucaucucauucaaguauggcuuuacuuggugacacuggccauagcuaaguuaacuuggcauguuugacuuuugacaauaacaaaaaugguuuuggauuuuguuuuauuuccaaaaaauguauacaauaucagaacuucacauuuuauauacuaguaucuggcuauuaguauuuuacaggaaccauaguucuuggugacuacauauauauauauauuuuugugaccuuuuuuguaaacuaagugccguuucaacguuacaaucauuuuuaggguuauuguaaucaaugugaauaucauguuuuuucaaaucuguucugagccuauaguguuugcuuugugaacauguguauuguauauauucuguauaguuauauuguacugaaauuagcuuguuugauauaaggaaaauauguauugaguaccuuuuugcuagccugauuguuuaaucuuuuuaaaaaagguuuaaacuuuuuuuaaaaaaaaaaucuuuaaacuggccuuuauuacauggucacacauaaaguugcaguuaggaaagggaugggcagggaaaaacuaguuuugagugucuuuagauagaaacaugagacuaagguuugauuuuguuuucguuuucucauuaaaauaucuuaugcuuuauggaauaa

SEQ ID NO: 192951 - RNA, 227139 nt, Homo sapiens
auggagacugaaagugagaguagcacuuuaggggaugacagugucuucugguuggagucugaaguuauaauccaggugacugacugugaagaggaagaaagggaagagaaguucaggugauuauggaauucacaguuccuuuguccuguccacucccuacccccacccgcaccccuuuuucuucucugcauuucggucuuuuuuccaauaagacuuucuguuuucugggggaagguuuggagcucaagggagcagguuuugaguuguauauagcacuccucauuccacaacuugcccugaacuuguaaaaugcauuuuaaaggacuuguuagaacgccaggaggagaagguguuagacagguuuuguaguagccuuucaggaauuucaaguagacacucauaaugaacuacuaccccuuccuguaucugauuuguaucaaauagauuugaucugaauuuguaucuaauagauuuuucuuccucuuuuucuuggaauguggugugugugugugugugugugugugugugcgugccugccugccugccugcuuuguuugccuuaugcauggguaugaaaaauuccgauuaaguacagauugguuauuuuguggcuuugaucuuuacccuugucucugaucuuguaucucaugcccccuuucccccaaaucucucuugguuuuugaaucucugguaguauuaguaacuucauaauugaaguuuuuagaggaugccuccugaugaagcagcucucaguuuagugucuguggugaagaaagaugucuuaaccaguuugugaaaacagaaccaauguuucauucauucuguuguacuguugcaaauuuuagggggcuuuauucuggcuuuucuuuuucuuucagaguuagcgauguaauaccuuugaguaucacaaaaaucucuugaugaaguuugaaguuuguugcugcauauuaucacugccacucacaugugcaauuaaacaucuuuuauaaguuuaccuaugagaacuuggauaggugaauauacuguuuucaucagauacugucuuuguguuuaaugcugaaaaagaguuucuccuuuucucgagucaaaggauuucuuuauccacaaauuuuauuuuuuaaagucuagguuaaaugauggaagggauugaauauugggaacucuugauaacccucacuaaauuuuuuacucugggguucaaauaaaugagaaguauauuuaaaauuuuaaaagaauaauuuucagaguauaaaaaugaauuauuagcauaugauuauuuuuugucugaacuuuugucucauuuucccauaauuuuaucuagccuuucaaauuugaguaagucccuucccuuccaagguaugcuaauuguuagucacauguucugcuuuuuaauaugguuugugucuugcuaacaaugaguaggacugaaguauuuguuuugcuuguaauaaaacuuuuugaccugguauucaaauuauggaaguuauuuggguauuugucaaaggaagaaacaacuuggaacuuauuucauuguuguuuuuauaacagauuugguacuguaauccuagauuuacuuguaaggcagugggcgucucucugggauuuucuuuugacaguuaaaagcaaauuuguguaaggaugagcucuucuuuuccuugggaguaugugacagcauuuucacucugagaaacugagcuagugauguguuguuuaaggaaacuaugauaccauagggcauuucucuucuguuuauauuuccuaucugaauagcaccauggcucuccuaaaucaauuauaucuuugugauuugaucugauuuuauuuacaaauguaacaaagaggucugggcaaggcccaauuucauguagugucucucacgcauucagcagugaggcaugaggaaauguggcagcagagugguuucacaaccucguggugguguuccugccgagaugcccuacaggaaaauggaggcauggguguggaaggggaagggucggauaggaguugcagcuguaaccuugggaggaccaaauaguagacucagugugguaugacaguuguuuuuguaaaaucaauguaauaauuuuaaaaaugucuuacuguguuuuuauaaaaaucucugcaaauacaugugacaucaagcugucguauugguuacauuuccauucacauacacacacauagcugagaugagggcaaaagauugugcacuuuucuuuuucccugaauagcuuguaaacuacauuuuaaaugcacucuuaaaagccugcucuuguguaacuuaaggcaccauggcuaagagaguaaagucauaccacaccuagaauguaggcuucuggugcuuccaggugccaucugcuuuaggaggaaguagucucagagacaaguuaauguuuguccaguagcuuuugaaauagcauuuauuuuuggacucaguuggaggaaaggauccuuuuuauuaacacucuuucacuaugggaaguugccggucuccuucauggugguaguuuaaauuugucugccauugacucacagaucuuucauuuucugauuucuuauuuguagucgguauuauuaccuaccuugucacugugguaaaauaguuauuagacuagaauauuuaguccuuagaauaaaauaguuccuagagaugauuagaaaaauccaucccuggauaagaaggaggaauauaaggcagaaaaggaaaaacauaaauguuuuaauucuaucaagaaagaaaaacuuuacuuagaaauuguuauauguaauguacuaggccauauauaugcuuuauacaguguaucaguuaacugcuuaucacuccuauaaagcagguaucauuuuuccuauuuccucggugaggaauuuauggcucagagagucacacagcccacauuugucaugguggagcaaaauuuugcaagugguagcacaaaaauuugaacccagauguaacugacuuugaaagugaagacuuuaaugaaagauuuuuggggcuaucuucugcuaaaugcuauuuucugcuaagugauaacuuauaagaggcuacagcugauaucucaaguuuugaaauuccuuuuuuuugaggagguuaugagcaucaaugacauauagauuaugugaccaucauaaaaaugaaguaaugaacacaauaaugugacuuuuaaaaaaugugaccucuaggacaccuaggaaucaugaaagguucuaguucuuuggcauuugaagguagaaauguuuaucauaugauuuuguuuagacuucccuaauaccacguuaugggcugauagacagccuggcaaauaugacauauaauuugaagcagcuacagagaugauauagugcuuaauugaaccauauuuuugaucacgaucuguagaugcccagaucgcugaucuucacguauaucuccauuauuaaggcaauucauuuuaagugacgagaaaguucugacuuuaguuaaacuggaugauuuggugaacauauuuuaauugggggggacaaugccuuuauugauuuauagcauuauagaacuaaugauacuucaugcacuugacucguugguugguugcauuauucauccucuaccucagggguucccaaccccuggaccguggaccaguuaucuuauuuggaaggaugccacaaguuagaagcuauuguggcagucuaaguagguaguaagggucuugacugugguauuguacaucuucuaggcucaaaacagcuuugaacucccaggcccaggcgaucagaucagaucuagaugauuucuuuuaauggcucauuuccccuggaagcccauaaaacaauuucaagauuuucuguuuuuauuacucugccuguucuuuuaucuucugcagaaauucuugauuucaggcuucccagccaguuuuaaugauccuggaaguacagagagguaguauuaacaauuaacugaggcugggcaugguggcucacaccuguaaucccagcacuuugggaggcugaggcaggcagaucaccugaggucaggaguuugagaucagccuggccaacauggugaaacccugucucuacuaaaaauacaaaaauuagcugggugugguggcggguuccuguaaucccagcuauuugggaggcugaggcaggagaauugcuugaaccugggagguagagauugcagugagcugagauuacggcacugcauuccagccugggugacaaaaugagacuccaucucaaaaacaaacaaaccucaacaaacaaaaaaaccacacaaaaaaaccaaaacaaaaaaacccaauuaacuguauguccauaaauaccauaucacacccaggcccauuuuauacuguguggcuuuucaaaggcaccacaucuuuaauaaccuauuacuuaugaugucaaaaaagauguauauuuugcccaaaaagcuacaacuuauauuguuuuguaaccuugaagaaacaucugggauuuaguuuagccccuaaaauauuauuuuaaaaaauuauuuuuaauuuuaggggguucauaguggguauauauuuuuaugggguacaugagauguuuugauauaggcacacaauguguaauaaucauaucauggaagaugggguaaccauccccucaugaugggauauccauccccucaagcauuuacccuuuguuuuauaaacaauccaauuauacucuuuuaauuauuuuucaguguacaauuaaauuauuauugacuauagucacccuauugugcuaucaaauacuaggccuuauucauuuauucuaacuacuuuuuggacccauuaacuauccccaccagccucccacuaugcccccaccacccuucccagccucugguaaccauccuucuacucucuguguccaugaguuuaauuguuuugauuuuuagaucacacaaauaagugagaacaugugauguuugucuuuccgugccuggcuuauuucacuuaacauaaugaccucuagcuccaaccauguuguugcaaaugacuaaaucucauuauuuuuuaugacugaauaguauuccauuggguauaaguaccacauuuucuuuauccauucauccauugauggacacuuagguugcuuucagaucuuggcuauugugaacagugcugcaacaaauaugggagugcagauaccucuucaguagacugauuuccuuucauuuggguauauguccaacagugggauggcuagaucauaugguagcucuauuuuuaguuuuuuugaggaacuuccaaacuuuucuucauaguaguugccuaauuuacauuccugccaacaaugugugaggguucccauuucuccacauuguugccggcauuuguuauugccuuucuuuuggauauaagccauuuuaacuggggugagaugaucucucacuguaguuuugauuugcauuucucugaugaucagugauguugagcacuuuuuccuacgcuuguuugccauuuguugccgucuuuugagaaaugccuguucaaaucuuuugcccauuuuuaaaucggauuauuacauuuuuuccuauagaguuguuugggcuccuuauauauucugguaauuaaucccuuuuugcaaauauuuucucccuugcuguggguugucucuucacuuuguugauuguuuucuuugcuguguagaagcuucuaaaauauucuuuuaacaguaaguauaacauucacccaacauacucucaucagugaauuuaauaguaaucagcaaagucugauaugaacaucccuuaaucucagaacauuuuaggcaguaauggagucuagccauuaggcugucuucauaaucugugaaaugaaucugucuuaaccgugaggcaugccaguacaagacuuucuugguauuuuaguaauuaagcccuuugggauggaguccaaggugggccuuucuuguaucuaucuguaugaguauuuugauguucaagaaaggcccuagaguacacaaacgauauagaccuguauaaaaguuccugguuauuagguuguuuaauugaaguuaaaaaguuuaaacccaaaccuaauuuuucuaacucuugcauuucacuuuggcacugaacucucuuaaauagucaauaggacuuucaaaaauaaauugaaaucccugaaacauuuaaagcucuauuuauaaauuaguuaauuuucuuuuuuuuuaaauuaaauaugucaagugacuagcuuagcaagaugauauucagagcaggcaaaaccuucccagauacuuaauuuuggaaguugcgcuauacuuuucuuuacauuaaugauuaguuuccauuuccauguucucauaaucauacauguauuuucucuauuugaaaauaaaaugauuucuuucacccagguuuucucucucucuuucuguguauguauguuuguguuuuaaaucaugguucucucuucuccucuacuucucuuccuuauaaaauaagaucuuuaggaaacuuuaacuuccuccuucucucagucucauacuucuagaugagacuuuugaaacucuuuuauucacccauucugccuccgucaguuuaauguuuuuugcuuuucauucagauuuaauuauuugugucauuuuuuuauuauuauuauacuuuaaguuuuaggguacaugugcacaacgugcagguuuguuacauauguauacaugugccauguuggugugcuacacccaguaacucgucauuuacauuagguauaucuccuaaugcuaucccucuccucuccccucaccccacaacagucccuggugugugauguuccccuuccuguguccaaguguucucauuguucaauucccaccuaugaguaagaacaugugguguuugguuuuuuguccuugugauaguuugcugagaaugauaguuuccagcuucauccaugucccuacaaaggacaugaccucaucauuuuuuauggcugcauaguauuccgugguguauaugugccacauuuucuuaauccaguauaucauuguuggacauuuggguugguuccaagucuuugcuauugugaauaaugccacaauaaacauacgugugcaugugucuuuauagcagcaugauuuauaauccuuuggguaucuacccaguaaugggauggcugggucaaaugguauuucuaguucuagaucccugaggaauugccacaccuacuuccacagugguugaacuaguuuacagucccaccaacagugugucauuguuuaguguuuauguugcuucuucucuguaucacauucuaucuuaauguaucaguuuuggaucauuuguauuugccugauacguucuuaaguauuuuuguucaguuaaguucucugggugauauucucugauuucuuguauaagcucaaaugccaaucuguuuuuuucuuuuccuuuguagguaacauguucuuuuugccagacuacuuguuaagaguuucuuuuuuauuguuauguauauuuuguuacccguucuuuaguuuggagcuuagugaguucuuuauuuuggaacuuagugacuuucagucuacagagucaaaccuuuguguuagggaagaaauuuuuuuguuuccuauuauugccuuugccucuauuaaguccccuuaaucuuuuauuuuaugauauauuucuuuuuacauuuuacuuugugaauugaaguuuuuuuguacuuguucucuuagcuaauuucaucuucuuuuuuaauuguucaaauucaauuugaguagauaaauuauuuuuaaggguucuucacguauagauacauacacacaagguauuuuuauaauaaauuuagguuauuuucuuucuuuuugagcuuuggagcuuuauucauucaguguacauguucuguuuuauucugacuguucagaaccuaucuuuuagcugcuaagcaaaguaucugcgcuucuuugcccuuuccccugcuguguuuucuucaguagcccccaugaugcauauggcucugccuugcuugucuuaggugcacacacccacauuaggagcccuaguccuucuggucaguuguuaaauuacuuuacaggguaauuuuccaguuuuuguuaguacccugggggcaagcaucucucuuguuguggaaaggggugggguauagccuuugaacuucuguuuuucucuuuaggucaguaugauaccacuugcuuuuaaguuuuucagucuuuuagucuuucagaaguguaucaaagucugaucucuggccuucuggugccauucauaccauucuguuaaggauuuauuuuuuccuauuuaacuuaaugauuuuugagacacuuggagaaggagagauuugcuuccucacauauaugcagucuaggauuggaaguccacugggaaguuuuuuucauagguuuugagaggaaacuuuucugcagggaacauucacugaggcagaaucguggugccuuucaugcaauuuggugggucuuaggagugugaauggcugcuucagugucuucuucagcuggcagguggggucuuccagaaaaaaauaguuuaccacaucaggaaugaugaagauauggucaagcauuccacuuuuccuaucugcaaaacagggcuuaaaauaguauaucaaacaauaacuaguuagaagauacaauggaagaaaaagugccacuuucaggagcaacaaagaugagauaccagaaauaaacuuaacaacaaacucuaaaaccuacaugauaaaaauguaaaacaucauugaagaacauaaaagaaguuuggaacaauugaagaauaugucuucuucauaacuggaaauacacagcaccauaaagauguuaguuuaagguaauuuauaaauuuaaugugaugauaagaauccuuuuuaaaaaacuaaauaaauugaucuuggcuaaauaauuuaaccaagaaacuuuguaggaaaaagaaaaagaacaaggguaguggauauagaggacuuuugcaacuagauguuguauugugaagucuuagucucaguaauuaaaacccauugguugugggacaugaagagaaguauuaugggguagaauggaaauccuagaaaauauacccacguucauaggaauauuuagguaugguaaagauggcuucucaaaagcuaauggagaugauauguacuauucaguaaauaguuuuggagaaacugaauauucaccuguggaaguaaagaaaauaggaauccuaccucauaccaaggaugaauuacaaaugaucaaagauuuaaauguacuaaaugaaaacauaaaaaauuuuuuaaggccgggugcagugacucaugucuguaaucccagcauuuugggaggcuaaaguggcaggaucccuugaggccaggaguuugaaaccagccuagucaacauagcaagaccccgucacuacaaaagaaaaauaaaaaacuuagccuggcauggugguaccugccuguagucccagguacucaggagacugaagugggaggaucucuugagcccaggaguuugaggcuauaguaagcuacgauuacaccaccgcccuccagcccuggaaauagagcgagacccugucuccagaaaaaaaaaaaagguaauagaaaacauagagaauuaacacaauuuuuuuuuauaauaggaaggcauuuugaacuaugauuuaaagcaguaaaagaaaaagccaugaaggaaaggguugagaaaugaggcuacauaaaacaaaaaacaucuacauuacauaaaauaucuacauuacaauauauaaaacaucugcauuacaaaaaacaaaguaagcaaggacauaugacgaccugggaaaaauaccugaaacucauauuacagaugaaggauuaaucuccuugauauacaaagaacuaaaaaugguuaagaaaaaguccaacaacccaauagaaaaaugggcuaauauauaaaaauauuuuuuuuacuguagaaaauuuguuuuucagauauauuuguacauauauagaaugacauauaaaugcacaaacuuauuguagcauuguuuguaauagcaguagauuggaaagaauuuauucaaguacucaucaguaggggauuaguuaaauaaauuaaggaauagcuacacaggggaacauuauauaguuguaaaaacagcaaagaaguucuauguauugauauggaaagucuccaggaaaaguuagaggaaaacaagguauacaacaauguguaaaccuacuaagaagcagcauauuuacacauugcuuuuauacucuguguggcuguauuuuuucauacauaugaauaauuuaugugugaauauaugcagcuauaguaauaaaguuuagaagacucuauuggaaauugauuaccuuggcagguagagaauuuaauggguuggaauugggcagauuggagacagggaugggaauaauuuuucuuuauaugccuuuuugauuuguguaugguucaauuguaauacauaugaagaauuauaguauauaagacauuuugagugggaagugaccaaaacugaauuccaacuggcuucagcaaaccucuguuccauagucaccaccaauguaacuguccucaucgguguuagaggguuaguuucuuuauuuuuuaggaauucugggaauauuagauuuauguaagugauuauuaguccacauaggcuaaccagaacagaguuccuguauuuuaagaggcuuuacaauuuaauuuauuaauauccuuugaaaaguaggaaaauuuauugcacccuaugauaagcagauaaugacuuuuaucaguuccaggcacacagaacgcugguagucucagauuuauaucaucagccguggguaaaaugaauagagaacaccaaacugagcacuucggacauaucucaaagagcuguucucuccaguggaauugaggcauauuuguacacagacagacaaaaauugacuaacaaaccaaauucucuguugcuaauagagaguagauaucaaauggucugaccauaaaauggacuuccagccauuguugccaccaguggauaguaacuggcgacaacuguugcagagccagaaccaaauuuggcgaagaauaagaaauaaacaaaaaccgaucggaagaauagaaagagaaagauauccugcuuggaauuuauuccagggaugaagaaaagauauuccugggagugaacagucccugaggugcaguuccuggguaauaugcuauauuugucuugagaaggaaauccgcuuggacuucucuguggaacuucaacauugucaaguguaauuuuucauaaguuaugagcaagaaucucauacaaauaaagugaauaugugacagauauuuacauaauuucuuagugagggaaacagcaagaugauaaggcugguucccauaaucuuucaauuugggggaaguaguuuucucuccuauuuuucauuuucauugaaugcauucagguuuaagucugaagauguuuuacagaaaacucugguaaaaaauacagcaguagguuacuuagguauuaugguuggcagcccuuaacuacagcuuuuuuguuagauaugaaacuacaaucaaacacuuuaagcauaaaauuuguccauaauuuuaaaagcauagaacaagagagucaaauaaauggauacuaaauuucuuauugaguugguucaucauugcauggcccauaauguauauauaaauauaauuuuuauaccucuuaaacuguguaacauuuaccaauaaacuuuuacacuuugagguauaacacauauaauaaagucuacaaaucauaaauguacagcuugauaaauuuauacaaaauauauacccagauaaucacaacccaaucaagguauagauuauuucuagcacacacaaaaccuuugucccuucuagucaguacuucucccaaagguaacuuauucugacuuugucacaauagauuaauuuagccuguucuugaacuuaaugccaauagaauuauauagcauguacucuaaugucugacuucuguugcacaacauuuaugagauucaucuacuuuuugcaaauuccuuuuuauuuaugaguaguagucuauuguaugaaaaauauuaaaacuaguauuguugauuuauuuuuucucuuaauaaauaauuguauauagugguauauguaaauacacgauuuuuuuaauauauugaccauguaaaccagugaucuugcuaauguauuaauucuaaauugcuuauagagucuuuuagauuguuuauuuacauguuaugucuucaaauaaagaaaaauguuuucuuuuccaauuuuuuuuuauuauuauacuuuaaguuuuaggguacaugugcacaaugugcagguuaguuacauacguauacacgugccaugcuggugcacugcacccacuaacucgucaucuagcauuagguauaucucccaaugcuaucccucccccguccccccaccccacaacaguccccagagugugauguuccccuuccuauguccauguguucucauuguucaguucccaccuaugagugagaaugugcgguguuugguuuuuuguucuugagauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuaucaugaauaaugccgcaauaaacauacgugugcaugugucuuuauagcagcaugauuuauaauccuuuggguauauacccauuaaugggauggcugggucaaaugguauuucuaguucuagaucccugaggaauggccacacugacuuccacaaugguugaacuaguuuacagucccagcaacaguguaaaaguuuuccuauuuguccacauccucuccagcaccuguuguuuccugacuuuuuaaugauugccauucuaacuggugugagaugguaucucacugugguuuugauuuguauuucucugauggccagugaugaugagcauuuuuucauauguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaguuuaauuagaucccauuugucaauuuuggcucuuguuggcauugcuuuugguguuuuagacaugaaguucuugcccaugccuauguccugaaugguaaugccuagguuuucuucuaggguuuuuaugguuuuaggucuaauauuuaagucuuuaauccaucuugaauugauuuuuguaucagguguaaggaagggauccaguuucagcuuucuacauauggcuagccaguuuucccagcaccauuuacuaaauagggaauccuuuccccauugcuuguucuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugucuccggcuuuguucuuuuggcuuaggauugacuuggcguugugggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccaugagcauggaauguucuuccauuuguuuguauccucuuuuauuuccuugagcaauggauuguaguucuccuugaagagguccuucacaucccuuguaaguuggauuccuagguauuuuauucucuuugaagcaauugugaaugugaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaauaggagugaguggugagagagggcaucccugucuugugccaguuuucgaagggaaugcuuccaguuuuugcccauucaguaugauauuggcuguggguuugucauagauagcucuuauuauuuugagauaugucccaucaauaccuaauuuguugagaguuuuuagcaugaagggcuguugaauuuugucaaaggccuuuucugcaucuauugagauaaucaugugguuuuugucuuugguucuguuuauaugcuggauuacauuuauugauuugcuuauauugaaccagccuugcaucccagggaugaagcccacuugaucaugguggauaagcuuuuugaugugcugcuggauucaguuugccaguauuuuauuaaggguuuuugcaucaauguucaucaaggauauuggucuaaaauucucuuuuuugguugugucucugcccggcuuugguaucaggaugaugcuggccucguaaaaugaguuagggaggauucccucuuuuuuuauugacuggaauaguuucagaaggaaugguaccaguuucuccuuguaccucugguagaauucggcugugaauccaucugguccuggacucuuuuugguugguaagcuauugauuauugccacaauuucagcuccuguuauuggucuauucagagauucaacuucuuccugguuuagucuugguagaguguaugugucaaggaauuuauccauuucuucuauauuuucuaguuuauuugcguagagguguuuguaguauucucugaugguaguuuguauuucugugggaucgguggugauauccccuuuaucauuuuuuauugcgucuauuugauucuucucucuuuuuuucuuuauuagucuugcuagcggucuauccauuuuguugauccuuucaaaaaaccagcuccuggauucauuaauuuuuugaaggguuuuuugugucucuauuuccuucaguucugcucugauuuuaguuauuucuugccuucugccagcuuuugaauguguuugcucuugcuuuuccaguucuuuuaauugugauguuagggugucgauguuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauuccggagcagguuguucaguuuccauguaguugagcgguuuugagugagauucuuaauccugaguucuaguuugauugcacuguggucugagagauaguuuguuauaauuuguguucuuuuacauuugcugaggagagcuuuacuuccaaguauguggucaguuuuggaaugggugugguguggugcugaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaacuccugccuuuuuuuguuuuccauuugcuugguagaucuuccuccauccuuuuauuuugaugugugucucugcacgugagauggguuuccugaauacagcacacugaugggucuugacucuuuauccaauuugccagucugugucuuuuaauuggagcauuuaguccauuuacauuuaaaguuaauauuguuaugugugaauuugauccugucauuaugauauuagcugguuauuuugcucguuaguugaugcaguuacuuccuagucucaauggucuuuacacuuuggcaugauuuugcagcggcugguaccgauuguuccuuuccauguuagcgcuuccuucaggagcucuuguaaggcaggccugguggugacaaaaucucucagcauuugcuugucuguaaaguauuuuauuuguccuucacuuaugaagcuuaguuuggcuggauaugaaauucuggguugaaaauucuuuucuuuaagaauguugaauauuggcccccacugucuuccagcuuguaggguuucugccgagagaucugcuguuagucugaugggcuucccuuugaggguaacccgaccuuucucucuggcugcccuuaacaucuuuuccuucauuucaacuuuggugaaucugacaauuaugugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccccaucacuuucagguacaccaaucagacauagauuuggucuuuucacauagucccauauuucuuggaggcuuugcucauuucuuuuuauucuuuuuucucuaaacuucccuucuugcuucauuucauucauuucaucuuccauugcugauacccuuucuuccaguugaucgcaucagcuccugaggcuucugcauucuucauguaguucucgagccuugguuuucagcuccaucagcuccuuuaagcacuucucuguauugguuauucuaguuauacauucuucuaaauuuuuuucaaaguuuucaacuucuuugccuuugguuugaauguccucccauagcucagaguaauuugaucgucugaagccuucuucucugagcucgucaaagucauucuccauccagcuuuguuccguugcuggugaggaacugcguuccuuuggaggaggagaggcgcucugcuuuuuagaguuuccaguuuuucuguucuguuuuuuccccaucuuugugguuuuaucuacuuuuggucuuugaugauggugauguacagauggguuuuugguguggaugugcuuucuguuuguuaguuuuccuucuaacagacaggauccucagcugcaggucugugggaguacccggccaugugaggugucagacugccccugcuugggggugccucccaguuaggcugcucgggggucaggggucagggacccacuugaggaggcagucugccuguucucagaucuccagcugcgugcugggagaagcauugcucucuucaaagcugucagacagggacauuuaagucugcagagguuacugcugucuuuuuauuugucugugcccugcccccagagguggagccuacagaggcaggcaggccuccuugagcuguggugggcucuacccaguucgagcuuucuggcugcuuuguuuaccuaagcaagccugggcaauggugggcgccccuccccgagccuugcugccgccuagcaguuugaucucagacugcugugcuagcaaucagcgagacuccgugggcguaggacccuccgagccaugugcgggauauaauguccuggugcgccauuuuuuaggcccgucggaaaagcgcaguauuugggugggagugaaccgauuuuccaggugccgucugucaccccuuucuuugacuaggaaagggaacucccugacccucugcgcuucccgagugaggcaaugccucgcccugcuuuggcuugugcacggugcgcgcacccacuguccugugcccacugucuggcacucccuagugagaugaaccugguaccucagauggaaaugcagaaaucacccgucuucugcgucgcucacgcugggagcuguggaccggagcuguuccuauuuggccaucuuggcuccucuuucuuuuccaauuuuuacauuuuuucuugcuuuuuuuccccaagugaauaagaccucaaguacaguguugaauagaagacaacauucuugauuuguucaugaucucagugggaaaucauuuaguauuucaauguuaagugugaugcuuagcuguauuuguguuuuucaauaauuuucauuaaaauauuuuaaagaauuuaugaauagguauuaaauuucaccuauugaaaucauaugugauggauuacauuuauugauuugcauauguugaaccagacuugcaucccaggaaugaagccgacuugaucgugguggauaagcucuuugaugugcugcuggauucaauuuuccaguauuuuauugaggauuuuugcaucgauguucaucagagguauuggccugaaguuuucuuuuuugguuguguuucuuucugguuuugguaucaggaugaugcuggcuucauaaaaugaguuagggaggagucccuccuuuuuaauuguuuggagugguuucagaaggaaugguaccagcuccucuuuguaccucugguaaaauuuggcugugaauccgucugguccugggcuuuucuuuuuuuuuuuuuugguuggucuauuaauuacugccucaauuucagaacuuguuauuggucuauucagggauucagcuucuuccuaauuuagucuugguaggguguaugcauccaggaauuuauccauuucuucuagauuuucuaguuuauuuguguagagauguuuauaguauucucugaugguaguuuguauuucuguggggucaguggugucccuaaacauuuuuuauugugucuguuugauucuucucucucuucuuuguuagucuagcuagugguuuuuuguuuguuuguuuguuuguuuguuuuuucaaaaaaacagccccuggauuuguugauuuuuuuuuuuuucuuuuuggaggguuuuucaugucucuaucuccuucauuucuucucugaucuuaguuauuucuugugcuuugcuagcuuuuggauuaguuugcucuugccuuuagcucuuuuaauugugauguucggguguccauuugagaucuuucuugcuuucugaugugggcauuuagugcuauacauuucccucuuaacacugcuuuagcugugucccagagauucuaguauguugucucuauuuguucucauuuguuucaaagaacuuccugauuucugccuuaauuucuuuauuuccccaggagucauucaggagcagguuguucaauuuccaugaaauugugugcuuuugagugaguuucuuaaucuugaguucuaaugugauugcacuguggucugagagauuguuuguugugaaguuaguucuuuugcauuuguugaggaguguuuuacuuccaauuauguguucguuuuuagaauaagugccauguggcacugagaagaauguauauucuguugauuugggguagagaguucuguagacuucagaaccaaagacaaaaccacaugauuaucucaacagaugcagaaaaggccuuugauaaaauucaacaucccuucacguuaaaaacucucaauaagcuagauauugauggaacauauuucaaaacaauaagagcuauuuauaacaaacccacagccaauaucauauugaauggagaaaagauggaaacauucacuuugaaaaccaguacaagacaagggugcccucucucaccacuccuauucaacauaguauuggaaguucuggccagggaagucaggcaagagaaagaaauaaagguuauucagguaggaagagaggaagucaaguugucucuguuugcagaugacaugauuuuauauuuagaaaacccagucaucucagcccaaaaacuccuugaacugauaagcagcuucagcagucucaggauacaaaaucaauguguaaaaaucccaagcauuccuuuuugucaacaauaggcaagcagagagccaaaucaugaaugaacucacauucauaauugcuacaaagagaauaaaauaccuaggaauacuguuaacaggggaugugaagggccucuucaaggagaacuacaaaccacugcucaaggaaauaagagaugacacaaacaaauagaaaaacauuccuucuucaugguugggaagaaucaguauugugaaaauggccauacugccugaaguaauuuauagauucagugcuauucccaucaagcuaccauugacauucuuacagaauuagaaaaaacuauuuugaauuucauaugaaaucaaagaagaccccauauagccaagacaauccuaagcaaaaagaacaaagcuggaggcaucacgcuaccugacuucaaacuauacuacaacgcuaccguaaccaaaacagcaggguacugguaccaaaacagacauauagaccaauggagcagaacagagaccucggaaauaacaccacacaucuacaacccucugaucuuugacaaaccugacaaaaacaaacaaugggaaagagaucuccuauucaguaaauggugcugggaaaacuggcuagccauauacagaaaacugaaccuggaccccuuccuuucaccuuauacaaaaauuaacucaggauggauuaaagacuuaaauguaaaaccccaaaccauaaaaacccuagaagaaaaccuaggcauuaccauucaggacauaggcaugggcaaagucuucauaacaaaaaugccaaaagcaauugcaauaagagccaaaauugacaaaugggaucuaauuaaacaaaauaccaucuccacagccaaagaaacuuaucaucagagugaacaggcaaccuguagaaugggagaaaauuuuugcaaucuacccuucugacaaaggucuaauauccagcauuuacaaggaacuucgaacauauuuacaagauaaagauaaauaaccccaucaaaaaguuggcaaaggauaugaacagacaccucucaaaggaagacauuucuguggccaacaaacaugaaaagaagcucaacauaacugaucaucagagaaaugcaaaucaaaaccacagugagacaccaucucacgccagucaggauggcgauuauuaaaaagucaggaaacaauagaugcuggcgaggcuguggagaaauacaaacacuuuuacacuguuggugggaauguaaauuaguucaacccuuguggaagacacuauggcaauuccucaacgaucuggaaccagaaauaccauuugaccuagcaauuccauuacccaaaggaauauaaaucauucuacuauaaaggcacuugcacacauauguuuauugcagcacuguuuacaacagcagagacauggaaccaacccaaauggccaucagugacagacuggauaaagaaaaugugguacauaugcaccauggaauacuaugaagccauaaaaaggaaugagaucauguccuuuucagggacauggacagagcuggaagccaucauccucagcaagcuaacacaggaacagaaaaccaaacacugcauguugucauccauaauugggaguugaacacugagaacagguggacacagagaggggaacaacacagaucggggccaguugugggguggagggugaggggaggggacggaaaguagaggacgagucaauagaugccacaaaccaccauggcacauguauaccuauguaacaaaccugcgcauucugcauauguaucccguuuuuuuuuuuuuuugaagaaauuaaaaagaaagaaauuauauauauauauuucccuuuaauaguguagugugaucaauuauagggcuugauuuuagaacguuuaaucaauuugcauuuugaacuaaaacucauucggucacuauccuuuuuguauauuacuggguuuuuguauauuacuggguuugauuuuauauuuuguuuaggaguuuuauaacuguguucauuauaucaaccuauaauuuucucuucuaguaaugucuagcuuuugcucuaaacucuggcuuggccuuauuggauggauugggaaguguuccuuuuauuuuuauacuuuggaagaauguuuauacaauuuuuauuaucuuuggcuuguauguuuaaaagaguucaauggauucauuugggcuuggaguuuccuuacagauuaauuuuguuuaauagcuguaggacuguacaaaucuuuuuguuuauuguuucagguuuggugaauuggguuccucagaggauuuguucauuucaacuaaauucucaacugcauugcagugaaaauguucauaauggccucacaaucuuuuuuuuuuuuuuuuuuuuuuuugagacagagucucacucuguggcccaggcuggagugcaguggugcgaucucagcucacugcaaagcuucaccucccggguucacgccauucuccugccucagccuccugaguagcugggacuauaggcgcccgccaccacgcccagcuaauuuuuuguaguuuuaguagagacgggguuucaccguauuaggcaggauggucuugaucuccugaccucgugauccacccgccucagccucccaaagugcugggauuacagccuugagccaccaugcccagcccagccuuagaaucuuuuuaauguucacaggcuuucuguuuauggcucccuuuuuauuaucuauauuguagauucuccauuuuuuuauuggucagacuuauucuagggauuguucauuuuauuaaucuuuuaaagaaucaaccuuuggcuuuguuuucuuuuuuaugcauuuacuuucuauuuuauugauuuguuauuuaaacauuuuuaaauacuuuccuugaauuaauuuacuauucuuuuucuagcuucuugugauagaagcuuagaaguaguaauuuuucaacuugucuaauuuccaguaacaugcauuuagagcuaugaauuuugcuaaauaccucuuuaguuguaucccacacauuuucaucuauuguauuuucauuaucauucacauaaaaagacuuucuaauuuccauugugauuuuuauguuugauuuaugaguuauugaguauuguguuucuuuauuuccaaacauuuagaggaauuucuaguuaucuuucagucauugcuuuuuagugcaguucugcggugguuauaaaacgugauucaugauuuaaauuuuuuuaauuuguugagacuuugucuucuagcauuuagucuauuuguaaauguuucauauaugcuugaaaagaaugugaaagaaaaaaugaguuuuguaguuguuggguuuaguguucuguguuaguucacauuggaaaauugaauuguucaagucauauacuuacaguuuugucugcuuauucuaucagccauugagagggauuugcuaaaaucuacaacggugauaguggauuuaucuguuuuuuaguucuuucaacuuuauguauuuugaagcuguuauuuuuugcauacaaauuuuguuuacaacuuauugcauauaaauuguguuaaccuguuaauuugaugcuuuuaugaaacgucucccuuuauuucuaguaauaccuugugcuuaaggucuacuuugccugauguaauauagcuacgcuagccuucuuuggcuaguguuuacaugguaucaguuuuuguaauccuuccauuuucuaccuuuugguguuguuauauuuaaaguaugucucuuaggauauaguuauugcuuuuuauuuugagacaaguugcuuuucugucacccaggcuggaguacaguggugugaacauggcucacugcagccucgacauccugggcucaggugaucuucucaccucagccuguggagaagcugggaccacagguguauaccauuucaccuggcuaauuuuuguauuuuuuuuuacagaugggguccaacugucuugcccagucuggucuugaacuucugggcacaaguaauaugcccaccuuggccucuugaagugcuaggauuauaggugugagccacugcacccagcaguuguugguuuuuaaaucccugcuuauagucuuuguauuuuaauagggaucuuuaaguccauuuacuuuuuuuaacuaaaagaauucacaugccaugugauucacuuuuaaaguguacaauucagugguuuuuaauauauucaugaaguuauacgaaaaccacuguuaucuaauucuagaacauuugagaaagaaaucccucaccugaaaucccucaccuauuaguagaacucuccauguuuccaucuccuuagccucuggaaacaacuaauauaauuuuugucucuaugggcuugacuauucugaaaauuucauauauagagaauuauaugauuuguggucuuuugccucugacuuauuuuauuuagcauaauguuuucaauguuuaucccugugguagcaugaaucagcacuucauucuuuuuuaaugacugaauaauauuuuauuauguguaccuagugcauuuugcuuauuuauccuucaguugcugggcauuuugauugucccuacuuuuuggcuauuaugaauaauauugcuaugaauauucauguacaaguucuugguagacguguuuuuauuucucuugauuaaauaccaggaguagaauugcuuggucauuugguaauucucuguuuuaacauuuugagaaacugccagucuuuuccacaguggcugugccauuuuacauuccuucuaauaaugaaugaggggugugauuucuccguaucuuucccagcuagucuguuugcuuuccaaauuauuaaugugcuugaauuuaaguuuaccauuuuaauauuuguuuuuauuugccuuguuuuauuauuucuucucuuauucuuuauuuccugccuucucuuagauuaauauguauguuuuauuuuucaaaaaucuuuuccucuaucagcuuuuuaguuauacauuuauuucucguucuucuaguguucacuauagagacugcaacauauauuugacuuacauacaguauuccauaaaauagagcuuuucucacuucucaaccaauagagaaauccuaaacuguuugacugaauguacauuucuuauccuuuguguuuuuaauguguauauauuguuaacuucauaagacguuauuuuuauguuuauacaguauuuacuuauauuuccccacuuuugugcuuuauucuuuucauguguuuuuguaguuuuggaaucaguuuucuucaauuaggaauucucuuuacuauuucuuuuauugcagucucuuggugguaguuuuuuucagcuuucauuuguaaauaauuuguuuuaccugcuuucaaaaugguuacuuuggugaggcagaagauucuagguuggaaauauuuuuuccuuuuagcacacugaagguuaauuucauuauuuucucuuuuccauugaaaugucuucucccauuguaauuauugcuuauuggaagucaacuuuaaaaaauucucuggcugcuuuuaaggauuucucuuuguguuugguuuuuagcaguuugacuguaauuuaccuaugguuuuaauuuuuaaaaauucugcuugagguuuauagaauuucuuugaaucuuuaguuugaugauuucaucaguuuugaaaacuuuuagcauuuguuuucaaauauugcuuuugucacauucucuuguuuuaaaaaauuaucucccuuaucucugucaucaauuuagacauauuugagaucuuuuuuuuuaaaccaagucucucauccuuuauacuauuuuguguauuuucuguuccuuuuuuucucuguguucuucaauguggauauuuucuacuaaacuaucuucuaguucacuaacccucucuuuagcuauguuuauuguucuacuaaauguaucugguuaguucuuaauuucagauacuguauuuuucaguuuuaaaaugaacauuugauuuuauggcuuccaauucucuguugaaauucaucauuucucucuuauuuuuuacuuucauucaauugaacauauaaaucauaaauguuuuuagcaauuugauaaaaauuuaacuaaauucuucuuauguauuccucuucuccccauacuguguucagaaaaguaacugcuugucauccaucuaaucucagagaggcuuguguuuccauaguguuuaaacuaguugguugcccugagaccucaguuuucuguuguguccuagaaaaguuaagauuuucagauuaucuauuuuuuuuuuuauuauuacuaggcuaggggugaugcucuuuacagcuuucugcaucauaggcagaaaaucacaaaugccauuuuaaagucucuuucugauaaugcuaagaucugaaugaaaugugagucuuucugguuugacuauuuuuuuucucaauuuucacuaguucuuguuuuuuuaagcaugccucauaauauuuacuggauacuagauaaugugaacgaaagauuugcagagagucuggagaauguuuuuuccuccaaagacaguuaauuuuucuucucguacuucugauucugucaaggcuugguuuggggcuuuguuagaauuuuucuauugcuauuuuguccauacucuuaaggcauggcuuuuuuagagucacacauaagagcucagggguuuuucagugcuccuccaucuuggcagugcuugcuugccagcccaucuccucaccauugaugggcugccaaaaugucuacuugccucuuuacuugguuuguuuuggguuucuuggcauccuguccuacauauuuguaagcuuaggacucaguuaauaauuugaggugaauuuugcuguagauuucugggcucuuucucuuuaggucuuuuuugggggcauuuugcauccugaauuccucccuacuuugguaaucccagccuccaaccucugccuucucaucccacuaagauuacaguuauuaucuugggcucuauuucccaugauugauuugaaaaguuaucuuauacagaaagaaggauuaaauguggaaauugcuugauugggcuuuccuuaucucaaagcuuguagcccuggaugucccaucuguauugguugcuuucuguugccuucagacaagcuguuuuauauguuuugcccaacauucauaguuguucucauugaaaaugcuuauuugcugcacucugcuccauugauuggaaccagaaauaccauaucuuuucuuuauucugaaaugauacuaaugcuuagcacaguucuguaaauauugauucagaguaacuaauugcuguugcaaaucuuuucaagguucaaauuguguugaacugauaaaaaucaguuuuuauauaauaaccauggaccauaaagguuaacuagcuguaaaccuuauuuuaucuucuggaauaaaagcagguguuugguacauuaggagagaccucugaaagccagaguagaaauaaaggaucacugcuauucaguuaagcucuuuuagcuaaacuucaaaucugacauguaguuuuucugcucuuucaauugugaucauuggaaggcuuucauagaauuggaaauucuuaucagaaucuuucguguuuugaucucuaggaagaugaaguccucaguacauucugaagaagaugauuuuguuccagagcuacauagaaauguacacccucgagagcggccugauugggaagaaacucuuagcgcaaugguaaaucaguuuuauacaauuguucauauauacauauauauguauauauagcacuuauauaaggaaaaggaacugaggacacauuacacaaaaaauuuuguugcuuuguucauuuauucaggaaauauuuauugagugaauacuguauacuuggcacugucguagagucugugggcagaguaauaggguuacagagugguaaaaauacagugugaaaggauaggugcuaauuauauaggguagucacagauggccucugugggaagaugagguuugaucaaagaccugaaggaggugagggagugaguaguguguuuaucuggaaacacaucauuuuaggcaauggaagaacaaguuacaggcuguggcauaggauuagagaacaagucggaagaaacacaaauaggauaguguggcugaaacuggaugagaaagaaaugaggucagagaagugguuuggguggguggaaagcagaucgugcaguuucuuguacuuuauugaugaagacuuuugcuuuuuaugcuuagugagaugggaaaccauuggaggauuuuuggcugagcagugacacaaucugacuuaaaauguuaaagaagucucagguuacugugaguaggaggaggcaaaagaaguaaagagaaucuguguguuauaauuaguagguaaauagugaugguagcuugaaccaggaugauagcacauauggugagaauugguuagaugcuauaguuuuacugauaaagacagcuguugucaaugaauggguaauaagaguaugagaugaagauauauuaagaauggcuucaaguuuuuuggcuucgucaaccugaagaauggaauuuauaguacugagaugcuggaaaagcaguuuuuguugggggauagguggaaaaaucagcaguguaguuuuucacguaauacauuugagauacucauuuaguuuauuaaaacuuuuuguaacagaucuauuaauaagaaugaagaaauucuucuuuugugggagaggacauuuuacuuaacugugguuaagagucaguguucucugucaaaauaaaauggaaacauucaucuaucagugcugaucuguaaugauauuuuacuuacuucauuuuugaaaaugucuuucacucaggcacagcaaauacugacauaaauucacaaacauuuuaauugaacauauuugucacuaggaaggcauuuauagaauucuguuagauucucuucuugauauuugccuuuuagcauguuauugucaguuaaucaauuccaauuaaagauuagguggaaguucucaguugcacaguuaaauggaauuugcaguauggaaauuuacuuugcauuuucaugugaucugaaaaacccuacuggaccuguaguuugagcucagaaaaaaauauucacuacacauuuguaugggaauggaaaucucccuucuuguuuuaauauuugauaauuugggaugcauggacaguagcuugugauuacuugugauucucagaauacuaguugucauuaagaugacuuuaucgucaguguuucuuauauauaagcuauguuuucucuuguaauuguacauuaaguucaccaagaaauaucaucaagucugcaguaaaaacugauuagcaaagucauuuaguguuccguaauaaaugucaaaaauauguauaucuaaagccuuuuuguauuccacacauauuuuuaccaaaauugguuauaauguaucuuaguagauuccacuucagguuuuacugaauuaauguuugcucaaguuaugugagaauauucuugccuguaguugucccaugcugacuguucauaggagcuaauucuucagucauuucacacucaacauugacuccucaacaacaauagcaauauugguuccauuuuuugacuuaccaagagucaaggaaaaccacugaaaucauuugccuuguuuuuuaagugacuauugauuugcuuccaauguccucaacauuuuaaaaauauuauuauguguaauuuauuuuagauuuuuuuauuauuauacuuuuaaguuccggaguacaugugcagaacaugcagguuuauuacauagguauacaugugccauggugguuugcugcacccauccaccugucaccuucauuagguauuucuccuaaugcuauccuuccccuagcccccacccccugacaggccccggugugugauguuccacucacuguguccauguguucucauuguucaacucacacuugugagugagaacaugcaguguuugguuuucuguuccuguguuaguuugcugagaaugaugguuucuagcaucauccaugucccugcaaaggacaagaacucaucuuuuuuuauggcugcauaguauuccaugguguauaugugccacauuuucuuuauccagucuaucauugaugggcauuuggguugguuccaagucuuugcuguugugaacaguguugaaguaagcauacgugugcauuugucuuuauaguagaaugauuuauaauacuuuggguauauaccuaguaaugggauugcugggucaaaugguauuucugguucuagauccuugaggaaucgccgcacugucuuccacaauggcugaacuaauuuacacucccaccaacaguguaaaaguguuccuguuucuccacauccucuccagcaucuguuguuuccugacuuuaaugaucaccauucuaacuagugugaggugguaucucauugugguuuugauuugcaugucucugaugacuaguauugaugagcuuuuuucauguuuguuggccacauaaaugucuucuuuugagaagugucuguucauauacuuugcuaacuuuuugaugguuuuuuuuuucuuguaaauuuguuuaaguuccuuguagauucuggauauuagcccuuugucagauggauagauugcaaaaauuuucucccauucuguagguugccuguucacucugaugauaguuucuuuugcuguggagaaggucuuuaguuuaauuagauuccauuugucaauuuuggcuuuuuuuuugcuauugcuuuugguguuuuagucaugaagucuuugcccaugccuauguccugaaugguauugccuagguuuucuucuaggguuuuuaugguuuuaggucuuauguuuaagucuuuaauucauuuugaguuaauauuuguauaagguguaagaagggguccaguuucaauuuucugcauauggguauccaguuuucguaacacuauuuauuaaauaaggaauccuuuccccauagcuuguuuuugucagguuugucaaagaucagagggucguagauguguggcguuauuucuaaggcuucuguucuguaccauuggucuauauaucuguuuuggcaccaguaccaugcuguuuugguuacuguagccuuguguaguuugaagucagguagcgugaugccuccagcuuuguucuuuuugcuuaggauuaucuuggcuaugcaggcucuuuuuugguuccauaugaaauuuaaaguaguuuuuucuaauucugugaagaaagucaaugguggcuugaugaggauagcauugaaucuauaaauuaccuugggcaguauggccauuuucacaauauugauucuuccuauccaugagcauggaauaucuuucuauuuguuuguguccucucuuauuucauugagcagugguuuguaguucuccuugaagagguccuucauaucccuuguaaguauuuuauucucauuguagguauuuuauucucauagguaucaucauccuagguauuuuaucauccuagguauuuuauucucuuuuagccauugugagugggaguucacucaugauuuggcucucuguuugucuauuauugguguauaggaaugcuugugauuuuugcacauuaauuuuguauccugagacuuugcugaaguugcugaucagcuuaaggagauuuuggguugagacgaugggguuuuuuaaauauacaaucacgucaucugcaaacagagacaauuugacuuccucucuuccuauuugaauacccuuuauuucuuucccuugccugauuucccuggccagaacaucuaguacuauguugaauaggaguggugagagagggcauccuugucuugugcugauuuucaaugggaaugcuuccagcuuuugcccuuucaguaugauauuggcuguggguuugucauaaauagcucuuauuauuuugagauacauuccaugaauaccuaguuuauugagaguuuuuagcaugaagcaguguugaauuuuaucaaagggauuuucugcaucuauugagauaauugugguuuuugucauuaguucuguuuaugucauugguucuguuuuguuauugguucuguuaugauggauuaugcuuauugauuuucauauguugaaccagccuuguaucccaggguugaagcugacuugauugugguggauaagcuuuuuaaugugcuccuggauuuggugugccaguauuuuauugaggauuuucacauugauguucaucagggauauuggccugaaauuuaguuuuuuuguugugucucugccagguuuugguaucaggaugauguuggccucaugaaaugaguuagggacgagucccucuuuuucagguguuuggaguaguuucagaaggaaugguaccagcuucucuuuguaccucuaguagaauuuggcugugaauccgucugauccugggcuuuuuuuuuugguagguaggcuauuaauuacugccucaauuucagaacuuguuauuggucuguucagggauucgacuucuuccuaguuuaggaaggugucuuccuaguuugggaagguguauguguccaggaauuuauccauuucuucuagauuuucuaguuuauuuguguagagguguuuacaguauucucugauuguaguuuguauuucugugggaucagugcuaauauccccuucaucauuuuuuauugugucuauuuuauucuucucucuuuucuucuucauuaaucuggcuagcagucuauccauuuugcuaaucuuuucaagaaacuagcuccuggauucacugauuuuuuuuaaggguuuuucaugucucugucuccuucaguucugcuccuuaguuauuucuugucuucuguuagcucuugaauuuguuugcucuugcuucucuaguucuuuuaacugugaugauaggguaccaauuuuagaucuuucccacuuucuccuguggucauuaaugcaauaaauuucccucuaaacacugcuuucacuugucccagaaauucugguauguugugucuuuguucucauugauuucaaagaacuuauuuauuucugccuuaauugcauuauuuacccaguagucauucaggugcagauuguucaguuuccauguaguugugcgguuuugagugaguuucuuaauccugaauuuuauuuugauugccuauuguuugggagacuguuaugauuuccauucuuuugcauuugcugaggaguguuuuacuuccaauuauguggucaguuuuagaauacaugcgauauggugcugagaagaauguauagucuguugauuugggaguggagaguucuguaaaugucuauuaggucuguuucauccagagcuggguucaaguccugaauauccuuguuaauuuucugucuuguugaucugucuaauauugacaguggaguguuaaagucucccacuguuauugugugggagucuaagucucuuuguaggucucuaaaaacuugcucuaugcaucugagugcuccuguauugggugcauguauauuuaggauaguuagcuucuucuuguuacauugaucccuuuagcucuugucuuuuuugaucucugugguuuacagucuguuuuaucagagacuaggauugcauucucugcuuuuuuuuuuuuuuugccuuccauuugcuugguaaaucuuccuccuucccuuuauuuugagccuaugugcgcaugugagaugaaucuccugaauucagcaccccgaugagucuugacucuuuauccaguuugccagucugugucuuuuaauuggggcauuuagcccauuuacauuuaagguuaauauuguuaugugcgaaauugauccugucauuaugaugcuagcugguuauuuugcccguuaguugaugcaguuuauucauaguguugauggucuuuacaauuugguauguuuuuguaguggcugcuaccgguuuuuccuuuccauauguagugcuuccuuaaggaguucuuguaagacaggccugguggugacaaaauuucucagcauuugcuugucuguaaaggauuuuauuucuccuuugcuuaugaagcuuaguuuggcuggauaugaaauucuggguugaaaauucuuuuuagaauguugaauauuggcccccuacucucuucuggcuuguacgguuucugcagagcucugcugucagucugaugggcuucccuuuguggguaaccugaucuuucucucuggcugcccuuaacauuuuuuccuuuauuucaaccuugguguaucugacaauuaugugucuugggguuguuuuucucgaggaguaucuuugugguguucucuguauuuccugaaucugaauguuggccuguuuugcuagguuggggaaguucuccuggauaauaucuugaagaguguuuuucagcuugauuccauucuccucgucacuuucagguacaccagccaaagauagauuuggucuuuucacauagucccauauuucuuggaggcuuuguuuguuccuuuucauucuuuuuucucuaaucuugucuucacgcuuuauuucauuauguugaucuucaaucucugguaucuuuucuucugcuugaucaauuuggcuauugauacuugaguaagcuucacgauguucuugugcuguguuucucggcuccaucaaguaauuuauguuauccucuaaacugguuauucuaguuagcaauuccuuuaagcuuuuuucaaaguucuuagcuuccuugcauuggguuacaacaugcuccuuuagccuggaggaguuuguuauuacccaccuucugaagccugcuucugucaauucgucagacucauucucugucugguuuucuucccuugcuggcaaggaguugugaucccuuggaggagaagagguguucugguuuuggaauuuucagccuuuuugcucugguuuuuccucaucuucauggauuuaucuaccuuugguguuugauguugguaacuuuggaugggguuuauguguguacguccuuuuuguuaauguugaugcuauuccuuucuguuuguuaguuuuccuucuaauagugaggccccucugcugcagguuugcuggaguuuucuguauguccacuccagacccuguuugccuggguaucaccagcagagacugcagaacagcaaaguuugcuguguguuccuuucucuggaagcuucgucccagaggggcacccgccagaugccagcuggagcucucuugcaugaggugucuguugacuacugcugggagauguuucccagucaggaggcaugggguucagggacccacuugagggggcagucugucccuuagcagagcuccagcgcugugcugggagauccauugcucucuucagaguuggcaggcaggaacguuuaggucugaugaagcugcacccacagccccaccuucucacagguacucugucccagggagaugggaguuucaucuacaagccccugacuggggcugcugccuuucuuacagacauguccugccuagagaggcagucuggcuacaguggcuuuguggcucugugguuggcucugcacugucccaacuucccaggggcuuuguuuacauugugaggggaaaauugccuguucaagccucgguaaugguggacgacucucccccuaccaagcucgagcaucccaggucgacuucagacugcugugcuggcagcaagaauuucaaggcaguggaucuuagcuugcugggcuccuugggggugggauuggcugagcuagaccacuuggcugccuggcuuuagcccccuuuccaggggaguaaaugguucugucuuguuggcauuccaggcgccacugggguaugaaaaaaauacuccugcagcuagcucggugucugcccaaauggcugcccaauuuugugcuugaaaccaggguccuggugguguaaucaccugagggaaucuccuggucugcagguugugaagaccaugugaaaagcguaguauuuggaucagaaugcaccguuucucacggcacagucuucucacggcacagucccucacaucuucccuuggcuaggagagggaguucccugaccccuugcccuucccaggugaggcaacgccccacucugcuuuggcucgccuuccaugggcugcacucacugucuaaucagucccaaugagaugggucgaguccugcaguuguaaaugcagagaucacccgccuucugcauugaucucgcugggagcugcaaacuggagcuguuccuauuuggccaucuugccagccaccucccaguguccucaaucaacucuuuaagcaacuauucucaccaguagauuuaaaccaauuuguuuuuuuuuuugacacauuucuuuuacugcugcaaucaaaugugauuugauaaacucaccauugguaaaugacuuuccuugcuugcugauaaaugaacuacuaggaaauguacuuagguugcaaucuuguuauuuuuuaugaagaaauucuguguggugauguacucaguuuuagaauuuucuaauuuuucagaguguuacuuuccugugaguugagaauauuguaaugagugcauaguuugguagugucaauguauauuccauuauuuuagcacagcuguggugucauuguaugauaaacacaauguuuugugaucuaauuugauaacaaaauaauagauauucaccugugccuuaaaaguaugacacucaaaguccaccucuuucuucuuuucuuauuuuuauuccuauguauauguauugguaauuuuaaaaaaugugguaugauaauacacguggaaauugaaaugcuguucaguuguaauuugauacuguauagugugccacguagcaguggggauugaugggagagccacauguggucuuuuugcagcuauucaccucugccauucuauugugaaaacagcuggaaauaauacauaacaaaugagugugacaguguuccaauaaaacuuuauuuauguauaccaauguuugaauuccauuuaguuuucaaaugucaguagucauuguuuuuugacuuuucuccccaaacauuuauaaauguaaaaacuacuuuuagcucaagggcuauacaaaauaggugauggacuggauugacucuugauuuucaacuccuucuuuaucauacaauuuuuuuuuaaauguuauuucaguaguuuuuggggaacagguggcuuuuaauuacauggguaaguucuuuagugguuguuuucugagauuuuggugcaccugucacccuagcaguguacauuguacccgauguauagucuuuuguuccucacucaccucccacccuuccccucgagugccaaaguccauuauaucagucuuaugccuuuguguccucauagcuuagcucccacuuauaaguaagaacauaacgguauuugguuuuccauuccugaguuacuucacuuaaaauaauggucuccaaacccauccagguugcuacggaugccauuauuucauuccuuuuuguggcugaguaguauucuguaguguauauauaccacauuuucuuuauccacuuguuggucaagggccaguuaggcuguuuccauauuuuugcuguugcaaauugugcugcaauaaacaugugcaugcaagugucuuuuucauauaaugacuucuuuucuucuggguagagauccagagguggaauugcuggaucauaugguaguucugccuucaguucuuuagggaaucuccauaccauuuuccauagcgguuguacuaguuuacauucccaucagcaauguaaacguguucccuuuucaccacauccaugccaacaucuauuauuuuuugauuuuuaaauuauggcuauugcugcagaaguaagaaguuaucucauuguaauuuuaauuuguauuucccugauaauuaguaauguggagcauuuuuucauguguuuguuggccauuugucuaucuucuuuugagaacugccuauuuauguucuuugccuacuuugugaugggauuuuuuuuuucuugcugauuuguuggaguucuuugugaauucuggguauuagcucuuugucagaugcauaauuugugaauauuuucacccauucuguuaguugucuauuuucucuggugauuauuucucuugcuguagggaagcuuuuuaguuuaauuagguccugccuauuaauuuuuguuuuuguugcauuugcuuuuggguucuuggucuugaacucuuugccuaagccaaugucuagaagaguuuuucugauauuaucuucuaaauuuuuaugguuuuaggucuuagauuuaagucugauccaucuugacuugauguuuguauauggugagagaugaggauccaguuucauucuucuacauuuggcuugccaauuaucccagcaccauuuguugaauagguaucccuuacccaauuuauguuuuuguuugcuuuauccaagaucaguuggccauaaguauuuggcuuuauuucuggguucuuuauucuguuccauuggucuacaugccuuuuuuuaaauaccaguaccauacuguuucuguaacuauaaccuuguaguauaguuugaaguugaguaaugugaugccuccauguuuguucuuuuugcuuagucuuucuuugucuaugugggcucuuuuuugguuccauauaaauuuuagaauuguuuuuuguaguuuugugaagaaugaugcugguauuuugaugggaauugcauugaaucuguagacugcuuuuggccguauggucauuuucacaauauugauucuacccauccacgaacaugggauguguuuccauuuguuugugucaucagugauuuuuuucagcaguguuuugcaguuuuccuuguagagauaguucaucuccuugguuagguauauuccuaauuuuuuuuuuuuggcagcuguuguaaaagggauugaguucuugauuugauucucagcuucguugcuguuguuguacagcagugcuacagauuuauguauauuaauuuuguuuucugaaacuuuacugaaucuauuuaucagaucugggagcuuuuuuagaugagucauuaggguuuucuagguauaugaucauaucaucagcaaacagcgacaguuugacuuccucuuuacugauuuggacaccuuuauuucauuaucuugucugauuguuccggccaggacuuguagcacuauguuaaauagaaguggugaaagugggcauccuugucuugugccaguucucaggggcaaugcuuucagcuugucccuauucaguauaauguugguuguggauuuaucauaguuggcuuuuauuaccuugagguaugccccuuuuauuccaguuuugcugaggguuuuaaucauaaagggauacuggauuuugucaaaugcuaguucugugucuguugagaugaucauaugauuuuuucuuauaaauuuuguguaugugguguaucacauuuauugauuuagauguguucaaccaucugugcauuccugcugugaaacccacuuggucaugcuguaucauauuuuugauauucuuuuggauuugguuagcuaguauuuuguugaggauuuuuguaucuguguuccucagggauacuggucuguaguuuucuuuuuuuguuauguccuuuccugguuuugguauuugggugauguuggcuucauagaaugacuuaggaaggauuuccucuuucucugucuuuuggaauaguuucacuaagauugguaccaauucuucuuucagugucuuauagaauucagcugugaaaacaucugguccuguacuucuuuuguuggcauuuuaaaaauuacuguuugaaucucacuacuuguugaacucugaacagacuacuugguguguacagaguuucugauucuuccugguuuaaucuaggaggguuguauauuuccaggaaguuauccaucuccucuagguuuucuaguuugugcacauaaagguguuaauaguagccuuggauaaucuuuaguauuucuguguuaucaguuguauuaucuccuguuucuaauagaccuuauuuggaucuugccuccucuuuucucgguuaaucuugcuaauggucuaucaauuuuguuuguucuuucaaagaaccagcuuuuggcuucauuuaucuuuugugugguuuuguuguuguuguuuccacuucauuuaguucagcucugauauggguuauuucuuuucuucugcugaguuuggguuugguuuguucguguuucucuguuuccuugaggugugaccuuagauagucuguuuucacucuuagccuuuuugauaugggcauuuaaugcuaugaacuuuucucuuugcaccguuuuugcuguauaccagagucuuugacaaguuaugucaguauuaucauucagcucaaagaauuuuuaaauuuccauguugauuucauuguugucucaaagaucauugaagagcagauuauuuaauuuucguguguuuuuacaguuuuggguguuccuuuucgaguuaauuuccagcuuuguuuuacuguggucugagaggauacuugauauaauuuagauuuuucuuaaauuuauagagacaugugaccuaucauuggucuaucuuggagaauguuccauguacugaugaaaagaauauauauucugcaguuguuggguagacuguccaguaaauaucuguuaaauccauuuguucuaggguuuaguuuuaagucuauuguuucuuuguugacuuucuguacuuuguaguacugucaguggaauauugaauuuccccacuauuauuguguugccaucuaucucauuucuuaggucuaguaguaauuguuuuauaaauuugggagaccucguguuaagugcguauauauuuaggauugugauauuuucuuguuagauugauccuuuuaucauuauauaaugucccucuuugucuuuuuucuacuguuuuugcuuuaaagucuguuuuuuucugguauaaaaauugcuacuccuccuugcauuugguuuccaucuguguggaauaucuuuucccaccccuuuaccuuaaguuuuguugaguugucaccuuaggggagucucuugaagacagcaaauaaucgguugguggaauuuuuuuuuuuuuuuuaauucauucugccauucucugucuuuuaagugagcauuuaggccauuuacauucacuguuaguauugagaugugagguauuguucuauucaucaugcuaauuguugccuuaauauguuguuuuucauuauguuauugucuuaugggcccugugaaauuuaugcuuuaaggagguucuauuuuggugucuuucaguguuuuguuucaagaucuagaacucuguuuagcauuucuuguagugcuggcuuaguaguggcaaauugcuucaggauuuuuuugucugaaaaagacuuuaucucuccuucuuuuaugaggcuuaguuuugcuggagauaaaauucauggcugacaaauauuuuguuuaagggggcuaaagaugggaacccagucucuucugauuuacaggguuucuucugacaaaucugcugguaaucugauagguuuucuuuuguagcuuauuugaugcuuuuaucucacagcucuuaagauucuuucuuucgucuuaaguucugaguggggcacugcaggagccaggccagccucaccaacuaugagggauuuagauaaccugaugacugugugugcaggugauuuuuuugcggugaauauuucagguguucuuugagcuuuuuguauuuagaugucuagaucucuaggaaggccaaggaaguuuuccucaauuaacccuacaaauaaguuuucuaaacuuuagauuucuuuucuuccucaggaacaccuauuuuucuuagguuuggccauuuaacauaaucccuaauuucuuggaggcucuguucauuuuuuuauucuuuuuuuuuuuuuuugucuuugucagauuggguuaauuugaaagccaaaaguuaauuuggguuaauuuucuucaagcucugaacuucuuucuucuccuuguucucauauauuguugaaacuucucaggguguuuuguauuucuguaagugugucuuucauuuccagaauuugugauuguuuuuucuuuaugauaccuauuucucuggagaauuuccuaucuauauccuguauuuucuaaaaaaauuucuuuacauugguuuucacauuuuucuggugucuucuugauuagcuuuacaaucaaccuucugauauuuuuuuuuucuucuggcaaaucagagaguucuucuagguacagauccauuguuagggagcuggugugaucuuuuggugguaguguagaauccuguugugucauauucccagaauuacuuuucugguuccuucucauuuugguagucuguuuaaguggaaagguguggaacucaagucuuaauguucagauuuccuugucccauggggugaucccuugauguggugcucucccccuuuucuugaggauggggcuuccuaagagcuggacugcagugaaucuuauuucucuucugggucuagccacccagcaggacuaccaggcucugcgcuggugcuagggaaugucugcaaagaguccugugaugugaucugucuucaggucucccaggcauggaugccagcacuugcuuggauggagguggcaggggagugagguagacccaguccuugguuguagauacguuuagugugcuggcuuucucgaaugcugguuaugcuagcaguaaaguugucaaauggagagacuaaggaccauugguuagccaggauguugugggcaguggaauuagcuauugucuucuucuuccuggcagcaagauuauucugucauaaguugcuguuauggcccaaguagauuggccuccagccuguggguggcauuuucaaaagagcaucagcuauaguaguaguagggggaucugugcuugcccugcauuggccaggauaaggauuuuaguuugucaggugauggauggggccauaaagcccccaagaguuucuaucuuuuguguuuggcaaccauggaaaauagagaaauaccaucagguuggggcugguuuagguggguccaagcuuagacuuuccuugggugaggcuugcuguggccacuguaggggauugagggggugguucucaggccaaugggguuauguuccagaggggcuuuugguugccucuguuguucuauauaguuucucagggaaaugggugauagcuguagcaagaggccuuacccaacucccucauaguuggugaggcuggccuggcuccugcagugccccacucagaacuugccccaggcugugagcuuuccugcugagaaagcaagcauggcuuucccaccuugccccucccugucugucaccaguggcuccuacguuuguaucugaagcaauuccuguuugccucccagauucugcucaaggaaauucacgcccagucagaauuacuacuuauuucaguaggaagcuuucucuguccugugaucccucccuaauucugcugccugccuucccugaaggccccugugagguauaguuggggauggcuucccugggcuugagcuggagacugggaguacaugcaagucacuuccucucacugcuguuuccacuuuuauguuuuucaugaguccuuaaauuuguuuaagcucuagguaaguuuaaaucauuuuccuguaaucuggauuuauggauucuccagugggguuguguguucagaggcagguuuucucccucucauacuuugggaacucaguuuuuugccuguccugugcaauuugcaguggcaugcugcuucauucaaagaucuuugaauucuuuugauuuuccugauacauuucuuuggugguucuuggagcaaaagaucaugguaaagaucaugguguucuccacacacuguucugucuguccaagugggagcuacacguuagcauugucugcuauccaccaucuaucuugucccuaagucuauucauguaaguaacuuaagauguaaggcuuuccuaaaaguuucagaugggaaauaguuuuauuucacuucuuauaguaugcuguuccuaucuguaucaugaugcuuuccuuauuguauuaaucuaguugaauaguaaugucuuugucucccuacuagguugugagcucuuugaggaaggguaggggucaucuuguuuucauuuuauugaaggauaaaguuuaaaagaggauauaaucaugacucucauagaaauauagaaugagcacaagccaaagauauuuaacucauuauuaaugaaagaacaagucaguuguuaaaagugguucaaaggagaauucaaaaauuaccauacucuuauagagcaaccauucuaaaaugcaugcauauggauguaaaucuggcaaaacuguucuguuucacuggguacaguuugcauuucuguggauaggaaugaucuguauuacucucauuuuucuauaaggcaaguuccaucucugcagaguuguaaaauagcugaaucaaaagacaaacaaaaucccauacgccuauggaaucaggcaauccucagaggugccagcauuccagggaaagaacauucaguaacuuuuuuugccucuuuuucaauccccuacuuuuccuacaauuuuuaaaucuucaguaaaucuguauugaauuuacugaauggaacaaaggugacauuaguauuucaugugauggucuguuuacucuguauuaaaaugucauaugcuguauacauaugaaauuacugauuucacuucuggaauccacagugaauugucuaagcacuuauggaaaauacuauuuauauaauacauuuuaacaucucauuauauucuuauuuuauacucuuauuaauuucuuuauguguaagcuccuugagggcaggugccauaaucuuucuucuauuuaaaaaaauaaagcaucacucugaauaaauaagugcaaugcuagguugcaaaaguguguagugaaugaugaaaacaguauaaaugagauuagagccacaauuuuacuaccauuucucucaaaaaucauacugauuuuaagcaauaaguaaguuagggacccuuuuuucucaauaauaaucuaagugaaauauaacuuugagagugaaauuuuuuauuuagggagcccuuuauggaguauuuacacucaauuccauuugguuaauuuuuuaaauuacuucagagauaaaagggcuuaaguauuacauuuuuauugauuuguguuaugacaucagaauauuaguuuuuuaauaaacauaucuaaaaaggagcuggaaauuuuggaacuuaaaaauuuaaggaguuuuauauuuauuauagucauuuaaaaaucaaaacaaugguaaaaaccuaaaauggggcucuauccuuuuguaauuuaugguuauguacucuucauaaaucuguaacuagauucaguauuucaagaaaucuaauaaaaugcuauaguuuuucugaauuacuaaaaguaaaauauuuacaguuuacagugagauuguuuaucaauuaaauauuaggcucuuucagaaaauaagauauuaaaauuaugaagagaaagaaaccacggagaguacugaacccuguauauacuaauguauguguagcauauacaauguggauaugcuggugaugauucauguccuggccaagacagagcauaauacugcaagauuucauugcacuauucgaaauggcacacaguuuaaagcuuaugaauuauuucuggaauuuuucauuuuacauuuuuggacugcaguugacuguggauaacugaaaucauagauaaggugaaauuuagacugguucuuuuuaacccaucaacuuguaaaaacauuuucaauuugaauaaaagaaaaaguauuugcaaauguuuuuuaaaucaguauccuuagcucuuuuauuccugugugauguuuaacuguuuauuuugauuuaugagugaauuuuaauucagaggaccuagugauguuuaucaucucagucuuuaaaagcggaauguuuuauguuauguugcuuugugaaccaucacaaauguaaccauugauuaauaugcaaagcccagguuuugaauuuuugccaguuuguuuggagcucuucaguaaacaacuguuaagucugucucuauccuauccucucccgugguacgucuucucuggcuaaagauucuaugacuucucuggcuaaagauucugugacuucucuggcaugaaucaagugguauuaauuauugaaguuauuuaauacguuacugagaacucugauaguuggagucuaugaaauugauaauuuuauaggucaaaauuuuaacaauuggcaguuucauaacguaaggccuauaaccguuugaauuguugaaccaaugcuuaagcaugugacuauuguuaaucauuaaacugaaaacuauauuucaagcaugcucuuuaaguuguuaggugaucuggauguugcuuuuacugauaugauuuguuguauagccuuucaaaaaauuuuuaaaacuuacaagauauucaaggaaaaaacuacaugaaacaugcagguggagggacaaugguucuucuaggucuuacuuggagugucaugguggucuaggaucuugcuauuucuuccuuuauuagaaauuuuucaaaauaaacaucuaguuuguggucuuucuuuucuucuacccuucuucuauucauacucuuuucccagaauuuauaucauuuauauuuauaauauaucuuuaaauauugcaugcacauuuuuacuaguaaaucuaauguacacagaauucaaguguagaaagagaucaguaucauuuucuagcagcgcugaagacugacaauaacuuaccauaauaaaguaccuguaaagguaaaguucuuagaguuucauaggaaccuuuguauaaaaugucugguaaaauuauauacauuguuggaacccuguauuuuuagcgagccuucugaauuuaggaguaucuuuaaugauaagggacugagaugaaggaaaggaugaaucucaguuauagaaaaguauaacauuuaaaagcuuugcuaauauguaaauguguuaauuuuagguugauuaaccagcuguugccuagcagaggaguugugauuauuaugcuaauggugcuuucuaauaguuuuuuccaaauuauuuuaaauaucgccuccgaauaauuuuucccugugguuaauuggcucucugaggagauauuuucuagaagugaaguuuaaggcaacacccuugcugcagaagagcuaguuuuauaaucacuuucagaaaucauguuuuuuccuucagucuucucauccuguuguucccacucaaaauagagaauugaauaagaauagugauacaauuuacccuuggggcuuauuugauggcuauuucuguguuugugaauuaccagcuacugaaauuuaccugucaccuucuuugauuccuguuucugguuuuuggcacuuccacauugguggugcuagauaacacaugggaggauguguuccugagccuggucuguggugcccagauauuaagacauuaggaaauauuccccauuuagcacuauuuuuaguucagagcucuugaguuuucuuauaugugaaguguuuuuuuaguaaaauugcuaggcuguuaucaagucugauggaggugcauaacgcugaaaagaauuuugagagaaaccacuaaacagcauucacagauucgauuuagaaagugucuguguauuuuaaauaauuauugccauauucuguggagacucauaccugaacucacaauauauaaacauguaaaagccuaauuauuuuuuuccuuaguacuguacagugaugauuuuucuaaggaccugcaacaauuuugaauaaguaaagaaaauuguaguuuguuuuuagcauuaagucuauuuuguuauaucaaaauucuuuugcggauauucacacauguaacucaguuauuugaauuccuugugacauacuuauuuuuuaagaaucacuuuaguaacauuguuguucaaaauaauauaacacaguuuuaauaaaucuaucuuucugaugguacaauaguuuccuuccauccaaggggaauauguuccaagacccccaguggaugccugaaacugcagauaguaaugaacacuauauauacugugguuuuucuaguacauauguacuugauaaacuuuaauuuauaaauuaggcacaguaagagauuuacaauaacuaauauaaaacagaacaguuauaaugauauacuguucacaguuucauggauagaagguucauucuuccuguagaucucagcagccucaguguaugauuucuuuucuuuccuuauuaaguugagaacuucaccuuuucacuuacagaagcacuuuccagcuccucuuugucauauccauguuggcagcaucacuccucuugugcuuuggggcuauuauuaagucaaagaagcgugaguugaauacaagcacugcaauaccaugagaguuggucuggucacugagaugacucccaagugagucaccggcggguaguccacaguguagaugcacuggacaaaggaaugauucauguuccaggcgggacggaguggggcggugcgggacugugugagauuucaucacauuacucagaacugcaugcaguuuaaaacuuauacauuguuuuuuucaggaauuuuccauuuaguauuuuuugaccgagguugaccauggguaacugaaacugugaaaagugaaauaacagauaaaggaggacuacuuauuggauuuccccuacauugucucuguucuuuuuaagaaaggggacaauacuuagaccaaugguaaaaucuucuaaaacaugucauuucagaaauucauuauguguguuucuuaugguuaaacugcaggaaacuggcaguccuguuugccuuucuugacagcacaaauuuuguaucaaaaucucguuuauucaguugauuauauauauauauauaugcaguuuuaccagcauauagacagcugcuauuuuuuuuucuauuuaagaggccaaauuuuuuuccccuucaucacuauauuuuaagcagaaaugauauuuuugucaccauuucaagaaauauuuauaacauuaaucuaaagcuucugugaccucugucaaauucugacuacaaaugauaaagauaauacaauaaauaaaauuugaaucuguuaaaaaaagugaaaaguggcaaaaagucacuuuuuccucagaauuauuuucagaugcuuuuuguuagccuuauacagaaagaacacuuugaucaagucuuauuauacuuuccccaugcauauuuuagugguuuuuuuuuuuccuuuaagaaaaagagcaauccugguccacuuugauagcagcauauacuuaacacugauugcauuuugauguccuuuaugaauguguauugggugauauuauuucugauuuuccauggcaauuucagauguuuuauuguucuuaauuauuaacuacucauuuugauuaguaguuugccuuucaugacaguacaaauuuaguauugaaaccuuguuuauucaguugaucucauguauauaaauauacauauguauguuauuugacuacggugccuugucaaaguaugagagcguuuuauguaaaugaaccuguacuguauauguaauuaugucuguacuguucaguaauuaaugucauagaucuggaguugggacauccuaccuucugucugcucuguucucuacuguaggaggccgauccuggcaaauaacauuucucaggcuccuuugccagcaggcuuuuggcucgguuuggcaaaugggaagcacacguggaagacaggagggcggaaagaggggaagagccgggguauuucuuccucucuuuuucugccuugagaggggucuccacuacuguucagauagcuuauaucagauaacucauaauuugguucagugauuaacaaaaaaaucuuuuuuacuacuauaacaugggcaaauuucuucauagaagcauuuuuauucuuguucuuuccugaccauaaauaugaaugccuagcuuugcacauuguaguuauauagauuaucuaaucucauugauuuaugacagguuguuuuacauuugcaaaugguugcuguaaguaauacgcagaggaggaagaagcuagcuugugacuuucucuuucucucuuuccuuuuucuuucccuuuaucucuuuugcccuuucccuuguaaaaauaaaacauacagaaaagugaaaagaaaaaaaaaagaggcuuucccauaauccuauuucccaugguggugagauuauuuugguauaggcuuuuuacaaugcagagaguuuuuuuuuuugauuuuauauauuuuauuuuuaauuguaauaaaauacacauaguauuuaccaucuuaaccauuuuuucuuucuuuuuuuuuuuuuaauuauacuuuaaguucuaggguacaugugcacaacgugcagguuuguuacauagguauacaugugcuguguugguuugcuggacccauuaacucgucauuuacauuagguauuucuccuaaugcugucccuuccccaucccccuaccccaugacaggccccggugucugauguucccugccuugugucuauguguucucauuguucaauucccaccuauaagugagaacaugcaguguuugguuuucugucccuugcaauaguuugcucagaaucaugguuuccagcuucauccaugucgcuacaaaggacaugaacucauccuuuuuuauggcaaugcugagaguuuuuuaacagaacauccguauaagcacauuuuuccuuauacaaaugucuucaaaugguuaguuucaaagaauauugcuuugggauauauucuccuuucccaucaugucugggaauaugauuuuuaaaauaauuauggacaauauacaauuuuauauuuccuugcuuuuccauuuaaacauaagcauucuaccugauuauuaaggugcugugcagugcaggugaaacuucauauucccuauuguauauuaugggaguugccauagguaaaggaauuggcaguuucacuggaaggaaaauaucucugaaaaagacuggcuaguggacacagugguagacaccuuggaagggggaauuaaaaaacguugccauggaaagggaaaggaauuaaauuuuccucccuuuagggggaaagaguguugucuugagaacugcagaaugggauguggaacagauuguagacuucacacuuaaaaugcaagauugccagggagauaggagagcugguuauugaacugugucagaucuguguaccucccuccaguuaccuaucucaccugcagaauuugcuccuuccucuaggauuugccuucaagugcauagcuuacuccuuugaggaagccuuaagaaggugguuugggaugguacugaagucauugcauucaaugggguccugggagugcugggaggcaaaagcuucugaggcuuuacaucccaaguccugggaaagaguuuuacuuccaugagagauaaaggagcauauaaaaucugagagcacucagaaauuccuaaggucuuagauguuguuaguauuuguuuuuuguugaauauguauaagaaauuaucacaagcuuaagggcuuaaaagaauacccauuuauuaucucacaguucugcauguuagaagucugggcaggcuuaacuggguucucugcucagggucuccuaaagcggaaaucaaaguauuggcugggcuggguucucaucugcagauucuguuggcagaauccaguuccuuaugguuguagaucugaggucccuguuuccuugcuggcugucauugugggaggugugguggcauaacuuuuaggggcugcaugaauucccucucaugugacccccucaggcuucaaagccaggggugguacuuggugcuucaaaucuuugacuuucccuucugcuaccagcuggagaaaacucuacuuuugaagugcucaugugauuagauuaggccuauccagauaauuuuuauauuuuaagaucgacugaccugggauuuuaauuacauuugcacccucuauucucagcaguaccuagauugauugaacaaccauggggugggaaucuuggggggcaagggagacccucuuuagaauuuugccuaccacagucuuacauguuuucucugguauuuauacuucauaauauauuuaacgugauaacauugauauauuaguuuguuuucaugcugcugauaaagacauauucgagacugggaagaaaaagagguuuaauggacuuacaguuccacauggcuggggaggccucacaaucauggcggaaggcaaggaggagcaagucaugucuuaacauggauggcggcaggcaaagagagagagcuugugcgggagaacucuuuauaaaacugucagaucucgugagacuuacucauuauaacgagaacagcacaagaaagacccgcccccuaugauucaauuaauuaccucccacugggucccucccaugacaugugggaauugugggaguuacaauucaagaucagauuuggguggggacacagucaaacgauaucaauugacauuugucaauggaaauuacagauauuuuagaaauuuuaauuucacuaauauaccauaaaaucgauugggcaggggaagcauauauauaaucuguuguuguugauguuaaaugaaaauguugauaaacauauuuaaugacuauacaguaauaggacauauuauugcuguuuaauuaauaagacugaguuuuguuauauauuuuucauuuagauuaauaccuuuaugaugaguuuugcuuuuucuuuuuacuauuauuuuauagggaauuacuuaacuaauuaauauggagauucccaaauuacuugccaaaaggguuuuauuaauucauauucuaauaaguaauguuuagcgacuuuugugccauuguuuucagucuuagaaaguuuuaaaauauaaaauuuugauaagaggaaagcuauuucucauuguucuaauuuuuuauuuuuaaaacuucauuguuucugaacuuuuuauaugccuguuuuagacaugguagguuuugugauaaaaauccaguucaaauucugugauuaacacacuaugcaaaucucuucuuucuuggucucaguuuccucuuuacaguggaaugucuaaaugaguuaucuuucaacucugugauuauguugaacaucucucaauacgcuauuuuguuuucuuaguuaaaaauugguaauacucauugguguucuguuaauaccugucaguauggaguuuauaguguuuugaaaggguuagacacauaaauaauauggagaggaugggcuugugguggggcugaauguagaaguagccagcuuugugguucuguaucagaacacaguguguuaaacuacuuuuaagucaguuuacaguuacccagucaauauuagcacuuugaauaugggaccaagauaacaagcuauuugaaagauucuuuaaagggucuguacaguggaggaaugguagaauauuuuuuuggauuaggaaacagugaaguagacagaauaaaacauugcuaauuccuaguuuugcaaguuuuccauaucaaauuguauuuuccugaaauggaugaacuguucucuaugugguuuaacugguucagauuauagggauacaaauauuucccuuguuagagaugcucuacuuuuuaagacggcauuguucuuuuuuuuuuuuuuuuuuuaccaguaaggguauacuuguggcuuauauuaagcuugugguaaacuauagaucucagaucuuguuacaugaauucuugucaaacaguuugcuccccauccccauacuuauauaauugaauuuugaauuuaaauucagggcuucaguuuuuauuauugauaaacuucacauucauuugguuugucuuggcagcuuuuaaaaaucucuuugaauucugucacucaguuugugaauguccauuucaguuuucuuuuaucuauaaauuugauaaauguaugucauauauuuuaaugugcuuuuauuaaaauguuaagaaaagaauaaaaaagcccugugauauucuaccuccuuccugcugcauguuaauguacaguaauugacacugaacauucuuuaguauuuaaucagcuucaaauuuaacuguauuaguauugaauucucauuuuauaaucuuacacacguguaucauaaaacacuauaugcugugccauaaucaagauuuaauacaucaucugcaugugacuguccacugucagucuagcugccuuauuuaaacacacagacacacacccucaaaaaagaaaugaauauggguuucuccuuaauuucuucgauuuuauauuuguaucucuuaugauuaaaaccuuaguuuuuagugacauuaacaacuauuuguuugcuuuaaucgucuucuuuuaauaguuucagaacgauaaugucacuauucccaaacaguuuguuuccuuucaucucuaggacauaucccacuaggaauauauuauuaguacuuuucuucacugucauuugagguaauuguucucugugugcuuaagguaccaacuuauaauuaaguucauuuguuuuauuuguuuuuugaucuuagggauugcccuuucaucccauuuuaauuuaauuuaauuuaauuuuacaaauacuuauaacacuuacaugaccccaaaaucugaacuacaaaacugagacauucagaaaaaucuuccaucccuaucucuuuguucccuccuagguaagcaucuaaauuaguuuuuaguuuaucuucccauuuuuuuuaaguguaagaaaacacauauauauauuuuuauauuuacagucuuuuaguuagaagguaaccuguuuuuguaccaugcuuuuuuuuuucaguucauauauacugaagacuacuucauagcaauaaauugaaguauuccucauuccuuuuauagcuaagacuauuccauuguguggaugcaauauaguguauuaaacuguuuucuuauugauagacaucuagguuguucucacccuuuaguuacuagaaacaguccugcagagaauaaccuuauacuuauggaugcauauggcauuuuguacuuuugucaguauaagaagaaaaugguuuaaaaaaaucaguguuaguuugguaagauacaagaaagagcagagguaaauauguuuucaaucuacuacucugcaccagaagucuugcuagguaguucuuaucaugaauggguguugaguuuuaucagacaauuuuucuguuaucuauugcaauaaucuaaugcuuuuuccucauuuuaauuuuaauuaaagacuuaauagauguucuauuaagccaucuuugcauucuugaaacaaauuuaauucacuuaugauguauguuuuuaacacaaugauagauuugauuuauuauucuauuuagcuuauguuuuuugcauuuguguuuaaugagauuagccuauaauuuuccacuuccuugcuauugucuguuuuucccauuuaauuuuauuuacuuuguuauuuagguauaucuuacauacagagaagucacaaaccuuaucuuacagcuuuaugacuuuuugcuuauguuuucuucuuaugugaucaccacccagauuuaaacauagaacuuuuccugaaauucagaaaucucucuugaguaccucucagucauuaucuuucccaccaaagguaaucguuguuuuuauacaugaaauccugcaauauguaguuuuugugccaggguucuguguguaauagaaucuuacgugggccuuauuucuaugaugauuauuuauguuuggcaccauuucauauucuuauugacccuugagauauccucuuuuguaaugugcucauucaaguuuugccuuuuuuuucuguuagguugucuuuuuuuagguuaauguuuagaaguucuuuaucuauuaugggcacuagucauuuaucugagacauaucuuccaauuucuucuuuuagacucugacuuaucuuuuugaaugcuuaauuuuaucauuugguaaucagaaaugcuuagauuuagugaaguccacuuuauuaaauucgguagggugucggaauaauuguuuuuuccguguguguccuuuuaagaaaucuucgccuaucccaaugucaugaagguacuuuauagaagaacauguuaaccuuuuauguuugggucugugaacuauuuaaaauugauuuuugugcaugaugugagguuugggucaacauucuuuuuuuguuuguuuuuuuuugagauggagucucgcucuguugcccaggcuggagugcaguggcgcgaucucagcucauugcaagcuccgccuccuggguucacaccauucuccugccucagccuccugaguagcugggacuacaggcaccugccaccacgccuggcuaauuuuuuguauuuuuaguagagacaggguuucacuguguuagacaggauggucucgaucuccugaccuucugauccgccagccuuggccucccaaagugcugggauuacaggcgugagccaccacgcccggccagcguucauuuuuauucauauagaaaucagauugacuuaguacaguuauugaaauggccaucuuuuuucugacuuaauugcgguggugccuuugucaugagucagauaaccauauuguuggcugcugucugaauucucuauugugaucuuuugguccauuuuucuagacuuagaccagauaccacacugucuuaguuauuauacuuuuacaguaaaacuugauaucugauaaguagugucuuccagcuuugcccuucuuaucuugguacuucugugucuuuugcauuucuauauacauuuuuagaauuaguuucccaauuucugcagauaagucuacagauaauauuggggaagaauugaugccuugacauuauuguaucuucuaaucuaugcaaaugaggcacaugugcauguauaauauaucuauuuagauugucuuuaauuuuugaacaauguuuguaguuuuuaguguagaguucugucucaauguguucuggcugcuauaacagaauaccuuagacuugguaauuuauaaacaauagaaauuuauugcucauaguuuuggaggcugggaagucuaagaucaauccagcagauucagugucuggugaggguuucuuucuuagauguggcaccuuuuauguguucucacaugguggaagacaaaacaggcucccacagcucaugccucuuuuauaagggcacuaauuccauucaugagggcagagccaucaugauguaaucacuucccaaaggccugaccucuuacuacccucaccuugggcguuagguuuuaauauacacauuuugauggaacacagauguucagaacauagcaaggucuuucacauuuuuuauuagaaauguuccuagguauuugauguuuucuucaaugcuauuauaguuggaauuuuaaaauugguuuuaaaauuuuauauucugcauguuuauugcuaauauguuucaaaucuaguuaauuuuuguguauuuacuuuaugccuagagaccuugauacauucuuugauuaauucugaguuugugaauucuucaaauuucacaugugcacagucuuuuauuucuuuuacuuuccugauuacgcuggugaggcacuccagaauaaugaugaauagaugugguacauacauccuucucuuguucuugguaccaaauuugaaacuuuaaauauuucaucauuaaguacuauagaccuuuaguuucuuucuggauacuuuuucaaaaaucacauuaaggauguucucgcucucuuuuuuuuuaaugaacaggguuuggaauuuuuucagauguuuuuacugccucagagaugacuauaugauuauuuucuccccuacagucuugggaugaucuguuugaucguaguguuuuuaucuuuuuuacauacucuugguuccaauuuacuaaacuuuucauauuauacuuaaaauuauuauuuuauacuucaaguagaauguagaaauccuaccaccaucgagguucccuuaucuaccaucguuauguuaaaguuuuuauauagaucacauaaacuuucaucagacaguuuuauaauuugugcuuucaacuggcacauauauuuuaaagcauguaaguggagauuaauaaucuguuauauuugccuaauuauucaccauuucuguuguucucucuucaugccggaagggccaaauuucaguuaaccugaguuauuuuccuucucccugaagagcuucuuuuagcauuucuuuuagagccuaucuacuggugacaaauucucuuaguuuucucuuaucuuaguauguucuuauuuuuacaucauuucugaaggauauugucacuugaugcagauuucuggguugagaguucuuuccgaauuguauagacguugcuccacugucuucugguuucugaugagaaauccacagucauuuaaauccuuauuacuccauaccaauacauaauguaucuuuuuuguuucuggaugcucucagaauacuuccuuuauauuugguuuucaacagcuugauuaugauguuuugguuuguaguuuucuuugauguuacuuguuuuguuuucugugaucuugaaucuguaaauauauaucuuucaauaaauuuguauuguuuucagaaauuucacuuuuuuccuguauuauuguguuuuuucucaucuucagagacuucgaagacaugaguguuagagcuuuugauauuguccguuagcuaucuauaggucuguucauauuuugucagucuuuuaaaaaaauuaacuaucuuuucuucagauugcaugauuuuuugucuguuaucagguucacugacucuuuucucugucacucuuccuccugcucacucuucccccugcuuacucuuccaccggcucuaaacauguaagacgugccuccuuccucuuugccuuccgcugugauuguaaguuuccugaggccucgccagucaugcuuccuacacagccuguggaaucgugaaccaacuaaaccccuuuucuuuguaaauuacccagucucaggguauuuuauuaagcuaagccaguauuuuuuauuugggaugcuacauuucucuguucuaaaauuuauauuuggguuuuuuauaguuuuuauuuucuuuuuguaagagaauuucagucuuuccauugguuccaauaucuaaugcaguguguuuauaauaccuguuuuaaagucuuugucugauuaguccaaucuguuucauuucagauuugacauuucuagguuguauuuuccuauggaaauagcucauauuugucugguuuuugauauagcuaguaauuuuuaauuaugucauggacauucugaauauuaugcugugagacucugacuccuuauugaaauccucuggagaguguugauuugugcuuuauuagacagcagccuggcuggguucagauugaaguuucaucuagauuuuuauaggugguguuuucaacaucaguucaguuucauggggaucacuguggucuuauccugcuuuuuuuuuuuuuucucccccugaucuugcucuguugcucaggcuggagugcaguggcauaaucauggcuuucugcagccuuaaccuuaggcucaagcaauucucccaccucagcccacugaguagcugcaacuacaggcacaugccaccaugccuggcuaacauuuaaauauuucuguagagauggggucucccucuguugcccaggcuggccucaaacugcuggauucaagcgaucuucuugccuuggccucccaaagucuugggauuacaggcaugagcuacugcgcccagccugccguuuuuuauuggggacuuugcccacauucucuggcucuccaagacugcuuuucuuguuuucuuucgugagaaagaugaaauucuuuaagaguuuuaaaacucuugcacugagcauuaggaaaaauagcucaugcaugcuaggcuuaacaccuaggugauggguugacaggugcagcaaaccaccauggcagauguuuaccucuaacaaaccugcacauccugcacauguaccccagaacuuaaaaauaaaaauuaaaaacaaaaaagucuugucuugcacuauuuuuccugauuugggcugcugucaggucuaaguaaugcaagaagagagagaaaauaauaccaaggguuauccccacagacuuuauacaguagggucuuccuuuauuguuucucuacucaaaaauggguuuucacucaggcucuuaaguacccauaccaccacucaccuggugaugugguuuggauuugugggcccauccaaaucucaugucaaauuauaauucccaaaguuggaggaggggccuggugggaggugaugggaucauggggaaggauuucccccuugccguuuucgucauagugagcgaguucuuacgagaucugguugcuuaaaagugguuuugggugguuuuuuauuggagacuuugcccacauucucuggcucuccaaggcugcuuguccuguuuucuuugggugguuuugauaucugugguuaacugguauuauaaaaugagugugaaagacaucauucuuuuucaguucuauggaauauuauuauucucucauuucucauuguuuccguaguuaucauaacuauuccagacgaauguagaaccagcuaaaguucuauaaaaauuccucuugaccuuuuuacuguuaauuuuuaauugaaguuuaacacacacacacauaagugaguaaaaugcacuaauguuuguccauuugaugucuuguauacuucugugaaaccaccacccacaccgagauauaaaacaguucuugguaagguuuuuucguauuucucaccagccaguuguaacacuuauuucuaugaauaauuuuaccuauucuugaacuucauauaaauguaauaagacagcaagauuuuuuucuucugucuucuuucauguacuauaacaacuguuagauuuauucauguuguuuaauauauuaauaauuauuuuucgaucacagaauuccauugcauauauauguaugccauaauuuauucacugauucugcucuuuguguauuuguaauguuucuauuuuuagugguuaugaauaagcuucuguuaauauuuauguacaaguuuuuguuguacaugugaaauaauuuagggggauacauauuugggaguguagucauaggaucauggaguaugcuuaguaggaauuaccaauuaauuaucauacaauuucccaaauggcuaugcuguuguauacucuaaccaccaaugcaucuuugccaacacugguacccuauucuacuuuauuuuuaauuugggcuuuuuggcaggugugcacuguuacuucauugugauuuuauuuugcuuuuucuugaugaauaaugacacugaguagcuugauuauuggcuauuaguauucuguucugugaaauaacuguugagguuuuuuuuuugcaaguuuaaaaauuggauuauuaguuauuuuguuacaaggauuucuuuauauauguugaguauaacuuccuuguuuguaauuuugaugucguugaauguauuaauuuuuuuugcuuaugaguuuuuuuugcuucuugcuacuuaccucagauuuauuauuguguuuauuuuuagaauauuuauuuuucauaaugaaugaauuuccauccugaauuaauuuuuguauauuauuuaagagaagauugaaguuuuauucuuaauuuuugcauacuuuuaaaaacuguacuguucugauugauugacaaugcuguucuuuugaauugcauuggcuccugugucauaaauaaacuuuuaucguauacgugugggccuuuuuuggauugcauuauauuucauucauuuguuuauccuuaacuccaguggcacuuugucuuacuuaguauugcuuuauaauaagucuugaaauuagaaggucuaaguaaggccuccaauuucgagguuuauaauuuuaauggaaagcuauuaacuauguuggcauauuaugucauacaaauaugacuagcuuuaacuuaauuuuuaaaaaaucuugaagauagagaauauaaguugaaaacaguauuacacauaccaauaacuacauaccaaccaaaaugugaaguuauguucaacucuuuuguuaauuauaaaagaaaggugaagaaguaacuaucagaaugaaaaaaguaaagauugaauaauauuuaauguuugugagguugucagaaaauaggcacucuugugcauacuugguagcagugugaauuagaucaggcccucuggaagaucauuuagcagugugcuucaaacaguaaggguaaaauauauauauauauuuuuggagucucccaugucuacuucuuucuacacagacacaguaacaaucugaucucucuuucuuuuccccauauuucccccuuuucuauuugacaaaaccgccgucgucaucauggcccguucucaaugagcuguuggguacaccucccagacagguggcggccgggcagaggggcuccucacuucccagacggggcggccgggcagaggcgccccccaccucccagacggggcaguggcugggcgggggcugcccccuaccucccucccggacugggcggcugccgggcggaggggcuccucacuucccagacggggcggcugccgggcggaggggcuccucacuucccagacggggcagcugccgggcggaggggguccucacuucccagacggggcagcugccggguggaggggcuccucacuucccagacggggcagcugccggguggaggggcuccucacuucccagacggugcggcugccgggcggaggggcuccucacuucucagacggggcggccgggcagagacacuccucaguucccagacggggucgcggccgggcagaggcgcccuucacaucccagacggggcggcggggcagaggcgcuccccacaucccagacgaugggcggccaggcagagacgcucuucacuucccagacgggguggcggccaggcagaggcugcagucuuggcacuuugggaggccaaggcaggcagcugggagguggagguuguagcgagccgagaucacgccacugcacuccagccugggcaacauugagcacugagugagcgagacuccgucugcaaucccggcaccucgggaggccgaggcaggcagaucacuugcggucaggagcuggagaccagcccggccaacacggcgaaaccccgucuccaccaaaaaaugcaaaaaccagucagguguggcggugcgggccugcaaucccaggcacucugcaggcugaggcaggagaaucaggcagggagguugcagugagccgagauggcggcaguacaguccagccucggcuuucacaacuuugguggcaucagagggagaccggggagagggagggggagggggaggggagggaaauauuuuuaaucauaaaauuagagcuauuaaaaugacuuuguuaacuguagacuuucauagauaauaaugucaucuaggggaauuaaaaaucagagauaaaaucuuuaugugcuuuucuaggguaguuaacaauacucaguuucuuuguuuuccuugaaggcugcuaaauuuuaguguuuuaauggggauuguggaugucaaauacuaguaaaauauguacacauguuauuccauuggcuucaugcucaaggaauuuauccucuugaugaauggaaaagucuuuuauuagagaacacuacauggcaauuugcauuaaaagaugaauaaaaauauaaugaaaugccccaauauacuguauacaggauaaauccuuugaaagauuaaugaaggaaaguaucagcauuuggcaaaauuaucgguauaggauuaaacagacuagguggauuugaauuggauuuuggggacaggguuguauaggcagggauaaugaacauguugaauuauauaguguaaacaaguagggaagagugaggaaauaaaaauuguuauugaauccauuaauuuccuuaauguuuuugucuaauuuuccaggaagccaguuaauugcuagagauagacacauagagaguuuaaauguaaauggugcgugcuuuuaugaacauauguucaguugccuuuugaggucuuuugaauguucuguugaugaaugaugcuguuacuguguugaugauauuauaaacucuuauuuuagaagcauaauuaagugauaauuauaacaugaaaauaggaaaacuuguuauuuuuaugaauaaauaucaguuaaugaacuauuuucuaaaaaagaacuuucuuaaucuuugguuuggagcaacagaauaaguaacucaagcuaugugcucucaauagaaauuuaagauaauuuguuuuauuuuuaaaauauguaggugaaaauauuaguucaucaggugauugaauaauaguacaguauuuuccuuucaguucuacuggcuucaucuugaaagaguaaaugacaaaaccuuguuauguuaaaguguauuguauuuguucauucacaaaaauauacugagaggcuaggauauuccuggaacuuuucugugcucuaggaaaauauugcuggacagaacauacaugggcacagacuaguugaacuauugguucaaacauauuuucuugaauccucugaagcuuuuuggaccguuguuugguucacuggccuaauuauuaucauuuugucuuuuuaggcagagguuuucccgucaggcccuuuugcauagccuguggauuuaccuuugggucauguuuccaucuacaguccagucaguugugguugcagaggugugugguacaugauguuccucccucauucggauuauaggcugggcagguuuucucguuuucucuugagauguauuuaggaacaguggccuccccagcuagcacaaagagcuuguuuucaaaagaaagcuaacguuucaauuuccagucuaccaaauaaagucaucaccauuuauuaacucagucuaguggauucuuuuuuauucuuuuauauuuuuaagucaauuuaugaacaauacagaguagugaaaagccacuuuauuagaaauuuuaguaagaaucuaagcuuggcgaaccuguuaaguaaauuuuggugcacaaacaucauaaaagaugaaagaguauugucacacuuucacuuuuuuuuaauggcaaaaccaggugauccagguugucgcagaauauugcaugaaaaaguacuuucaguugaaugaccaacuggagaauacuguauuuccuuuuuuguccuuagaaauauauuguucacucaauucuuaauacucaauacuauauucaucuaggauauuauaauuagucugauauaucauguacgugguuguuuugccgucuuuauuagagucuagagugcuguugucucuuuguacccaccuuuucauguaucuguucauuauaagguaucuuucuuugucaguguuuuucucuuuucuauaagugaaagaaaaugaaaacuauugaauuagugaauauauuaaaugaaagugaaaugcagacuagaaagauggugucuccaagcuuuuuaaauaccuucuugaagaugaggcaguuuaggcaacacaguauaaaaacugaaugauaacuuauuucacuguggcaucaacuuuguaggacagggguuugcgaacuuuaccuuguuggaugccuguuuuugcauaucaaguuuuauuggaacauggcuguguuuggucauuuauaaguagcuacuuuuacacugcaauagcagaauugaauaguggcaaagauaauguggcccacaaaccuaaaauauuuaccgccuggcucuuuaagaaguuugucaacgcuuuuucuaggauauuaucucauuuucccuuuuuaaaaauauacuuuuuauuuuagucuuaaaauuuuuuucuaguaugauaggguauaauugaaugaugaugaguacugaugaaauaauaccuaggauuaugaaguaacuuuguuucaagauagaggaaaaauaagacaagauguuaccucauauuuauaaaaaguuucauugaauccgugugguagccgcaagauggaaugaguucuguuucauuacuaaagaaucuaguaauacucuguuuucuuugggagaccucuaagaaggaguaaaaauauaucuaagaagucuugaucaugaaauaccaacccuuauaaauaguuaaauuugcuaagaaaaaaaaaacccucaaaaaggaaaauugaacccagcacacugugaugauguaacaagguuuaauucucauaaguucaugcauuguuaccucauaucuuugaaaaguccuauuuaaaaaaaaaaguauguaaacugucuggcuuuuuuguuuucucacaagaaaacauugcaaaaguuaagguugugauucuccucccaacuuacuuuaacugcuuaucucacauuauucgccccuauugaaucauguggcaugggcuaucauaauucaacuuaaguuuuuuuaaaauuauaagucauagguauuauagcacaaauuuauuuuuaaaauagauauuuggacuugacuuuuauuuuguccagaguguuaagaacuuuuugauuuuucauuuuguuuuuuaaaaaaugauauacuugauuguaucacugaaguuaagaauucaccacuaugaaaacugugacagacuaaggaguaauuuggaaguauuauauacaugucauguucagauuuuggugugagaaauacauguuuuaaucuccuaauuucuuuuuuuauauuagcauuuuaauguuuauuaauuauuuuaacaaagguuauuuuauuccaacaacuuccaggggaaauuuuaauucguauugagguauauaauagcugguuuugaaauuugauuacaaaagcaugaaaauucuuauucucacagaaaaauuucccuuauacaguaaagcugaauauuuaaaucaggugaauaauuuauauucuuaauaauuaaaacucaguaauuuuaagauuauuaaaccaagauauauuuuguagguaaaaagucagcagaacuauuaacauaaauuauaaccugcuuuuuaaaaaaguguaauacuaaaguaauagccauaaauauuuugucuuuauuuuuuaaggcaagaggcgcagauguuccagagauuccuggagaucuuacucuuaagacguguggcaguacagccaguaugaagguuaagcaugugaaaaagugaguauaacuuuacaguggauucuaaaugaauuccuacgaauggaaaucaguucuucaauucucuuaaaacuuuuauuuagacuuuuuacaaaaauaugcuguuacugugcaacugcuaauccuuaaauuaugacucagcagucaguggaauaggccuauagauuauccacuccucuaaaauauacuuuauuuuuguucuugaagcaacuuaugucauuuucuguuauuuuacaguuguuugauaggaacagucuaaccaugucauucuugguacccuuagugcaugcucucauucauucagaaauaucagcuuuauuguuugaguuaugagauuauuagauuucagguuugccuuugaggagcaugaaguagaugccaagaguugacuguuaagugaaauacagguugagcaucucuaaucugaagcuaugaaauccaaagugcuccaaaaugugaaacuuuuugagugccaacauggcagcacaaaugggaaauuucacaccugaccuuacgugaguguucacaguuaaaauuuuguuucaugcacaaaauuauuuaaaauguuguauaacauuaccuucaggcucuguauaaaauguauuugaaauauaaaugaauuuuguguuuagacuugggucccagccccaagauaucccauagauauaugcaaauauuccaaaaucugaaaaaaucugaaauccaaaacucuucuggucucugugccauuuugaacaaggacuauucaucguguaccugaaaguaaucaguuuuaaagaggaaaaccaucuuuucacuuaguagaguuagauaguuaugcuucauguguaaguagaggaaagacaaggauaaaaauguucauucugcguucagguccaccacuccaggacugaugggcugugacaacauucacagguaaaaucugguuuucuacuuuguguugggaaugcuucugguuagaagcuggcuguccacaguuuccauaacauuugccgaaaauagcaguuuuucuauggacauugauucgggucaaaauuaggagauaacggugaugcuuuuuuuauuuuggguuuugaucuguacacuaaauguaauacucaucugacucaguguauuuuuaagaggauuugugcggauauguguggcucaugcgcaugugcuuacgaaauauuuuugcuugcaugagcucuuaaauccacuguauuuuucccuuaaacuuaguaauuuuuacuguuucacuaucucguuucuuauuuauuucauguguuucagguuacccuucacuaaaggucacuuuccgaagauggcugaaugugcgcauuuccauuaugagaauguugaguucggcagcauacagguauacugaaauauuucuuacaucuugaauuaagauuuacacauuuaccuuuauaucuagaugcuuaucuauauaucuguaucuaauagaugacacuuugaaguaguuuuuuuuuuaauugaugucuuauugguugagguaaaaucuuucuucucuucuauugacaaauacuugaugucacguugacauaugaaaguaaccaucacacuaacauguaucaguuaaggaaaaucaguccugucccccuccguuuuccuguaucauguccauauguccauggcuuuguguagugacuuucuauucugaaauuauguaaacuugucuuaauuaauuguugugagcuuugauacuugguagauuaaaguguucucacuuuauucuucuuuuucagaaauguuuuuacuguuacugccuuuucauucacauacaaauuauugaaucuaacuugacaucaaccuacauacuuugcucuuauaucauuggcagcuuaauguccuuuguacauuauauauauauuaaugugaaaaaacuauuaaaaaccuaaaaaauagcuagauugugguuauuuaaaaaauuauauuuccccaggggaacaaaagccacccuuuacauugucuuucaaauuaggcuaauagaaaaaaaagucuugauuucuacacacaacauguagagguaguccacuuccuguccuugcccuaaccacugucucuccagaagaaaacuccugagacaugacugauuugugucacagugugcuacuuuuuguaauuuuauuucauaaacaagugagaugaauuugaucuauaggauuuaugaaagugaaggacauuucuauuucaaauaaauugacaguuuaaaauagcacuagagauuuauaaugcugugacaucaaacaaaggauauuuuguuccauuaguguguauauccuugagauugcaguuaacaugauaaauuucuuaggucaggaagaacugauuaagaaaacaguaaugaguacauuuuucauuuugugacuguuaagcauuugauauaucuguuugagugauuuaguuuacucagcuugcaauuuagguaaauuauuuucuacuuaauuuauuuugcuuuuuuuuuuaaucuuuacaagguugaaugaacucuuuugggggcaguaaacauugugaggaguuuuagcaaauugaaaagaaauaggaggcuagagaucuaaaaacaguccaaagaauauuuaaauguuaacauuauaugaaagguuaggaaaucucuaaagcaucugauuuaaaauaaaaacaaaacuguuaaugguaaacauuguauaaugaaauagaaaaagcacuggccuuaguucacaaacauagauucuaauuuucuuuuugcuucuuaggaaauuuaugaccuugggcaaguagcuuagccucuuugguuuuauuuccuuuaugaggugaaugagguugugcuaaauaguaucauaguucuaaacuuuuauuauuuuauauuuaaagaguuuauaauggcugcauugaagauguggguagggaauagacaguuguuauucagcugcguuuggcucuccugagauuuuguuaaaugcugguuauuagaguccaguccucuuaauuggaggacugugucuaauuuuuaugggagaacacauuugguagacuuuuaccaaugaacagaccuguaaucuucauuuuagauuacacaccauguuucacuuuccccauugcacuuacuucaacccuguagaauuccauuacucaggcagaagaaggaaaaaaagaugugauacuaacucaguuugugacccugcuuguaugagguguaugagugagauguuucaggauuguauugauugaccaggaggccuggaguauggaagauaggggugguucaaaggaaaccagcccagcugcaccuugccaguccacaccagaaucuucuuucuguguuuaugguccucuacuuggcacagcucuccugcccaguuuuguccugccucuguucugugucuuuggagacuggccucuacauaucacaucuaccaguuuugcuugccuucugcuucugguugaauucaacccauguuagauaccaucaggaggaaaacauuaguuuccauuaacuaaguuguguagcaaaagaacuauaauagcauccuggcuugacuuacaugcuuauguuuuuuaucuuggguugcuguucucucuuuggcuaguauaagguuuuacauuuugauggacugauugaaugccauuuaaagaaaaaaaaaacaaucauauuaaccucuaaacaauccuauguucuaucugcuacaggcaguuaaaauaaaguuccuaugucucaguucuuauucuuuaucauuuuauaaacaucuugcuuuuuacauagguaaaaauuagcacauuugauucuaaacguguuuaugggaaaugaauccuuuauuuucaauauaagguuggaauauguucugaagagaaaacaaguaagaaaacuuaguaaaaugugucaauaauagaucaucaguuguaugcugggcagcucuaguauaaaucaguagguuauucauacugucaauuggccaacuugguuguugcuuuuuaauauguaccaauucugggacauucugcagugacauaccuucucuuuuucacucugaucuuagaaauuucucuuagauuuacagauucauugucuuuauguuuauagcucuuucuucucuucagaucuugaaaguuuauaauugcaguuggccaucauauccuaguaugacagagauguuaacgucuucuacauuuuaaaaauccagacaaaauaaucuuuaacuuucuggcuuuuaguucuggaaugaaauaguuauuuuuaauccuauauguuagaaauuccaaugaucaauuuuauuuagucugaaagacacaguugcuuaaaaaacaauuuagacaugucaguacuuuuacugggucaguacuaucauuaccauauaaugauauguaauguacaaaggacaauuuuaugaucucuucuuugaauuccagccuuguauauccaacugacuucccugcaucuucacuuggaugccuaauaacaccucaaucauugcagcgugccaagaacagucuuucagaccugcucuuucugcugacuucccaucuugguaaauagcaacucuauccuuucaguucccgaggccagccaagaaccguggagcaucuugggcaucuuucuuucugucaguccucacauccaguccaucagcagauuuuuuggcuccaucuuuaaaauaaauccaggaucuaaccaugcccaccugcuucucugcuaucaccuuacacuaaagcauugucuuuuggggaggauuauuucaauagccuucuauauuuggcacagcagcaagaaugauucuuuucaaauguaaguccaaucaugucacuuuuuaaaaacucuccaguuaguuuucaucuuauucagaguaaaagccagauuucugaaacuucucuacaaggauuuacagaguguacccuuaccuuuccgaccucaucuuucuucucuuccccucagacagggugauccagccacaguagccucuuuguuuucugccaguaugcucacccccuucucagggccuugguacuuuuuguuuccuuuacuuaaaaugcuccucuaggacagccacacaccuugcuaccuccucuuuuaaaaguacuggcuccagugcuaucuucccagacugcaccuuccuuacauaagauugcaacuauagucaccagcauuccucaucucccucucuuuguuuuauuucccuccauaccacuuaacaccauucggcaugcuaaauauuuuauuauuuauuuucuuccccucaacaucuagaacagugauugacacauaaaaacuacucaauaaauauuuguuuaaugaauaauagaugaaugagaugaauggaugaaugaguuuauauuugaagaagagauacaauugguuuuuaaaaugcuguuuuacuauuuuguuuuuauuaaucauuuuaaauuuguucuuauaugauaagaauauauauuccuuaugaguauuuauuauaaaacaaauuauguaaccauccuguuuaagucucaauuugguacauucaguuguaauguguaguauaggagagauaauaugcugaggagaaaggugcuggugugguguagaauggguaugaccagcuggugcaguuagccuuggucuugcuuuccuuaucuucacacugaaaaggaaguacgguuccuagauacccuagaauacuaggugacagcuaauguuccuucaagcuaagaaauuguagaugaacuaugaguucugauugagguugugauaagguggagaggaacagagauauaacagcacgggggaggauagguuguaccaugccauauucuuauuuuagucuacuuccauggagcuugaauaagcuauuaauaucuguaaaaauuaguacagauaauugcucauguaauagaaguagcuuguugaaacaucuuuauauuccugagacacauuaugcugaguuauauauauauuuaaaaacaaauuccuuuuuuacacucuacuaagauuuuauaauuucugcaucuguguuuguuggugaaguuaaccugugugcuauacuugucccacuagccuaagucuggggaauuucugcuccccuaucccauucuccaccccuuuuaaauaaaugcacuggaauaguuuguguaaaugggaauuaccuguucuuugaaggguuaguagaauuuuccuguuaaaaccuuuugaaacugguucccaacuggggacuuaaucuuugccaucuuuacuuaccauuucaacuuaugauuugauuauugcucauuagguucuuuuguaucuccuuagaucaauuuuuaucauuuauauuuucuuaaaaauuguucauuuaauuuagcuuuuuaaauucauggguuauaaguuguacacaagauauuauuaaaucuuggucuuaucaaggaaccagcuuaugguuuuacugaucaaccaaauuuuuuuuucuguauuuuucauaccauuaauuucuaagcauaaacuuuccuuuuguuucuugaauugaaaguuuaguuuuucuuauauuuuuuuuuccagaaaagaguugagaauaaugcguauugccuacuaggauuugccucucaaaaacuagcuucgucauaaaccaacuuugucaaauauuaauauuacacaacauauacuacuuaaucucugcuuuagagaaauagaaugcaacagguauuguuaaugauucauuuguuuuuagguauuacuuuuuaguaagugcauuuaaguuuggauauuuuccugugaauaguaguuuggccaaauucuacagguuuugauucauaaaugucuuauguuuaguuuagagaaauuuaaauuucacaaaaaaauaauuacuagaaggggcuuuuuguuuuaaguaaagccacauguaguuuaaaauucugcaaauuuauuguuacugcacuuauuuucccuguuguauuauucugcaguccaaaaacaaagguuaauucacauuucacaaaauauuuuucaguaagaagcggggggaaucucuuguaacacgcaaagaaaugaugaguuugaggcagcgcuguuccugcugugcuuuguguuguaccgccaucuaguguguagggggggaaaaggauauguuugauuuguauuuucuuuaucaucugguuaucugaaguuaucacuugauguguuucuuuuuauccaauuucauacaaaacauuaaguuaaauuaaccugaaugguagaguucagguuuuuguauaaauaaggaauaggaaaaguaugaauuuaauaucugugucucgagcuuucuauaugcaagcugccugcaagggacuugaaaaugcugucauggcuuucuaucauuacaugcauuucugccuugaugcugggaaggcggaaagaaguaguaaaguuugaccugaguguaggaauauugagggguaauaaugcaaacaauuuuaaaagccugaaguuucauuuaaaaaguaguaaucagaauuacaauaaaaauacaagccaauauuuauugaauguuuugucugagccaggcauuauaucaaauacuguuuccacauugucucaauuacgcuccacaacaauuucagguacagaaauuuagguaaaaagaguuuaagaacuuacucaaguucuuaaaccguuuuguggacuguauuugaaucaaggcggccugacacuagagccauucugcauguucuuuuguauugcuagaaaagaauagacugacucaacuaauacuuuaacaaaaaggaguaaaugaugguucuagaguaucucgcaucuuuaauguaguugaagguuaaaaaguaugauacauaauacugcaguguaaccuuaaguaauuuccauugugaucuuaaguaaauucuuaaugucucuggucgucaguuuccucauuuguaaaauagaaacaaauauaucuauucuaacuauaucauaaaguauuaugggaauuaaaugacauaauaauugugcaguacauuuuaaagggcuuuagagaaaggcagaaguucuagggaagcacuuagguaaagucaaauaaucaucuuuaaaaugugggaagucauacuuguccugaugacccaaggacaguguugucaggauugaggcaguggauacugacuucaccugaguacuuccuaucaguuaagccuucaucauuaauaaaaauaaauuaaugaaaagguuaucucuccccauuuuguuaagacacuugcaguuugaaaaauuaacuuguacauauuuucaguuuaaaaaaaucuuauacagaaguacuguuacuacauguguaaucauuugaaauaaaacccaugcuaauuuuauucucacccuggccacaaaguuuaguuuuccucaaaagaaauaaaaaucuuagccuuacuuuucugcauguucugcaguauacucccucuuauacaaggaaaucauuguccuuucaggagagaauuugaaaugaaauguucagauagugagucaucaguuccacugucaucuaaguacuggauuuucacuguaucucguuugagauuauucaguccaagaauuagauguguaaaagugguuggacugugaaaaaauauaucuauaguggagucagccauaauuuacaggcaguuuacuuauaguauuguugagucugaaacugugaagagucugagauguuuuccuacuaguaagcuaacaaguuggcuucccacaacuacagacacacuacacacauucucacucucucuuucucugucucucuguagccucccuuucccccagcagaaacaucaagucucuggaccagaaauuaagcccuuguuuacuugaaaaguaacuuauguugguucccuaggcccugguucuccauaaagugauauggugacaaccagagauauccuguguuuacaagugggauuugguaccacaagagaacucugcacuuaugaaacuugaagcuuauacaggauagcuggcauuccugcccauucuccuuucucgagauggagagagagagagaccuuugcucugaaauguaaacaaaaucucugggaaaaagaagcaaggaucuguauuucacaaacacucuggaauguaaacauggcuugggggagagagaaaacuuuuaucucuagagggcuccaucuuuaggguuacuggguuaaguucagucccuuagcccaggugccagugcucuuugcuuagaaagcccugaccaugcugaaaugugaaaauauguaugaagcaguuuccugacaaguauauguucuugagugagcaucaguaagaugagggcugugauucugcugucguguuauuuggucucauuuuccauguauucuucauaugaugggcaucacagugaacugauggugauucuaguguuuaaagaugagcacaucgguuacuuuaucagauacucagcugagaaaacagugcucuauucccauucugggaagaaaaacucuuaggucuguuaagaugcuuguaggucucuagcuuuuuccugguaaaucugaaggguaauuuugccuuuuauugauuuucgccuuaugugcuggaauuagaacuuauuucacuuauuaaccauguaagauguaauucugcuguagaauuauucuuccucuuggcguccugaacucaguaguuuuaaaguaguauuuucagugucaaauauuaggagguugaagguaggguggguggaccacauaauauuauacaacagaaaucauuuuuuugugucuccacgucugcuacacaggcugugaggugaaagaaaacuuguuuacaaaccccauagguaugacacaugaaauugcagccauuauagaacuacaaaagaugaauaaaagaaaagaacucuuuccguguuccauuugcaauccguugauuaggcuuuggugaaugguuucuucugugggugggugguauauuuuuacccugcucuaugcuacugauuuccauucuccauauggagaaagaacuuuucugaacauuugaagacuugcugaauagaguuguauuuuuaaagauccuaacaacacuaauuguaauugguuuccauggugauagaaaagugaacucaauacaggaaaaauaacuccaaagauagauuuggaagaaauuuagaaaugugggauuuggaaauccuguuugccauuucuaauagaugaaggacugaaauauuauuaaauugagaagugaaaauuauuuaaaucacugaguugcugucauaaauuucuacaggcaaauauaguucaguccuucauaguguauagucuuuguacauguaguucagguacugcauaaaauacauuaauauucagacauguauaggguguauuaaaacccacaguucucuuaggauaguuuuauugaauaucuuguaugugcuagccaccuaugugaguaccacugaugaagcagauaaucuuuccucagagaaaacaaguaauauaccaauaaguuuaagagaaaaacaauguuauaaauguuauaaaagugcuuguagguauucaguggugagagagauuauguccuguggcauucaaaagucuucaucuuuauugaagauugaauagaauuuggauaugcagagauagaagugaagaacccucagccaaggaaaaauaguacagacaaaggugcuuguguuuucauuguucagcucccucuuauaagugagaccaucaauugcuuucuuaguaagaacugagaaaguauugcaggauuuugagaagggaguaccaugaucaaugugugauggagauggagagagaccauuugaaauacuguuguaauuauccagauguaagggggccuagaaccagggaauuagcaguggggaguaggaaaaaaggggaugacuguaagagauaaguguuagcagacaugagagacuaaagaaucaaaggugaaaaaugagaccuugagccuggaaauguaaaaagagagcauguguggaaaggaggagaaguagcagaaucuagggcgauuagguuggucagcugggugaauaguaguacaguuuguuuugugaauucaggaggaggaggagaauaugugaggaaagaugacgaauucaguuuugaaacuaagcaccauauuucagggagaagacaauguuuguuuauucauuaaauacauagcgaucccuacuuaaaucucagguacagcugacccuugaacaacauggguuugaacuguauggguccacucauaugugaauuuuaaaaaauaaauauauuggaaauuuuuuuagaguuuugcagcaauuugaaaaaacuugcagaugaaccaugcagccuagaaaucuggaaaaaaacuaagaaaaagguaugucaugaaugcaaaauauauauauaaauacuagucuauuuuauagcuuacuaccauaaaauacacaaauauauuauaaaaaguuaaaauuuaucaagacuuacauaaacacagacugaacauggugcgauuccuaaucaagaggaauguaaacaaacauaaaggugcaguauuaaauuauaacugcauacaguuuaauguaguacauacuguacuacuguaauaauuuuguagccaccuccuguugcuauugugaauucaaguguuacaaggauccacuuaaaacacugugugauacuuaaucaucucuguaugugcauuguguauugcaguaaaaagugaucucuuaugguucuuccauacuuuucauuguauuuggugcaauaccauaaaccuugaauaacaccacgagacucauacaaaaugcuacuagugaugcuggaaaugcucccaagaagcagagaaaagucaugacauuguaauaagagguaaauugcuugauaugaacuauaaaugaggucuacagccacauuugucugccauuucaaucuguuguaaggacuauuauuuuuuaaaaaagaaaauuaaugaagcuguuauugcagcuauagcaguaggugugaacaucuugcacuuuuugugaaauaccuuuuuaucucauauugaaaaugcagcuuuuaugucggugcaggauugcuauaagaagggcauacuuauagacuauaauaugauuugagaaaagcagucauuugcuuuugauugguauuuugauuuauauuuugacaauguaaaguaaaaggaaggugaagagucuaaagcuggagaauuuaaugccagcaaaggaugguuugguaauuuuagaaagagguuggcuuuaaaaaugucaggguaacaggagaaccugcuucugucacccaagaggcagcagaugaguucccagauaacuuuaagaaaaucacugagaagaaaggauaucugcauggaaaguuuuuaauguaccaugaagcagccaaauauuugaauuuuuggugucccagaaagugaagagaaagugaaagggauagaaaacuaauuuaaaaaaaaaacaaacuaacuaaaacuuucuaguuuuagcaggagauuuagauaugcagauacaggaagcucagaaauucccaaauagauacaauucaaaaaggccaaggcacaucauaguaaaacugacaaaagugaaagacaagaauucugaaaacaggcagagaaaagcaucuagucacuuauaaaggaaccuccaucaguuccucagacuaauggugaaauuuuuuuuuuuuuugagucuugcucugucacucaggcuggaguacaguggugcaaucuuggcucacugcaaccucugccuccuggguucaaacaauucuccugucucagccucccgaguagcugggacuacaggugcaagccaccaugucuggcuaaauuuuguauuuuuaguagagacgggguuucaccuuauugaucaggcuggucucgaacuccugaccucaggugggaggccgaggcaggcagaucacuucaggccaggaguuuugagaccagucuagccaaccuggugaaaccccaucucuacuaaaaauacaaacauuagccaggcauaacgguaugugccauagucccugcuacuugggaggcugagauaggagaaucgcuugaacccaggaaguggaaguugguggugagcugagaucacaugcugcugcacuccagcaugggcuacagagugagacucugucucaaaaaaagaaagggggaaaaaauaaaagaaaaauagacauuacaauggaugcuacggaaauacaaaaggucaugagacugucaugaacaacuauacaguaagaaguuggaagaccaagaagaaacggauaaauuucugggcacgugcagccuacuaaaauugaaucaggaagacuuagaaaaccggaacauaccaauaaggaguaaugagauugaauuaguaacaaaaagucuucuaacaaugaaaaucucaggaauggauggcuucacugcugauuucuaccaagcuuacaaagaacuaacaucacucuccucaaacuauuucaaagaauugaagaggagagaauucucccuaacucauucuaugaggccagcauuagcauaacaccaaaauccgaaaacuacagaucaauaucccugauaaacauagaugcaaaaauacuuaacaaaguacuugcaaacugaauccaacagcacaucaaaaaauaagacaccaugaucauguggaauuuauuccagggaugcaaagauguuuugacauacacaaaucaauaaacaugauacaucacaucagccgacugaaagacaaaaaccaucguuuccucucaaagacacagaaaaaaauugagagauucaacaauccuucaugauaaaaauucucaacaaaccagacacagaaggaacauacuucaacauaauaaaggucauauaugacagaccaacaccuaacaucauacuggauggggaaaagaugaaagccuuuccucuaagaacugaaacaagacaaggaugccaacuuuuccacuccuguucaacguaguauuggaauucauagccagagccaucaggcaagagaaaaauaaaaaagcaucuaaauuggaaaagaggaaguuaaauugugccucuuugcaaauaugaucuuacauuaaggaaaaccuuaaagacuucacagaaaacuuuuugaucugauaaauaaauucagugaauuugcagauacaaaauuaacauacaaaaaucaguaauauuucuauauagcaguaaugaaauagcugaaaaugaaaagaagaaggcaaucguauuuacaauaacuaaacaaaaaaccuaggaauaaauuuaaccaagaaggugaaagauuucuaugaguaaaauuguguaacacugaugaaugaaauugaagaggacacaaacaaauggagaccucccaugcucauggauuagaagaauuaauguuguuaaaaugaccauacuguacaaagcaauuuguagauucaauacaaugucuaugaaaauaccaaugccauuuuucacauaaauagaaaaaacaauccuaacauuuauauggaaccaaaacagaaccugaauagccaaugaaauccuuagcaaaaagaacaaugcuggagacaucacacuaccugucuucaaaauaugacaagggcauuguaaccugaacagaaugguauugguauagaaacaaacauguagaguaauggaacagaauacaaaacccagaaagaaauccauguguuuacagccaaauuuuuuuuauaaaguugccaaaaauauacauugauaaaggacacacccucuucaauaaauguugcugggaaaaguggauguccacauguagaagaaugaaacuaaaccccuaucucucaucauauaaaacaaucaacccaagauggauucaggacuuaaauguaagaccugaaucuauaaaacuacuagaagaaaacaggggaaacacuucuggauauuggucuuggcaaagauuuuauggcugagaacuaagcacaggcaacagaaacaaaaauagacaaaugauacucuauuaaacuaagaaccuuuugcacagcuaggaaacaaucgacagagucucugaagagacagcugguggagugggaggaaauauuuguaaaugauaucccacaagggaguuauacaaggaauucaaacaaaucaacagcaaaaacaaaaacaaaacaaacaaaaaccaaaaaauaaaaaaacacaaaucucauuaaaaagugagcaaaggauaagaauagaguucucaaagaagauauacaaauggccaacagauacaugaaaaauacucaacaucacuaaucaucagggaaauacaaaucaaaacccacaaugaguuauauuaucuuacuccuguuagaauggcuauauuuuaauacaaaaaauaauagaugccagugaguaugcagagaaaagggaccucuuaaacacuguugucaggaauauaaaugaguacaagcacuauuuaaaacaguauggagauuucucaaaaaacuaaaaaaggaacuaccauaugauccaacaauuacacuacugcauauguaucuaaaggaaaguaaaucaguguaucggauugauacccacacucccauguuuauugcagcacuauuuacaauaacaaagauauggaauccaauaacaaagauauggaaucaacccacaugucucuccacagacgaaugguuaaaguaugguauauauauauauaugcaaucgaauacuauuuggccacaaaagaaugaaauuucugucauuugcagcaacauggauggaacugaaggucaucaugugaagugaaauaaucuagccacagaaagacaaauauugcauauucucacuuacaugugggaucuaaaaaacuugaucuaauggagguagagaguagaauaacagucugagaaggggcaacaugaugaagaaguuugauuaaugggaagaaacaugcaguuagauagaagguguaaguuacaauguucaauaccagaguaggaugacuauaguuaacaaccauguauguguauuucaaaguagccgaaagagagaucuugaaauguuuccaguacauaaaaaugguaaauacuuaacgugauggaaaccccaaauacccugauuugguaaugacgcuuucugugcuuguaacaaaauaucacauguaacucacaaauauguaaaauauuauguaucaauuuaaaaauugugcauucaaagacacuaucaagacagugaaaagaacccacugaaugggaauaaugcaagucauauaucugaagcaaauuaaauguagaacuauuacaacucaacaacaaaauaucaacaacccacuucacaaaucagcaaagggcucgagcagauauuuuuccaaagaagauagagaggugaucaacaaacauaugaaaauauucuagccuauacauuaucgaaaggucauauugaacucaacuagugcuuuuguagaacugccuauuucucccuucacuucugucauguuugcuuuauauauuuuggugcucuuuugcuuggggccuccauguuuauaauuguuauauguucuugaugaauuuucucauuucaucaauauauaauguucauuuuuguccuaaugucuauuuugucugauacuaguauagcuacccaggucuuuuugguugucaucuacacggaauauaguuuuucaucuuuucauuuucaacauauuuguaucuuuggcucuaaagugagucucuuguagaaagcaagugguuggauugugucuauuuuuaaucuguucuccaucucugccuuaugauuguagaguuuacucuguuuacauuuguaguaauuacucuuaaggaaggacuuaugccauuuugcuguuuguuuucgauaugucuuauauuuuuugcccccauuuuugcuguuacugccuucuuucuuauuuaauugaauuagugacauuuugauucucuucucauuuuuuccucuguauauuuuauauggcuguucucuuuaugguuaccacagugauuacauagaacaucuuaaaacuauaacaguuuauuuugaauuuaugccaacuuaacuucaauucuauacaaaagcucuacuuuuuuuuuuuuuuuuuuuuuuugaaacauaguuuugcccuuguugcccaggcuggagugcaaugucaugaucuugguucacugcaaccuccgccuccuggguucaagcaguucuccugccucagccucccaaguagcugggauuacaggcaugugccaccaaaucuggcuaauuuuguauuuuuaguagagacgggguuucuccauguuggucaggcuggucucgaacuccugaccucaggcgauccgccugcuguggccucccaaagugcugggauuacaggcgugagccaccacguccggcccaaaaucuguacuuuuauacagcucaaucgccaucauuaagucauugaugucacagauuacaucuuuauauaucaugugcccaauaacauacauuuaugaaugugucuuuuaaauaacauagaaagcaaaaagugggguucuaaaccagaguuucgguauuacugguguguguuugcccauguauuaaccuuaacuggagaucuuuuuauuuucauauggcuacaaguuacugucuaguguccuuuuauaucaauguuaagaacuuuguuuagccuuucuugugggguaggucuaguguuggucaacucuuucaguucuauuuuuugggggaaaucugugaaugucuuaauuucuccuuuauuuuugaaggauaguuuugcuggauauaggauugcuaguugacuagguuuuucuuucaguauuuuaaauguaucaucccuccaccuuuuggccucaacauuucagcugagaaaauagcuuauaauguuuuugaggaucacuuauaugugaccaguugcuucuuuuuugcugccuucaagagcuucucuuugaccuugucuuuugaaaaaucugauuauagugugucuugguguggaacucuuuggauuuuggaugugcacauuuaugucuuucaucaaauuuggaaugauuucagccauuauuuuaaaaaauaauauuugccccauucucuuuuucauucuuagauuuccauaaugcgagaguugguccacuugaugggucucauagguuuuuuaaagcacugauuaauuuuuaaaauuauuucuucuuucuguucauuacauuuuaucuacuugucuuaucuuuaaggugacugauucuuucuucuucuugaucaaaucuguuguugagcuaucuagugaauauuuauuuucuuuuucaacuuuuauauuagauucagggaguacauguacaaguguauuuauuaccuggguauauugugugauguugagguuuaggguacaaguaaucccaucacccacguacugagaauaacacccaaaaguuaguuuuuaaaucuuuuccucacugccacccuccccuaucuaguaguccccagugucuauuguuaccaucuuuauuuccguaaguaccugauguucagcuccgacuuaugagugagaacgucugguauuuaguuuucugcuccuguguuaauuugcuuaggcuaauaaccacugucugcauuuauauugcugcaaaggacgugguuuuuucuuuuuuauagcuguguaguauuccaugguauguguguaccauauuuucuuuaucuagcucacuuuugaugggcaccuagguugauuccaugucuuugcuauugugaauagugcugugaugaacaagugagugcaugcgucuuuuugguagaacaauuuguuuucuuuuguauauauauccaguaaugggaucgcugggucaaaugguaguucuguuuuuaaaguucuuuugagauaucuccaaacugcuuucgacaauggcugaaguaauuuacauucccaacaacaguauauaagcaauuccuuuucucugcagccucaccaacaucuguugucuuuugucuagucagauuuuaacuuuaguuauuguaccuuuuggccccagacuuuguuuuuuuaauacuuuauaacuucuugcuaauauucucauauguucauacaucaguuucuugauuucccuuauuucuuuguccaugguuucuuugaacuuuuugaauguguugaauacaguuuauuuagugucuaguuaagucccauauauagacuucucagguacaguuuuuguuuuuuccucugaugaaugugugcuuuccuguuucuuuguauaacuuguggcuuguguggcauacuguacauuugaauauuauaguguaguaacucuggaaacuggguuuucgucuauccuuaagaguuugauuuuuuucauuguucauggcugcgguuuguuuggugauuuuuuuuuccaaacuguuuuagugaagacuguauuccuugucauauguauuuaguaaagucuuucuucuuuuagcuuguguuuagguaguguuuugucagggauuuuuuugaaugccaggagugaaaaauaaaaaucaaugaaaaagccacuuucuccggucuuuacguguugcuucuguacuggaauacucauucaacaccuagcgaagcuguuuacaggucugccuucgucuucccuucauguuacacuuauccuagaggucagcuggaggugaaaaccuagggacuucuuagcuuuuugugaguauguguccuacccugugcgugugcauggcuuucaaaauacuuccauauacccaggcacuuuugaaugcugucauuucccagagaccucucuacucagcuuucccucuuagauuuuagguuguuuacuuuaugucucaaauauaauuuuuuugcuccagauaguuguagaguuuuuguuugccuuacuguauuuuuaagcaauauuuaaugguuuuccuccuugaaugaguuccauauuaggugaaauguagguaagcaccuugcaucaguucuucagguagccucuagacagguuagaagagacaaacaauaguuugugaauagggucugucuauuccuuucaggcccggugaggguuggcaucauuaagacuacugcugagccagagagguuuggggcaagcacaaguaaaaaugccacaaagcuuuccuauuuugaaguggcuuuuuccuugauucagugaucucuugguuauucuaaacccuuuacuguuuucuggaguacugagaaaguugacucugagagauugugcuuguuuuuugugauuuuuggagggauugaagcuuguagccaccuacuuuaccauuuuauugacaccauuuggccaucuucuuucucuuuuaguuuuuucuuuucuucuuaucuccuugcuuuuuuuuuucugaaauguucucucuccuuaugccuuccuccccauuucuuccuagagagauuaauuuuauuucuagucuuaauuucuuuuaagguuauugacauuuaaaaauuuuauccucuuccuuuugguuuggaaaccagaaaauagaaaauauguaucauuuuucuauucuuuuuauggcugcaauuaaaaucauaacucaaaaaccuaauuuaaaggcuaaauuuuuugguaucucugauucugucauaaaguaucagcauuuagaauauuuuaacugugaucacucuuuccuccauguuaguguuguucaggaugauaauucuaacuuuucaucuuucauaauuaaauacuauucuuauauagcuaaauuuguuucgauuuauaaacuuauuuccugaauuucuuguucaauauuucuaccuuacuucucaguuuauucuuuuagaaucccuuuucuucugagguacauauuuuagaaauuuuuuuuggugagguuuuguuggugggaacucuucaguuuuuguucaucagaaaaugcuuuuuuuggcucuuauuuuuacaugauaguuuagguaugaauaacaucuugguaaaucucuuuucucagaacuuaaaagauauucuuaaaccguuccaucuguuacuguugagauguuagguguuuuauaguuacuuagauauuuccuauuucuggaacuguuuauuccuuccugcaguucuggguuuuugucuaguaccauuucucuuuagccugaagaacuuguuuuaguuuuuugguuggacuagucuacuggagacagauucuuucagauuauuuuuauuugugaauauuuuuauguugcuuaauuucugaugguuauuggcaugaauuauauuaauaguauugacaacauuucuuucagcacuuaaaagauguuuucuuuuugucuucuccccucucuuguuucugaugagaagucagcuguuauuuauacuuuuccaccaugagucauguauguuuuuuucuuuauagauugaaaguuuuuucuuuaucuuuccuuuucaaaauuauaauuaugauauguuuaguacugauuuauucauuuaguuuggggugcacugaguuucuugauuuugaagcugauguuuucacauauuuuggaaaguucucaucugguaucuccugagauauucugcuucauucucucuuaucuccuucugguacuccaauuauaucuaugguuauauguguuugacauucucuuagggagcugaacuguauuguuauuuuuguuuauucuuuuuuucucuuagugauucaguguggauacuuuucauugaccuguuuucaaguucacugcuccuuucauuuacuguugccaguuugcucuuaaaaucugauacaaaaaaucauuuuucgcauuuucuauggaacuuuuuuucauaguuuuaaucucugcuggauuucccauauuuucuuuugacugcuguaaguaccacacauauguagaaucaaguaucugucuuuuuguguuugguauauuuaacaugagcacaguguucaucccuguuguagcauaugucagaauuuuuucuuuuuaaaggcugaggcugaauaauauuucauuuugccuguuuguauacauguguaaaugugugcaccacauuuuguuuauccagucaucuguugaugggcauuggguuacuucugcuuuuuaguuaugaugaauaaugcuucugugaacauggguuuacaaaugucucuuugagacucuguuuugucuuugggggguguauacccagaaguggaauugcuaggucauauaguaauucuucuaggucauauaauaauucuccuuuuaagcuuuuugaggaccaccauucucuuuuccacaguggcaguacgaauaccaccaacaauguacaaggguuuuagucacucuaauuugaaaccagcacuugauguuuucuguuuuuggauaauagguguccuuauguaugugaagugguaucucauuguaguuuagauuugcauuugcuaaugauuagugauuuugaacaucuuuuugugugcuuacuggucauuuguauaucuucuuaggagaaaugucuauucucuaguacuuugcccauuuuuaaauuguuuuuguuuuuguuguuguuaggugauagaaguucccucauuuugaaccugugguucucacugcaugugacauaggugucuugaagacagcauaccaaugggucuugguucuuuauccaguuugccacugugugucuuuuaauugggguauuuagcccauuuacauucaagguuaguagugauauguguggauuugauccugucaucaugauguuagcugguuauuuugcagacuuguuuaugugguugcuuuauaguaucauuggucugcuuauuucaguguguuucuguagcagcugguaacaguuuuucuuuuccauauuuagugcuuccuucaggagcucuuguaaggcaggucuggugguaacuaauucccucagcauuuguuugucugaaaaggaucuuauuucuccuuugcuuaugaagcuuaguuucaccagauaugaaauucugucuuggaauuuuuuuaagaguguugaauauugacucucaauaucuucugguuuguaggguuucugcugagaggucugugguuagucugaugggcuucccuuuguuggugaccugaccuuucuuucuagcugccuuucacauuuuuucuuucauuucgaccuuggagaaucugacaauuaugugucuuguggaugaucuucuugugaaguaucuuacuugaauucucuacauuuccugaauuugaauguuggcuucucuaguuagguuggggaaguucucauggaugauauccugaaauacguuuuccaauuugguuccauucucuccaccucuuuaagggccaccaggggguuguagauuuggucucuuuacacaaucccauauuucuuggagguuuuauuuguucauuuucauucuuuuuucucuauucuugucugucugucuuauuucagaaugccugucuucaagcuuugagauucuuuccuaugcuuggucuguucugcuguuaauacuugugauugcauuauaaacuucuuguaguguguuuuucagcucuaucagguugguuacauuauuuucuauacuggcuauuuugucugucagcuccuguauuguuuuaucaugcuuuuuagcuuccuuggauuggguuuuaguguacuccuguagcccagugaucuucauuccuaugcauauucugaauucuauuuccauuucaggccaguucaggacccuuacugaagagaggauacauuuguuuggagaauagaaggcacucuggcuuuuugaguuuucaggguucuugugcugauucuuucucauguuugugggcuuauguacagucuuuuagguugcuggccuuuggauguuuuuuuucccccuuuuauccuauuugaugaccuuuaggguuugauuguguuaugaaggggauucagcugauuggcuucauuucuggaaauuuuuggggggaccagcgcucugcucccaacuguauuacauccagacuuuguucucugucuccuugagguuaggaauccacuguguugguggggaccaaagugcuccuggacugcuggucacuacacuccaauggguggugacagucaaagcauuucauaguguggugauagcaggguccauccuuguaacagcagcugcagcagagugcuagugggugccagggugcuuggcucccuaugggcauucaccacaguggcaggggcaaugcagcugggugguggguggaggcccucuguugguuacugugcacacaguugugcuggaggugguguuggcuugggagcuggugggcgcaggucuaggugccuucucugugccacauaagcagaaguggucacucagggugggagaggauucgcuguucucugugcaguguuaguauaagggcagggugcaggcaggguugggguuggcuggcucugcccaccaaggcuccgucuacagugguggucggcagguggagguaggguggauugcacucuuguucacugguggagaaaggaaagcgaaaccugcccauacugacaugugccagcaaagugauguguggaguugccauggccucaggggaagcugacauauggggagggagucugggcugaugcauggucauagaugccaccccucugcagcucuccacaggucaggcaugguccaccauugcagaagcugugauauagcucccaggacaugugaggcugcccugcaagcauguguggccaggcuggguccuugggagaggccagcacaccaagggauggucagauugaacuggccccaucugaugggcaagaccaucuugcagagaucaggucuagcaguuccccuugaaguaaagccaccuaugguugcaaguugagcuuaugggcaugaccacuccuaaaugugcucugcuauggaugcuccugcaucaaaccuucugggcuccacaucaacuggauugcugccccuaccacuucucuaagaagcucucccugccaauucaaguguccaugguggucaaaggggggucucugccugccaggguuucagaggccuguagcgagugcagguugcuccuugccaguucaauucaccucuuccccgggagcuguugggauccaggaacgaguccuggugcagugcacaguagccccaugcaggguucccagcuuucucccccuucagccuagcuucugugucuuccuuguguacacucugggugccuucccucugaagaucuguuagaagcacgccagucaucuuggucucucagugggagcuguuucaccuggcugcaucuagucagccaccuuguucucccccacugcuuauaauuguaucuucuuuguguauugaaccuucuauuaucauauacuauucuuuuuuguuucuaaacuuuuugguuuagugucuguuuuauuuauuuuuaguauagucaccuccacucucuuuugguuucaauuugcauggaauaucuuuuuccauccuuccacuuucaaucuauuuguguauuugggucuaaaguguaucuccuguaaccaccauauauaguaaugcaucacuuaacaggguuauuuucagagggauauauuauuaggugauuuuguaguugugaauaucucuaaaacauacuuagaauagguauagccuaccauacacccaagcuaucugguguagccuauugcuucuaggcuacaaacugguucagaauguuaaucugcugaauacuauaggcaguuguaacacaaugguaagcauuugugucucuaaacauggaagagguacaguaagaaugugguuuuauaaucuuaugggcccacugugauauaugcaguuugucauugaccaaaauguuguuaugguggcacaucacuguaauugaauuauguuacuuuguuauucugccaaucccugucuuugauuguacuguuuauuucauucacauuaaaaguaauuacugauaaggagggacuucucucauuuuucuauauguuuucuuuauaucuuauagcuuuuuucccuauauuccugcauuaaugcuuuuuaaauguguuuaguugauuuuuuauugugaaauguuuaaauuucuuucuuauuuucuuuuguucacauucuauagcuaucuuuuugugguugccaugaggauuacauuuaacauucuaaaguuauaacauucaaauuugaauuuaugccaguuuaaauuuauuaacauagaaaaacucugcuccuguaauagcuccauggucuccucuuuugguuguugauuaucacaaaauuacaucuuuauacauuuuucugcucugaaacauaaauaauuuuuaaaauauauuagccuuugaaaugauguaggaaagaauguggaauuaaaaccaaaguuaaaauaaugcuagccacacuuugggaggccgaggcggguggaucacggggucaggagaucaagaccauccuggcuaacacagugaaaccccgucucuacuaaaaauacaaaaaauuagcugggcaugguggcaggcaccuguagucccagcuauucaggagguugaggcaggagaauuggugugaacccgggaggcagagcuuguagugagccgagaucgcgccacugcacuccagccugggagauggagcaagacuccgucucaaaaaaaaaaagaaaaaagaaaaagaaaaauaaauaaugcuagccuuuagacuaauaauuuucuuuuaaguauuagucucuuaaaucauuuagauaacaaaaaguggaguuacauaucauuguacaguaauacaggcuuuuauaauugcccauauauuuaccuuuauugaguucuuacuucuucauuaggguuugaguuaguaguguuuguguguauguguuuuaauuuauuuuacccugcagguaucccuugagaauuucuguuuggcaggucuagugguaacugacucccucagcuuuucuuuaucugggaacaucugaaguugggauuuuuaaaaucuaggaacaucucccuuacuuuuuaaggacaguuuugcugguuauagaauuagugguugacaguucuuuuagcacuuugaauauauuuaccugcuguuuuuugaccuuuaaaguuucuaaugagaaaucucccagucuuacugaugaucccuugcagguguugagucacuccuaucuugauucuuucaagauugccuccuugucuuuguauuuugaacauuugauuaucgggugucuuagugugggucucucugaguuuaucuuacuuagaguucauugagcuucuuggauguugauauucaugucuuuuaucaaauuugggaaguuuggggccauuaucuuuucaaauaaucucuuugucccuucucucucuuuuuuuauucugguacuccuacauguguauguugguuugcuugagggugucccaugggucccuuaggcucuuguuacuuaucuucaauuauuuuuucuuccuauuacucaaucaucucuuuugucuuaucuuuaaguuaacuaauuguuucuucugccugcucaaaucugccuuugaaucccucuagugaauuuuucauuucaguuguuauacuucucagcuacaaaauuugauuuugguuucuaggcuuuuuaucucuuuauugauauuucuauuuuguuuauauaauguuuccuugacuuuuuccacaacuuccuuuaggucuucgaacaucuuuaagauaguuguuugucuaguaaaccuacuaucagaucuuuuucagaaacaguuuuuuauuucuauuuuuauuaaaaaaauuuguagauuuguagagaugguguucuauguugcucaagcuggacuugaacuccuggccucaagcuauccuccugucucagccucccaaagcacuggauuacaggugugagccaccaugauucauuuugauucauuuuuuccuuugaaagguucauacuuucuguuucuuuauaugccuugugauuuuuuuuuuuuugaaaaauggacauuugaaucuaaugaugugguaacucugaaaaccagauucuccuucuuccccagggacugcuguuuuuauuguuuuuguuuguuuuuuauuguucuuguccgucucugugccaaagaucagccugaguuggaacuuaaugucuucuuuugucuuuccuaagucuguaccuuucucugagagugugcagucacuuucuaauuuucucuguaagucuuuugaauaggucaguugcuuuugaaugcccuagucuauuauauuuucccaaaggaggaaaaagagaaaaaucaagggggacagggaaggaaaagggcguuggcccuuuaugucugcugccagucacuuuagccagaggagcaugggccugcaaacaguggagcuagguguaauggacacauagcuauuugucugcaccucugcaauccaaagcagugauccgcagccacagcauagaucucugaaauuuggaggcaguguucuuuuugucugucuugacucuuguaagguauguuuaugcugcuccaggaguaugugcacagcugccugcuauagggguggcaggggcggggcggggccggggggguauagggagcuguuacuuucuuaagugcugauguugaccaaaaugaacuacaguuucccauccaagccuucccuuggaaguagcaggccuucaguagauaccagaguugucaaaauaguuauccaccggacagauucugccagugcaguuauugucuagguggaaagaucgauuccuggugagucugccguuuuuccagaaucuucucuuucucgugugcuuuugcguguuguuugccuguugaacuguauuuuagaaucucaauuauauuuaauuuacauucucuuucuuauuauuuuuauaucuggcccaauucugugucugcuuuauuuuacccuugccucucaugaccaugugucacauuugcuugcuuaucuguguguuuuguaauucuuuaaugugaaauauauaagaaacagcugagacuaaagucaguaaacuuaccuccaggaaagggcuuaucucuucuucuuucagucuguugaaaugaggugcugcaucaggcugaucuguauuugauaagaucuggucuuuuaugacagcuuuacuuugauugaguuuaucacuacuuuaaauauuuugaaguuaagguucugagauuucuuucacaaggaaaacugaagaguggugagaugcugaagguaucuuugugcuuugcuaugaagcccagaucuucugaacugagggagaacauguucucuuucucugcuuugcagccuggaugcuuauucucuugucuguccaguucuuucccccaguauuuugugccucuggagagcacucuuccccuugcccuaugcaagagcuuugaggguagcugugaaggccugcaguuucucccagcuuuucugugccaccuccauccuucaguuguugaguguccugagugccuucagagggguaucuuccaguucuccuuuccucuguuucacugcccugcucccagucaagggagguuagcugccuuguccuuggggaggcuucccauacuucacagguucauucucucaguucucuuccucuccugcagccuugguuuacucacccgauaucccuggugaguaccugugggaaucaguugaugggugagugucaacucucugcuacagagaguuguaauuuuaguuuaucacuuuagugauuacacuacaguguaauuuuaguuuaucacuuuaguuuauaugcaguuacucaagguuuggcuggcuucuccuuacccugucuaacauagauucuuuuuucucuuguaucucugccaggcguccaagcacaucuuugagucacuucugucucaugaaaguguugucacuuucugaaaacuaguucauguagguuucuuuucacccuuaauuauuuuauuucuuuuuuaaacuaugcuuuuaucauuaaccuggcuuuuuugggcuaaugggaaaaugauuguuaucuugugaacaacuuguacuuaauaucugaaguuuaaaaaaauacuuugugauaccacuuuccucaauagagaauauaucuucaucaaccuuguacuucauauaguaugaauuauaaugguacauuacauuuauuaaguauuaguuaccuggguggacacuguccaugcaucaucucauuuaauacccacaaacuugagaauacauaauauuauaucauccucauuuuccaguugagagccuaagcagguaggucaauauuacauugcaaauuauaaacacauuugaacucaggguuguccaucucugggaccgcguuugcaaauugacguccaaagauggggcagguguguaacauaagugaguaaagcaagugggguauaagaaaaauaacaaagcaaguagcaugaugaaugacaauuaauacucagccuagauacuggcaaaaaaacuacaggguagucaguucugugacaaacuuucuuggggaauauacaccucauuuaaaggugauggucauuucucagcuguagcuaguuguugcccgugugagaauguagguccaaucuucccaauuuucugauuuuucaguagaagccagaaaucuguauuuuucacaugaaaccucuuagcuucuacaugucgguagcugguuuaaauaaaacuaaaauccaguaugcagaccuacauggugaauuuuuuuuugaaauuuuaaauuucaaaucuuuguggauacagaguagguuuauauauuuauaagguauaugagauguuuucauacaggcaugcaauguguaauaauagcaucauggaaaaugggguauccauccuucaagcauuuauccuuuguguuacagacaaucuaguuauacuauuuuagucauuuuaaacuguacaauuauuauuaacuauagucaccuuguugugcuaucaaauacuaggucuuuuucauucuuucuguuuauuuuguacccauuaaccauccccaccuccuccccaccccacuacauggugauuuugaaauuaaacacguccauaggcccaaccuguuaucugcagccaguuuuuaaucuauguaauaaggucugaacucuuuuaaacuguuaugucauacuaucucucagugcuuaguuucauguauguacuaaauagauuaaggaagugaagacccuuauacguaagcuacacagauacagauauauauuuuaucugaaacaccaaguccuucauucaucugccuuaagcaaugaaguucucauauaagauaugucucacauuaagcugaugcucacccggagaugaugcuccagguauuaugaaugcuuaguuuauucucguuuacuaaucaugacuuucuuucccccucuucuuuuuuuucugugauguagcuuucacuuucagaagaacagaaugaaguaaugaaaaauggcugugaaucuaaagagcuggucuaccucgugcagauugcuugucaggugauuuugugaauguauucuccauuucauaugaaguuaagaauuagguugagugaugauuaaauuuauuucuauaacgugauuugccuaaaggauauaauccacagaaaaauacuuauauaauacugaaaugagauugugcaauaaugacuauuguaagaaaauaaaugguauuauuuuaaaacagaaauaaguguauucauacaauacuacauggaauguagaguugagcauugcaacuugcaugucuccucuuugcacuuuuagaaaguuccuaaggcuuuugacacuuaugaguaaauaacaaugacugugguaaucaagauuuuuuguuucauucuuuaaucuauacccuuaagugaaaauacuuuuauuaagacuaaaggaaagauauuuauugaucacuacauuaaaugauucagcuauugaucacauauuauggcaaaagaguagauuauguuaucucugcuucagaugcacacuuuuucuaacugagacauuaaguuucucuucgguguaacaauaggauaugugcauguuuuuguagcuuguuauuucuugacuuuuaauauuggaacuguuuugaagguaaugaccaugacuuguucuuaaugagacuuaaaauaugucauuuguagcauugauuauuucccccaucauguaagcacuuaguauaguucuuuuauucacuuauucuacauucuuugagcuuuuugccuacuggugaauuagucauuguaaagaaagcauuuaggaggaaagcuuucuucuauacaaaguuuucagcuaucuuugggagagaguaagauaugggcauuuauauuuuuucucaaaaaguauuaaucauguaccugaagcuaaaugauccaaaaaaguccaaugcuuucaucgugugugauauacugaaguuuuuaguuguggucaccuuaaggaaaacuuaccagaauuaagugcguuucuuuuuaggugucagaguauaggauuggaaaucaaauuuuagcuuguauauaaauaaguaagauggccaaauucacguauuguuuauauauguuuuauugcaugucaccuuggcuucuuugagaauguagggaagcucuuaauuacuaaguuucaugucauauuucauaaaaugcuuccauuuggugaguuaauuuuuaagugaaaauauugagugcauuuaugauaagugauuacuaauagauggaugaaaaucauaucuuuuuuaucuagaguacaucguugguaugucaggaaugaauuucuuaaucccucuacaaccuaagacauuuuagcaucucuuuuuucucacuguuaauuuccauaugcuucgagaaugcaaauguucuuuuucuuaugaacaaagcauaacaugaaaaaaauaaaaaaaaaucugugcuguuuuuuaaaaugaccuucagaaggcaagcaugguauuuugguaccaaauauuauaacguauaauuguuacuugauuuuuauauucauguacaguauuagugaccuagauagauaguucguuuccugguauaaguaucuugucaagcuucuuaaaaaauuucauacuacuugguauaccauuuguuauaucaaaguaguaauuuagugcauuguaauaaugcauuugcaccuguucuuugccucauuguauguaaucauugauauauucccauggcuuacuccuguauucuugacauauuguguuagccauaacccauauuagccuagaaucauacuuuuuuauaacuaagagagaaaaagacauacaauuagacccucuaauuuugcaagugaggaaacugagguccaaauuacugaaguugguguccuaagcuauacagaguguuagcaguggggacuacaaggauuucaguuucuugacugccaccuuuuucugugucuauuucacucuauaacaaauuugagaaacugcuuaaucuucagauaagaccaccauuauacacugauguaaucuguuucagagucuacuuauuuacaaauuuuauaucucugucaguuucuacuuuuuaauaauaucacuugauguucuuuuuauuuaaccaaaauucuugguccuucaucuuaacccuuucuucucuuauucuguuagcuuauaaaagugacagauugauuggcugugaucuuuuuucuuucuguaaguuaagugauacugauuucuuucagucuuaucuuggaaacuuugaaaugugucugugccugcccuuaaaaguuuuuauuucuuucuaaauugugagcccagaauuguaaacugucuuccaguuuacauuuggaaccuucaaaucuagagccccuaagggagcacccaggccaacuggggacuguaaucuuagugauaguaaaaauauuuaaacagcugauacagcauggacccaaagcaauagaacagauacuaguuauaccgaucucauuuacccauauuggugugucuuagcugaauacuagccauggauaaaaugcuuuuuaagaugucuugaauaauaggucugugaugcuguggugagcccacaacucccucccuuucauaguaauuaauuagaauuacaugucgugcugcagauauccccucccuuaucuuuuuauucuguucucugaguaaacgaacaaaggugucuguugagagaacaaacagaucagcuacuguggaugaggaaccuucucaagaaaguuaauguauuuaguuugaaauuaauggaaauuaauaaaaauucuaguaaucucaggaauaugucacaguagauauaaaauuuaauaauuuuaaaaggccaaaauuagauaaacccugacacuaauuauauugagccccacuacacagaauaaaacguuuugugaguuuaacaucaguguuaccagguccuaaaaguauucugucuuuuagugcuuuauucuuuagcaaauaagcaucagcuuuuaaauguucauuuuaaaauggcaaauuuaagcccaucuguggugggcguuuuuuucuaccugugcuguaauaaaagucuuguuuugaucuuuuccuucuguaaaucuaguuuuguugguauaagaauaauuguugcuuaguaaaauacuuaggauuuuaauguuucacugucagcuuuauaguaguugauauuaaugguuccuauucaaguuaagaguguauuaacuaccuuuguauuuuaagcagaauucaucaauauuuaauaguuugauuuuucugaagaucaaguauuuuauaaauauauacaguaaucugaaugcucuugugucaugguagguggguuaaucacuugguuucaggggaaugcuuccuugccucagaauaucuccugugcucuaauguucucaugcuugaaauuccaucaucaaaaaugcauuccuugauauuaaguaacuccuuuuccauucagggcauuagaaaaugcuguuaacuacaggagugggaguaaauauuaacauuuauagaacauaugugcaugaacaaaauauauaggcagauugccaggauuuuuauuuaaccucauaaugcuucugugaaagguaggugucauuuauucccauuucauagaugaguaacgugcuguucauugauguugaguaacuugcauacauuucuguauuuaggauagggccaggcugagauuuaagucucucccucucucucucuuuucauugaacuucauccauuuaaaaagauaauugauagcauccauuguuuuucagauaaucccaugacaaagggacuuccaaggacauaagcaaagacuguucuuagaaugacaguuauuucuaaaauuuguccauuucuuuccauuuuuauuguuaccaagcuagcucaagcaugaucucuuguuugggcugauguuugcauccuauaaucuauuauaaccuuauaaacugccagaaugguauaaaauguaaaucaaauauuguuaguaucgugguugaaacucuuggauagauucccacugcauguggagcuaaacccaaacugcuuaccgaggucuacgaggguccuacacaaucuggguaucccugccucuucuacaucaugucaggaccaucccuccucacucgcaugcuguggucacaccagcuuucgggcaguuuguaaaagggccugaguucuuuccuguacuuugaucaucccaugacuccguucacacugugcucuugcuacaucugguagcuucccagucuuuaggacuugauuuagauaacaccuccuuagaaaggcuguuucugacccuaugugaaguagaucccuccuuauuucuucagaguaugaaacuaucauuuuauuuauguguuuguuuacuuuaaaaaguauuuguuuuccucacuagaaacaaauucuaagaagucaaagguuuauuguuuaucauuucuguaucgcaucucuagugcuuacuacagugcuuagcaccaugugaguggucaguaaauagcuagugaauaaaugagugaaagaagaacaaauucuuaucauagaaaucugauccuacauauguugggauauuuuuuucucauucugcauccucagccuuaucaagaauuguugauuuuugucaugcuuggauaguaguaguugguaguaauugguaguaaugcuugcucuuuuuuuuuuuuuuuuuuuuuuugacaaggucucucucugucacccaggcuggaguacaguggcaugaucacaguucacuacagccucgaccucccaggcucaagugauccuccugccucaccuggcuaauuucguacuuuuuguagagacaagguuuugcuguguugcccaggcuggccaugaaccagcucaagugauccacuuaccucugccucccagagugcugggauuauaggcaugagccauugugcccagcugguagcaauaauuacuaagaugaaaaauuagcaaauuaaaauuuuggcaggaguauauaaggaagagauuuugauuuauuccuuuacaaagucauugaacuuuaaaaauacucugauuguuuauucagucuguuuggaaauugguugaucaaggcucuauuuuauugauugauugauugauugagaaggagucucgcucugucaccagucuggagugcaguggugugaucucggcucacugcaaccuccaacucacagguucaagugauucuccugccucagccucccgaguaucugagauuacagacacaugccacagugcccagcuaauuuuuguauuuuuaguagagacgggguuucaccauguuggccaagauggucuugaacuccugaccucgugauccacccaccuuggccucccaaagugcugggauuacagguguaagccaccgugcccagccaaucaaggcuauguuuuuacauaugaaaguacuuuacauuuaaaguucuuguuuuauaucugcugaaaauacaaaguauuuacuaguuuuauaauuuuacucagugaauuuaacguaguuuuagaugauuugcaaauuauguguuagaguuuuaauuuuauaaauggagauguauauaaaagauuagacuuuuugcuggccuaaaaauauuuuuaagaaguugaaagaaaucacuucaugaauauaugaggaacuacauuuugaaaucuaauucccugccuuaacuuuuugaagcucccgaaggcauuugugugguuggcaguugacacuuauuuuuuugaguaacacuacuuagauggaagaugauuauuuuucaaaaaauuaauaacuuuuuauuuuucagacaaguuuuacauucacagcaaaauugaacaggaaauauagaguucccauaagcuccauguuuugacacacaugcaacaucccccacuauugacaucccacaccacagugguacauuuguuaucauugaugaacuuacauuguuacaucauuaucgcccaacuuuauaguuuacauuaggguuuacucuuggagguguauauucuauagguuuagaaaaauguguaaugacauguaucaccaguauaguaucauacagaauaguauuauaaaaauccuccgugucccucugauucaucuuucccuuuucucuaaccccugacaaccacugaucuuuuuacugucucccuaguuuuugccuuuucuaagauaccacauaguuggauucauacaguauauagccauuuggauuggcuucuuucacuuaguaauaugcauuugaauuuccuacaugucuuuuuauggcuugagaguucauuucacuuuagcacugaaaaauauucguugucugguuauaccacauuuuauguauucauucaucuacugaaagacaucucaguugcuucuagguuuuggcaauuaugaauaaaguugcuauaaacauuugcacgcagguuucuguguggacauaaguuuucaguucauuuggguaaacaccaaggagcaugauuacaggauugcaugguaaaaguguuuuuaguuuuauaagaaacugccaaacugccuuugaaagugacugugccauuuugcauucccagcagcaaugaaugacaguuccuguugcucuacauccuugccagcauuuguugucaguguuuuuggauuuuggccauucuaauauguuauguaguagcauuucauuguuuuaauuuggaauucccuaaugacauaugauguugagcauuuuuauaugcuauuaaccaucuguauaucugucuucuuuggugagaugucuguucaaaucuuuugccuguuuuuuaauuagguuguucauuuucuuacuguugaguuuuaugaauacuuuguguauuuugguuuacagugcuuuaucagugugucuuuuuuuuuuuuuuuuuugagauggagucucacucugucgcccaggcuggagugcaguggcgcaaucucggcucacugcaagcucugccucccggguucacgccauucuccugccucagccuucugaguagcugggacuacaggcgcccaccaccacgcccggcuaauuuuuuguauuuuuaguagagacaggguuucaccgugcuagccgggauggucucgaucuccugaccuugugauccgcccgccuuggccucccaaagugcugggauuacaggcgugagccaccaugcccggccaucagugugucuuuugcaaauauuuucugucgauuuauggcuuauguucucauucucuugacauugucuuuugcagagcagaaguuuuaaauuuuaaugaaguccagauuauuauuuaucuuuuucauggaucaugccuuuuguguuuuuuaaaaauaucaucgcuguaacuaaggucaucuagauuuucuccuuuauuaucuucuaggaguuuuauaguucuguauuuuacauucauucagucugugauccauuuugaguuaauucuuguaaaagguguaaggucugugucuagaaucguuuucuuguugcauguggauguccaguuguuccaacacccuuuaacaagucuguaucauguguccauuguauugccuuuguucccuagucaaaugucaguugacuuuuauaugggucuguuucugggcucucuauucugcuccauugaucaauuugucuguucuuuuggcaacaccaugcugucuugauuaguauggcuucuuuuuuuuguuuuuuuuuuuuguuuguuuguuuguuuguuuuuuugagauggagucuugcucuguugcccaggcuggagugcagugucaugaucucagcucacugcaagcucugccucccggguucacgccuuucugcugccucagccucccgaguagcugggacuacaggcgcccgccaccacgccuggcuaauuuuuuuguauuuuuaguagcgacaggguuucaccauguuagccaggauggugucaagcuccugcugcccgucucagccucccaaagugcugggauuacagguaugagccaccgcacccagccuaguaugguuuuauuauaagucuugaggucugguagugucagccuuccaacuuuguuuuucuuuucuuucaguguugucuugguuuuucugggucuuuugcuucuccauaauacuuuagaaucaguaucaacaaaauaacuugcugggauuuugacuggaauuguauugaaucuguaaaucagguuuggaagaacuggcaucuugacaauauugccuucuuauucaugaacaugcaacauuucuccauuuauuuaggucuuugacaucuuucaccagaguuuuguaguuuuccuuauauagcuguuagguguauuuuguuagauauauagcugucuguguaguuuguuuuuugggugcuacuauaaacauuaauauauuuuuaauuucaaauuccccuuguugugugcuggcucaugccuguaaucccagcacuuuggaaggauuaguaggaggaaugcuuggcgacugaggcuaggagauugagaucagggcaacauagugagaucucaucucuauaaaaaaauuaaaaauuagccaugugugguggugugugccuguggucucagcuacuuaggaggcugaggcaagaggaucgcuuaagccuaguacauugaggcuguaaugaggcaugauuguaccacugcacuccagccuggaugacagagugagacuuugucucuaaaaaaaaaaaauaauaaaaccaaacaaaauuucucuugcucauugcugguauguaggaaacugauuagguuuuguauauuaaccuuauauucugcagccuugcuauaaaucauuuauuagugccaggaguuuuuugucaguucuuuugauuuucuguauagauaauccugucuucugcaaacaaaguuuuauuccuuuccaaucuguauaccuuggguuuccuuuucuuauuguauuagcuaggaauucugauacuaucuugaaaagaauugauuacagaacaucauugcuuuguuuuugauccaagcgggagaguuucaaguuugucaccauuaaguaugauguuagcuguacguuuuuuguagaugcucuuucucaaguuauggaaguucccuuuauuucugguuugcugagaguuuuuuaugaaugggugauggauuuucuuaaaugcuuuuucuguguuuauuggugaaaucaugugauuuuuauucuucuuuagccuguuuaugugauggauuacauuaguugauuuucaaauguugaaccagccuugcauuccugggauaaaucucacuugguaguggcauguaauuguuuuuauauauuguuggauuauaguugcuaguacuucauugaugauuuuugcauguauguucaugagagauauuugucuguaguuuuuuuuuuuuuuucuuuuuucuuagaaugucuuugucugguuuuggucuuaggaaaauguuggccucccagaagaaguuagacacuucucucugcaucugucuucuggaagagauauagagacuugcuauaauuucuuucuuaaauguuugguaaaauuuaccagugaauacaucugggcuuacugguuucuguuuugcaaagcuauuaacuguuaauuagauuucuuuaaggccuauaucuuuuucuucuugugugaguuuugguggauguaucuuuuuaaaaauuggccaguuucaucuguguuacaaauucacaggcauagaguuguuccuaauauuuuuuauuguccuuuuaauguccaugugaucuguagugacgguccuuauucauauguaauguuaguaauuuguguauuucucucugucuuuuuaaguuaguuuggcuagaagcuucucaauuuuauugacauuuucaagcaauucacuuuugguuuugguaauuucuguuuucaguuuuguugauuucugcucuaauuuuuaguauuuauuuucuuuucuuuacuuuggauuuaauuugcucuucuuuuucuaguuaccuaagguaaaacuuagauuauuguuauuagauguuucuucuuuucuauuucaauagcuuuuuggggaagcggugguguuugauuauauggauaaguucuuuaguggugauuucugaaauuuugguguacccaucaccugagcaguguacacugugcacaauguguugucuuuuaucccuucuucccaucaucccccugccaaguccccaaaguccauuguaucauucuuaugccuuuguguccucauagcuuagcucccacauuguacgaacauacaauguuggguuuuccauuccugaguuauuucacuuagaauaauggucuucaacuccauccagguugcugugaaugccauuauuuuguuccauuuuauggcugaguaguauugcaugguauaccacauuuucuuuaucuacucauugauaaaugggcauuugggcugcuuccauuuuuugcaguugcaaauugugcugcuauaaacaugugugggcaaguguccuauaaugacuuacuuucuucugaguagauacccaguagugggauuguuggaucaaaagguagaucuacuuuuaauucuucaaggaauguccacacuguuuuccauagugguuguacuaguuuacauucucaccaguuuucccuuuuuaccacaucaaugccaacauguuauuuuuuuauuuuuaaauuauggccauucuugcagaaguaaggagguaucacacugugguuuugaugugcauuucccugauaauuagugauguugagcauuuuuucauauguuuguuggccauuuguauaucuucuuuugauaacuguuuauaccccuagcacacuuugugguggaauuauuuguuguuguuguuguuguuguuguuguuguuuugucuugcugauuuauuuggguuccuuguagauucuggauaucaguccuuugucugaugcauaguuuguggagauuuugucucacucuguggguuguuuguauacucugcagaagauuuuuaguuuaagucucaucuguuuaucuuuguuuuuguuucauuugcuuuuggcuucucgguuaugaagucuuugccuaagccagugucuggaagaauuuuuccaauguuaucauccauaauuuuuguggugucaggucuuagauuucagucuuugauucaucuugaguugauguuuguauaaggugagagaugaggauccaguuucauucuucuacaugugacuugccaauuaucccaccaccauuuguugaauaggguguccuuuccccacuguauguuuuuauuugcuuugucaaagaucaguuagcuguauuuggcuuuauuucuggguucucuguuguuccguuggucugugugccuauuuuuauaccaguaccaugauguuuuggugacuguggccuuauaguguaguuugaauuuggguaaugugguaccuccagauuuguucuuuuugcuuagucuugcuuugguuaugugggcucuuuuuugguuccauaugaauuuuaggauuguuuuuucuaguucugugagaaaugaucaugguauuuugaugggaauugcauugaaucucuagauugcuuuuggcaguauggucauuuucaccauauugauucuacccaugagcaugggauguguuuccauuaguuuaugucaucaaugauuucuuucggcaguguuuuauaguuuuucuuguagagauuuuucaccuccuugguuagguauauuccuuaguauuuuauuuauuuauuuauuugcaacuauuguaaaagggauuaaauucuugauuguauucucagcuugguugcuguugguguauagcagugcuguugauuuguguacauugacuuuguauccugaaacuuuacuaaauucacuuaucacaucuaagagcuuucuggaugagucuuuaggguuuucuagguauacaaucauaucauuggugaacagcgacaguuugacuuccucuuuaccagucugaaugcccuuuauuucacucucuugucugauaguucuagcuaggacuuccaguacuauguugaauagaaauggugaaaggaggcauccuugucuuguuccaguucucgggggaauacuuucaacuuuuaccuguucaguauaauguuugcugcggguuugucauagaugaguuuuauaagguaugucccuuccauacugauuuugcugaggguuuuaaucauaaagcaaugcuggauuuugucaaauguuuuugcugugucuauugagaugauugugugacuuuuguuuuuauguuuauguuguguauuacauuuauugacuugguuauguuaaaccaccccugcauuccugguaugaaacccacuugaucaugguguaauaucuuuuugauauucucuuggauucaguuagcuaguauuuuguugaggauuuuuacaucuguucuucagggauauuggucuguaguuuucuuuuuuuuguuauaucuuuucuuaguuuugguauuagagugauacuggccucauagaaugauuuagggaagauucccucuuucucuaucuuuuggaauagugugaauuaggauugguaccaguucuucuuugaaugucuaauagaauucagcugugaauccaucugguccuggacuuuuuuuuguuggcaguuuuuaaaauuaccauuugaguauugcugcuuguuauugguauguucagaguuucuauuuauuccugguuuacucuaggaggguuguauaauauauuuccaggaauguauccaucuccucuagguuuucuaguuuaugcacauuuaaaguaguucauaauaucuuugaaugaucuuuuuauuuaugugguuuuaguuguaauagcucccauuuauuucuaauucagcuuaguuggaucuucucguuucuuuucuugguugauauugccaauggucuagugauuuuauuuaucuuuucaaagaaccagcuuuuucuuuuauuuuucuuuuguauuuuuuuuucuuguuucaauuucauuuaguucugcucugaucuugguuauuucuuuucuucugcuggguuuggguuugguuuguucucguuucuguaguuccuugaagugugaccuuaguuaucuauuugugcucuuucagacuuuuuugauguaggcauuuaaugccaugagcuuuccucuuagcaccacuagugcuguauccaaaagguuuugauagguugugucucuguuaucguucaguucaaagaauuuuuaaauuuccaucuuaauuucauuguugacccaacaaucauucaggaacagauuauuuaauuuccauguauuugcauaguuuugagggcuccuuuuggaguugauuuccaauuuuauuccacuguggucugagagaguacauguuauaauuucgauuuucuuuaauuuguugagauuuguuuuguggccuaucauauggucugucuuggagaaugauccauauacugaugaaaagaauguauauucugcaguuguuggguagaauguucuguaaauaucuguuaaguccauuuguucuaggguauaguuuaaguccauuauagcuuuguugacuuucugucuugaugaccuauuuagugcugucaggagaguauugaagucccccacuauuacuguguugccaucugucauuuuuuaggucuaguaguuauuauuuuacaaauuugagagcuccaguguuaggugcauauauauuuaggauugugauauuuuccuguuggauuaguccuuuuaucauuauauaaugucgcucuuugucuuuuuaaacuguucuuacauuaaaguuuguuuugucucauguaagaauagcuacuccugcucacuuuuggugucccuuugcauggaauaucuuuuucuaccccuuuaccuuaaguuuaugugaguccuuguacuuaggugagucucuugaagacagcagauacuugguuggugaauucuuacccauucugguguucuguaucuuuuagguggagcauuuaggccauuuacagucaacauuaguauugagaugugauguacuauucuauucuucaugcuaguuguugccagaauaccuuauuuguuaguuuuucauuguuacuguuuuauaggcccugugagauuuaugcuuuaaggagguucuauuuugguguauuuugaaguuuuguuucaagauuuagaacuccuuuaagcauuucuuguagugcuagcuugguaguggugaauucucucaacauuuguuugucugaaaaaaacuuuuuuuucuuucauuuacgaagcuuaguuuuucuggaugcaaaauucuuggcugauaauuguuuuguuucaggaggcuaaagagaggcuuccagucccuucuaguuuguaagguuucugcugagaaaucugcuguuaaucucauagauuuuccuuuauagguuaccugaugcuuuugccucacagcucuuaugguucuuuucuuuagaaacccugaugacuaugggccuaggugaugaucauuuugcgaugaauuuccugguuguucuuugagcuuauguuuggaugucuggcucucaagcaaggccagggaaguuuuccuugacuguucccucaaauauguuuuccaaaccuuuagauuucucucauuucuugggaauacuaauuauuguuacguuuagucaucuaacauuaucccaaacuucuugaaggcuuuguucauuuuuuaauuuuuuuuccuuugucuuuguuggauuggguuaauugaaagccuugucuuuggguucugaaguuccuucuuuuacuuguuugaaucuauuguugaaaauuuccagucuauuuugcauuucucuaagugugucuuucacuuccaggaguugugauuuuuuuuuuuauuuauguuauuucucuggagauuuuuuuguccauaucuuauauuauuucuaaaauuucuuuaaguugguuucaccuuucucuggugccuccuuaagaagcuuaguaaucaaccuucuggccggguacgguggcucacgccuuuaaacccagcaguuugggaggcugaggugggcagaucaccugagguuaggaguuugagaccagccuggccaacauggugaaacccugucucuacuaaaaauacaaaaguuagccacgcguggugguguaugccuguaaucccagcuacucgggaggcugaggugagagaaucacuuggacccaggaggcggagguugcagugagcugagaacgugccacugcacuacaaccugggugacagagugagacucugucucaaaaaaauuaauaaauaauuagccuucugaauuauuuuucuugcaauucaaagaguucguuuuuguucggauccauugcuggugagcugacgugaucuuuuggggguguuaaccuuguuucgucaucuuaccagaguuguuuuuucugguuccuucucauuuggguggacuaugucagaggaaagaucuuggcuucaaggucugcuguucagauucuuuugucccacagagugcucucuugauguggugcucacccccuuccccuagggauggggcuuccugagagcuggacugcagugauuguuauugcucuccuggaucuagccacccaguggaguuaccaggcuccgggcuggugcuggggagugucugaugugauccaucuucaggucucucagccauggaugccagcaccugccccaguggagguagcagaggaaugaagugggcucugugaggguccuugguuguucuguuuagcauacuggguuuuuugaaugcuuguuaugcuagcagugaaguugucagguggacagacucagguccugugguuagccaggauguuacagguuguggaauuagcugucauuuucuccuuucuuagagcaguuuuuuaaugaguugcuguaauggcgugaguugguuugcuuccagccaggcgguggcgcuuugaagagcaucagcugugguaguauagaggggauacaagcuuggcuaaggucuccuggauaaguaguuugguuucucaggugaagggugaggccauggaguucccaagggauuaugucuuuugucuucagcuaccagggcagguagagaaagaccaucagguggggguagcguuaggcggaucugagcuugggugaggguugcugcaggugcugugggggauggggugugauucucaggccauuggaguuaugaucuaagggggauuaugacugcuucugcugcaucauacaggucgcuagggaaguuggggaaaguuggcagugacggguuucauccagcucccaugcagccaggaaggccagucucauucccacugucccccaucaacagcaccaaguuuauauccugucagcuggugagcaggacugaaaucuugccccaggcuacaagccucccugcugagaaaacacgcagggcuuucaggcuucaccccuccccaucuaccuugucuucuguacuccuaucugugcuuccuguuuaccucccaacccaaccuggauucugcguaggaaaauuugcgcuucaucaaaguuauuacagaauugagcuggaacuuuccuuuuuccuguggucuauccccaguuccacuggcaucccucccaaagaaccccugugagauaaagucagaaauggcuucccugggccucucuagggaccaggaagugcccaggaaagugucuacagggcucuuccagcugcugcuucuacuuuuauauuucacucagcucucuaaauucauuucugcucuagguaagguuaaaucuuucuuccaugaucuggauuuucggguuccccagugaggaugaguguucagaggcagacuuucccccuuucacacuuggggcacucacaguuuuucagcugucucauggaguuugcagcagccaacugcuuuuuuccaacgguuugugacuucuuuugguuuuccugguauguuccugggaugguuuugggaggaagaguucaugaugugagccuccacaugcuguucugucuguccgagugggaucugcaaguuagucuugccuccuagccaccauuuuucuccucucuucuuuucugaugcaugcguucaaugcuauggauuuuucucuaagcacugcuuucacugccucccacaaauuuggguaaguuguauuuuuguuuuuauuugguucaaaauauuuaguaauuucucuugagauuucuucuuuuacccauguuuuauuuagaagugugucauuuaaucuccaaauuuuuugguauuuuucaacuauuuuuucuauuauugacuaauaguuuaauuccuuguggaaauuuuuucuauuauugacuaauaguuuaauuccuuguggucucauuacugaaaagagguccugauccagaccccaagagaggguucuuggauauugcacaagaaagaauuuggggagagcccauaacgugaaagcaaguuuauuagaaaaauaaaggaauaaagaauggcuacuccauaggcagagcaacagcaugggccgcucguuggcuauuuuuauguuauuucuugauuguaugcuaaguaaggguuggauuauucauggguuuucuagggaaaaaggguggguaguucccagaacugaggguuugucucauuguuagaucauauaggguaacuucuugacguuguuaucucauuuguaaacuguuguggugcuggugggagugucuuuuagcgugcuaguacauuauaauuaguguauaaugagcagugaggaugacuaaaggucacuuucaucaccaucuugguuuuggcggguuuuggccggcuucuuuaccgccugcuauuuuaucagcaaggucuuugugaucuguauuuuguaccgaccugucucauccugugacuuagaaugccuaaccuccucggaaugcagcccaguaggucucagccucauuucacucagcaccucuucaagauggaguccuucugguucaaacaccucugacacucugugagcagacauauuaugaauucuguuuuuuaaaaacuuguuaugguauguuuuaugccccagaaugugguccccaagauacagugacuguuccauaugagccucagaagcauguguaauccguuguuguuaagguauucuaucaauaucaauuauauccaguugauugaugguacuguuaagucaacuauuuucuuauugauuuucugccuacuggaucuauucauuucuaauagggggguguuaaauaauuucuuauagaggguguuaaauaauuacaacuguaauuauuucuccuuguaauuuaaucaguauuugccucacaguacuuucauagucuguuuuuaagcacauaaauauuaaagauuguuuuaugucuucuuggaguauugauccauuugacauuacugagugccccauuuaucccucauaacuuucuuugcucugaagucugcucugacugaaguaaauauagcuauuuuugcuuuuuuaauuaaaaaauuaguauggcaucucuuuaucauuuuauuuuaaucuaucuuauauuuaaaguugauuucuuuuagacaguuggguccuguauuugauccacucugacaguuugucuuuuaauugguauguuagaccacugauguuuaaagugauuauugauguaguuggauuaauaucugccugucauuguugcuguuuauugcccuuguucuucguuccuauuuuuguuuuccauacuuugucuccuuuuuguguguuuuuuuccaacuuuauugugauauauauaauugucaaauaaaaauuacauauauuuaagguguagaaugugauauuuugauauguguaugcguugugcgaugaugacugcagcugaguuacauauccaucaccucacaguuaccuuuuuuugcauguguggugagaacacuuaugaucaauucucuuuuuuuguuuuuaauugagcauuuuauauguuuccauuuugucuccuuucuuagaauaucaauuacauuaaaaaaaauuuuuuuaggccgggugugguggcucaugccuguaaucccagcacuuugggaggccaaggcgagcggaucauguggucaggagaucgagaccauccuggcuaacauggugaaaccugucucuacuaaaaauacaaaaaauuagccaggcaugguggcaggugcuuguagucccagcuacuagggaagcugaggcaggagaaucgcuugaaccugggaggcggagguugcagugagccgagaucagaccacugcacgccagccuggguaacagagcgagacuccaucucaaaaaaagaagaaaaauuuuuuuuuuuagugguugcacuacagguugugauauacauuacaacuaauccuaguucacuuucaaauaauuauacugcgucauggauugugcaggugccuuguaauaaaaauuauuuguaauuccucucuauccuuuguauuauuacuaucauucauuuuacauauagaaaucauacauaaguauauacauauacacauaccuccauacacauauauauguaaaacacacauagucaaguacauuguuguugcuauuauuugaacaaacuguuaucuguuguaucaauuaagaauaaggaaccaaaguuguauuuuacauucacuuauucuucuccauuacuuuuccauucuuuauguagcuacagguuucugaucugugucauuuucuuuuucuuuaaagaacuucuuuuacauuucuuacagagcaggucugcuggccacaaauuuucucaauuuuuguuugacaagcuuuauuucucuuucauuuuugagggauaauuuugcagaguauggaauucuagguugcuggguagggguuauuuuguuaauacuuaaaacauuuacucuacucucuucuugcuucugugguuucugagaauauguuauauaauuccgauuuugacccucuauagguaagguguuucccccgcaaacucccagcuucuuucaagauauuuucuuuaucuuggauuugcugaagguuuuuuuuuguuguuguuguuuuuuguuuguuuuuuuuuugaggagggugaugcaauuuauccugcuuuauguucucugagcuuccaggacuggugauuuggugucucggucauuauugcuagaaauauugguuuugcuccuuucuccauuucuucuccuucugguauuuucaguauguauguaucauaccuuuuauaguuuucccacaauuucuagauguucuguuccuuuucuuuagucuuuucucucuuugcauuucaguuuugguuguuucuauugugauacccucaagcuccaauucuuuccucagcuguguccagucaacuaaugaauccaucaaagacauucaucauuucugcuuuugaucucuagcauuuuuuuauucuuuguuauaauuuccaauucucugcuuacaucuguucuugcauauugucuacuuuuuccuuaaagcuuuuagcagauuaaucauguucuuuuaaauuauuggucugauaauuccaacauuccugccaucuuugacucuuuuucugaugugucuucagucuuuuuaaacgguguuuuuuuccuuuuaguucacguugugauuuuuuguugaagguggacauaaggugggucaaagaaguauguuaaauagcccguuaguaaugugaugguaagguguguguguagggggaagcauuccauaauccugugauuaggucucagucuuuuugugagccugugccucugaacugugaacuucacacgugaaucucaguucacagcccuccauccugcaccuuuagguaggacacgaugacuggagugggcuggaguuugguauuccucuucuccccaguggaaagcuugaagaagcuggagcuguauuuucuucuuacuccagaaaaugaggcugugguaagaguuuuuccugagggcagacuuuguugaaaacauaguguuuggguguguuucagaaguuuauuuucuccugucccucuuaagagcacaaggagauuuuuuucagauauuuacugugaggaccuaguagagcucacaaaaguguguggcucccgugacgggguucucugggaguuuuuauugcucagacuugucaucccugagccucuagcaauuuaucaauuauagauuaaguuuuccuacccuagcacugguucccacagagguuucugcguguggauuucugcuguggguaagugcaauucucuguauuuaccugucugccucuaauuugggagggggauagugauuuguuccgugaccccacuucuguaacagaucuaagaaagaucuguugauuuucacuuuguucagcuuuuuacuuguuaaccagugacuucugagcuccuuacauagcagaccaguaaccagaaguccagugauuacuuuguaacuagacggacauugaucacuucugaaauggaacuguaucaugaauguauuuuuguauggccugucauuuccaugugguacuugguaacacaaaaccaaaugaacuagaaguugagcuggcagaacaaauaaaaagcguauaacaaaaaauauuuuaauaccucuuuuaaaaauauauuuuaaauaccucugugggaagaaugccugaagcaaaugagaccaacacauuucuuuuuuuagugauucauauucugaaguuauuuauuuuuucuaccuuaacuacuuauuacuuauuccuccuaacuacaacuuuguacccauugaccaacaucucuucacuuucccuauccucagcucauguuaaucaccauucaacucugcuucuaugaauucaguugauucagauucuacaugugagaccaugugauguuugucuuuuuuugccaggcuuauuuuauugcgcauaauguccuccagauuuaucaguguuguugcaaaugacaggauuuccuuuaaggcugaauaguauuccauuguguacguauaccacauuuguuuuuaucuacugauccagugauggacacuuaaguugauuccauaacuuggcuauuguaaauaaggcuauagugaaccaaggagagcagauaucuucuugauauacugauuucaaguucuuaggauauauaucuagaugugggauuauugagucauaugguaauucuauuuuuaguuuuuugaggaaccuccauauaguuuuccaaaauggcuguaccaauuuauauuuccaauaaaaguguauggggagucccuuguuuccuuuucucuacagcuuugccgacaccaucuuuugccuuuuugauaauagccauuuugacggaugcaagaugauaucucauugugguauuaauuugcacuugccuaaugacuagugauauugagcauuuuuucauaauaucuguugaccauuuguauguuaucuuuugagaaaugucuguucagugcuuuugcccauugguuaauuggguuauuuuuuuuuucuguagaguucuuugaauuuuuaaaauauauuucagauauuaaccccuuauaagauguauuuuuucccaaucuguggagguuuucuuugcccugauaaucauuuucuuugcugugcagaagcuuuuuaguuugauauaaucccauucaagacuaacuaauuucucuuugagaucuuuuaagcagaaaguucaauauuguguaauaaaccauuuaauaaauaacaucaguauacauucaaggaauuuucuugauuguaacucacugaguguuacagcucucaaaggccuaaguagguuacagcucucaaaaggcuaauaguuccaucaaauaauuugauuaaacauacaauuauacuguaguuugaugauauguuauaguaauauacaauauacucaguagaaagguuggcaaaaauaugaauuuuuuauaaaagaagaaauaaaagugacugagaaauaugaaauuguguuuagcuucauuaagucaauaaaaggcaaaugaaagaagauacaguuuuucaccuacuggaaaauuuuuaagucauuauuuuuaguauuugugaggaugcauuugaaauagacccaagcaguaaaaauugguacaacgugucaauuuuuaggaauuuuguauguauuuauuuuaacuuuucauuucacaacgauuuuagacucacagaaaagcuauaaaaauagaacagaaauauccuauuuacccuuaacccaguuucugcuaaugucacauuuuuaggaauuaaugcuaagaaaguauaagacauugcaacauaaacuuaaauacaaauguguuauuuauaaucuuguuaucaauuauuguacugucaucuuagaacucccaaaucugucaguuuggaaguuuaaacaccuuuuucaaaaucagucuuuauuaguggaggcauuguucuagugucuggcugggcauguuaacaauuuaaccaaacuaauauuugccugcuauacuccaugcaugauagaugcaugagcaauauagcaugcaaaaguuauuuuuauuccagacagcuuuaacagugagaaaaauaccaauagugauagcuaauauuuaaugaaugguuuccagggagucuguuaagcaccuuacguggauuauuucacuuacucuucugacaaccccaguuacuauuagccuccccauuuuacagaugaggaaacuguggaauaguuauauauggucaagugauuagcacauagccuaggguaguauaaauucagaucuugcauucucaauuacuggcugcuguucucauucuuucucuuuuucuucuuucuucccucuguuucacacuuauguagcucuagaaaucuauuauguaagacaagggaaaaugauauuccaacuagcaaagauuaccuuauaauacaccagaacacucucuauuuccuaaagaguguuggcugaaaaaggauuagaagcaaagccaauuucucuucuacaagcaccaggcaccaaaaaaugcaggacuacauuucagugaucuugaccacuucuuccaaaggaguaauaaaugugagccuaccaaauugcagaucauuucucuccucaccuuuaauaccauggaauaauuguacacauguuuggaguugaagccuaauacaucuucucgugaaaaggagcagaaaaacaaaacauaagugaaugaucaccagggcaugcugaauuauuccaaaacaauaauguugaauuugagauuuuauucuccaaagcugaagcugaugauucagccaauauggaaagcaaccuuugaucucuaaagauauauuaacuuuuagcugacugaaacccugaugcacuaaaaaguaauuguuaagaauguucuuuugucuuuugaguuguugaacauuggugacugguugcuuguucugcuaaauauccugagaauuuguuuggaaaccuuguuuucuacuuuugguagguucagcccagaguaaguucuccaaauuaauagagaguaauagcuagcauguauugagcaauuucuaucugccuacuacuaagcacuuuacauugauuuauuugauuuaauucuuaaauaaccaggauucacaauugggacauugugguccuagagccaagcuauuagcuguguauuuauuucaggaguugguaaaucuaaauauauucagcaucuguauagguaauguuaguuaaggaaaauggcugggugugguaaugacauuggcaaacuugugcuugcugugcuguaccuaaauguuuucaaaugcaguuucuaaaaacacuguaggccacacccaaaucagaagauauaauggauaaauuugaaauacuaugggugauggcuguaaggccuucucuuucagaugaaaauuuaaauuauuuuauuggauacuuauuuucauacuuguucuuucacauaccugugugaaaauuucagcaaacuaccuaaucugugauuauauucauaaagaaggaaauaaaguuuuauguuccuucuuuuugaugagauacugcaaauugaggggacagucucagacuuggauaaaguguuuuacaauacaugucaauuaugaagauuauuuuuccaauauauuaguaaacaaaucuucuagaagucaauacauaaaagucauuguaauagagaaaaugaacaggauuuugguaguaauaggcaauucauacaaaaagaaaucuuaauaacaaaugaaaagaugcuaagcuucacucauaaucaagggaauguaaauuaaaagaagauaccauuucaacucuaucugguuagcagugcuguaaauucugaugaugccaagaauugcaaggauuugggggcagugggaacucauaugcuacuguugggugaauaaauugguguuaccacuuuggcaaauuugaaauaaaaugaugcuuguacaucauaacuuggcaguucccaggaaugcuuuggguagaagguagugauagaacugagaaaauaaaggaguuugcuugagcaaagcaucaaagaaagagcuaacaugacaggaagaacaaacagcacuuacagaaucaugaaggcaaggaaaggaacauucagcucaugaaucgaauacaugcaaaucauucaauauaacuggaagccaagaaagggcauggaguaauagccaguaagaucagucuggaaauuuagacagggcccagaugauaaaagcugugaaauguggggauaguuuggguuuaauccuguagaccaguggcccucaauucaggcugaucgucagaacuaacuggaucccuuuccagacuuagugaauuagcaucucuuagaauagggaccaggacacuguucuucaaaagucucagucacauugcuucucugccuuucagccaaggucaaguguagaagucuugaccacaucuauuauuucauucuuagaacccucugaaagagggagcugguaaugacuuuuugucuaugucguggaggauuacaguccaaagugggauuaugcaaguuuaucauguuaauuuuugagacacuagugauuagaaaucagcacccucucaugaggugauacccucuguuucugcuccaguugucuggggcagauggaggaacuggugucucugaaggcuuuuucuuucagacccuccagauuuuuaugagccaaaaggcucuacauaaaaauuaaauuacauugcaaaacuauaugcuauacagucgggauuugcucaucauuacucaccacaggagcuuuugaaggacuuguuguuguugcggugugagcugauaaacucuguauuuuguaguugggggugcaggggaggaguucaaaggcaaggcacauuagcaauauuucagguaagaaaugaugaugguucuuacugaagcuugggcuauaggacugaacaagaagugauagauucaagagaagauuagaagauaguaucuaauaaauauccuuuaugaguguaauuuuaaaaaaugagcuugugagauugggcaaagaaaggaaggccugagaggcagggagagcugagguuucuagaugcuguaugaauaucaaauauuuauagaggaagacuucaguaguuuugguuuuuuaguauauuuccgaucucagucacagaaaauguugguaguaacaaaucaaaaccugauuuuauuuuucuuuaauuucaguuaauauucuccuaccuaugguuuuuuucuuuuugguagauuuaaaaucacauguuauuuuaaccauuuagcaguuauuguucugaaagugaggcaguggauuuugaccagcaguaggaagagggaugguggagaguucuaucuuauuuucaauuauuggccuuuuaauguaauauaacuuauuagaguguuucacaguuuuagcuauuaacuaucaaguuaauagaaacuucucauuagaaaauauaaaaucucaugaauaaaaucacauuauagaauauggccugauucauaaguauuucccaauagaggugaauuauaugaguuucuuuuuucuaccaauagggaaaaaguuggauuguuaaaagaaguuaugaagauuuucggguacuugauaaacaucuucaucuguguauuuaugaccgaagauuuucccagcucucagaacuuccccguucugacacccugaaggacaguccagagguaagcauuuaguacauuuaguacagagguaaucacuauauaugaguuugcagaaguuuuugucuguauacuaaacaaaagcuuauacugaacacgcagggugauuccugggacuacuugccuguuucauaacugaaaaguuaguaauguuaaauauaauguuuagaaugaaaguagguucaguguguaauuuuauaagggaaaacaacucauaacaauauaucaacaagcaauauauaugagcaaaacauucuccagagagcacauaaaaguggaagcaaaaauauggaaaaacauugccuuucaugaucaaagggauccauauuaacaguguugaguaguuuaugacagcaugcuguguguaugcaccuaccuucaccccuacaaaaaaauaaauaguaaaaacguaaaagauuucuaaacagagauucuuuauagcaucauuaaaccaaaaguaccauugggaaucaaaaauuguaaggaaucuuaaaaaguagaugggauaagguuuauggggaaaaguaaauauagccuaaacauguaagugcaacaagaccgcaaaacacaaggaaacuagaaaguuuacacauagaaacugaauaaauaaaauaacugagagguacaaacaaggcuuuucgaaggaugauuacuauccucugagagaaagugaagcugucacauucaugaaauggauuuaaauaaacuaaaaucagagauguuguaaacgaauauaggaucauuuaaauuaauuuaguaagagcaaaccugaguaacuggacuccauacagaauguacccagcugaagagaaagucagggaguugaaugaucaagccaagucauuuauaagaauacaaccccuggaagggacggaaaguuaaaaaguugugagagaacaguugggagucauggagaauagguccagagagguuucuacugaugggaguuacaggaggagagaguggaugcaaggaaauaauuaaaaauugguguaagccacucccccuaccagaucuaaauaaagugauguucugagauucaguggguucauuaagugcuaaaauauaacggacacugcagcagggucucaggagugucuuaaaacacggaucucuuuguaccauagaaaaccugaaagucccuuuaucugcauuucccauuucugcuucauuucauuuuuuuucuguuucauuuuuuucucucagauuauccuaaaacauggccacuaccaagaggucccagguuuuuauccccuuuuaagagagcagccagacugagcuagaaucugugucacaauuccuaauuccuggguuagcucuugauugguccaacuaauacuggggcauauuccuggaccaaucggcugaaccaugguauaggaucacguaugaacauggcugcuccugccacaggccaugugcauggaagauuacagugggucuuggggaaaaggguuucugaguaguagggggaaauuuaggcagaaaagccaaauauguaucugcuauaguuaucuuuuugcauauucaguacaaaaauagaaagugucaaaauuagaaaccauggaauaguaugaucgcugaugauaaggggcuagaaauugaagcucugcaugagacaggggcugacuugcuauguaagugcccauagugcuacugguaaguuucugugaagaguccucuguaacuauuaaaaugccuaaagaucuauagauuuuuuucuuccagaaaccauccaguuuucccugccagagagcauaguaucuuuacucagaguuacacugaucuuuuucuuuucagucggucacucagaugcuuauggcuuaccugucacgccuuucagcuaucgcuggcaacaagaucaacugugggcccgcccuuaccuggauggagguauuuccuaauucacuuuucaugaaaaauguauauuuaaauuaucuacuuaagaaauuugauauuaacauaauuuugaugucuauugagcuucaggaaucaaagaaaugaaguauauucucagcaucugggaggauagauacgugauacacgaaauauuuuuucaucucaaaucuuucuuugauaaucuuggaaacuaaucuuaauauauuuuaugaaucucgaugauaccuguuauuuugguguuuaguauacuaauguauauauucagcaagguguacauuuuuuuaguugacuuaguaauugaaaauauuuuucaguuauuagcaagggacaacuuuuuaaaggguccuuuuuaagaguaaguauugagugaaacauuauucaguaaauagauuacauauuuauucuuaaugugcauauguagaguuauauuguuuucuccucccacuggaaauugggaaugcaagauggaaaguggaaagaauauagaacuaugggccaaccugcguugagaucuuggaaaaaguauugaaucucuuguaaauuacauagccucuuucaucuuuagcaucucaccuuuaaaugaugauaaguauuuuuuuuuggaguuaugaggauuaaauuaaacuguauauguuauaggcacagcacaaugacuagcauauuuuuacuacccaguaaaugguaguuuuuuuuuuuaagacucuuuggguuauuguaucucuaaauuaaaaugaauuucuuuuauagauagucaaagaagcauuugcaaguccagugucuuuaucucauaguacauuuucuuugugauagauugauaauaagggaaaucaccuuuugguucaugaggagucauccaucaacacuccugcugucggugcugcccauguuaucaagagguacacugcucgggccccugacgaacugaccuuagagguaaauaguuaaagugguuguuuguuauuugguucuugcuaacuuucuggccucaucuuugacuguucuuaaccauuuccuuaauuuuuaaaaaaaugaaaagcaccagguuuuuccauagucuuuuauauuucagccuguaauaucuucuauuuuuguuuaagugacaguacucauccuugaaaacugagguuaagugucuccuguuuugucugggaagucauucuugaucucccuccccucacuccaugcaaauacauaccccccaaaaccugaauugaaugucauucugaacugugcucauggcuuauugcugauauaucacuuauuauauuuaaucaugauuguucuccucuuugucucauugagcuucuggaaagcaaggucugucuuuuuguguuuuuguaccuaaaaacaauacccaaugauacauuuuuuuucacauauuguugaaagauugaguuaaagaacagauaaaaggugaaaugaacacaucuugcuaccacauauaaaaggaggggaauuaaauuuuuuccucuaaagauauauauuggcuaaugagagaaaaaaaaugcugacaguuacuaaauuuaagaaauaacaguauaacuuuuuacugcauagaaucugaacuguuuucaaacuuuuagguucuguacagaaagaaauguaggucuuggaaugaugauguuagcauauauggcuuuacaaaauggcuuauacaugauauguaagaucaguugugaauauacaaaagaaaaauuccuaaagcucuauaguauauguuaguaacauugcucugaaguucuuaacuauguuuuaucauagauaucagcauuucuuuugauugaagaauauaacuuccauugaauauauuauuaaaaacuauuguaauuuuuauauuuaugauuuuauaugaguuuaaacucaguaguuuuucuuuuacagugaagaaaguuagcucuuuaguggauauaauuauauuuuacuaucuauugaaagaaguguaguugucaucaaauuuuauacuuacuaagaauaacccauccuaggcccuuuucuguaugauuaaauaagauaugucaagagcucaguacagugccuggcacaugguaagcacucacuaaauguaauauuaagggaaucuguuacuguuucuaaacaugaauauuuaaaauuaucuuuuauaagugaaucugaucacucucagugacagcaguaacaguauuuuaacagaagugaugauaauggugugaugccuagcauuaaaaaucuuaugcuaugaaucuggcuuucugaaguuacugcaccuguguuaguugaaucacagucuuugugcugcuuaacuuuuuguagaccucucuuuaacaaaucauaagauaauuaaaugauuuuuaaaaagaaaugguacuuuuuuuggaaauuacuggccagagcaugaauaguacuuuaccuuuucauacaguucggauuuaaauucuagguauaacaauugguuuaaaauuuaacuaaaaccauuuugcuuaaaauuuugauucuccuaggugggagacauuguuucuguuauugacaugcccccgaaaguguuaagcacaugguggagaggcaagcacggauuccagguaggcagcagcaaauuaggugugggaaaauucaaaggaaaguuuuuuuaugauucaguaauacuuuuguuuacaugugcugguaauggacuuugucaucagaaauuuugucugcaacgauagaaaaugcagauaguaaugauaauagauuuagauuuccuuuucuaauuacuauuuugguuguuucuuaucuccuuuuucaucuuuaaaugguggugaagccaaaaugugaauagcaucucagaccucauggccacuuuuagguuacaaggccuguggagugaccuugcuuuuaauacagguuguuaaucgggauucacauauauuuccucucuggaauuaagucaguuugauuaauauuucucuauaaaaaggcauuguaacuguuauguaaacuuacuuuuaauuacagaacaacagaaucuaaagcaaucucauuucuuuuucuauauucaguagucccuuaucuacgguuucccuuuccaugguuucaguuaccugagguuaaccaagguucgaaaacauuaaauggauaauuccaaaaauaaauaauucauaaauuuuaaacugcaugcuguucugaguagugugauaaaaucucucucugucccaccccggacgugaaucaucccuuuguccagcauauccacacuguagaugcugccugccccauuagucauucaguagcccucucaguuaucagguugacuguugagguauuaaggugcuguguucaaguaauccuuauuugacuuaauuguuuuagucgauuauuaguuauuguaaugaaucucuuacugugccuaauugauaaauuaaacuuuaucauacguaugcauguauaggaaaaaguauccuaggguuugguacuaucugugauuucaggcauucccugaguggucuuggaacauauuucuugcagauaaggagggacuacuuuauggcuaaacaguuuugagaccugauaauaacaucuauuagacugacuuagcaacuacuuuuuaugaggagucucugaaaaugccuuaaaguuguauccuuaacauauagccugugguuuuuuguggucuacuuauacaaguguuacuaaauacuacauaaauaaaaugcuccugcuauauuguuagaaauuugauaagcauuguauaaauacuuugaguucuaacuacauauuaaauaaaaaugaauuauuagcuuuuuauaaaauauauuuuuuauuaaaacauaauaauacaauuuaaaacauuauaagaugguggauaagagugggcucuggcuccagauugucuggguuuuaauccuguguugucucgggcaaauuguuuaauucucugugucucaguuuccucauuuguaaaauggggauuaugggacuauuguuuaccucacaugauuaucuugaagauuaaauaugugagaauaaaaauagaacaugcuuauuagaccaggucugauguauaauuuuuuuuuaaucaauaaguguugauuuuuaaauuuaaagaauucugguuuuuauuuuacaaguuuaauuuuaucuaucccuuucccuauuaugaaagcaucuauaguaauuuaauuugguuguuaagaccagaaaaacccuaucacauuaccccagaacucuucuuguuugugcuauugggaucccccuccaucugugcucugauuucuuaccagcuaugaauaagugcuuuugauuaaauauaaaacuaaauagaagacuacaguuaucuuuuuccuauuaaggagucaguucuucauguuaguggaaaugaacaauagacuuaagggucucaaagaugaucaaaagauuaauuuggcuuuaaaauaauaguuauguuguggucuugauguuacuacuaacuuucuucugucugucugucugucugucuaucuuaucuaucuaucuaucuaucuaucuaucuaucuaucuaucuaucuauguguaacaccuuagggaagucauuugcuuuuuuuggauuugaguuucuucuuaaaaucagaggguuucacuuaaaaucucucuauuccuucucaacauuuaaauucuaugauugucuucccuuuguuuauguaacagauauuuauucaguacugauugugugcuaaguguauagcuuuauaccccaaaguuuuguugagacgcacacaauuaguucauugccuaaacaaacuaauucuuuucaaagugaguauaaauuaacuagucuaaaacuaguuaaacaucaguuuauugccaaaacaaauuauugaaaacaaaaacgaaauuucuaacuucaaagauugauuuguaaccgauaaugaaaaaucuuuccuauaggaaugcuauuuuucaucuugauuggucuuagaaaggcaaucguaucuccauggaucauguuggagugugccugugagaagagguauugauguggggggugcccguguaaccaggaacaagucuuuaaauguuacugucaaacuuuuuuuaaaaagaaauucaggcuaggggcaguggcuuacaccuguaaucccagcacuuugggaggccgagguggguggaucaugaggucaggaguucaagacaagccuggccaacaugaugaaaccccaucucuacuaaaaauacaaaaauuagcugggcuugguggcgcauguuuguaaucccagcugcuugggaggcugaggcaggagaaucucuugaacccgggagguagagguuacagugagcugagaucaugccacugcacuccagcuugggugacagagcaagacuccaccucaaaaaaaaaaaaaaaaaaaaauugcaaaucaguauuuuaaggcaggaauccacaguucagcauuccuugcuguuucuacacauuaguccauuucuaagagcacucaugguuaauugcagggaaaggugugaaagaggagacauguugagcaucuguuaccugcaaaguauagcucaguacuuuacaugcaguguuuucuuuaauuucacaaagcuucuagguaguuacuguccuccauuuuuauggagagaaaacaguuuuugagagguuuaauaaguagucaggaugcuaagucaguuaagugaagggaguagggacugagaucuaagucugcuccaucucauugccugaagagcacuaagcaugauuuuuacauucacucucagauuauuaacguucuucaugucaguuuucuaccauauggaaaggaacaucuuuccugcucaaccagcaagaaauauaguguaaagauuagccaacuguggacugcaaagcauacauguuuacuggugggaacauugcuguuacugcguguuauguuuuugugugaugauuaaucaauuguaugcuggagaaaaacucuucagacuguucaugauguccccuaccuuuguuagguauuuuuaaauuguaagcgugugcuccuccugggagacacucuguugagagaggaagacaaucaugguaacuguacaucagacaucuuuccacauccugauuuucaaguuuaacugaaauaauagcuuaguucggugguuuuuauacuuuuucuuuuaauccaguggaauuacuaaucaaacagaaucaugcgcagaaccucagugcaagaaaaaguaaccauggagcugcccugauugguuuaagugggaaacgcugggccuuauccccaugcagcccaccuggcuggccuccuucaggccuucugcagcagcccugaggggccucaguaggggugaaaaccaugaguuuagcuuacuaguggaccucacuuuguguaguagauacaucaaaagcuauuuuaaaauuuuaauuuugaaaagccagccaacagucuaaaguuaauagggaaacauguucuuuauaagaagauuuuucaugacuccuguuagaaggauaauaucuagaguuauaaaauuucucuaauguaaauuaugucugaauuccugguacuucauauauucugauauggaugggggauaucauauauucauauauucugauauggaugggggcaaauaaucacauauauaugauuguauaugagauauauauauauauagagagagagagagagaguguguguguguguguguguguguguguguguguauauuuuuuuuucuguuauugggcauaacagaugacccacugauacuucugccagugggagcuguuucuaggauuuauucaucccuuaauuggucuguuagguacuguguucauuugcuagggcuacuguaguaaaauaccacaaacuggguggcuuaaaaauuaauagcaaauauauuuuccuacaguucuggaagcuagaaguuaagguaccagaagguuuaguuuuuuucaaaaggcuucucuccuuggcucacagauggucacuuucuugcguguccuuacauggccuuuccucucuguguuugucuguguccuaaucccuucuucuuguaaggacaucagucagauuagguuaggggccaccucauuuaaccuaauuaccucuuuaaaaguucccaucucuaaauacgcaguuaauccaugaacaacguguguuugaccuuugcgaguccacuaauacacagauuuuuuuuuuuuuuuuuuuaucaaacgcuauugaaaauacaguauuugugggaugugaaacccucauauauggagggcaggcuuuuggaauaugacgugggauuugaguauguguggauuuggcuauaugaggggguucuggaaccaaucccccagcuauguugagaaaugacuguagucgcauccugaguuucuggggguuaggaauucaacauuaugaauuuugggggagaggggcacaauuuuuagcccauaauagaugucaaccaguccugaauggagaagcugguugagccaccuuuagggcuggccugaaggcaccugagggacucucuuacauagacuugguggggaacaggucccuaccugagccaggcugguuucaggcucaaggcaggcaggacauggaggacuagcagaccucaguacucuccuuggggucucucugaugaguagggaguagggcucaccaggauucccuggaaggugcaggagggcuuccuagaggagguuacacuggagcacaguguugcauaugucuucugccgagaggauguccgaugacccacugaugcuucugucagcaggugcacaggccaggcggggaacagcaugcaccucggucagccagcucgccuggcucugguuacaugugaacccugucaacugggcuccggcugcagaacacggaggaggcugugcgucacagagguggcagugucuucccuagcaguguaaaggaaacgagggccucgucuugguguuggcugucaccggugguuuuccuagggauugagaugacuuagugcaggccucucucaggagagaagggaagaggagcaaggaugugggcuacugcuucccaugauggaggcugagugagcugaggugucacccucuugagcgcugcugcaacacuuucugaagcucguuguugacacccaggcccgauaugucugcauuugcagcucugcucagcucgauguguucauggcaugugaucuggacuccaguuuucuuuugucaaggucacacuaugugugugugaucuccuuucuggccagcugucagggcaugagaaggcacaagucucugugcagugguccuuccuuaauauugcugugaacucaugcuauauaguggugguauugugauuuuaauauuuuaaaaauagagcuggaugugguuccucauaccuguaauccuagcacuuugggaggccaaagugggaagauugcuuggaccccggaauuugagaccagccuggccaacauggugaaaccucaucucuacuaaaauuauaaaacugacccaggcgaagugguacaugucuauagucuaagcugcuugggaggcugaggcaggaggaccacgugagccuggcagguggagguugcagugagccaagagccagaccuugucaaaaauaaaaauaauaaucaauagacuugauuuuuguauaguuacagauuuacagaauaauugagcagauaguucagaguuucauguaauaccccugcccacuccccucaccuauaccuucccgucauucacauuugcuuuacaguacauugaauagaaucagcaaaaugcugaucuuuaccaaccaucagcugauuagcugaguuuaccuacagcacugacugagcacuguuucuagaagaguggucuaaggagcaccagggccagaaucacacagaaaaaaauacagucucaaaucauaccuugcaacuguugaaacaauuuuggggcuuacuuuuuguuauaauuaaugaaucaauauugauauacuauuauuaacuaaaguccauuguuuauguuagaguucccucuuggugugcauucucuggguuuugacaaauguguaauagcauguauccaccauuauaguuuucauacugaauaguuuuauugcccuaaaaaucuccugugcuucuccuauuuuuccuuuccugcugaacccuucacaaccugugaucuuucacugucaugucuuuuccaaaauauccguauuguuggaaucguauaguauguggccuuuucagacuggcuucuuuuacuuaguaauaugcauuuaagguuccucugugucuuucucuggcuugauagcuucuuuuugaaucacuaucuaauauucagugucauggauaugccacaguuuauauauucaaguauugaaggaccuugugguugcuuucauguuuuuagcaauuaugaaugaaacugcuauaaacaucuaugugcagguuauuguguggacauaaguuuucaagucuuuugaguaaauaccaaggaauaucauugcuggaucauaugguaagaguauguugaauuuggugagaagccacaacacugucugccaaagugccuguaucauuuugcauuguuacuagcagugaaugagaguuucugcuguuccacauccucaccaacauuugauaauugccaguuuaaaaaaaauagccauucuaauagguccaacacauaaaguuaguuugaggaauaguguuuaccaaauguauugaagggugcuguucugcucucuucauuuuguuaccaguaauucuuuuuauucucccuuugccacugacucuuaaacuugaauguuuaaaggaggcuauguuuaaauaucaaaucccagggccuaagcccuacaguucguuucagucguugugggguaggaucuaagacuauuuugguccaugugugcugcaggucaauucugcuacucaccugcauuuugccaaguucuauucuaaguauugcacuagcccagaccauaauuuagccgugggaacagaaggauaaguucauccauguguuuaaauuauacugugacucucuuucuuuucuuaaacuucugggaguaggaagugugaaauuauauuaacuacaguaauuugaaauuuugaaaucuguguuuuuuauuugucaccuaaggaguauauugaaucucucaucuuuguugucugagguauuucaucauauaauauacuucagaaaguaaaaguaaaaacucuucccuuuuuuuuauuuuuaaacuaacuggcauuauuaauagauuuguguucuugucuguaaaugauuguuagaaauaugaggugauaccucagaaaacccuuuuuucuagguaaaggcauuacacaaauacaacauguuaauauauuuuaggauuguuuguuaugugcagugucucucagaguuuuagcuaggagccauugguaucugaaugagagaaacgugauaaaaauggguauugaucaucagaaucucaggggauggggucaggagucugaauuuuaacagguuuuucagaugauuauuaugcacagaacaugagaacugcugauguaggcucgcacuguuuaucuugugugcagguaaagggagcaaucagacacaguuuagaaauuguguuuuguuucucccuccccucagaaaaucuuccguaaagcacaucugggacacaguuaaucuaauggcuagaaucucacuuagagagugacagaauuuuauauaccccauguucucuugguuuuccaugagaugaucaaggaucaccuauuucguuuuucauaguuauccccaaauauugugaguuuucgugcacaaguaucagagaagcgauucuuggacagcacaguuuuuuuuuuuuaccucaagaguauaauguggcuccagguaacuuaguuuuagagaaaucaucuuuauuucaaggggcagauauucagaaaccuuaucuuguauaguagcuuaauggauuugcuuauuucucugcuuauuuauguaaaaacuaucauauucauguaauauccuagaauccaaagcugcaucuuuucauuauucaaaaucaaauagagcaaaauguuuacucuccaguuaaguaaugggaaaucauauuauacugugaguuuucaucugugacauaauuucaagagaaggggaauuaugugauaaugcaaaugaaauaaauugcuaacauuucuugaguacuuaggugugcuuuucgaagugcuuaccacuaaccuuuuaauuccacaacuccaugaagguacuauaaugaucucauuuuagaugaagaaacuaaagcauaaaggguuaaacaacuagcccuuugucauuacacuguauauugcagaguuucuguugaagccuaugcauuuuaggcauauaacagagcaugguaauaauuuaaugaauaauaguggcucugcuuguuuacuugugugaaucauagauuuuucuauaguggaugaugauaguggaccaucugguucuaaacuaucauuuuaaaaugguagaaaucuggagacaaauuuagauaaauuuuucuguuucacaaagacaguaaguacgugguauagccaggaccagaauacaagcgugaugacuuuuaauuuuguauuucuuuuccuuuugggacauagaaauaaauacauuuucuuaauuuauguuuuauuuguugcuacuuuuucuuauuagugccauuagauauauugauguuggagauaaauuuccuacuugauagcuuuuuguuaauuuauaacaucagaauaugucuuaccaaccgaggcuuaaacacucaauuuuuuaaaucagcauuaaagaacacuuuauuuguuuuuaguuuuuuucuuuuuuuuauuauacuuuaaguucuaggguacaugugcacaaugugcagguuuguuacauauguauacauguaaaaacucaauuuuauagaaauuauugacaaaauggcuguggcaguaguucuuaaucuuauuaaacccuaauacccccucuuuaugacaaguauuuucuaaaauccuuuuuugucauucuaaaauggaauuuacaaauuauuuaacuacuuccauuaauauacacuuucaaaaaagucagcauaaauuuucagauauaaaggagaaauaaaaggaaaguaauuuauguauuuaaaauacacaguauguuuuuaaauauaaauacuugggacaacuaugugaagaccuuguuauccuaaauguaguccacagacuugcagcauucacuucagucagaaaauguauaaaacccauguauaauaguacuaaaaauaggaaauacuuaggacuguaucugaaaaaaaaaaagaugugaaagagcuauauacugaaaacuacagaacauugcuaagagacauuaaagaagauccaaauaaauggagagauauacuguuuuuauggguuggaagacuguauauuuuuuaagaugacguuucuucccauauugaucuaagucaaaaucccaggcaggcucuuguguagaaauauacaagcaaguuaaacaauucaaauggaaaugcaaaggaccuggaauauaauagccaaaacaaauuugaaaaagaacaaaguuggagaacuaacacuaacugaagauuuacuacaaagcuacaguuuucaagagagugugguauugguggaaagauagauaaguagaucagugggaaagaauagacaguccugaaauacauacauacaguuguacacauggacaacugauuuucagcaaaguucaaaagucaguucagugaagagauguaauggcaguggaacacuuggauauccagacgucuccaaaguaaacuuuauuuauuuuaccaucuacaaaaauuaaaauagauaauauaccuaaauguuuauaaaguauaaacuauaaaacuucaagaagaaaacuuaggagaaaacuuuuguggcuuuggauuaggugaagaugucucuuuuuuuuuuuuuuuuuuuuuuuuuuugagacagaaucuugcugugucaccaggcuggagugcaguggcccaaucucggcucacugcaaccuccgccuccuggguucaagcgauucucccacuucagcuucccgaguaguugggacuacaggcgcaggccaccacgcccagcuaauuuuuguauuuuuaguagagacaggguuucaccauguuggccaggauggucucgaucuccugaccuugugaucugccugccucagccucccaaagugcugggauuacaggcgugagccaccacgcccagccaauauaccuaaauguuuauaaaguauaaacuguaaaacuucaagaagaaaacauaggagaaaacuuuuguggcuuuggauuaggcaaagauuucuuuaaugugacgucagaagaacaauucauaaaaauaauuuaauuucaucaaaauuuaaaacuucugcucuuaaacaaauuuacaagaaaacaaacccaucaaaaagugggcaaaggauauaaacagacacuucucaaaagaagacauuuaugugaccaacaaacauaagagaaaaagcucaucaucacuggucauuagagaaaugcaaaucaaaaccacagugagauaccaucccacaccaguuagaauggcgauuauuaaaaagucaggaaacaacagaugcuggagaggauguggagaaauaggaacgcuuuuacacuguuggcgggaguguaaauuaguucaaccauuauggaagacaguguggcaguuccucaaggaucuagaaccagaaauaccauuugacucagcaaucucauuacuggauauauacccaaaggauuauaaauuauucuacuauaaagacacaugcacauguauguuuauugcagcauuguucacaauagcaaagacuuggaaccaacccaaaugcccaucaaugauagacugaauaaagaaaauguggcacauauauaccauggaauacuaugcagccauaaaaaaaggauggguucauguccuuugcagggacauggaugacgcuggaaaccaucauucucagcaaacuaacacaggaacagaaaaccaaacaccacguguucucacucauaagcaggaguugaacagugagaacacauggacacagggaugggagcaucacacaugggccuguuguggggugggggacuagggaacggauagcauuaggagaaauaccuaauguagaugacaaguugaugggugcagcagaccaccauggcacauguauaccuauguaacaaaccugccuguucugcacauguaucccagaacuuaaaguauaauaaagaaauaauuaauuuuuuuaaaaaaacuuucggcucuuuggaagucauauuuacuaguacagaaagacaaaccacagacugggagaaaauauuugcagugauuauaucugauaaaggauuuguaucagaacauacaaagaacucucacugggcaagcucaguagcaugugccuguagucccggcuacuugggaggcugaggcaggaggauugcuugagcccaugaauuugaggccagccugggcaacauacugagaugcuauuuuuuaaaaaacaaaaacucucaaaauuaaagaagaaagcaauucaauuuaaaaaauaggcaaagauuggaagagauaucaucaaaaggauaugugaauggcaaauuaauacauagauauccaacaucaauagucauucgagaaauguagguuaaaacaacaaugagguauugauucauacuuauuaaaauugcaaggauguggaagaauuggaauucucauacagugcuggugggaauuuaagaugucacaacucauuugaaaacaguuuagcaguuucucaaguuaaacacucaguaagucaucacuuaauguuguugguugguucuuggaaacugcaacuuuaagcaaaaugacauacugucuaaugaaaccaauuuuaucauuggcuaguugauauaaauaagaauuaaguucccacagcacagaguaagucaguucacaguuuccaaugugaacaucaaugacguuaagggaggaauuacuguacacuuaccacacgaucuaacuguuuacagaaaaagcauguguccauauagaaacucauacaugaauguucauagcaucuuuauauguaauaguuuaaaacuggaaacgacccuaauaucugucaacagcagauuaauagacaaauggugguguccauacaauagaauauuacuuagcaaugaaaggaauacacaguugauaaauacagcaacaugagugauccucaaagauaugcugcaugaaagaaggcagacaaaaaagaguauauuacauaagacuucauuuauguaaaauuauagaaaauggaaaguaauauaucgugauaaaaaguagaugaguaauugcccgaggagcagugaugggaggauagggggaaggaaggauuacaaagagauauaaggaaacuuuugggguugauggauauauuauaaucuugauugugguaauaguuucauggguguuuuaucaaaauguacauuuuaaauaugugcaguuuacuuuggguuaacuauaccucaguuaagguggaagcaaaaacugcaggagcauucuugacuucauguuguucaugcauccaauccaguugaucauaucugucucuucuaccucugugucguuuacauucauauacuguccuuccuuuuucaugcuguugucauacacuguagguuuuauucucuuuccuagccuauuuugcaaauuccugaagugguguacugcuucuuaucuuccucccuuccuuccagcuugaaagguauacaggcgaaugcuuuuccuuuuagaacaugccuguuccugugcugcuucugcucagaaugugucacuuuuauuuccuacagaaggaacuuaaaacuccuugugacgguauacaagaucauccaggaucuccgacuuuauucucacuuaccagucuuacuuugcacugcucuguuuuagaaacuggauguucugccagauguaacuauuauuuccccucuuaguacacaaguugcuuuuuucuacucuugugucuuuuuuuucuaugugucuuuccacuuacaaugccuacucuauccuuuucuuacuccuuccaaggcugaaagguauuacaaauuaauuaaaacuuuaaagcaaccguaaucuaguuugucuuauuugauauuguauuauggcaacugggaaaagaaauuuaauccccucagcuacuugcuguacaauaaacaauuauguucaauauucaguauuaugcuuaguauuaucauuccacuguuccucccaguuuuugcccaucaauuacuucuugccuuuacuauccuucuuuuccaguguagauucuagagccuugauuacauucaccugucacaaauauauucuuaaacccuucacccuuugguucuucucuuuuaucacuaguggucucuguuuggcuuaaugaaaaaaaaaaauagauacuuuacuacuccuuacuuaaacuaucauuaguaucugauuuucuuuuuccagagacuuuuuucucuuaacugacuugacacagucuccuuugccaggacacccuccucuacuagaccucugacguuugguguuggacugccuucuuauucuacacucuuugucccuugcuaucuuacucacuuucucaacuuuaaaaaccauauuuaugcccaacucucagauuuauguccugaucuuuagcuuuguuuuugacucucaaaccugcauauccggcugcaagaguaauuuuuuauuuaaauggaaauuagggaguugacauucaaggggacaguauaaauaaggcaaagaaaccagaagcaauguugugcuuuugggggacauacaaggagaguggggggugggggaauugguaggaauaucucaaagagcccaauacaagaauuacuaggcuauaaguaaauggaaccagagcuaaaaaguaaggaccugaggaacuuauuucugguuuuugcuuccuuugguguguagcaacuguuguuucuuugucucuucucuucuuuguuuggaaaaauauuuccuaauucuaacaauucaauggagaucauugaagauuuggaacuaguuccaaaaucauagcagacaaacuaauugacucauugacuuaccgucuauuugaucaacugugcugggaugguguuggcaggccaugguagucagacugggcagagacucuaaagaagauuagguucuuuaagcauguuucgggaguggggagaaaauaauuggcauuucuggacaauagccugugaauuuguauugguucaaaucuccuuagugaugugauuuuuuuuuuucuccagcaguacacagacaugcaaguaugguagugaauugauuuaguuguggugguuugcuggauugguuuggcaggaaguuaauauugcaaggaaauuaaaggguacugauuuaaaacaaaugcucaaucacaggguccauauuggguagcaaacaaaacaaaaaaaaccuggaauuguggggauaaguaccuuggggggaaaugugaaggggaugggaugucucuguuuguacuuuuguuguuauagaauaucaacacuagagaccugagaggauaggaaguuguagucagaaaaugaaaaacuggaguuuuaacacucugaggccaaauaauuccaauugaaaaaucugugauauauuuugaggagugagcagugcuucuacuaaguuuaauuugaaaaauguuuggcuacgccaacagugcuaaagauucgcuagccauaaauuaaauaaauaaaccaauagaagagaauuuuuuuuuuuuuuuugagacggagucuuucacucugucacccaggcuggagugcaguggcucgauaucugcucacugcaagcucugucuccuggguucacaccauucuccugccucagccucccaaguagcugggacuacaggcaccugccaccaugcccggcuaauuuuuuguauuuuuuuuuaguagagacgggguuucaccauuuuagccaggauggucuugaucuccugaccucaugauccgcccgccucggccucccaaagugcugggauuacaggcgugagccaccgcgcccggccaagaauuuuuuuuuuuaagucagcgauaagcacaugaucguuaugcugaauuccuuuuuagguuuuuguugauugccucaaagagacuauaguuaggauuagguucuguuguuaacucuacuguuuccaaagcuccaggcuuauuuuauugcaguaguuucuucucuaauauuccuuuuaaguuacaccaaaguauuuuucagcacauacacucacuuuagaagccaaaccggguuuucuuuuuagucugaguauuccccaagguagaagaagaucagaagaaccagauuacagucuguucccuuuacaucucuccugguucuccuagagucagagggugagccauaugcuugcuaagcuacuagaaacugauuaucagaagcuguuagagguggauaggcgcaggacgaaguguaugaauauacaucaguggucagcuggagccaacugugaaauuuuguaggacaguuguuaaaaacagccauuauuaaaaauuaagguauauauauuuacaaugaaaugaauuguauuaaaaacaaagguaauaaucaaauauauuuuguaauuauuuuaccacauuuuaccauuuaugcucuugaaguuauuuccagcuacucuaucuguaugcuuucaauacuguauaacugagugcccuucugcuucucuuuccaauuuuguguucaguuguaucaaguugguagcuugaaaccagccaugaugggaguguguauacggugggcgcuggaaaacacuggaaaugaaggccuuucccccguggagagcuaguuguuaaacauuuaccagcacaccaugguauagauuagcaugucugguggcuuuuugcuuuauuucaaagacuugagugaaaacagucaacagggaggucuccucuuuucaagaccauuccuaaccuguuccagcccugucucuacauuguucuuuuccuucuauuacuguguuuuuauuaccuacuucuuuaccgucaugggcccuagaugcuggcuuuuucuccaucuuccauucucuuccuggaguugaaucucauuuugaccccugccaauauacccaauucugcucucccuuuccagccauguaaauugaagcuuuagaaauugccacagcugcagaaagaauaagauacagaacaagaugacauagcuaauagaucauauuuucagaguuccagucacuuuuuaccauuugacauuuuaucaaaauuguuacuauuuggugaaaucuuaggugaaguauucauuagaaaaguauaaguguucauuaacuguacuuuuaaaguuaguuccauucucguguguaauauuuucaagagaacacaauuuuuuaucaugaaaauuuugugaugguaaaauggaaucuguuugccuuucacaaauucauagaacugacucuuuuaaaagacuccuugauguuuaggagugauuuuggcuucaagaaacaaaaaacugagcggaaaagaugauggauuucuagugcugagucagcagcuuaaugaugccaggcaggagucucuaagguucucucagcuuuucacuuauggucaagugaugaccacgacagaucuagucaugacaccugugcucacggcacagaggaggagacaggauaguagcagagcuguguuuacauguguugcggcuuugccugaauauagggagucugggaaacugucuaguuuagcuaguaguuagugauauuacacuuaugauaaaguaaaacaagagggcagggauuggaguuagguauuaggugagccuacuguagaucuaccucuguauaguaugcaguggcauuuccccauauaccuaaaccuaauucauugugaugaauuuaaaaggugaaaauguaacuaauguaugugauauaguucccugagaagugcauuaagcucucuuuguucagucuuugugggaagugauggaaaacuuuuuuuuuuuuuugccaaaagauacucgaacuuagaaacuaggcaguuacuuucacauaaacucuuugagguauagguaguguuaucccuaacguuacaaauuaggaaacuaagacagagauguuaagcaguuugccauagaucacagaaccuaguaaaugggugagccaaguuuagaaucuggacuuuucucucaggcaguugcagauuuuauauauugaaaugaauuagaauguuuuagaaagaaugauauuugagagucaggaaacuucagcagauauauccaaaagguggcauuuuguguaauauccauuugauggaggagcuagagcccucuagcaguucugguagccaaauacugggauaauaauagcauuuacuuaugcauuaacccauuuaugcuuaguguuccauuauuggaacgcuaagcuugugggaguuauuuauaucuuacugcucaaggucaucgccaaguucugauuuuucacaaaaaaauuuugcaaccucugccauaaauggguuaaagcuuuagaaauugccacggcugcagaaagaauaauguacgaaacaggcugccguaguuaauagaucauguuguuacuagaccauuuaguuaacaaaucaaugcauuuuacucuaugcauuuuauuuauacuagcccauuuaauucucauaacaucccuuaugagauaggcauuauuauuaccauguuuagacgaagaaacuaaaacacaaagaggcuaaguuacaaaccuaaucuagugaguggcagacuuaagauugaacccagauacuucuuuuuuguagccauguguuagcuuuauauauaaaacaugaugaaaacuuguuuaauauaaaacacuuuaauauaaaacaugaugaaaacucaauuacaagaguucgaaagggcaagaaaaaccaaugaguuuccacuuuauugcaaguuuuaaaaucugagacuaguuaaaaaaacugauauguuaauuucagaugaggguuaauuuuuuucaccaacuaaaaauuacuauaugggaagaucagugcaacaaacaguacaguuugcaaacccaagccacaaacuuauuguuaauaaucaugguaagaaacagccaaagagcaacugaugccucaguuaaguuugaaagaaacucugccuucugugaaggcagagaagaaauaugcaagcaauucuccuucaagaaauuugcauagagucaggauguggugacucacgccuguaaucccagcacuuugggaggccaaggugaguagaucaccugagguugggaguucacgaccagccugaccaacauggagaaaacccaucucuacuaaaaaugcaaaaaauuagccgggcaugguggcgcacgcguauaaucccaguuacuugggaggcugaggcaggagaaucguuugaaccugggaggcggagguuacagugagccgaggucgcgucguugcacuucagacugggcaacaagaacgaaccuccguugcgcaaaaaaaaaaaaaaaaaaaagaaaaaaagaaauuugcauagaaagagaaaauguuagagccuuuaccacaagugaaauugcaaagcuugaacauaauucaacucaauccagagagcaccaaacaucaaauuggggccaagguagaacuugaacauuuaauuuccagcuaugugacuuggagagcacuauaauuucagauguggaaaccagcugcagguaggcucuuuuagaaacaugaauuguauacuccauaaauucugaaacaaggcagauauuuguacauuguuacuugaauuucagaaggguaccucaaggcaucaggaucuuuuucagagucacucuugaaauaguuguaucuucccagccuugguaaccaccuuuuuacaguucucuagccuuugcauugaaacacaccacuuuguggaaugacuuuuaacauucuauccgucauggcuuaagauccugaagcagcuauuuccagggcaccucccaucuccucggcaugagcaguuucccagucacuucuucauccccccaaguccucuucaugagagucuccagagcucauagcaucaaggucuccauugcugggacucacaccggagacuacaucuggaagcuccacuccuccagcucucucugcuggagaccaaacugacaguuuauugcaaagacuuguaaaaacaaagauuauuuacaaaugcauuuuuguauacauuuguuuaauuuacgaccugagacuuuuauaaucgcuuuccaaacccuuuuauggaggguggaacacuuacuugaggcuacgcuguuaaccaugucccauauccccucucauaacugacuuguguaagaaaaaaaaaugaagauuuuuuuaaguugacucuuaccugguucuaaucagucuuggaagcauuucuacuuguuccguaaaauaggaaguugaguagaauauauuaaagaauuucaccaguaaaacaaauaccuaaagcaucauuuuggaaggcagugcauaggaaucccaaauucacaucuugugaacaaaacugauagucugauaaugauaccucaucucuacacaaaauaaacaaaauuagccaggugagguggugcaugcccagagucgcagcuacucaggaggcugaggugcgagaauuguuugagccugggggaucgaggcugcagugagccuagauugugccacugcacuccagccugggugacagaaugagacccugucucaaaaacaaaaaacaaaaaaacugauaaucuguuaauaccccuuuucagcucaugauaacugguuuauaucuucacaauuuuaacaacuaccauagaauauggaucuagaaauugaaauaagaauguagcaaaugaguaugugaaaauaauuucacacagauggaaauuauacagcucagaacuuggugaugaaucauacccuuggaaaacuauuccauucuuccccagagucugucaacagagggauacacaaagugauggagcuuucauauuucagcuuuaacaucugcugcauggcagcccauuuauauuuuuaucuaaggaaacaucuauaaauauugauaaagauuuccucuuugcuuuuguuuccaggcuguuuaucucgguauuuauccuuuuggcuauacaguaucucuggaugaucuggaacucagcauuuuccuaauacggcuuguuacaaugccaaaagcaaugccugcgguucugcuacuaggucacugugguguguuccucaaagccagagucuguugacacugcugagauuggcuguuuucuucucucuuacuuucccucuuuuccaugcgcuacuaguuuuuaaaagcagugaauaccaggauuuuaaaugagagauuauuuuacacauuuauuuuagucaugucuuuuuuuuuuuuuuuuuaugaaaccugggagagagugaagagaaaauucacaaaaaguuugaguuguggcuuaguguugauuuaaaaaacccauagagaagucaauaaacauaaguuggcaacagagguaucaacauaacuggauugagauuucaguaaagcgcauuauuaaauuauaaaauuuuaccuacuugcaugcauagcucauugucagacuaaauauuuuaauucauguaaaaaaagauugggaaauuaaaaacuaaaaggaaaaaagcagacuuagauauuuggacaaauaaaacagauaacuuuauguacucauagcaacagauuguuuuauuauuuguuuguguaauuggcaucaucuguuauuuagagucuuggaauaauagaaucauuugggagggacuguagaauacauuacuggaauucaguuggcaguguucacauaauuggucuguuugcugguuuagaauccuuucuuuguugcuuuucaucaggugggacucuucccuggacacuguguugaguuaauuaaccaaaaaguuccccagucagugaccaacucagugccaaaaccaggugaguacacuuuuuucacuaguguaguuauuuuaucaacugcuugaagacacagauuuucugucagucaaguauuuagcuuguuuugcuaguuuugcauuuauaggcauaauaauuaacauucuuaauuuuauaugguuuugauuuuuaaauguauucuuauaucucuguugaucauuuugaaaagguuuacaugcacucaaauuuuuaggcaauugcuccauuaagcuuugucauuauuuacuuuuauaguugcauaauagcauuguaacuuaaugaauaaaaugauuuaaaaaauagguuuaaagaacuaacauagaaauuguaggauuaacugaaaauuaauaaaugaaaaguaaguauauuuuaacagggcauaugaacaucaaaacuauuuuaaacagcauuucuuauuacuuauacaguauacuuacagugcugcauaaauaucuagaauauauuacaaauaaagcauuguugaaggggauaaaaaucaagaaaaugugaauuucgguguuuauugaggugauuuaguuuugggaagauucaacagaaugccucaucugaaacuuuuugaugaugucgauuaaaaaaaaauucaaacaaagucuaaaaagcuuuggagagaagagggagucauccaacuuauuuuuccuagcuauauuacauuucuucuguccuuucccaccucccaauaaaaggagaagaaaaaauuucugggccucagaauuaauuugaacuguuuaccuuaugauaguauuuucuaguuuuaggaccuguauguaagaguuaagaaaaaaaaaacaguuauucuuuacucuuuugguauuuucccacuucugcucccaaagcuuacauccaacaaucuuugcuaauaguauuuaaguaaagguuaauaauaccuuucaaagcuuauuucuucacaggagacuagggaaucauuguucccauuucucucauuggaauuuguuuauuuuagacuaacuuuauuguucaguagagaaaaugcuucaaaacaguguuuucugcaguucuacuugagucaggauucucaguucuuuuugaagcaauuuuauccuucuuggguaaacuuuuuuaaaaagcuccuaaguggguacuuguuugguaaaucuucauucguaacuguagauuucauucuuuuuaaaaauacggcguuauuuuaaacuuaacuuuuugaaaacucagcuuuauuaagauaaaauucgcauaucgugcaauuuacccuuuaaauuguguaacaggguugugcagccaucaccacaguuaauuuuagaacaccuucaucacuucaugaagaaaucccauauccauuagcggacacugcuccccucauacugcucccagcccuaaacaaccacuugucuacuuucugucuuuauugauuucccuauucuggacauuuuguauaaauggaaucauauaauguguggucuuuugugaugggcuucuuuuacuuagcauaguguuuucaagauucaccugugcaguagcauguaucaguacuucuguuuuaauuccuucuuuuuaaauagcuggauaacauuucauuguaugcauaugccacauuuuauuuguuuauucauuuggaguuguuuccauuuuuggcuucucugaauauucauguacaauauuacauguggauauguuuuaauuucccuuggguauauguccaggugugggauugcugggucauaugguaacuauauuuaaucuuugaagaacugccagcugcaccauugguguaacuguaccauuuugcaguuccaccagcaguguaugagacuuccaguugcuccauauccuugucaacacuuguuuuuauuuggauuuuuuugauuauugccuucuuaauugugaaguaguaucucacuguggauuugacuugcauuuuguuuuuggcuaaucauguuuagucauuuuauaugugcuuauugguuauguguucaucuucuuuggaggguaucuauucauauccuuugcuuauucuuuuuucuuuuucuuuuuuuuuuuuuuuuuuucgagacagggucuuucuuugucaccacaggcugcagugcaguguugugaucauagcucacugcagcccucaacuccaggccucaaaugauccuucugacucagccugcugaaugacugacauuacacgugcaugccgcugugcccagcuaauuuuuaaauuuuuuguagagaugaggucuugcuuuguugcccagauuggucucaaacuccugguuucaagugauccuuccaccucaaccucccacuuuugcccaguuuuuaauuggguuauuuguguuuuuuuuagugaguuguaaauguugcucauauauucuagauacaaauucuuuaccagauaauaaugauuuacaaauauuuucaccuguuuugugguuugucuuugacuuucuuugguaguauccauugaugcauacaaguuuuuacuuuugauguuucuuuagucauuuaugcuuuugauuccuuauuuaagaaggcuuuggcuaacccacagucaugauuuacuccuguguuuucuucugagagguuuacaguuuuagauguuacauauuagucuaugacccauuuuuuaaaguuaauuuguguguauggugaugaggcagggguccaacuucaugagguuauccaauuguucuagcacuguuuguugaaaagauuauuucuuuccuguugaauuaccuugauacccuuggaaaaaucaauugacccuagacacaguugacccuagauuuauuccugaauuuccaguuuucuuccauugauuuauaugucuuuuuuuguucguuuuuuugaggcagagucuugcucugucacccagguuggagugcaguggugcgaucucggcucacugcaaccuccgccuccugaguucaagcaauucucuugccucagccuccggaguagcugggauuacaggugugugccaccacaccuggcugauuuuuauauuuuugauagagaugggguuucaucauguuggccaggcuggucuuaaacuccugacaucgugauccgcccaccucggccucccaaagugcugggauuacaggcaugagccaccgugcccagucucuauauguguuuucuuaugccaauaguacccuguuuucauuacuguuguuuuguaguaaguuuugcaguggggaaguguaagucauccuacuuuuuucuucuuuuuaaggguugauuuggcuuuucugggccccuuguaauuccuuauggcuuuagaaucagcuugucaguuucuacagaguaggaugggauucugauagagaguauauugaaccuguagaucaacucgggaaauauuauuaacaguauuaagucuucuaaucccugaacaagggauguuuuucauuuauuuagauauucuuuuguauuuuuaauuuuuuuucuuuggagacagugucuugcuuuguugcccaggcuggagugcgauggugugaucauaguucacaaguccucaaacuccugggcucaaggcaucuuuccaccucagccuccugaguagcuaguacuacaggcaugugccacugugccaggauaauuuguuaguuuuuuguagcaaugucucacuguguugcauaggcugguccugaacuccuggccuuaagugauccucccgcaugagccuccaaaagugcugggauuauaggcaugagccacuaggcccagucagucuagacauucuuuaauuuauuucaauauuuuguaguuuucagaguauaaguuuuauauaucuuuuguugaauuucuuuauaaauauauucaauucuuuuuaaugcuauuguaccgggaauuuuaacauuucauuuucuuauuguucauggcaaguccauaggaauauaauuuuuguauguugauguuauaucuugaagccuugcugaacuguuuauuaguucuaauaguuucauaguggauuccuugggauuuucuauauacaagauuaugguaucuacaguagccacuuuuuacuucuucccuuccaaucuggaugucuuuuuauuguucuugcccagugguccuugugagaaccucuaauacaauauugaauauaaaucucaaguacaagcauccgugucuuguuccugauuuuaggggaaaucaucuagucuuuuaccauuaaguagcuguggggguuucauagauguccuuuaucaggguugagaaaguucccuucuguuucuugugugucaaguguuuaaaagagugcaggaauuuuuccaaaggcuuuuauucaucuguugagauuauaauggguuuuuauggucauuauuuugaaguuacuaaaauucaacaucaaacauuuaauuuccugcacauauuuuuauccaucuuucugugguguaagcuuaacuuauauuaguuauuaugucucaucuuugauaguauugacucagauguacuauaaauuggguuuuuaaaacuuagccuaauauuggcauuaaaauaaacuguguuaguaucaaucaagugcuuucucucuuuuuuuuuuuuuuuuuuuuuuuuuugagacggaguuucgcucuuguugcccaggcuggagugcaauggcgcgaucucagcucacugcaaccuccgccuccuagguucaagcgauucuccugccuuagccucccgaguagcugggauuacaggcauaugccaccaugcccggcuaacuuuuuguauuuuucauagaaacggguuuucuccauguuggucaggcuggucucaaacuccugaccucaggugauccgcccaccucagccucccaaagugcugggauuacaggugugagccaccgugccuggcccauucucauguuuugaauggagaaaugacacuucaaguagggauaaccuccagaaccauuuagcauugggaaaguuaaucaguuauugauaguucuggaaaacagguuuguauuuguagaccugcauagcauuguuauuucuaaauuaagaaugaccaagaaaaaccuagcguaccuucaaaagcuaguauuuugucuucugugagcagcauugcagaguuggcauaaggaaaugugcuuuuuuuuucuuuuuuugauggagucuugcucugucacccaggcuggagugcgguggcgugaucucggcucacugcaaccuccgccuuccagguucaagcaauucuccugccucugccuccugaguagcugggauuacagacacaugccgccacgaccugcuaauuuuuauauuuuuaguagaggugagguuucauguugaccaccuggucucgaacuccugaccucaagugauccgccugccuuggcuucccaaagugcugggauuacaggcaugagccacuguacccagccaaaauguacauucuuaauacauuuugaaaaggaugaugugaauucugucagccuugggcuuguuucacacuuuaaaacugucuuugccuacgguauaaacaacuugaauguucuauuuauuuuuaacauugccaucugucacuguuagaugccaaaucugaaagauacagcuauaguuugagacugaaaauuucaaguuccuauacuauuacacaacaaggguaacauaggaaaaauauucucuuugaaucuguucuuaaauguuauuaauauguucaauuauuuguguguacagaaaauuaaucaccauauccugaccaagauagaaaguacccaugguaccuuaggaaaaagaagguaagaguuugauagagagagagagagagagagaggagaggaaacaaaagagggggaagcuugucuauaagaaauugucauuuuauucagucacccuagggcaugauauaguggaagaugaggucuagguggggaaagguggaaggggaagcacauguuuuucuuuguguuuguuuugcuugcaagucacugaggagcuauuuacugacacuuuucuugaaggcuuuauguucauagcuauucucuuuucagauauuucuuuuuccgaauucucuuucuccucuccuuuacauaucaguuacauuauuugauauugucucacagaucucagacucuguuuuuucuuuuuuuuuuuuuacucuguuuucuuuuucuucuuuuucuuuuuuuugagacaguuucgcucugucucccaggccagagugcaguggcacgaucuccuguuuucuuuuuuucucucucucuuuuuuuuuuuuuuuuguuuucaguuuggauacuuucuguuguccuaucaucaaguucagugauuccucacucugcuauguguggucagucuucucuuaaggccaccuaacacauucuucaauucucguauuuuucuuuucucgcauaaagcuaaauggucuuuuuacaauaauugcuaugcuggaauuccccaucuuuuugcaucauccaccuuuuccaccagaaagaaagaaagaggaggggugggggauagaagagagaagagggaaagagugggagaaauggagaacagagaagaaaagcaagcagagcuuauuuugaggcauuaacuucuggaaauaaaagacuagugauuuaggcaaccuucccucugaggacaguuaaaaaauuuugacagaaguauaaaaacauaucuuugaagcauuagagaguuaauaaaacuguaagcaauuauugugauaaggugaugaaacagaaggaaaucugaagagugaccccugcauauggagacauuauuccccuaggauaucugcugauggaguagaggaggucaucauagugcuaggggaacaaaaauuggaggucagaacccaucaagacagaguugcugaaaaaugccccaagcuuugaguuggaaucuauguagaaauugaugacugauucuaaaauguauauggaaauacagagccaagaauaccaaagacgauuuagaagaacaaaaaagugggaaacuuacuguaauagaugucaagauauauugugaaagcuucacuaauuacgacguugguauagauguguacagauagaccaauagaucaauggaacagaauagaguccagaaacaaaccugugucuauauagauacuugauuuaugacaaagguggcauuggagggcaguuucaaaagaacagucauuucaauaaagaguacugagucagcuggacaucugaauauaaaaaaagagaagccugauccuuauuuaaccccauacacaaaaauccauuccaggagaauuacaaaucuguaugugaaagacgaaacaauaaaacuuuuagaagauaauacuauagaauaucuuuaugaccuuggcuuuagacauaguauuaauuauaacugaaaagcuuaauaauuaaacaauuaaaaggaagaacuuuaucauaauaugcccuuaagacagugaaagggcagauuacagugugggaagauauuugcagaaugcguaucugacaaaggaguuguaaagagucuuuaggaaaaugcagaucgaagccuuauugacucuuuaguacauacuuaaccagaauaauuaaaauuuaaggauaaugauaucuaagguuggcaagaauauacauuaauaggaauucucauaugcugaugaugggaguauuaauuugggacaaucauuggcauuaucuauugaaguugauacacaacuguaacccagcaguuccacuuuuagauguauauagagauucauguacacagacuaagacacaugcauagaaauguugauaacagcuuuauuuccauuuguuaaaaacuggcaaaacuuauggguguauacaugguggaaugaauaaaugaagauauauacaguaaauuccccuacaccaguaaaaaugaaugaguuaaaacuguuugcaacaacaugauugaaucucacaaaaaauaguauugaauguccugauauacacacuuacacuguaaaguuucauguauacauguagagaguucaaaauccuaagaguucaagacugcucugugguauuagaacuuaggauagcaguuaccuuuggagaggaaagagaaggucagugauugggaugggcaggagagaggauucuggaguacugguaauguucuguugauccaggugggaauuauacggaaaugucaugauauugagcaucuuuuugugugcuuauugcccauuguauauuuucuuuggauuaaugccuauuuaagucucuuucuauuuuugaauuggucacuuugcauuuuuaaaaaauauuuuuuccauccagaugaauauucuuugcaguauugcuuuaauacacaaauguuggaaaucauauuuucaaaaaauacuuuugguacuuuuauacuguaaauuacuuugcauccaccacaaaguaaguagaagccuauguacuaaaccagagaacuuuuucucugauauauuguuaaaugaaaaggcaaaucacagaacaguaaaaucccauuauaaauucauagaaagaggaucuagaaggcuauguacguaacugcaaaggggaaugggauuauggagacaguaagaaacauuucauuuuuucuccauuugguuguguauuauuuaauuuuuuuauaauugaaauggaauaguucccuuggccccuuugcaggauucaaagcucaggggcagcacgcaggugagugggugcagaggcaaggaugagcaccucugggcaacugguaggagcagaacucugugcaggcccauggcagcaucuagaaguuacccacgacccuuggcgccccagagggcauguguuacagugugcucuuuuaccguugccauccauggguggcucaaauguuaacucaguggagggucagugugacagccucuugcacuuguauccaaguccuugucugggguccaggaagaaucaggaugcgcaaaugaauugaaggguggugaauguggaggauuuuauugagcgguagaaguggcucucagagggauggggagcuggaaaggggauggaguggaaaggugguccuccccuggaguuugaccaugcccagcugaacucuccucugaaguccugccgucgagcccucccucugaagucagucugcuucucucaaacguccggcugcuucucuuauucucugcugcucuacggcucuacugcucugcuggcagggccugggguuuuuaugggcacaggauaaggagcgggucaggccaaggugguuuuggaaaaggcaacaauuguaggggugggaaacaggaaugcauguucucacuuugggucauagguccaggcuugagaguguggcccuugccagggaccacccucuucuacccaguguuucccuuucuccuguccguaucacaaugagcauguauuauuuugcagaauaugaagaaauagauuguaaucuccuguuaacucuacccugcccaaacagguaauuucuaagauccuucuuaaugcaucuaccccauaaaauggacacuagugacacuagauuuaaugcagguguuaaauuuauauaccugugugaaaagcagcaggguuaaagggacaaaagcucaggcaaccuuggguucaaucccuaugccacauuuuauugucuggguauacacauuuggccucucugauuuucaauuuccauaacugaaaagugaggcaagauuauuauuucaaagauuauggauaagguacuuaagaccccuggauacuuagugaaugucaacuguuauuuauugauuuguguuuauuuacuauguuauuuaaauucaugaguaucagaaacuauauuuaauuuauauagauacuuauuuaagauacuauuuauugauauaaaucuacaugccaagauaucacaguuguguuagucuauucuagcguugcuguaaagaaauaccugagauuggguaauuuauaaagaaaagagguuuaauuggcucacaguucugcaggcuguccaggaagcauggcacuggcaucugcucggcuucuagaaaggccucagggagcauuuacuuaugguugaaagcgaagugggagcaggcaccucauguggcaggaguaggagcaagagagaguggcagagaguaccacauacuuauacaaccagaucucacgaguauucacuaugcaaguacagcuccaagccaugagggaucugccccugugaccaaaacaccuccugcuaggccccaccuccagcacuggggauuacaauugaacaugagauuugaguggggacaaauaucuaaacuauaucacaguacaugaaggaaacauucauuacaguaguuuucacagaaccauggugggggaaggagcuucuuugaauggucuaagaauuugcaucacaaauuucuguuuuauuugaagauaacuuuuuuuuuguuaacagauauacauuaaagcugagaccuuuuuuuuuucuuuaagacuaguuaagugcaugugugagaagacagaaaagaguagaacagggaaauagaucuguaacugacauggguacaaucuauugagauaacucaguaacuuuggaccagccgggcuuuuauuuguaguguuguuucaggaaaccaguccucuaguaucuugcuuuuuauguuauuuuacauucaguauuaccuaauuccaguuguuuuguucuaaauuuucacuugcuugcuccuggauuguuucuauuuucuuucuuuuuucaguuuccaacacuuuuugcucuuuuguagccauguuucuuugcaugucacuuuaguaagaagugaccacacauuuauaugucaacuaaaagagguccagguuuuuacuuacucuauuuggaguguugcaccgaauaugaauaugcuucccauugaacaaaugcuuaaguguguuaagaaucagauuguuaaaaucccuaccuucagaggcacugaugaaagagucaaaggaguacuaaaaugcuaaagugccuugggaagcuuucuccccaaauacauugcaaaggauagaucaagauaauauuuucucacucuguaucaggggaaaacagaaaauuuauaauaccauguauuuauaaagugcuuuaggguuuaugaauacuuacauuuccauuguuuaaacuggacaugaaucuggucacaacccugugagcuugcuagggauagggaauguauuuccauccccuccccuuccuacccguuuuuuuuuuuuuuuuuuuuuuuuugagacggagucucccucugucccccaggcugcagugcaguggugcgaucucggcucacugcaagcuccgccucccggguucacgccauucuccugccucagccucccgaguagcugggacuacaggcgccugcaccacgcccggcuaauuuuuuguauuuuuaguagagacgggguuucaccguguuagccaggauggucucgaucuccugaccucaugauccacacgucucggccucccaaagugcugggauuacaggcgugagccaccgugcccggccccuacccuuuuuuaacaaauggagcaacuggaagcuuaagacaccugccugaggcuucacaaguaggauuugcugaaaucuccugacaccugaugguaaucacagccagcgcuuacauaucccugacugcgcaccaagcccugugccaugcaccugacauggguuaacuagcuugugugcagguaguuaaugcaaaacccagaauucugcccacuauagaaccuugaauagacauaaagauuuuuguucucucugucaaaacaaaaauuuaauuccuuuugcuuuuacuacaauaggaguaaauaaaauguguuuacauuuuuauaaggccuauauaaacagaacagaaauuagggcaaaagaugggcugaauugagguuaaagagaauugcuuauaggaaccuacuuaauuugcuaauuuuguuuucagucaucgucccuuccuaaugccacuuuaauuuaaaaaaaucuuuuaauuuuucuucacuaugcauaaaaaauauccccaaacucucuuacauuguagcauuuccagucauucuuuuccauuuucuuaguauaguauuucucccuguguacuugacuggaaucuccuuguguuuucugaacauggcauguggcuucauagcuuucacuuugcuccugcuguuccuacacccugaaaugccuuccccauuuuggccaguugaaauccugcuuauauuucaagacucaggccagaauccacuucuuccaugaaagcuucccugacccaccucucccuaaucccaucuccucuccaccacuaguccacuagugcaaauuuaauagcaguuauuucacauauucacuaaauuguacuuucuucauaagugacaaacaugucauucaucuucaucuccuccccaggcuguguguguagugguuacacaacgaaugccuguugaauuaauccauccuaguauuuacuaucaaauuaaaauuuuggaguacagcuuucaucauguaacucuuaucuucagaauauuugggugaauccucccucuaugccagaauuagauacaaaauuuucaguguagaauugaagguguuucacaaauaguggaacuaacuuaucuuugcagccauuuuuuccccccauuucuuaccuauauucagcuucacuaacguguuuccuuacucucuucccaagguacucugggcuucccccuucccucgcuugugacugacuuaccauuuuuuugugugaagguucccuaggccacucuuugacaaacuugaauuugcauucagcccaccugaguucacauucauuucucucaaaaaaauuuugaguuugauacuucacuuucuauaugucuuuuuuccccaccugcgugguuuuguuuguuggcagauguuguauuuuauaguaauuugcgucuuuuauauggaugcuccaaaacaguucuugauugguaauuauaagcaugaacaguuuucauuauaguuaccaaaaauguuuccuaaacccauaugcccuuuagucagugcugggaguagcccccuaaucagucuuuuucuugcccugaguaaagaggcuuuuccgcuuuuggccauuuccgauauucauucauuaauugaucaagaauuuaucgagugcauacuaagugcuauggcuaaaacagugaacacaccagacagaaauuccaccauuuugguguuuguauucacgugugacuagaaggagagcaguaaauaaauaaauaaacaauauaguaugauagauaagggcaaugaagagaaauaaaccugagagacggaugccaagacuaggaaaugcugagaaguggcuuaugugggguuauaauuuucaagggaggguagggugguccgggaauggcucauuagaaaccuacuuuugaacaaagaccugaaggagaugaggaggggagaucugcauguaaucuggaggaagagcuuuccaaagacggaacagcagguguaaugauaccgaguugaaugugugucagacuugguaaagggucaggaggaaggccagguuggcuagagcagugggugaagacauaagaugaggucaagaggggagagggaucagaucuucucuggggccugggugucaccauagggguuuuggcuuuuauucagaauuaguuggguaggcaguggaagacuuugagcaguuuuuguuugguucuuguuaagaggaucacuuugcuugcuguguuaagaggaaaggcagagauagguagaagaagaggggcuggcaguggcuguugaaaugagccaggugagagaugauggugacuuagaccaguaugguagcuguguaagugaugagaagugaucugcuucuggauauauuuuggccauggagcuggcagaauuugcagacaugcugugaagggauugaaucauccagguaauuuuuuuuuuuuuuuuuugagacagagucuugcgcuguugcccaggcuggagugcaguggcgugaucucggcucacugcaagcuccgccucccggguucaagagauucuccugccucagccucccgaguagcugggacuacaggcacccgccacuaugcccagcuaauuuuuuguauuuuuaguagagaugggguuucacuguguuagccaggauggucucgaucuccugacuuugugaucugcccuccucagccucccaaagugcugguguuacaggugugagccacugcaccuggccuuuuuuuuuuuuuuuuccaagauggagucucacucuguugcccaggcuggagugcaauggcgcuacuuggcucacugcaaccucugccucccggguucaagcaauucuccugcucuccugccucagccuccugaguagcugagauuacaggcaugcgccaccaugcccggcuaauuuuuuauuuuuaguagagacaggguuucaccauauuggccaggcuggucucaaacuccugaccuugugauccuccugccucggccucccaaagugcugggauuacaaaugugagccacugugcccagccccacucaaguaguuuuuaugauagaaugauuagaauaaagccauuccuuuuccagugaauucuccuuuugccucucccacccaugcaaagauacauccuaguccaaaauagggggauagucaccaaacauuuuguuaaauaugagagaaaaacaagugaccucuccuacacagucacuagauggcacagcaucuuuucagucaauuauauuuuuugacuuuuuauuuugaaauaauugaucucagaggaaguugcaaaaauaguacagagagauccccuggauucaucacucaauuucuccuaguuggaacauaacuauauaguaguacauuaucaaaaccaggaaacaacauggucacaauacaguuaacuagaugcagaccuuacuccaaauucaccagcuuuggcagcacucuuuuucuuaccauguauuuuuauauggcauuaggguacagcuuuuuggguuucagaugagaauuaucaucauuaaucucccacacacaggccaaugauuguggaauacaguuauuccuaucaauguuuauauguuaaguaauauauaacauauauuacuuaaauauauaugucaaguaauaacauguauuacuuaaauauauaugucaaguaauauaacauauauuacuuaaauaauauguuauauauaauaugauaaaauaauauauauuaacauauauauuacauaacauaaacauggauguuuauaaguuaaguaauauauggggcuuacagauuguucuaaguauucccaaauggcuuuucuacaguaaaaauauguacuuucuuuuuucucacucucuucccucaucccuccuucucuucuuucucuuuuuucuuccucucucucuuuuguuuuucccuugcccucccuugcugucuuuaguacuaaggaagagguugggagggagagauguuauucauuuaaaauuaaagaaaagaagaguggcuuugccuucuccaauaggaguaaauuuuaagagccuuguuuccuauucagcuaaauucaauaaucugcagaugucccauugguaaagaucaaaauguuuuguuccugccacauacuggaauucucuaugaucuuucuuauuuuaaaaucacauaaauuuauuguuuuuuauuguggacuaccauuuaucaacaauucuauguucagagcuauguucaaagaggaaggaaagaauaaauucaaucaacagcagaagauuuuggaauggugcaugaugaauccucccuggauaucucaucucuugccaguuacuguuaugggaccuuggcaaauugcuucaucucucugccuuagucuccucaucuauaagaugagauaauaauagaacugccuucauuagauuaggauaaauaauguuuuuaaauaccuagaauugugucuggcacauaguaagugcuauaacauuauuuuguaaauuaaaaaauaccugaggguagaauuuacauuaauauuaguaaaaagucauuggaauggaaaauauguaaauauuuuccaauucauuuguuucuucaauaaauacauaauuggguuaacacaguucaguauuauuauuuaguagaaguauugaaucucaguauuuauauuguauuuaugcaaauaacuaauaagaaucuuuaaagcuuuaaaaagucacgaauugagauugauugucaguuugauaauaguugccaaagauuuucacuuuugcuaaugaaugucucugguagaggaaaagaaguaccuugggacuccaugggugaaggagaguuacauauuuaacaucuguguaguguaugaaggagaagguuguacuugggaaaacuuguuuaauucuggauuucccauucugaagaaaccuuuuuuauuuuuuucccuaauaauugcauaagagauugucuuagaauuuuucacacagagacuguguaaguugauacuuaaaaaaauguguuaguagaauaacaaucuuagcucaguaucagcaaagauauuaaaagauuuguuuucucagccuauccuguuguuuuagugauucagccuuuuacuggcaguacuuccuacuugaucaauuacuuuucuuauuuuaaaggagccuaaagugcuaucauuuuuauuggauacacugucucccaccuacuuagcaaacaacugaaaagcaauuaacuuuuaaaaagagaaaagacauaauuuaauaucaauuucauacugguguuuucugagcaggaagugcucaccugugugggguugauggguggagcucuucuggugaagccuguucugcaagugugaguuuaggcuggggcguuucugugguguugcaaagcaguaugugcugagagaggaggauuaagcuccuggaggcagagcucucccacacacuugcuggcuugcugggcuccacugacuggacugaaaacagggccaagaaaacugcugcugcaggggguccugaaaacagcuggaacccggcagugaugugggaccuaacuugaaguuaaccugugguggugagguuggaaccaguuggauuaugauuuauuuucuacacucuuguacggaaugcagagcuguuguauccugaugaaucuacugcuaaauauagucauuuggaauaauuuuaaguauugaucuuaaaacuuguaccacaacaagagguaaggagaucucaaucagucauuuaaauauuugacucaagcaacauucagaauuuuucacugaaacuauguuuagauuauauuugggcacauguuaccuugguugcucucuuagguaaaugguuaauuauuuaauuaucuagaaauucagcacuugaacauuaguauuugucauguuugucaaaaaguuuauacuuuuugaaguaggcuuugcugauuguacaacacagauguucccagucgguuucaagaaauaucuuuuuuucuccuauuuccaaucagcuuauuucuuguuuucuauacauuaguuuaauauaauaaaaguuuuuaugauuaaaagaaccugccuuuauuucuuaagcagccagcuuauaucaucuuuuuaauuuuuuuccugguggguuaauaauauuucaauuauugauuaauggaaaugggcagugcuaaugcacuuaaaauaauuugguagacuguguaaagaggcuccucaaguuugcacgaagaaguaaccuuucuggccuuuucccuucaaguaugguucuuccccgccucuuugguauuggcauugguaaggauaaccaucuccauccauaaaauauuuuguauuaaaucucagagauuuuaccacuaaggugguguuccguauguauaugguguuucuuuagaccucgguaauaaaugccuuucauuaaaauaacauggagaccagaauuuucucugaaucacaaaucagcccuuaauagggcugauuaguauguucaacuucuuaacagagguugaacauuuuucuuuccaggauuguugcacuagugcuuaaaugacagcaauauuuuaauuuuuaaaaccauaaaugggggaauuucagaauuuagagcucauuuucauagucagcuuuuuaaaaaagcaucuacugcucauauaauaaugguuugaacuaugauuucuuuuuuuaaaaaagaaugcuauauggcauuuaguggaagauagaaaucuaaaaugucuuagguuaaguuuauauuuaagaaaauuagagcaggaaggacuagaaagugaugccauguucucagugcugauuccaggauagauagccagauuccagguucuggaaagcugagucaguuuucugguuagcccuguaccucagggauucucaaaguuuucagaugaaauguaacaagaaauuguaguaguaauaauagcuccuauugauugacacagaauuuaauguuuggcacauacacuucauguaagcaucauaguaaccuuagugagagcuguuguuagggucauuuccauugugagugaaagaauugagacuuaaauagguaauuugcucaagaucuugcaacuggaaagugauuagggacugaauuauaacccuuuggucugauuccaaagccuauuucuuuaacaagaacucauugucaguuccauacucaccaaauauagaaacuuuccccucuacuuccugcaaaacaaaacaaaacccacaaaaucaaaaaccaccucugauaguaucaaaguuccacaccaaacuucauagcuuaauaaagugcagaggacugugacauuaaaguacaugugauuacaauuuaaucugacaaaaauuuaucucaaaagagaguuuuuacaccauuaaaauuaagguucuaaguuuuccaauuucuagaacuaauguauauuuugguaguccuguuaccuuugauguaccugaauuccuaagaauuuguguguguuauauuuaauuuuuguaagaauacacaagcaugucuuccugagauaguacuagcuuuuaagcuucuuaucaaguaguacuaguucauccuggaaaaauaagagcccagacaauuuaaaauuucuuagcagguuuuaaaaucuauauucuguauauaauaucccauuccaauuuuaaaauacuuuaagugucaggaauuuauaucuacuucauguuuuuuccuccugcuucugguaaaaugcaaaucuuccuuuucuguuuuuagaaaugaaauuagucauagucucuuauauaauaaccgaggugguaaagucagcaaguuaaaaauacuucuuacuuugauuuuguaccaagucgagaaacagaaccaaucguauuuauuauuuuaaauuuguaauuuaaauuucgaaauaaaaauuaguaucacuuuuagcaggaaaaagguguaacuuauuuauaucaaccuaaaauaacauaaucuaaauuugaaccuucuuugauauuuauaacugaaaucuguagcuucuagaaaaguaaguguguaauguagauaauaauagucuuaucuuaaccguaugaccauuuucccaagggaacuaugauuuuuaaaggucuagcaugagcagguucuguguuguaacaguuuguguacuccucuaggaagggcagcagcauagugauguugcuuugguuucaucuuuaacccuggagaagagauacaguuuuauucaaauaucccaauauuuuaguuaaccauugguaugccauucaacaugaguugugcuggauauucugaagaagcaguuuguggcccauuuucugcucucuuucucucagugaauuguuguuaccucuucugugucuaaaagauucuuuucuaaaaucuacuacagauuuauuuucuagaucccuuaauguuauucauuugcauuccagucaguaaugccuuuugaaaugucuacucuucucucauaauuagauagaacccuguuugaauuauauaacuguuaguagcuuucccauuuuucagucaagagccauuacuaguggugcuauuuuaaauguggccuugcauguauaugaauuucugagauacuugguuuuauuccuuugagguuggaauagcaaacuguuucauuuaauuccugauccggucccagauagcuuuucugagacagcccuugcagcuguuauauacaucaguuaaagaacuguguuuuuuuccucuuacuuccaaaguuguuugugauauauugaucaaaagugauucuguacuuuccuacucuacaauagcuuuguaguacauuaaaauucaagacucaauuuaucuaaaaaaaauuuuugacauauacuugggauaggaguggggaaugaagcccaaggcugaaaaacuguuauauuccugauuuuaaaaagugguuccuagagagacacugagaauuuugcuuugugagcgucaaccugauagauuauaaguuuucagaaguucagaacauacagaugauauuuaccuuauuuuucuuuuacugcaguaaacucuugaaaccuaugucaaaaaauaauuuuuauaaaguauguggcauuuucuaauacaaagaauauuauaagugaccauuguacuguugaccaaggacuugcaagcaaauaaagaaguaaacaacaguauaccauauggcaugaccagcaacugugaauguccuuagcaauuaaagguaguacaagcaucaaguccaagaaacaguuauaagcauguuauguaaauuaguuauguaaggacuccuuauuacuacuaagcauucauggaacuaaauaauuaaaauuaauuuaaaaaguguuaaaccuaauaugcuuaauaaccuuuaacagugauuuuuuuaucuuaaauuuuuauaccagccuuuuuccaagaugauuuagagaaccuaauuuuuuuugacaaaguucuccaaugacguuuuaaaugaugucuuuuuuucuccugauaaauuucccuaaacuaaagguauguuucuuagauuuuagagcuuuguaugcuauugacacuucauacauucucagaguacuuuaugauuucucagguauuuucauuaaaaucuagaaucguauugucugguuaaacuucucauuuuucauauuacuaaucugaggucuaaacugcuuaauuuccuuuucuaaaaucuuauagugaguuauuggcagaaucgggauuaaaacugucucuccacauucuuggucugguacuuuuucacuagcacauaccuuagccaaugaugucaugauuggauggaugaccuuaauuagacuauaugucuuauuauuggaaaacaauaaaagcuuucaaugacuaggucauugguucaaggauguauuuuuaaaucuucaaauaggauugcuaacauuuuaugcuuacuacauguuuuuaccacacacacaacuguguauuuagauauuauaggauauuaccgaauaaacuaaagaaaaugaauugaaauaugaauaauaaauuaucuugauaauuagaaauagauauauagaagagaggaaaggaauaaaguuuuguaauucugauaacuuauuacauuuaaguuauuacacagaaugugaugggagauaauuagaauuuauuuaacauaccuguucuuuugauaucaacuuuuaaggagguaauucggaugauuagagacuuguuuauauuuugaaugugaauuauuuugaaugugauguuaauacaaacagauuaaauuaguuaauacauguaaagcccuggcacacaguaaaauaguaagcacucaauaaucauuauguauacaauaauuaucguuaugguauuacuguagcaucuagauuuuccuucaauuuuuguugacuaucuggguuaggauuuaccuuuuccuucauacugccuuuguaggacugggagcaggucaguggguggugccagagagagggcagagcuaucacaaaacagaccagaagauucacagagauaggaauagucagugacagaauuucuucagcauguccuuauuccaucaaacaaaacuuggcuggguuuacuuugcaagaaaccccuuuacucugauuugaaugauauuuuuuguaaaacuggaaaaacacaucgccagaguuauucauguguauuuuuagucauuggcuuaaagaacuuuuauaucauuagucauaaugauaugaaagccuuauuuauguuaaagucuuuuuguguuauaaaaaggaaaaguuucaaaaggguauauuuuucuauagaauacuuguaauauuucuguauuauuggaaaaaguauuuguucaguuccuuuaauauuuacauugcauauugaaaucuugcccaacuaccuacaaauuuuuauuuaaaagauuuguagaguuauuacucuagugaaucacagauuaauuugaguccaguuauuuguaaauaaaagcuuuguugguuaagcuuacacuaauuuaacugauauaaucaaggcuauagacugaguaagauucauaucacauauuucccaagaugaaugcgaacuaaaguuuuucagaaacuuucucaguugccuaaagauccuuuugggucauauaacaaugcuugcuaaagauaaguuuaguuuuacaacucuuggcaauauuccuuuuaauaaauuugaaaauacuaaguacacaguucacuucaacuacuuacuuaagacucuaacuguaaaucgaugucauuuuucuuugcugcuauuuaagguauuugcugaugccuauuguuguuuuuccauucuuucuuggugcuuucacccaauacaguucuucuguguuugucuuccuuuacuagaaguucacaucuaauauguuuacaguauucuuacauuuauuacaguugcuaagacggaacuuugcccuggcuuaaggcuguuauuuuuuuaaauugccacuugccuuuucaagucuauugcacucauuuaugucacugcaaaggauacaaggaaaguaggaguauaaaaguauuuaaaaauauaaaagcauaaaagcaagccuucugcacguucugcacuuguaucccagaacuucaaguauaguaauaaauaaauaaauaaaaauaauaauaaaaaacaaagucagaagcaagaaaagaaaguaguuacaaauuuaguguaccucauucaaaacuuaaacaagacaaacuaaaauaucagcuuaauagauggagagaaaucauuugauaaaggucaacacuuguuccuuuuauauaucuuagcaauuggggauagguaauuucuguauauuuaagguuucuacccaacaaacccaagugaauuuuauucuuaauggugaaacauaagaaauaaucuauuuaaagucaggaacaagagaggcauuuauuggagguccagugaaguuagacaaaaagaauuaaaaggauuggaagggaagaaucaaauguguauuauuugcagauuuauaaauccagaugauucuacagucaaauuuuaagaaauaauaacagaguucagcaagguugcugaauaaaagauaaauaauacaaaaauaacaauagcacauuuauuaaguuuuucugucuagcacuaagugcuuuauaauuuuaacucauuuaauucucacaauaaugcuguucaguaguuauuauuuuaaacuuuuuuuuucuuuuucuuuuuuuuuuuuuuugagaccgggucuugcucuugucaccuaggcuggaaugcaauggcacgaucucagcucacugcagccuccgccuccagguucaaaugauucuccugccugcugaguagcugcgauuacaggugcccgccaccacacccggcuaauuuuuguauuuuuaguagagacagguuuucgccauguuggccaggcuggucucgaacuccugaccuugugaucugcccgccuuggccucccaaagugcugggauuacaggcaugagccaccaugccuggccuaaacuuuuucauagaugaggaaaaugaaauacugagaauuuaaauauuucuccauaaucauaccguuaggagcugcagaggcaagauuggaaccccagaggucugacuccugagucuacccuuugcaaccaugcuaauugcauuucuguacaccaauaauaaaugauuagaaaauguaauuuagaaaacaccauuuuauaacaucaagaaagucauaaaguuccuaagacuaucuacaacaaaaguucguaagacuuuuaugaaaggaaauuugaacaauuuauugaaggacauaagcaaauuguaaauaaguggagagaucuauuauguucauggaaaagaaagcucaguaucauaaagaagucuguccuccaaaauaaucuauaauucagugcagcuucaaugagauuccaaaaaguuuuuuuucuccuucuaauuugacaagcugauucuaaaauuuaugugaaaugggaaauggcuaaaaauaaggcaguuuuagaaaauaauagugaaugaagggacucaucuuuccaguuaagacuuacaaauuaagaaagugagguauugauagagagaaaugagacaacucagaaacagacgucuuacaugcuauaugcauuuuucacguaagauagaaucagucuuacaauucagugauaaaaagguuauucgauuaaagauggcagaauaguugauuauacauauggaaaaaaguauauaucucucccuaaaaaacaugaaaaagcaaaaguuuuuagaagaaauagggcaauauguuuaugacuuauaaggaaaaucucuugaaguacagaaugauuucuguaccuaaagacauuuaaaaauuugugcaauaaaagauaaaccauagacuuggagucagucuuuauaauacguaaaggauucauuucuguauuaugugaagaauucuuauucaucaguaagaaaaagacaacaaaauagaaaaaugggcaaggauaugaucaguuauuucacugaagaagaaaacugaauggccauaugaaacauaugaaaacaaugccuauucugauuagcagucacagaaaugcguauuaaagugaaauauaauuucagaaauuugacagagcuaaguagaacaaagauuugaagaaugaggacugaaaaauacaucuaauuagaguguauauugauaaaucauuuuagauaauauuuuagcaaaguugaaauaugguugaaaaguagcauauucuauaacccaacaauuuuccuccuaaacgugagugccagagaaguccugucacuugugcccagggagacacuuaccagauuauacaguguagucaggauuguaagaacaaacacuuguaaacucugacagcaggagaauggaaauauaaguugugguauauacuuaaaagagaauauuguaauguaguuuaagugauauacugaaccacaagugccguggauaaaucucagaauacacaguuuugcagaaaguuugauaucagaugauuccauuucugaauuugaaaaacaugcaaaauguuaguauuguuuauggcuacauacacaugucguuacaguaugucguuacauggauggaaaugauaaaugcuaaauucaggauacagguucucucuguaggagaauaggauugcggaaacaguggcuucagcucuaucuuuuauacuuaagggaaaauaaucugaggaaauaauguggcacaauguuaagauuugaaaaaccugcaugaugaggacauggauauuuaucauauuauucucuuaaauauuucuguauaaucaaaguauugagcaauuuuuaaaaauaaguacauugacauugggcucuaauacuuucuaucaguacguuagcuccugauuuuccagggcagucauaccccaggccugugucuucuggucguguuuuccaguuaguguauccuaaaacuggucucuagagacuuaugugaauacaaagcugauuaagcauuaagccaguaggcuuuuaaauaguagucagguuaaaacuagguauaauacaauaggaguuuuguuucagcacuuuuuuccaauucuuaacauuuguuauauuuucuuuugaagagcagaauuuucagaacauuuuuaguucauuaaauggauuugauaguugucuagagaaaaauucuuucuucauauucauuagcgugaauagauauauugucgugcuuuaaauaaaagcaauuuauggaauuuuaaauuaaaauucaaaucuuuuaauaucuguuuaacauaaaguacuuuaagguaugcaacagagacugagaaugauagaauuugugagauuauaagagaaccuuaaacauuauguaauccaguugccuguauuuguauucuccucacuuaaauuucuacccagugguuaucuaaucuguuugggaacuuugaauaaaagacaggauauuauauacaaucuguaaaaauccacuggacauguuaaacauuacagucauaccuuauuauaccuuugguuuaaucagaacaaucugcacagguauuaauauauucccacuacuacauucuaauuuugucuccuugacguugugaauuuuuuaccuuuccuaaaauuugauguauauaaucaaauaaacuuacugcugaggccauuaucuugggacagaccauuuuccuauacacccucagaaauuaauccaagcccagauuuaucuuaagucagucuagaacauuucugggaaccaauuccuagaacuuuagagaaaguauuaugagcaagcaagaauucguugggauugcuggggaaguauuacgcugguguaauuaaacagcacugcccugccucuccaugccaagguucacuauggcuuaacgaacugcauguuuuuuaguaucucucuauaaacugguuauugguaucauaaagauuuaccuuggagauacuaggucgugugucauacugcaaaggcuuuuaacuacuggaaagacuggccugguaggguuugucuuugguuuaaaaaaagauugcaaauauaaagugugucaugucuaaauaacauuguggcacauguuguauuuuagcucugaaguaggaaauuugaauacaaaguaguaugguuugcuuuugucuaaguauuguuugcauuuuauuuuuuauauauuuuaucuguggaaauaccauugguaucauuuuagugucucuaauccaggauguuugguggaccuuaauccucacagccuugcuugccaguguucuguagaaauggguuuguaagcacuuaaucaucuaaccccacauccugccuucgucaguagaaaucuucugauagaauuaacaguauuagauacuuuccuccucaaaagguaguaacuaguaauauugaacaggaaagcaacagguggggaucagugcuugugucccaaauaagcucuuuuugguuacuuuaaugucuaagaaaugggaagaaaguuuaaaaugaagaaaacuaauuuaagagauuuauauuuggaaguguuacuagauccucaaauuugaguauaauuaaauugaauaguuuuauuuaaaucuccaaggcagggaaauuaaucuaucuugauaaauaauugauuauuuaauuauguaugccagaacuucuuacugucuaccacaaugaagaggaguccaauuaaaauaacaucaccagcagcgcugaaacuaugcagaacauaguuuaaucuuccuuugaaggcuuuuggaaucacguaagacuuuaugacuagucaccauuaugaauauccauuauuucagugucucagauugggauguagaugggcaagaagagaccauauccaccccucccacucacacacccaguuuagaugugaaguucuaaucuacguagcaauguuuuguggaaaggugacaaugcaaaguggccauucagaguagaagccagagcugcacguaugucagcacaguuucccagagcccuggagugccaaaugggggcacagaguugccagugacacccuccauuaucuuaauuuuaugcucuguugcaacucuuacuuaauugcgccuugugucacuauuuaggaaaaauaaacaugaauacucuuuacccuaacaggaaaagauagccacguuuccuuguuccugaucuaaacuugccaaaccaagaagcagagucaguuaccuaauguccugggaaguccaguugugcacagacugcuuuugacuagugagguguuauuguguaguagaguuuguuuggaggaucauaacuauaaauauguuuccguugacuuaccacugaauugugaagauguauguuuauuggucaguauauaauuccaguuauaaaauugcuaaucgaugugaaggaaaugaauguguucuuuucucuacuguugagaagccuaguucaauauggcagacuacugcugcaguuuaaaaaauguucucccuucauuuguguugaaaauggucacuuuuucccuuucuuucuuuuggauacuauuacuacugacucaggauuuuuauuuauuugaucuuuuaugaucaguuauaaccauucuuuaugauguguggaucgucccagauguguccacaagagucugacucagggaucccucagcugugggcauccccuugcuuucugugacaagcuuuccauucucaucuucugcuuugccugcuucugacuugcauucuggguuuguuuugauaaggaauuuuauuuagcacccaagaucugagaccagaggucuucauugcaaccaauauaucauuauuucuaagccuuuuaaaguggauagagcuucaggaaagugugugaguguuuuaaucaugaguucauguugauguuuccaagucaaaguugacauuacagguuuuucuucuuaaccuuuuagaucuuauaauuguaucucauuuucucucacauggaaaaucuuuguuuugucccacaauauguauaaaguuguuaccaauauuauuaccaauaguaaaggaguuggaugaaguuaaauauuacuuugcaggaguuuuuugguccuuagaauauaucccacuaagcacgugguccuuuuuuaaauauuuuaaauuuaguuuugaacauguagaaagaacauuaacaugauucagaagucaagcuauauaaaaaagauacacucagggaaguuucacauccuauucuuacccuuuacccuuuccccaccuguuguuuuuaacccauuuuuauuagcuucuaguuuauccuucuaguauuucuuuuugcaaaaauaagcucacauguacaugcauauuugugugggugaauuugugugugauguguguauuccucauccuuucuuaugcuaaauaugcuguucucugcuuugcuuuuuugacuuaauguauccugaagauuacucccuaucaguagguagagauccuccuuaaaaauaaaaaaaaagccaaccaauaauccucugugcagauguaccauaauuuauucaaccaauucccuauuaaugcucuuuuggguuucugauaaacauauuugguuauuuuuaaaggaacccaguguuuuaaaauguuuugaaauguuuaaaauuguuuauuuguaaacucucuauucuggccuaugcucccagccuuuacauaccccuugagccucauuucauaccacugucccguggcucccuaccccucucauggcuuccagcucagauaugacuuccucagagaaacuguuccuuaacucucuguuuaaugcaguuucuuucaagucacuaauacgucacccuguuuauuuuuuuauuagccacuauaaauaaucugauauuacuuuguugccuucauuuaggcaguaucauuuaguggauaagaguuuggacucugugcuaaaugcccugauucggaauccugguuaugugacagugggcacauuaacuuagcauucucugccucaguuuauuccucuaaaaauggguauaaauauuuuccuaauagugggcugugagaaaugaaugauuaauaaauauaaacacuuagguaguuacuugcacauacuaaguguaaaguaaaugcuggcuauauccguauuacuauuuaaucauucauugucugccaucaguaagcucugugacagcaaggaccuugucucuccuguuccccaucguaaucucaugacuuagagcaguuccuagguuauggcagacacuuacucauuuguugcuaaaugauuaauaguuaauauucacuuuccauuccuuugaaacauucuuagaaauauguuacuuaaagaaugcuuucuuauauacaucauaugcaguuaccaaauuugacaauuauuuucaucagauucagcaucaaaauauaaaugccuacuguuaacauguauuuuggaaguuuuggacaaaaucugaaacagaaaucagaagcuuuuacuaucagacaaaagcuagaauggccauauuuacuuugacacaguuacauauccaugaaauucaaaagaaucaacuaauauccuucuaaaauuauugagaguuuaguaaaugaucagaugugagcuaugcauuaagaaauuguuuucccagaauagagaacucagaaauaagauugcacaccuacaaccaucugaucuucaacaaaccugacaaaaacaagcaacagggaagguauuccguauuuaauaaauggauugggagaacuggcuagccauacgcagaaaauugaaacuagaccccuuccuuacaccuuauacaaaaaucaauucaagauggauuaaaaacuuaaauguaaaacccgaaacuauauaaacccuagaagaaaaccugggcaauaccauucaggacauagguaugggcaaagauuucaugacgaaaacaccaaaaacaauugcaacaaaagcaaaaauugaccaaugggaucuaauuaaacuaaagagauucagcacagcaaaagaaacuaucaucacacugaagagacagccuacauaauggaagaaaauguuugcagucuauccauaugacaaaggucuaauauccagagucuacagggaacuuaaguuuacaagaaaaaaacaaccccauuaaaaagugggcaaaggauaugaacagacacuucucaaaagaagacacucauccugccaacaaacaacacuggucguuagagaaauagaaaucaaaaccacaaugagauaccaucucacgccagucagaauggcgauuauuaaaaagucaagaaacaacagaugcugacaagguugcagagaaaaaggagcacuuuuacaauguuggugggaauguaaauuaguucaaccauugcagaagacaguguggcaguuccucaaagaucuggaagcagaaauacuauuugacccagcaaucccaaacaaauguaaaucauucuguuuuaaagauacacgcacccguacguucacugcagcacuguucacaacagcaaagacacagaaucaacccaaaugcucaucagugauagacuagauuaaaaaaaagggauacauauacaucauggaauacuaugcagccauaaaaggaacaagauuauguccuuugcagggacauguuuggggcuagaagccauuauccucagcaaacaaaggcaggaacagaaaacuaaacacugcauguucucacuuauaagugggagcugaacaaugagaacacauggaugcauggggggaacaacacacaguggagcuugucgagauaguuacggggagggagagcaucaggaagaauaguuaauggauacugggcuuaauaccuaggugauuggaugaucugugcagcaaaccaucauggcacauguuuauauaauagacuugcacauccugcacauauacuccagaacauaaaauaaaaguugaagaaaaaaaauuguuuuccagcauacuaguaauuaccaguuaagggcauaauugaagcaagguguuauucuacuaaagcagaaaaaaaaauuaaguuaccuagcaauauuccuaauaagaaauauguggaauguguccuuuaugaggaaaauuagaaaaaucuuuugagagauaauaacagauuuagaaaaauuaugacauacucuuuccauguagaaauauugaauauuauagaaauuaaaauucuuccaaauuauuguauaauguuaaauuguugcaaaccaaacuuauuaguuuucugcggaucuugucaaaauuauuuuaaaguucauauggaagaugucuaaaaaugaacauaaaugguuugauggccacucuauaacaaagauucauaauacacaaucugcuagcaacuagaggagaauaauuacaccagccuguaacuuuuaauauagugauauuauaugugacaaacuucugaaguuaaccaacuauacuauaaaugucucauuaguagaaaagugagcauguaauuuaauuuuacugugaggaaucucagauacaacagagguuguaauuuacccagaguuucagagcauacaugucagagauagcaucaacauuauauugagauugcaaguaaguuuuaacaggugguauagaaaauaauaauuuuuuuucauuuaaucuguguuacggucuagaauaacugcuuuguuuuacuuuguccaagacuuuuacugguuuuagccuggaaaguuccaugucucaggaaacuugucagucauggacuaaccaggaugguuggucaccuuguguagucuauaaaaaagacacuaaugucuguaaauaauguuuuccauaaaaugaaaagaaauggauggcagaugucuaaucuuguguagaauagcccaucuaguguucuaucuaggccauaaguuacucuaggcacacaagguucccucaggagucuucaucuguucaggaauguuaagguuuggauucacucacuacuguauaauaggggaggggcaaaggaagauggccaaauaaaaggcuccacugauuguuuccccuugaggagcaccaaauuucacaacuauacgcauaaaaaaauacccucaaagaaaccaaaaaucaggugagcacucauaguaccugauuuuaccuuccuauugcugaaagaagcacuagagaggguaagaaaaacagucuuaaaucaccuuugccacccccucccccauccccugguaguggcccuguggcacagagagagaaucugugcucucucuugagggagaacuuaggaauuuugggacuuugccuugaauccagugcugcccugucacaguggaaagcaaaaccagcuugaacuuaggugaugccuacccauggaggggccauuuagacagcccuagacagaggggaaaucugucccagccgucagaacuuagcugcaacaagccucaccacugcaagcuaaagugcucuggggccuugaauaaauuugaaaagcagucuaggccgcaaggacugcaacuccuaggcaagucuuaaugcugaacugggcccagagccaauggacuugaggggcacaugaccuacugagacaccagccaggguggcuaagggagugcuugugccaccucuccccuuacccuaggcaggacgguuugugacuccaaaacagaucccuucuuucugcuugggaagagaagaaggaaaauuaaagaggacuuugucuugcaucuuggauaccagcucagccaugguaggaaagggcacuggugagaguugugaggcccccauucuagccuagcuccuggaccacauuucuagauacaccuggggccagaagggaacccacugccuucaagggaaggacucagucuuagcaggccucaucaccugcagacuaacaagcccucggacccugaauaaccagcagugauaccuggguaguaugccaugggccaugggugagacucugagauaugcuggcuucaagugaaagccagcuuauuccuagcugugguggcuauggugaaagacuccuucugcuugggaaaaguaaaggggacuuugucuugcaccuuagguaccagcuuggccacagugggauagggcaccaugcagacucuuggggacucugauucuaggccuuggcucuuggucagcauuucuagacccgcccugggccagaggggagcccacugccgugaaggauaaguuccaggccuggcagcauucgccacaagcugacaagagccuuugggccuuaagugaacaucaaugguaaccuggcaguacucccuguggcccugugguggugguggccaugggauggggcuccucugccuauggaaaggggagagaagaguaggaaagacugugucucaugguuugagugccagcucagcugcaauauaguagaacaacagguagauuucugaagcuuuugacugcagucccuggcuccuggacaacaucucuggacccaccuagggccugggggaacucacugccuugaaaggaacaacacagcuuggcuggcuuuaccaccugcugauuauacaguccuagguccuugaacaaacacaggcaguagccagguagcaguuacagugggcuuugggcaagacccagugcugugcuggcuuuggguuugacccagugccgucccaguggugguggccacaggggugcuuguuucaccccagcuccagguagcuuaucacagagacagagagagacuuuguuuauuugggagaaaguaagagaagaaaacaaaagucucugaccgguaauccagagaaugcuucuggaucuuaucgaagaccaccaaggcaguaccucuacaaaucugcaggaacuacagcauuauugaauugggguguccacuaaugcagauacagcuugcauugugaugcagaucacaacacccaacuucuuuugaauaccuggaaaacuuuccuaagaaggacagguacaaacaagcccagacugaagacuacaauaaauaccugacucuucaaugcucagacacugacaaacauccacaagcaucaagaccauccaggaaaacgugaccccaccaaaugaaguaaauaaggcaccagggaccaacccuagaggugugugaccuuucagacagagacuucgaaauagccauuuugaggaaacucaaagaaauucaagguaacacagaaaaggaagucagaauucuaucagauauguuuaagagauugaaauaauuaagaagacucuagcaaaaguucuggaguucagaaaugcaaucgaaauacugaagaauauaucagaauauauuaauagcagaauugaucaagcagaagaaagauuaguaagcuugaagacaggcugaaaauacacaaaggagacaaaaggaaaacgaauuaagcaugccuauaagaucuagaaaauagucucaauugggcauaucuaaguuacuggccuuaaagaggagacagagaaagagauagggguagaaaguuuauucaaagagauaguaacagagaauucccaaaaugaaagauaucgcuauccaaacacaagaaguuuacaaaacacuaaacagauuuaacccagaaaagacuaccucaagacauuuuaauaauaauacugccaaaggucaaggauaaagaaaggauacuaauagcagcaagaaaaaagaacauacaauggagcuccaguauaucuggcagcagacuuuucaguggaaaccuuacagauugagagagaaugaguggcaugacauauuuaaagugcuaaaggaaaaaaacuuugcccuagaguaguauaucuggugaaaauauccuucaaacaugaagaaguaguaaagacuuucccagacaaaugaaagcugaggaauuucagcuuguagaccuguccuauaagaaaugcuaaagggaauacuucagucagaaagaaaacgacauuaaugaacaauaagaaauuauaugaagauacaaaacucacugguaauaguaaguacacagacauggaauauuauaacacuaacugugguguguaaacugcucuuaaguagaagacuaaaugauaaaccaauaaaaaauaauaacuagaacuuuucaagauguagacaguauaagauauaaauagaaacaacaaaaaguuaaaaacagaggaugaaguuaaagcauacagucuguuaguuuucuuuuugcuuguuuaucuaugcaaacaguguuguuaccagcuuaaaaaugaguauaagguaguauuugcaagccucaugauaaacucaaauccaaaaauauacaaugcauacacaaaaaguagaaaguaagaaauuguaucauaccaccagagaaaaucaccuuuacuaaaaggaagacaggaaggaaggaaagaaggaaaagaagaccacaaaacuaccaguaaacagauaacaaaaugguuggaggaagucugaacuuaccgauaauaacaucaaauguaaauggacuaaacucuucaauaaaagacauagaguggcugaauggaugaaaaaacaagacccaguggccugucgccuauaggaaacacacuucaucuauaaagauacacagagacugaaaagaaagggauggaaaaagauauuccaugucaauggaaaccaaaaaagagcaggaguagcuauacuuacauaagacaaaauagauuucaagacaaaaacuauaagaagagacaaagaaugucacuauaugguaauaaaggggucaauuuagccaaaagauauaacaacuguaaauauauaugcacccaacacuagagcacccagaaauaucaagcaaauauuguuagagcuaaagagagagauagaucccaauacaauaauagcuggagacuucagcaucccacuuucagcauuguacagaucuuccagacagaaaaucaacauaggaccuaaucugcacuauagacuaaauagaccuaauaaauauuuacaggacacuucauccaacagcugcagaauacauauucuucuccucagcauguggauuauucucaaggauagaccacauguuaggucacacaaaucugaaaguauucaaaaaaaaaaaaaaaaaaaaggaaagcauugaagugauaucaggcaucucuggccacaacagacuaaaauuagaaaucaguaacaaggaauuuuggaaacuauacaaacacauggaaauuaaauaauauacuccugaaagacggugagucaaugaagagauuaagaaggaaauugaaaaaauuucuggaaacaaaugauuacagaaacaacauaccaaaaccuaugggauacaauaaaagcuguacuaagagggaaauuuauagcuauaaguaccuacaugagaaacaagaaaaacacccuagcaauguauuuuaaagaauuagaaaagcaagaauaaaccaaacccaaauuaguagaagaaaaagcaauaaugaaagaucagggcagauacaaguuaaacugaaaauaaaacaacaaagaucaacaaaagaaaaaguugauuuuuugaaaaguuaaacaaaauugacaaaccuuuagccagacuaaggaaaaaaaaagaagacccaaauaaagaaaaucagauaugaaaaaggagacauugcaacugacacugcagaaauucaagggaucauuaguggcuauuaugagcaacuauaugccaguaaauuggaaaaucuagaauaaguggauaaacuccuagacauguucagccuaccaagaucaaaccaugaagaaauccaaaaccugaacagaccaauaacaaauaaugagaucaaaauuauaauaaaaagucucccagcaaagaaaagcccaggacucaauggcuuaacugcugaauuuuaccaaacauuuaaucaaagaagaacaaguaccaauuguacucuaacuauucagaaaauagaggagagaguacuuccaaacgaauucuacaaagccaauauuacacugauaccaaaacaaaugacacaucaaaaaaagaaaacuacaggccaauaucacugaugaauauugaugcaaaaaauucucaaaauacuagcaaacugaauucaauaacacauuaacaaggucauucaucauggccaagugggauuuaucccagggaugcaaggauaguucaacauacauaaaucaauacaugcgauacaucauaucaacagaaugaaggacaauaccauaugaacauuucaauuaaugcugaaaaagcauuuaauaaaaauucaacaucccuuggccgggcacgguggcucacgccuguaaucccagcacuuugggaggccgaggcgggcagaucacgaggucaggagaucgagaccaaggugaaaccccgucucuacuaaaaauacaaaaaguuagccgggcguaguggcgggugccuguagucccagcuacucgggaggcugaggcaggagaauggcgugaacccgggaggcggagcuugcagugagccgagaucgcgccacugcacuccagccugggugacagagcgagacuccgucucaaaaaaaaaaaaaaaaaaaaaucaacaucccuucaugauaaaaccccucaaaaaauauauauagaaggaacaugugucagcauaauaaaagccauauacuacagacccauagcuagcaucuuacugaauggagaaaauuuggaagucuuuuaacaucaggaacaugacaaggaugcccacuuuuaccacucuucuuuaacauaguauuggaaguucuggcuagagcaaucagaaaagagaaagaaauaaagggcacucaaauugaagaagcagcagccaaauuauccuuguuugcagauaauaugaucuuauauuuggagauccuaaauacuccaccaaaaaacuauuugaacugauaaaacaaauucaguaaaguggcaaauacaaaauuaacaugaaaaaaucaguagcauuucuguaucccaacagugaacaaucugaaaaagaaaucaagaaagcaaucccauuuauaguagcuacaaauaaaauaaaauaccuaggaauuaaccaaagaaaugcaagaucuuuaugaugaaaacuauaaaacacugaugcaagaaauggaagagaacacaaauaaauggaaagguauuccacguucauggauucggagaguccauauuguuaaaaauguccauauuacccagaccaaacuacagauuuagugcaauuccuaucaaaauaccaaugacauacuucacaggaauagaaaaaaauauacuaaaauuuauauggaacuaaauaauagccauagcaauccuaagcuaaaagaacaaaacuggaggaaucacauuaccugacuucagauuauauuacagaguuacaauaaccaaaacagcaugacauaaaaacagacacauggaccaacggaacagaauagagaacccagaaacaaauccacacaccuacagugaacucauuuuuaucaaaggugccaagagcauacauuggggaaauaacagucucuucaauaaauagugcugggaaaacuggauauccaugugcagaagaaugaaacuagaccccucuuucucaccuuauauaaaaauuaaguccaaauggauugaagacuuaaaucuaagaccucaaacuauaaaacuacuaaaaaaaaaugggaaaaaucuccaggacaauuagagggggcaaagauuuguugaguaacaccagacgagcaugggcaaccaaggcaaaaauggacagugggaucacaucaaguuuaaaagcuucugcacagcaaaagaaacaaucaguaaagugaaaagacaacccacagaaugggagaaaauauuugcaaacuacccaucugacaaaggaugaauaacuggaauauauaaguagcucauacaacucaaaggaaaauaauaauuugauuaacaaaugggcaaaagauccaaauagccauuucuuaaaagaaggcauacaaauggcaaguagguguauaaaagauacugaacaucauugaucaucagagaaaugcaaauuaaaacuacaaugagauguuaccucacucuaguuaaaauggcuuuuauccaaaagacaggcaguaacaaauguggagaaaagggaacccuuuuacacuguuggugggaauguaaauuaguacagccacuauagagaauaguuugaggguccucaaaaaacuaaaaauagaacuacuauacaauacagcaguccuacugcuggguauauacccaaaagaaaggaaauucguauauagaagagauaucugcacucccauguuuguuguaucccugcucacaauagccaagauuuguaagcagccuaaguguucaucagcagaugaauggauaaagaaaaugugguacauauacacaaugggguaguauucagccauaaaaaaauaaugagauucagucauuugcaacaacauggauggaacuggacaccauuauauuaagugaaauaagccaagcacagaaagauaaacuuuguacauucucacuuauuugugggaucugaaaauccaaacaguugaaaucauggagacagagaguagaaggaugguuaccagaggccagaaaggguaauaagccaaugguggggggguggggaauagggaugguuaauggguacaaaaaauagaaagaaugaguaagaccuagcauuugauagcacaacaggcugacuacagucaaaaauaauuuaaacguacauuaaaaaauaacuaaaauacuauaauuggacuuuuugcaacacaaaggauaaaugcuugaugggauggauaccccauuuacccuggugugauuauuacacauugcaugcuuguaucaaaauacguacccauaaauauauauaccuacuguguacccaugaaaauuuuuuuaaauguauaguaggcuucaguaagacucucaguaaucaucugcaaacuuaguagggggauuuaggccaucuggcuuagucuucuaucuaacagcuaaucuuugagcucaugauauuguuguauguugacuuuuagcauaauuaucccuauaagcugcacuucucagcaaaagucauuuuuaagggauuuacuuucaguuuuuuuaguugucuuucuaauguaucagucgguggaauuauuuuuucaaauauuaauuuacucaccuuuuuccuugaucuauaaaggauuuaagaugauguacuuaguauauuauagacgaauguuaauggacuaucugaugcuuguguggguguguguuuuguauuuauauagccauuagguugacaaguguguucugugucauuaugggauuguccucuuugcaaaaugagaaagaguuuucuuuuuucaguuauauucaacagauuacaagugcuacgaaaauuucuaaccaucaaguaaaauaauuuaaaaauugacaagaaaugcaaaccgcuuuuacaccauuuuaagucuuacuuauuauaaagaucuccaaaguaauauauuacaguaaaacucagguuccucuuauaauccuguaacauccuuaaguaugcauugggaagaugacugguuuaccaagcuugauucaaacgucauggguuacaacauuuaaauuugcugacagucucauaagguaagguggugagaagauaucgggggaaccagcccccaguauuuuaauguagguucuuuucuauuuucccaaagugucggcuggucuaagaaauaaagguaaagaguacaaaagagacaaauuuuaaagcugggugucugggggagacaucacaugucggcagguuccgugaugcucccugagcugcaaaaccagcaaguuuuuauuagcaauuuucaaaggggaggguguuuacgaauagggugugggucacagagaucacaugcuucacaaggcaauaaaacaucacaaggcaaaugggggcagagcgagaucacaggaccagggcgaaauuagaauugcugauaaaauuucaugucccgcugugcaugcauugucauugauaaacauuuuaacaggaaacaggguucaagagcagggaaccggucugacuaaaauuuacuaggcaggaauuuccuaauccuaguaagccugggggcaccgcaggagaccagggcguauuucaucccuuaucuacaacugcauaagacagacacucccagagcggccauguuagagaccucccccugggaaugcauucucuuucccagggcuguuccuugcugagaaaaagaauucagcgauauuucuccuauucgcuuuugcaagaagagaaauaugacucuguucugcccggccccacaggcagucaggccuuaugguuaucucccuuguucccugaaaauugcaguuauccuguucuuuuuggaugcccagauuucauauuguucauacacacauguuuuacaaacaauuugugcaguuaacacaaucaucacaggguccugaggugacauacauccucaguuuacaaagaugaugggauuaagagauuaaagacaggcauaggaaaccacaagaguauugauuggggaagugauaaauguccacgaaaucuucacaauuuacguucagagauugcaguaaagacaggcauaagaaauuauaaaaguauuaauuuggggaacuaauaaaugcccaugaaaucuucacaauuuauguucuucugccauggcuucagccagucccuccauucaaggucccugacuuccugcaacaaaaagaaaguacaaaauuaugauguuauuuauaacacaacucuuagcuuaaacuuguacugacauuuuccuaaagauuauaaaguauauucauaauagauuauuuugcugucagccucuugagauauguuuguuuuuaugcuaaguaaaauguaaccucuugccacaacuaagaucuuuucucuuuauugauuuuuagugucuaaaaagcacggcaagcucauuacguucuuacgaacauucaugaagucucguccaacaaaacagaagcugaagcagcggggaaucuugaaagagaggguguuugguugugaccugggggaacaccuucuaaauucugguuuugaagguaaaaauaaaaugugcaagcuuauacucugaguuucugaccucuccauauugguuugcuauaaccaauuauggaguagauuuagucaaaugauaccuguuucauuucaguucaaugcauguacuaagcuuucucagguacucaguucuggauggagcugagaaugaaaagucuaagaaugcacuuuggcauuagagauguucguguucuauucgggaagaguaggacauucacacaaaauauauuacaaccacccuguuauuuugccugaguuucuauuucucccuagauagcuucuucagccaguuuugccacccacauuuuauccuaaaauauuuaucuaauucuucuuauggaaaaaaaacugucagaguuuugagacauaaaaugccaaaaucaaucuuccaauuuuuuuuguuuuuaaagagacagggccuugauuuguugcccacgcuggagugcaguggcgugaucauagccgacugcagccuugaauuccugggcucaggcaguccucccagaguacugggacuacaggcaugugccaccacaccuggcuaauuuuuauuuuucauuuuacuuuuguagagaaucuguauuuuauuuuuuauaggaaucuauauuccuuucuuuauaaauuaaauuaugaaucaagaauuuaguuguuggauggggggauggauaggagggaaagaaaaaaaggaguuuuccuuuuauauuuaaaaauagcacuuuccucuagcaucucuuucagaaaugccagaagaugaaggcaggaucuaccugugauguugcuaaguaccagaaauaggugauuaugaaauuccaaauuaguaugggaaauacccauugugccuuuugagaagaccauuagugaaaaacaaugguaaaguaauaauaauaauacugaguugauaguaucaaguucaaauuaaggucuugcucauuguuuaaagaauaucaguggacuuaggaauuuaaugcaaacuguaccauguuucuugagagaguagacaaaauguuauuucaaacagauguuauucccaaauuaauaccaacuuaaugcagaucccuaaaaaaacaaaaacaaaaaaaaccccugaggauuacuuuugcaacuaaaugcacauggaaaacucaaccagugagaaugucaaagaaaaaaaucaguaauaggaugggagacaucuaguuuuacuauauauuaaaacaauauucaaaacuagaaaagcagaguuuucacugggugcaguagcucacgucugcaaucccagcacuuugggagucugaggcaggcagauagcuugcgccuaggaguucgagaucagccuacacaacauggcaagaccuggucucuacgaaaaauacagaaauuagccagcauaguaguacgcaccuguaaucccaguuacuugagaggccaaggugggagaaucaucugagcuugggaggugggggucgguaagcugauuucacgccacugcacuccagccugggcgacggagcaagaccuugucuccaaaaaaaaaaaauuuucuuuuuaaaggcagaguuuugugcugagaaugaaaugugagugaaacagcuuacaguguucagaaauaguucuuacuguacauaagaauccauugugagaaaaaaguaugguuuuagaaccaugucacauggaagagcuauuuauaauacauacugagauaauuaaauagcaguuuugaaaaaaauucacacuucaucauacugaauauaaacuucaaauguauaaguuaaccauuuuaaacuuacaaaauugccaaugugaauugauuuuguuuugagauaaaauaaauaauagcuuucucagauuuaaacaaaaaacaugaagagaugacuuaaauauauauauacuuuucauauaaugaaaaauaacaguguagagggagagguaccauagacaaggaaauauaaucauuuuuuggauaugaugaaaugcugcuauuacaguguaugagaauaucauuucagacuuuuuagaaaauuaaaguaauuuuaauuacugaguaaaagaauggagaauagauacaaacauuaaacugucacagggcuauaaauaauaaacaaaauacagaaaaauguuuauccuuauuuguaaucauggaaauguaucuuuaggcgauuuugaaauaccauuuuacuuugguaaauauuaaaauaacaaagcuauuuuucuaaauuaugauauccagugccauaaauauaguagugauuuuuaccaauagguucagaaucguugguuucagaagguucugaguuagcacuaccuuuuuggaaaacauuugacauuucauagcaagacacuuuauaguguuccuuucaucuaaugaauccauccuuagggacuuaucuuaauguuauaauuaaauagaaauaaaaguguucaucauagcauaauguaugagaacaaagaaaacgaaauacccaacuuugggagaauguucuuuuuugagaugggguuucacucugucauccaggcuggagugcaguggcccaaucgcagcucacugcaaccucugccuccugggcucaagcuguccuccugccucagcuuccugaauagcugggacuauaggcaugcaccaccacacccagcuaauuuuuguauuuuuuguagaggugggauuuugccauguuggccaggcugaucucgaacuccuggacucaagcaauccacccaccuuggccucccaaagugcugggauuacaggcgugagccaccacacccauacaggggaauguucuauaaauguugaagcuguuaaaaauuuuaaguuugagcugugugagauggcuuaugcuuguaauccuaguauuuugggaggccaagguaggaggaucgcuggaggccaggaguuuacaccagccugggcagcauauagcaaaaccccauuuauacagaaaaaaauacaaaacgagcugggcaugguggcacacacccauacuucuagcuaguuuggaggcugaggucgggggauugcuggaccccaggaguuggagacuacaguaagcuaucaucuugccacugcauuccagccugggcaacaaggcaaaacccugucucuaaauaaauaaauaaaauaaguuugaauacaguguaggaaccugaaaaauauuaucuauaaaugguagauacaacuuuugaaagucuggauacuuaggugauaugagaaaugaauauaauuaaaguauuagagaauauuguugagauuuuuuuuucuuaguugucuugcuuuuucaauuaaaaaaauuagaggaauauuagaaaugaauuuaauaauccuggaagauuaaucccucuuugccaaguuaaacucaaaugacuagaaaaaaaauuaacuugugaccuuaaaguguaauugaaauucaguaaacuuuaggagcuagaaaccucaaagaccaaggccagauauauuauacuuggcauauuaaaauaauuuccuguuucaucaggguugguaagaaaugaauaaauauucauaagaaggauauucauuugaacauucaaaugaagccuaaauuagcaggagaagggaaaccuuugaaguuuauuaacuaaaaauuaggaaauaaaaugguuuuuuaauagcugagugauuuaguaguuugucuuugauuuaaugaauaugugaggaauuucaguuuuuucagauuuuaagacuucauagggggcugggugugguggcucaugccuguaaucuuagcucuuugggaagccuagaagggaagagcaccugagccuagggguuugagaccagccugggcaacauggcacguuuaacaccauguaacauguuaaaccuugcuuagaugugaucauuaauaugaaagagaggcccagcaggguggcucaugccuguaaucccagcacuuugggaggccgagacagguggaucaccugaggucaggaguucaagaccagccugcccaauauggugaaacccugucucuacuaaaaauacaaaaaguggccgggugugguggugcaugccuguaauccuagcuacucaggaggcugaggcaggagaauugcuugaaccugggagcuggagguugcagugagccaagaucaugcuauugcacuccagucugggcaacaagagcgagacuccaucucaaaaaaaaaagaaaaaaaaaugaaagagaguuuuccaauuuguccugccaugcucauuagcuuucaaauaucaauucaauuuuaguuguacuuagaaguuucaguuauguuuccauucuucauaaggaugauaggggaggacagaggcuauuauaucacuucuuucugaaaaauagcagguuaaacuacaguguucaucuguucccuaauuaugauaaaaucuauuugaguggaacagaguuuuuugguaucauugauuuuuugucauugauuuuuuuguagggacagugucucuacaaaaaauuuuaaaaaauuagcugggcaugguggcacgugcaugugguuccagcuccuugagagguugaggugggaggaucucaugagcccaggagguccaggauacagugagccaugaucacaccauagcacuccagccuaggcaacagaaugagacccuaucuccaaaaaaaaaaaagacuucauauguauuguccaugaccuauaaccacaguuauaucauauguguguauauauuuacacauacaaauauauauagagacuauuuuaaagucuaaauuaaaacaaugagaauugauuauauauuuuaaacucuaaaauaauuagaauaaaaugaagaaaaaaugauuauauauuauauacauaauugugaggagagaugagacacauacaguauauauaauauugauauauaucauauauaauuguucuuucucaaaguuuagacuuuaauauagugucuuuacccuaaauaaaauuaaccuugcacuagauuuuucugagaaggaagcucguaucaaaauuacguuuuaugugcuugcuucgacagcacauauacuaaaauuugaacaauacagagauaagugugaccccugcacaaaaaugacacacaaauucgugaagcauuccauauaaaauaaaaauuuuuuuuaaauuuuguuuugcuaaaugguuaauucucugaauauuuccuagugaaaaaucagcuuuauagggagauuaucuuauuauacuuucuaaacuucugaguaccucucuguuggagcaagugacaaacuugaccugugucuucuguacaaaguguuguaagaaaucacauaggagccugacaaggcaguugucuuuuuauucuuuuauguguggucccugcuguucaaucaggauuaucauagaguuuuagcuaucacaaaccgguguuuauaauugaguguauuaaacauuauaucacaguuauuuguagaacugauuguuuaaaaaucugcccacaaaagaaguaaauaaaaaucugcccacauaguacuuuuuuugagcauagauuauacugauuugucauuuacuuuggcauccuuuuguuuuguuuuguuuugauacggaguuuugcucuuguugcccaggcuggaguguaauggcacaaucucggcucacugcaaccuccaccucccagguucaagcaauucuccugccucagccuccugaguagcugggauuacaggcgcccaccaccaugccuggcuaauuuuuuuuuuuccuguauuuuuugguagagacaggguuucaccauauuggccaggcuggucuugaacuccugaccucaggugaucuaccugucucagccucccaaagugcugggauugcaggcaugagccacugcccgcagccuacuuuggcauccuuaucuauagcuuuaaaauguuguguuguuguuggugguggugguggugguggugaugugacguuaauuucuuuuucugguaucauugauuuuuuucauaagaguuaguauuuuuuuuugguguacauauuuaaaacugaauuucauuaaaaguuugaauugagaucacuaaaacaaaauagugagaguuuuauagaaaacuagguaaaauuauguuugguacaaaauauuacaaauauuuugaaacccucggagaggacucucuguugccugaacauauuucuguguuguaugauaugcacaaaacuuuaaaugagagcacaguaggaaaaagcaaggcccagauaacaccagaaauuaauccuuuugguagucauauuagguagaaucaugaugcacauucuaauaagucacacuguacucaugucccuuuagccuggaaaccaucucccugaaacuggaacucagcuuuuucgucuguaucuguaaugcuuucaugaugccuggaaaauagaagagacuuaauaaauacaugauugaugagugagugagcgagugaaugaaugaagagaaaagagcagaaacgaaaccaaaacugucaagaaaaaaaaaucaaagaucaauucuugucauacuuacuuccuacuucuuuuagccauauucuaaucuaaaggaucaucgauuuuaauuuaaauauguacuucuuauucuguugucguaugaugauauuuuaaaaacuaagaauguaaaaucaaaguaaaucagaaguguauuauguggagaaugugggaaugauucugaaagucauaccgucuuuuggaggaagcauuuuggagguuucuaauguuauauuuugacugggucauuauucgcugugcauuuggcugguuuguuagaugguuuggggguagcuaguaaauagccuuuuuuuaaaacuaggauuuuuuuuacaaaauauauuggauuucuuauauugcuuuccuacucuuucgugaaaaaauaaaacagaucuuuucuucuuuuuucuucugacauuguuuuucaguuuuugcuccuuuucuucaagauucaaguuuaugcuuuucuuucauuuugccaccuauuuguauuaaaugacucauuuguuucccuuaaacuuauaaguaauaguuauguaauuuuauuuauuaagcucauuaugugauuuuuguguagacauucaguccuucuacucagggaacacaaaauauaagaaaacgauucagaugcuugccaugaaguauuacguguguagagacuuggacauauuaucaggaaaagaccucuaauucuccauauuuucaauguuuuccuacuuauuuggaagaauaaacagauaugaaucuaauaacacacagauauacacauccaaugaaaauuaccgauacuuuuuuuuauaaaugguagcuuauuuuuaugaaaaauuuaugugugcucggagagccugauaauauggaaauaaaauacugugcucugaaggguuuuucuugaagacaaaccuuuuguguaccugggugaaucagcaugcucauuuggagcauauauaaugagaagcaucuucucagugcuuuacaggaaagaauuuuaacuauuuuccuaaguaaugauguuaauuaucccaguaaucucuaaauacauucccuuugaagcagaagacugaaauuuuguagccccaaauuuuauuauuccacuuccaguuuuuagaauugaaaccuaagacaccaaguuuaucauuggugggacaaugugagaaauagaacccaagcuuuuauaaagaugcuauguauuuugcauaucauuucgacacagagguugcuucuaauaucaauuaaauccacaagaaguacccagcaauucuaccugcccuucaucuuuacuacauaaccauaaccuuuucuuguuacugaaagucuugaauauuuuuagagguagaaagcauguaguugaaaauguauucauaugaaaacuaagguuccuucccugcuaacuugaccagauaaugaccauuucaggcucucagggcacugguaaauuaauucacuugcuaauuuuauacauugugucaggacgguguuccugaguuuuaaauauacaaagauggacgaugcaugguuuugcucuugaagagcccacagucagaaaaggguaauaguuguaugaacaaauaaaugauaauuuugaaauauuuuucuaugagcacauagaacacagugcucagccaccucuacuuguggguauucaaugaaggcucgcuaaagagugauaguuuaccuggauuuugaacaauagccaagaauuuuuucuauacgaagagcguuaugggagagaguccagcuagaggaaauuguuuugugaagaagucauagcaugguugguuuguauggcaaaagguaacacuucacuuggccuaggguuguggaauauggaaauacaauaauaauuaaauguaaauuaugaaaggccuucucugccaggcaguauauugcaguagucaaaagcauuggcucugacuggauaaagaaaaauguggcacauauauaccauggaauacuaugcagccauaaaaaaggaugaguucauguccuuugcagggacauggaugaaguuggaagccaucauucucagcaaacuaucacaagaacagaaaaccaaacaccacauguucucacucauaagugggaguugaacaaugagaacacauggaauagggaggggaacaucacacaccagggccucucgggggguuggggggcuaggggagggauaacauuaggagaaauacucaauguagaugauggguugaugggugcagcaaaccaccauggcauguguauacuuacguaacaaaacugcacauucugcacauguaccccagaacuuaaaguauaauaaaaaaagauauauguaugugugugugugugugugugugugugugugugugugugugaaauaaaaaacaaaacaaaagcauuggcucuguacuuggacugccugaguuggaaucucucacuucugccaguguuuccugccugcccuuggguaaaacuuacucucucuaagauacaauuucuucucuguaaaaauugggaauauauaguacuuuccuuguaggauaucucugaaaaucagagaguaugcauuguaaaguacuuagccuggcauauauuuaguacuuaauacuaucagcugcugguuuuuguuuuuugauuuuuuuaaucaaagaugagguuaaguuuuaaauguuguuauaggaucugacagaauuuaaagauggauugcaugaaggacaauaaaagucaggaaaaccaaggaaaaguugguuauaauaauaaaggaaugacaauauacuguuaaugaaauacauucacuaaaauuaucuuauuaaaaugccuuauuuguuucauuugccacucugaauguuucaucucuaguauaguagcucuuugcagaccaaauuuuccaagcauuucuuuucaaggauuuuaauuaacccuaucaaaugaucauacuaaagucuguaaacucaucaaucugcauugcaaaacaacuauuguuaaauucucagcugcuguaaauguuugaaugguuauaaaaugcuuuaucauauauuuugaaaauucuguuuuauacugcaugccccagcauagcuguccaguguauauucauagagcuaaccagagagagugcccuguauuacaagcugauaauauaaagucaaaaugucaauaaaguuaauguaaauauggccaggaaauuacaagauuccaucuguuugaaauugccuugggcuuugcauuauauugguguuuuguugauugaauaaagucagaauuugcauuaacuaugaaaauauagaagauccuuuucuagaagcaaaacuuuguagcacuuacaaguaauuauguuguugggacaagcauuuaacuuuauauauucauuugcuauauaugaaagucagcugaacagcuguauuucuuaaaaaucuggcaugguguuaggacuaaacaguucacuuugcuguaauguguaacuguaacaugaucuaaaugagucuacugcagaagaaagacuguccuaauaauguaugaacucucuuacucacuuaaauaucaugacauagaaccagucuugauuauucaggaauuaguuaucuaauuuaggugggcaauuaaauaaauauacccucaucauuuuuuguaguggauuaauuuuugcuccuuuuaacuuuaauuuacaaauuuuauuuuacuuuuguaaacuaagacaaucuuauuuuuuggcaacuuugguuccagugaauacuacaauuucaucuguuucuuuacaaauucucuuuagugccgcagguucuucaaagcugcacagcauucauugagagauauggcaucguggauggaaucuaucgccuuucugguguugccuccaauauccagagacuacgguaaaaucuuauauggcacuuuuucacuccuucuuaacuaauuaaaaugcaaauauuuuaaaacagauucacuuacuuugauaaccuauuuucauuaaagauaauuuagauaaaauaggaaauaauauacauguuauugucucuguauacuuuucuaaauggcauuuuuuucaucuguaguaucagagaaccaugcaccuuaaucucuucaguacuuguauuuugccucuuuauaguguuugaagauuuuaacaaauugaguuugaaccgaugacagccaugagagaggaaauuugcauuauaauaaaauuauucuuuagguguuaauuaaaauggaugggaauggaacauuuucuaaucuccuuugacccugauucuguguuuauguucaaguaugcaucucuacauauuucacauccuccccaaaucuucucugagacaaaaacagugacaaacucugugccugcaauauuuuauuuuugcuuaaucucuuggauucuagacuauucuugacaugccauuacccuuucuuuuuuacuguaguacaugauaacugccauuauucuguagagauuuuaauacuuuaacagaucauagagcccaucucaguuuugggaaauacaugcuugaaaaauacauaaauuaguccuuguacuaaagacaguuucagucuucaguuuaagacaaaguaaaucucauauuguacacacacauuaauccucuagguagaugauaaguggucucaugcccguggaugaauauuaauuaaccuccuggagagugagcuuacucugccuuacuauucugcguacaacuuuuauuuuacucauucuaaugauacagauuuuccugccuauuaaaauuuguuguuagcuaggaauugcuuuauguuguuucugacuuuuuuauccugcuucgggaaagcauuucuguguuguacaaucuguaucugaggaauuucugcucauaauuguucauagaucaauugccauucaacacuagucucuggaauugccaaaauauuggauauucaagucauuagcaauuaggaguccuguuuucagacuguuguacuauaagagcuguucauucauauguaucucagaggcuauuguccauuuuaauauuaaagcugugcccuuaauuuccacauagaaagacaucuaucuuguacuaagacauccaguuguugcugaaguccaaacacaacuuaaaugaaauauaauuaauggaagauaauagcaacucacugagauagagcugaacacuuuuggagcuuaugcuuucuguuuuuaagacacauauuugcucuccucaaucaaaugauuugcuuguccucuucugucuacgucagccaugaauuugacucugagcacguccccgaccugacgaaagaaccguauguucaggacauccauucuguggguucccuauguaagcuguacuuccgggaacucccaaacccucugcuuaccuaccagcuguaugagaaauuuucugugaguacaggcuacuuuugaaucuaauucuuuguggaacuuugcugugcuuuuguucaaaacacaugaacuuugguuuggucacauguaagaaauaguucugugacugaaaugacuccuuaaaaaaacaaauauugccagcuagucgguggucuuugcuguuuucacauugucauucuugugcuuucugacuuugagcugcuagucuugucacacuuaauacugaugaccaucaagccuuuuuaaaauuaguuucguagaucucaguguucacacuguguggaaacaguuuacuuccugaauacaauguuguguuuccucgccauuucacauccaagagcaaagcaaguugaucucagagugaaaacugaauuguaagugaacuuucauuuuuacuaacagagcucacuaguuuauuuuguacugugacucuucuaggaugcaguuucagcagcaacagaugaagaaaggcugauaaaaauccacgaugucauccagcagcuccccccaccacacuacaggucagccacaguggguaaauaccaggcagagguagaagucgguugaccuguaaacguuuuuuuuuccuuuggauuucuauuuaaacuuccuuggaguucuaauuaaacuuccauuucauauauauauauauauauauauauauacacacacacacacacacacacacacacgcacacacacacacacuauauguauguguaccuauauguauauguauauguuuauguauagauauucauuuguccuuagauccccagggccuggcacacuguuuagcauuccauagguacuuaaagguugaaugaaugaauggauggacaaagggauggcugacuaaacuuggggguuuuuuguuuguuuguuuuaguuucuucuuugguuuuauuguuguugcuacauuuuaaaaccuaauuugauuuguguguuaguuuggaguguuggaaauauuuaugguuaugucugagaaagccagaauaaaauugaaaguuacuuugccaguuagaaaaagacaacaguagaaacuagauuccaguaugcaaagaaacaaaagauacauuuuaaaauuccaauuacugacaagaaauuaaacucagcggauguucuaguaauaugcaaauuaaguaauuuaauuuuuuuuuucaaaaugacauugcuuauguauauauuucaaaaaucagcacuauaggccaggcgccauggcuuacaccuguaaucccagcacuuugggaggccgagguggguggaucaccugaggugaggaguuugagaccagccuggccaacauggcaaaaccccgucucuacuaaaacuacaaaauuagccgggcaugguagcacgcgccuauaaucccagcuacucgggggcugaggcaggagaaucacuugaacuugggagguggagguugcagugagccgagaucaugccacugcaccccagcuggacaacaaagcgagacuccauuuaaaaaaaaauucuaauugugguuucuguuuaauguuuaucaccuuugcaccaucauaaacgucaaaaaaucauaaauugaaccauuguaaguuggagacuaucuguauacaaucuuucuaaaacauaagguacuugaggucaugaauucugucuuguuuaucacuguauuuccagaauagagucuugcagauagauguucaauaauauacacugcauauauguuuuauaucuucugcacacuauuuuauagcuugacuauagauacuuauauguauauauauccuaauauuauccacuuugccugucuucuaauauauauuauauuacuuaccauguaugcccuaccuggauuucauaccuugccugcuauuaauauguacauguauaucuccugcuuuauaauguauacaauaucuuguguaacucuuuucuucacuauaacuuauauguguguguaucuccuacuuuguauaucuuuugauauagacuuuuuauccaaaauuuuaacauuaaccuuucugaauuccuuagauguucuugaaaagcguaauuuuccaucauguucucucauuuggauaugccauguuauuuaaccuuucauaauuugcauauuuaaucuacauauauggugguaugggguguuuucuauuuccuuuuuuuuuuugaggcagggucucacucuguuacccaggcuggagugcaguggcacaaucuuggcucccugcagccucugccucccaggcucaagugauucucccaccucagccccccaaguagcugagaccacuggcacacaccaccaugcccagcuaauuuuuuguauuuuugguagaguugggguuuugccauguugccuaggcuggucucaaacuccugagcucaggugauccacccaccucagcaucccaaagugcugggauuacaggugugagccacugugcccggccuuccuuuuccaauuuugaauauuacuaugagggccauccuuuuacaugguaucuagauuauguuuuuuauuacaggauaaugaccuggcagugaaauucuggaaaucuaaauuauuauucucaauauuagacaauaauauccaaauuacguuccagguugcgaaguuuuauacaauucacacucucaucugcugaauauaaaagugcucauuuuguggaauccugacuaaaauucuacauuaacuuuuaaagacauccuuauaaucagauaggcaaaccaaauagaugucuuugguuuuuuaaauuugcaauucucauaaaauacauuccugaaguccuuuaaucauucccuucauucaccuuccucaaguaauaaaauuuuacaugguuuucuuuuuuuuuuggcugaggagccuggcuuuauucuauuuuauuuauuuauuuuuuuauuauacuuuaaguuuuaggguacaugugcacaauaugcagguuuguuacauauguauacaugugccauguuggugugcugcacccauuaacucgucauuuacauuagguauaucuccuaaugcuaucccucccccuuccccccaccccacaacaggccccggugugugauguuccccuucuuguguccaugugaucucauuguucaauucccaccuaugagugagaacaugcgguguuugguuuuuuguccuugcgaucuaaauacguuucucaagcuucucaccucuaugucauacccaggccagccucacuucgguuugucuucucuuaauuauauacagcagagacagagaauuaccauuuuaacuguaaagcaacuacaaugcccuugaacgcgcaggcacuuuggagccacucugaccuugauuugaaaugcagcacugccacugcuagucuguggaaccccagcaaccuugacuuuguccucgguacaaggggaaugguaauucugugcuuguuagagcuauuaugagaauuaaaugagacugcugguaaaagccucuugaacaaugccuaaugccgagucuaacuaugauauuccuuuuccucucaaauucauguuaggcccaucugaaucuuuguggcucggauguagaccacauuuuaucuuucauuacuguuucauauaauacagccuuauauuucugucucccauucauuguccuuuuuuuuuuuuuuuuuuuuuuuuuuaaagacaaggucucacucugucacccaggcuggagugcaguggcaugaucacagcucacugcagccucaaccuuccugggcugaagcaauccuccugccucagccucccgaguagcuggcacuacaggcaugcaccaccacacccagcuaauuguuuuuacacuuuuuguagagaugggguuucacuguguugcccaggcuggucuugaacucucgaguucaagugaucugccugccucagccucccagacugcugagauuacaggcaauagccaucacacccagcccguugucuuuaguaguuuuacucugggcacuauuagguaggacgcuuugagacaugcuaggugauagauaauaccucugugugugcaugcgcacagacacacacacacacacacacacacacacacacacggcacuuaccugguuuaacuuacauuuaaggugaucaugucuuguuuucaaaaguacucuucccuauuguuuaaucacaauauauguggaauuguuuaaguaaagcaaauuuuaaguagucaagauaaaccagaauaugaggauuugaauuaggcucuuuauuucaaaagcauauccuuugcucaaauauucuccccuugaugccuauuggaauuuuucuuguaacuguuuuaaggcuuuugagacauuacuguuuucuuucauagaaguguugaaauccuuuccuguuaguaugucugcugcaaguagaauggcauaacuucaaaauauuauuuguuccagaaacuagcuuugguggaagauucacuucuaauaguaauauuucaaccuguuaagcaggaaaaaaaaguucucuuggguuuguauggucccuuucuucauuuugcuauugcaaacuuaggaauuaauuagcaggcuuuuauguucuauacugcugcaucauguuucuuucuguuaauauguuguauuuuauuuccagaacacuggaguuccugaugagacacuugucucuucuagcugacuauuguuccaucacaaauaugcaugcaaaaaaucuagcaauuguuugggcuccaaaccuguuaagguaauuugcauuucacuuauuaauuuuaguagaacuaauccuaaauaaaaggcugauucaucaguguucuuuaaggaaacuuuuaaaagauuaaacaaaucuguucuuuuuauuugcaucucccuaaaacaggcaacugggccuuagcuaagggacaguaaaaguaugauuucuuccucuguuugucugagauuuacacguuuaaaaaaagaggcccuugacgacugcuaucuuuacaacucugugaugaaaauguuuaccucacagaucaaaacagauagaaucugccugcuucaguggaacagcagcuuucauggaagugaggauucagucugugguuguugaguucauccugaaucacguugaugugcuguucagcggcagaaucagcauggccaugcaagagggggcagguacggcuccgauggcccuuccuaccaggagggugugucucagcuuccagaggaguagcaaaccaugcauuucuuauugcaacaacaaaaacgugucacugguauaaggcagcuaauaauguauggcugcuuaccaaaaugcacaauuugacaguuauuuuguguguauauagugaauacuacauaugagaccuauugugaucuaaguucaugacacauuaaaaaacuugucguucauuauugauguguauuaaaguauaaaguggaacagaagaagaaaaauugcuuccaaaacuaaaaauaucugagugauugaucaccuuuccucauaucuuuuaagaaaggaaaacaguuauuaaagaguuuuauauguguguaugugugccacugguguauccccuucaguuuuuuauuuaauauaaagcuuuucucauaucuuuuaagaaaggaaaacaguuauuaaaggguuuuauauguauguaugugugccacugguauguccccuucaguuuuucauuuaauauaaagcacuaugguuuuugcuauuuaacauacuugaagaaaauuugaaacaacagauagguagauagauggagagauagauacuaacaaauugaauacacucacguaguugacucucuucaucagcuuccuuuucuuuuugaagcuucucuaucaaggcccaagucccuccugguauccucuccauccaccaaacugcugacauuggaagaggcccaggcacgaacacaagcucaggucaauucuccaauugugacggaaaauaaauauaucgaaguaggagaaggaccugcugcacuucaggggaaauuucauaccauaauugaguucccacuugaaagguaaaauuuguuaaauccuauuuugggauaugauuuucauagcuauguccuauuauuuucuuuuaguuugcuuuuaauuuuguauuuuaguauuacucuauugaauucuaggcuagucccagagaaaccuguuuauucgaauauggaugauacuuaccgcuucauggggaaugaugcaaaugauucuugcuuuacaaugucauguaauuuuauaaaagaagaacaucagugguauagggaaaauuguuuggaaaaauaaggauauacugucacuauauggguugauuuugcucucugaacuauguuguuuauaaaguuguuuagaaauaagcuguguuggaagaguuuguucagaaagucaggaauggacagugacuuguuugacauugguuucacauuaagguuagaagagauuaauaguguggucucccagccaacagcaucagcaucaccuggugauaauugcuagaagugcacauugugcagucguccagucacaccccagacccgcugaaucagaaacccugggcgugggacccagcaacuggucauucaucuaacuuuccaggugauucugaugucugcuaggacuugagaaccacugcagcaguucacucuuucaaugucccuuccagcucugaaauucuauuacucuaaagaaaugauaauaacaugguuucuguaucuucuuuacuagguuauaguaggaagacuaauguauguaaaaguuauuuuugaugucucugcuacuccuuuggcuauuacacaugaauguaaggauuuugauucucuggauuggguaguacuaauauaacuuuagaauuuguucuucccguauuuuaguauacuccucuaacuuccuuucacuuccugugacuaaaaacauucuaucagcaaaaaguuggaacauacucuuacuuugucauccugaguuugucuuuagcaucuugauuuuauauucuaguuccauaauuuacucaaagauuuauuuauggaguaguaguuaagagaguagauacugggauguagauuggccuggguuccaauucugacuccaucauuuaauaguuuuauaauguuaaagaaguuauuugaacuucuuagugucauaauuuccuuggcugcaaaaugagaauaauaguacuuaccucaugugguuguaucugauuuaaaggagauauuacauauaaggcagguagcacagugccuggcauucaguauauguuuguuauuauucuuaauccuugucuucuuuguuugccuuuauucucuacucacaccuaaaaucauuuucuuuaacucuguguuauuuuuggacacuuaauauuuccuauucccagauacgucuuauuuucacuuauuuuucaguuugugagguuggauccaaauaugaagauauauauaaaaaugaucuuugugaaaauauuuacuaguacuaaaaucugcauguuuacuauccauuuucugcuuuggcugcacuguguagagugugcugucuggaagguggauguuugcuuacuguuucacuuaugcuucuccagccuguuugguucuuucugucauguguucauuucuuuucuguaagaaaagacagacccauggcuaucuuaauguugauuauuuuuucucuuucauagaaagaggccucaaaauaagaugaaaaagucuccuguggguagcuggcguuccuuuuucaacuuggggaaaucaucaucuguuucuaaacgaaagcugcagcggaaugagagugagccuucagagaugaaagccauggcucugaaaggugagugccugggagauucucacuucugcugcugucaugauggucuucgguuguucugggcacguucuucacauauuguuaugaucugcuuccauaacguguucacaguugugucacacauacagagugucuucucucaccgauucuuuauuccuaaauugaagaguaacauaaauuauauauaaauauguagaaguaugcaauuucuuuucuuaaggaaacuauauagauuauauauaguguaaaugugauuaaauucacauauaccuuguauauuguuguaaauaaauacugcuaugguaucuaaauuuauugaucuguauuuuuacagaucuaaaaaauuucaaaacuguuucaacauaacuuucaaguuuauaacucuuuuaacuaaagaagguauuuuuuauuagaugucucauuaauagaguaucuuauuagaucaaauaaaucuauuacugucgaaaaaguacucuuuuaaaaauaguuuaaaagccauauucuauugauauuaacaacuucugaaucuaggaaggauaguaguacuucuuagauaauguuagaaguauaauguucaauucauuuaauucgucauucaguuugcaaucauguagagcaugugcuagcuauuuugauagcaggcucugcagauagaaaauuaggguaguaccucugccuuccaagucaaauugggaagucauacgugugagaaaguaaauuuuagugcagaaucauaguuauugaaauagugguuuaggcuagguacaguggcuuacaccuguaaucccaacacuuugggaggccaagucaggaagaucgcuugaagccaggaguucaagaccagccugggcaacaaagugaggcccugcaucuacaaaauaauaauaauaauaauaauaauaauaauaauaauaauaauaaauugcaaauaagcgaggcuugguggcacauaccucuaggcuuagcuacuccggaggcugaagcaggaggauuacuugagcccaggagguugaggcugcagugagcuaugguugugccacugcacuccagccuggaugacaaagcaagacauagucucuuaaaaaauaaaagaaauaguuacaugagacaguugugguaggaauugucaacucuuguagaggagggacuagugguuaggaaauaacaaccuuugauauggguuuucaaggagaaguagggauucaccuaacugacaggagacuaagaaugguauuucaggagaugggagcagagugaaaagaagccagcugagggcugaaugcuggagagaagcaauguuuaaaggugggaaaggaagaauugucaugagaggagaguaagaagaaaugauuacaaagguaggcagagaaaaaaagagaugcaugcuauccucagcaggggaggaggggguuaaaaagaaaguguucguagugcugccaagggguuaaagaggaugaagauauuuagcgaauaagauucacauauguacguaaaguuaccuguguuaguaucccagaguucccauaacaaauuaccacaagucaagugguaaaaaacaacagaauuuuuuucccucaugguucuagaagcucaaagucugaagucaagguaccagcagggcugugcuugcuccagaggcuccagggaaaaauccuuccuugccuuuccaagcuccugguggcugcuggcauuccuugauguguggcagcaucccuccaaucuuugccuccaucuccacauggccaucucuguguuuucuuacgaggacaccagucauuggguguagggcccacucuaaauccaguaugaugucauucaagauaucauauuggucuuuaggaaauguaaaagaaagaagcaucuuaguuaaucucucugcucaaauucauaauccuuuagaaaagagauuuuucacacgggaaaccauuugagaacaguauaacacauuauauaauagaguacuaaauugcugucaaaaugugcaguauaacacauuauguaauagaguacuaaauugcugucaaaauguacagcuaaucacucucaaaaguuuaaauguaucaagaaaaacaccgaucccauuaaccacauauguaacaaauaagaaaucuucacacuauguguuuuuuauucuucagguggcagggcagaaggaacccuccguucagcuaaaagugaggagucucuuacaucucuccaugcaguugaugguaagacuaaaagcaucagucauuuuauucuauaauauauugcauaaaggaauacugcaauugaguauauuuuuauauaucugugcuuaauaaauaggcuauuaacucauuuccuaggaauacuagugucuauuuaguauuauucagauuaaaauucauugaugcuuucacauggaagcagucuuuaaucuuuucauuuuuggcaugacugcuauucaguuuacauaaaaguagccaaaauauuucaaguuaacuauuuauauuuauuaauaucuagugaaaacuuguguuauuacuguuuccuuuagauuuuacaaugggagcauaagaguuuuccaagauuuucaauuaaacuagucaagauaaccuacaaaacaaugcagcaagcuagguggauacuaguguuaagcagaagauauuuguaaggaauuaauuuuaugggugaucaauacauuugugaauauauauauauauauauauauauguuagacagagucucgcuuuguugcccaguuuggaguacaguggcgcaaucuuggaucacugcaaccucuaacucccgguuuaagugauuaucuugccucagccucccaaauagcugggacuacaggcaugcgccaccaugcccgggagcauaauuuuauaaaguguauaauuaagcaguuuuuauauuuuuaguagauacgggguuuugccacuuaggccaggcuagucucgaacuccugaccucaggugaucugcccaccucagcuucccaaagugcugggaucacaggcaugaaccgcugugaccggccaauauauuuauauuuauuaagauaguuucugccucuuuaaauuacuuuuuaacuauggcaauuaaaauaauccuaauagaauagagaguuucuuuuuuaccaguuggauauuuagcaacaucguaaaauuauguaauacucucugccacucuugaagacugcuugggaaacuuaaaaccuauucuuaaagaaaaaaaugaaguucuuguuuaguaucugaaaggaauuuuuuacuaaauauauguaaauacuuuaugggauuaugaagauuuuuuaauugagaaguucaauuuauuuagaaauuugaauauuguaaggauguuuccccacaaaaaaaacauccauuuugcuauuauagauucaaaaugccacucaaagugauuaauuccaccucauaagucauaugaggccagugauaaaauaagacacaaagaaaugaaaaacuugcccaaagucacaccaagaaucaguguuggauuaguaauagaauccaagcauucugaguucuuuuccucuccagaccaugaaauacugcauucgcccucugauucuaucacauguuugcuauuuagcauuugguuuuggaguucuguuaucucaaguguaaaugaucugugugcacugaaagaauuuucagaaagaaaaugagaaguaacacuuccuucaccuagauaguaaguuacugcugugcugaguaggugacuuaccacagcauucuguaucuacgauguucuuacuuugacacuguuauucauuuuuuccaggugauucuaagcucuuccgacccagaagacccagaucuuccagugaugcacugucugccucuuuuaauggagaaaugcuggggaaccgcuguaacuccuaugauaaucugccucaugacaaugagagugaggaggaaggagggcugcuucauaucccagcccuuaugucuccucauucagcugaggauguugacuugagcccaccagacauuggaguagccagccuggauuuugauccaaugucauuucaauguaguccuccuaaggccgaaucagaaugucuggagaguggugcuuccuuuuuagauucaccaggauacuccaaggauaaaccaagugccaauaaaaaggaugcagaaacagguaguagccaaugucagacuccaggaagcacagcaagcucugaaccugucucuccucuucaggagaaacugaguccauucuuuacccuggacuugagcccaacugaagauaaaucaucuaagccauccuccuuuacugaaaaggucgucuaugcuuucucuccgaagauaggacggaaauuaagcaaaucaccuucuaugagcauaucugagccaauuucagugacccuaccaccacgggugucagaagucauugguacagucucaaauaccacagcucagaaugcaucaucuucaaccugggacaaaugcguugaagaaagggaugccacaaauagaucccccacccagauaguaaagaugaaaacaaaugagacaguugcccaagaagcauaugaaucugaaguccagccccuggaccagguggcugcugaagaaguagaauugccagggaaagaggaucagucugucucaagcagucagaguaaggcuguagcuucuggacagacucagacagguaccguuuguuuuccuccauucuuucuuuaaguuaagagggaucuucaauccugugugccaucugugccuuuuaagagagaaauuuguccacagcuagccuuuaaucaaagagaaugcuuuucuggguggugcugauggcucagagcccuaaauuaaaagcaguccaacaaaacuccccaaaagggccaaugguccugcuucaaaucuucacaaaaguccccuuaucucuuuggacggugagaauucguggauaauuuuugcacaacugcguagcucuugauucuguuuuucucuucuaauaaaauaucuuuauuguagccuuccaaguuaacaagccagcuacaccaucaaauguaaaaacuguucauaauaacagucuacaagcacuugaagcuuguuuucuaagcaaucuuuucugagccaggugagggacaugcuuuuuuucccccccaucucuguaacaauucaagaagagauugcagucuuuauacacuguuuguuuuaguuuuccuucugaaccagauguguuuucaacagcauuugcaugugggauagaagaucauggauugccauuuugaaauauggaaggcaccuauuuuuuaaugaucacauggggaguguuuggcuuuccauuuaggauaacguaagcuaccuuuucacucucauuuuuuuucccaauuucccacuaggagcaguuacccaugaccccccucaggauuccguuccugucaguucagucucucuuaucccaccaccaccgccuccgaaaaauguugcccgaauguuggcgcuagcauuagcugaguccgcacagcaagccucaacucagucauugaagagaccagggaccucucaggcuggguauacaaauuauggagacauagcgguggcuacaacugaagauaaucuguccaguucuuacucugcaguugcucuagauaaggccuauuuccaaaccgaucgaccagcagagcaguuccaccuccagaauaaugcaccaggaaacugugaccauccucuaccagagacaacagcuacuggggauccuacccauuccaacacaacugaaucuggggagcaacaucaccaaguagacuuaacagggaaucagccacaucaagcauauuuaucuggggacccagaaaaggccagaauuacuucaguucccuuagacucagagaagucugaugaucauguaaguuucccugaagaccagucugggaagaacaguaugccaacugucuccuucuuggaucaggaccagucuccaccccguuucuacaguggagaucagccuccuucuuaucuuggugcaaguguggauaaacuccaucacccuuuagaauuugcagacaaaucucccacaccuccuaauuuaccuagcgauaaaaucuacccuccuucugggucccccgaagagaauaccagcacagccaccaugacuuacaugacaacuacuccagcaacagcccaaaugagcaccaaggaagccagcugggauguggcugaacaacccaccacugcugauuuugcugcugccacacuucagcgcacgcacagaacuaaucguccccuucccccuccgccuucccagagaucugcagagcagccaccaguuguggggcagguacaagcagcaaccaauauaggauuaaauaauucccacaagguaagaaggggaagauaucagugagaugaaauauacuauuaccaaagguaugucacuuuucagcaggguguguuguuaucuuugagucagacacaacaauuacuuuuaagcccuguggcugguuuccaugagauaguucccauuugagguuggagucugccauuaccuugaugcuggcuuuuccccaggaaaggaguagcuccuagaugacuauagcuuaacuguaccugcucccuuuucuuccuaaagugucucgguaguuuauuccaguaacacaaagagaucaggaucaaaugagacaaagugggcuuuacgguuguggguugcuuuuucuuauuuuuuuccaacuccaucacugacucauugugacuuugggcaagucauuuaccuacccucugccaauuauucacaguuacacaaugaaaauacuucauucucaaaacauucguaagacugucugccuugcagacuuuuuggaaguauaagagauuauagugccuugggauuuuuuguuacuuuccuagcauucaccagcaguuugucccauagucaggugccuguuucaaugagagaauguaguaugcagaaugcuaagguuucuuccugaauuuccucauauuuuaagaaagugccacagguuguuuuucuucuauauggucaccuugaacuauuaauaggacuuaagauuuuagaccuuaguggaggaugcuguguuuacugcuucucaaggauagcauguuuucaguaugaggauuaucuuuggccagacuaagguggaaucaaagguaggagagaggcaguagcuucugauuugaauauugccuuucccuauguuugaagcccuaaaacugcuaacuguguacaacugugaauuucaaaagucuccccagaugauagaauuaacucuuaauuuaacaagauguccuuuguguugagacugagcuagacuaauagaccggguauguauuuuuaagcucuacagcauuacuugacuaaaccucucuuuugguuuguauauuaaaauuaugccauaggcaaccucaucucgcauuuaaaaccucucauaaauuagaaaacuuugaaugguucuccaaagauaauacuggguguuguacaaaauagcagcacaagccuucuuuuccuagaaauggguacagauucauugcaaccacauggcuugggaaaguucaagcugcuacccaaccagccuuaauuugugaguuacaaauuuaauaguacuugauucauagagggaacaaaaaauagacccauaguauuaucaucuuucaauagguucaaggaguaguuccaguuccagagaggccaccugaaccucgagccauggaugacccugcgucugccuucaucagugacaguggugcugcugcugcucagugucccauggcuacagcuguccagccaggccugccugagaaagugcgggacggugcccgggucccgcugcugcaccugcgcgccgagucugucccugcgcaucccuguggcuuuccugcaccacugccccccaccaggaugauggagaguaagaugauugcugccauacacuccagcagugcagaugccaccagcaguucaaauuaucauuccuuugucacugcuucauccaccucuguggacgaugcauugccuuuaccacuuccugucccacaaccuaagcaugcuucucagaaaacaguuuacuccuccuuugcuaggcccgaugucaccacugaacccuuugguccagauaacuguuugcauuucaauaugacuccaaacugccaguaccguccccagaguguaccuccccaucacaauaaauuggagcagcaccaaguguauggugccaggucagagccaccagccuccaugggucuucguuauaacacauauguggccccaggaagaaacgcaucuggacaccacuccaagccaugcagccgggucgaguaugugucuucuuugagcuccucugucaggaauaccuguuaccccgaagacauuccaccguacccuaccauccggagagugcagucucuccaugcuccgccgucuuccaugauucgcucuguucccauuucacggacagaaguucccccagaugaugagccagccuacugcccaagaccucuguaccaauauaagccauaucaguccucccaggcccgcucagauuaucaugucacucagcuucagccuuacuuugagaauggccggguccacuacagguauagcccauauuccaguucuucuaguuccuauuacaguccagauggggcccugugugauguggaugccuauggcacaguccaguugagaccccuucaccgccuucccaaucgagacuuugcuuucuacaauccuaggcugcaaggaaagagcuuguacaguuaugcugguuuggcuccacguccccgggccaacgugacuggcuauuucucucccaacgaccauaauguagucagcaugccuccggcugcugaugugaagcacaccuacaccucaugggaucuugaggacauggaaaaauaccgcaugcaguccauccggagagagagccgugcucggcagaaggugaaagggccugucaugucccaauaugauaacaugaccccggcggugcaggacgacuugggugggaucuaugucauccaucugcguaguaaaucagauccugggaaaacuggacuucucucaguggcagaaggaaaggagagccgccaugcagccaaggccaucagucccgagggagaggaccgcuucuauaggaggcaucccgaggcagagauggacagagcccaccaucacggaggccaugguagcacgcagccggagaagccaucccugccucagaagcagagcagccugaggagcaggaagcuuccugacaugggcugcagucuuccugagcacagggcacaccaagaagcaagccauaggcaguucugugagucaaagaaugggcccccuuauccccagggagcuggccaguuagauuauggguccaaagggauuccagacacuucugagccagucagcuaccacaacucuggaguaaaauaugcugcauccgggcaagaaucuuuaagacugaaccacaaagagguaaggcucuccaaagagauggagcgacccuggguuaggcagccuucugccccagagaaacacuccagagacugcuacaaggaggaagaacaccucacucagucaaucgucccacccccuaaaccagagaggagucauagccucaaacuccaucauacccagaacguggagagggaccccagugugcuguaccaguaccaaccacacggcaagcgccagagcagugugacuguugugucccaguaugauaaccuggaagauuaccacucccugccucagcaccagcgaggagucuuuggagggggcggcauggggacguaugugcccccuggcuuuccccauccacagagcaggaccuaugcuacagcguugggucaaggggccuuccugcccgcagaguuguccuugcagcauccugaaacacagauccaugcagaaugagcccugcgagcaauagaguugaagcagccucugcuggacaguggacuguucuauuuuuuucaauaaccaaaaagauuaaacaaaaaauacuauaaaaccccugaccacauuuaaaaaaugauaauaaaaguaaacaaaucagcaucuuuuuccccuucccugcuucauuacccccucuuccaucuauagacuuugucauuuuugucuuuagaaaagaucugaaggaugguaaagccccgugcugaaacccaguagagaaaccugucucaggacacacuugccaucuagggcuagcuugaaagagccugaggacugccuuuaacugaauuugaauucagcauuguccuuucuucuuaguauuugcugcauaauugagagcaguucacaucgauuuccugguaggcgucugcauucccuguuguguuccugcuucuccuucaguagcugcacaacuugcgcagaucgacacacuguugucacuucauucuccccgucugagaaggaucuuguguucaguuagagucguggaaaaaucccugauccuucaaggucagucagacaguuggcaacauuauaauuaaaaauaagaaauuaagacuuuaaauuaaacauuugguagagucaucauaaaacaccagaccacuuagacucaggcugaaccauacucuuucuauucuuauuuuucauccuuguuccucacgguucagugaacaggcucauaucaugacagaauggacuuuuaaaaguuaguacuuaaggaaacuucuuuagguggaagaaaguaaaguucuuauugucagugaacuuuauuagcaccagaaaucucuauugaugcuuuuaaugcauugccugccuucagguuuucuucuuaccccaccccucaauaagauuuggugaauuguaauucuaguaaaacaugucauaccauugguuuuccuaaauuaucaacuuucuuucauuaaaaaaaaaaaaaaaaaaaaaagcccagcaugguuugacuggauagacacgcauaauuuauuaugaauauaaauuuccauguuuguuucuguuccuaaaccagaguacgaggucccugggaauuuaaguagcuacgcauuaucuauuauuagacugcaaguuccugcaauaacugcuuaguucacagccccguuucaccaguggaguucugggcaguuauugcuguccuaaggcauuacugucguuugcuuacucuauacuuguguggucacagucuucuuguaauuaccaucuacaccagcauuucagguauagcucuuuauaacucuggagacauguaaaacauguuuaacacccacgaguuuugaaaguugcauuccuuauuagaguaggaacucucuagcccaacuccauucuauguucucagcucccuccaccccccaaaauacaucagacuagcaaggcaguccuauguuuacaaaacgaguuuagauugucauuucauuccauaacucuuaauaauacucaaguuuuauacauucacguauuuuaaaugcucggucuguagaagacacuaggagaauugcauuccaauuacuggaugguugcugcucuggcuuuuuagaacuugaaauuaauuuuuauuuagagcaaaggaggaaaucuuuuaagaggcuaaaaucaugcugcuauuauugcugugaaauuguauaaagauuaggauucaugccaguuuuuauuuuaaaaaauaaugugcauuuuaaggguuuauauuuagaaaaaaauaaaauguuucaagaacaacacauugauauguggaaauauucuauaagguuuucuuuuguucccuuagaauucauuggagggaugcaguaaaaacuguaguagaaaccuugaaacacccauaugugaaaaggucuguggaaauugaggccucuacauuaaaagugcagaaccaacuguuuuacagucaaagugcuaggaaaccugauaggauacuucccuuuggcacaaaaacacccugggugcuacauacaggaguaugaccuuuggugaauauguggcacuaauuuuuuuuaccuuaaucauauucuugucaaguaggcaacccauugccccuuggagaccacaccagcccuguaaguucucaccagcagcauggagauuaggaagaggggcugcugugaccaggagauacacacggcuuuaaguaacugagagccuaaagaaaguaacccagggaguccgguccaguuuuaauauuuguggauuuguugucacacacauuguuuaguccugaaacuaaaaccuauuuuauaaauaguaggguuaauuccucgaaacaauuucuuuauuaauaaauguccuguggguuuagaaauaucagguaaauauuugaauacagaaugaugauugcaauuacuguuacaagcgugaaacacaaacuucagaucaaaucuagaguugcuucauuuaaugcaugcuagcaacagccuuaacuuuggauucaguuauuugaaacacuuuuccggcaucuuucccuuucuaauguugugggguggaaaccggauggcaaaucacugugagccggauaccucagcacaguccaccuugugugugacuucacaaaugggggacuucacaaaugggguaacugaauguuauuacuuucaaauuuugacauggagcauuaugaucaaggaaauggagcugccuuauacauuaaacccgugauuuaauccuauugacauuuucauagccaugccuccagauuuuaucuuuuuggcaaaauucugauuccacaguuuggucugauugaaauaaauauucccuggacgucuggcuaaaaauuuugcuaacaaucccagaggugccauuuucuuauuaauaaauuucauuggagccuuauuucuuacuauauucaauuucguuucaaaccugcaagucccugggauggucccacgacuagggccugcacauuucuuacaauggcaaagcauuuuuuaaaauuuagggucagguugaaaaauucuaggacuaauucuguagagaggagggacuguuaacuaacgugaguggggacggaggaguagguuaccacauuuggagcaguaauagaugcaaacgauguaaauuugaaauuugccccuuuaguuaaagaaggagccugcaaaguccauuucucuguuuucagcccugucagucacccauuuaggauguuggcaaaguacugcuugagcagaauguguaagaaaguaauaaugaaagcaaaaguaugucagacaguuacuucuuccacaugguuagaggcaugugauuuucagcacuguguguuacagaaaugucaggaaugguguauuauaacgugugcaagauaaugucagugugcacagagggucuuuuuuccuuaucugauuaguacuguuaauguucaaagaauaaaaaugguuuuacaguuuagauucugagauagcaaaaccugauuuuucaaccaugaccugcaugagagaagcauccuaggaagucuuagaucauacuuuugaguuuuuaauuuuaauuuauauaguguuuuuuuaugucuuaauauuuuugugaacugguguaaauuguuaaugcauauaagcuuguguauuuuuguaaauaguuuugugauuuauuucuugccccauauguaaauauuuagagucucauuucuugcaaacuuauuugaagcugaguuguggguuuggguuuuguuuguuucuuugguugcaggguggggugggggguggcaggggagggaggaagggauuuuuguaccuggagauggagauaucuugugguuuaaagcaaaugucccacugaaagugauucaaauaucaacagaauuauuucagguuaaaacaga

SEQ ID NO: 192952 - RNA, 227139 nt, Homo sapiens
ucuguuuuaaccugaaauaauucuguugauauuugaaucacuuucagugggacauuugcuuuaaaccacaagauaucuccaucuccagguacaaaaaucccuuccucccuccccugccaccccccaccccacccugcaaccaaagaaacaaacaaaacccaaacccacaacucagcuucaaauaaguuugcaagaaaugagacucuaaauauuuacauauggggcaagaaauaaaucacaaaacuauuuacaaaaauacacaagcuuauaugcauuaacaauuuacaccaguucacaaaaauauuaagacauaaaaaaacacuauauaaauuaaaauuaaaaacucaaaaguaugaucuaagacuuccuaggaugcuucucucaugcaggucaugguugaaaaaucagguuuugcuaucucagaaucuaaacuguaaaaccauuuuuauucuuugaacauuaacaguacuaaucagauaaggaaaaaagacccucugugcacacugacauuaucuugcacacguuauaauacaccauuccugacauuucuguaacacacagugcugaaaaucacaugccucuaaccauguggaagaaguaacugucugacauacuuuugcuuucauuauuacuuucuuacacauucugcucaagcaguacuuugccaacauccuaaaugggugacugacagggcugaaaacagagaaauggacuuugcaggcuccuucuuuaacuaaaggggcaaauuucaaauuuacaucguuugcaucuauuacugcuccaaaugugguaaccuacuccuccguccccacucacguuaguuaacagucccuccucucuacagaauuaguccuagaauuuuucaaccugacccuaaauuuuaaaaaaugcuuugccauuguaagaaaugugcaggcccuagucgugggaccaucccagggacuugcagguuugaaacgaaauugaauauaguaagaaauaaggcuccaaugaaauuuauuaauaagaaaauggcaccucugggauuguuagcaaaauuuuuagccagacguccagggaauauuuauuucaaucagaccaaacuguggaaucagaauuuugccaaaaagauaaaaucuggaggcauggcuaugaaaaugucaauaggauuaaaucacggguuuaauguauaaggcagcuccauuuccuugaucauaaugcuccaugucaaaauuugaaaguaauaacauucaguuaccccauuugugaagucccccauuugugaagucacacacaagguggacugugcugagguauccggcucacagugauuugccauccgguuuccaccccacaacauuagaaagggaaagaugccggaaaaguguuucaaauaacugaauccaaaguuaaggcuguugcuagcaugcauuaaaugaagcaacucuagauuugaucugaaguuuguguuucacgcuuguaacaguaauugcaaucaucauucuguauucaaauauuuaccugauauuucuaaacccacaggacauuuauuaauaaagaaauuguuucgaggaauuaacccuacuauuuauaaaauagguuuuaguuucaggacuaaacaaugugugugacaacaaauccacaaauauuaaaacuggaccggacucccuggguuacuuucuuuaggcucucaguuacuuaaagccguguguaucuccuggucacagcagccccucuuccuaaucuccaugcugcuggugagaacuuacagggcugguguggucuccaaggggcaauggguugccuacuugacaagaauaugauuaagguaaaaaaaauuagugccacauauucaccaaaggucauacuccuguauguagcacccaggguguuuuugugccaaagggaaguauccuaucagguuuccuagcacuuugacuguaaaacaguugguucugcacuuuuaauguagaggccucaauuuccacagaccuuuucacauauggguguuucaagguuucuacuacaguuuuuacugcaucccuccaaugaauucuaagggaacaaaagaaaaccuuauagaauauuuccacauaucaauguguuguucuugaaacauuuuauuuuuuucuaaauauaaacccuuaaaaugcacauuauuuuuuaaaauaaaaacuggcaugaauccuaaucuuuauacaauuucacagcaauaauagcagcaugauuuuagccucuuaaaagauuuccuccuuugcucuaaauaaaaauuaauuucaaguucuaaaaagccagagcagcaaccauccaguaauuggaaugcaauucuccuagugucuucuacagaccgagcauuuaaaauacgugaauguauaaaacuugaguauuauuaagaguuauggaaugaaaugacaaucuaaacucguuuuguaaacauaggacugccuugcuagucugauguauuuugggggguggagggagcugagaacauagaauggaguugggcuagagaguuccuacucuaauaaggaaugcaacuuucaaaacucguggguguuaaacauguuuuacaugucuccagaguuauaaagagcuauaccugaaaugcugguguagaugguaauuacaagaagacugugaccacacaaguauagaguaagcaaacgacaguaaugccuuaggacagcaauaacugcccagaacuccacuggugaaacggggcugugaacuaagcaguuauugcaggaacuugcagucuaauaauagauaaugcguagcuacuuaaauucccagggaccucguacucugguuuaggaacagaaacaaacauggaaauuuauauucauaauaaauuaugcgugucuauccagucaaaccaugcugggcuuuuuuuuuuuuuuuuuuuuuuaaugaaagaaaguugauaauuuaggaaaaccaaugguaugacauguuuuacuagaauuacaauucaccaaaucuuauugaggggugggguaagaagaaaaccugaaggcaggcaaugcauuaaaagcaucaauagagauuucuggugcuaauaaaguucacugacaauaagaacuuuacuuucuuccaccuaaagaaguuuccuuaaguacuaacuuuuaaaaguccauucugucaugauaugagccuguucacugaaccgugaggaacaaggaugaaaaauaagaauagaaagaguaugguucagccugagucuaaguggucugguguuuuaugaugacucuaccaaauguuuaauuuaaagucuuaauuucuuauuuuuaauuauaauguugccaacugucugacugaccuugaaggaucagggauuuuuccacgacucuaacugaacacaagauccuucucagacggggagaaugaagugacaacagugugucgaucugcgcaaguugugcagcuacugaaggagaagcaggaacacaacagggaaugcagacgccuaccaggaaaucgaugugaacugcucucaauuaugcagcaaauacuaagaagaaaggacaaugcugaauucaaauucaguuaaaggcaguccucaggcucuuucaagcuagcccuagauggcaaguguguccugagacagguuucucuacuggguuucagcacggggcuuuaccauccuucagaucuuuucuaaagacaaaaaugacaaagucuauagauggaagaggggguaaugaagcagggaaggggaaaaagaugcugauuuguuuacuuuuauuaucauuuuuuaaauguggucagggguuuuauaguauuuuuuguuuaaucuuuuugguuauugaaaaaaauagaacaguccacuguccagcagaggcugcuucaacucuauugcucgcagggcucauucugcauggaucuguguuucaggaugcugcaaggacaacucugcgggcaggaaggccccuugacccaacgcuguagcauagguccugcucuguggauggggaaagccagggggcacauacguccccaugccgcccccuccaaagacuccucgcuggugcugaggcagggagugguaaucuuccagguuaucauacugggacacaacagucacacugcucuggcgcuugccgugugguugguacugguacagcacacuggggucccucuccacguucuggguaugauggaguuugaggcuaugacuccucucugguuuagggggugggacgauugacugagugagguguucuuccuccuuguagcagucucuggaguguuucucuggggcagaaggcugccuaacccagggucgcuccaucucuuuggagagccuuaccucuuugugguucagucuuaaagauucuugcccggaugcagcauauuuuacuccagaguugugguagcugacuggcucagaagugucuggaaucccuuuggacccauaaucuaacuggccagcucccuggggauaagggggcccauucuuugacucacagaacugccuauggcuugcuucuuggugugcccugugcucaggaagacugcagcccaugucaggaagcuuccugcuccucaggcugcucugcuucugaggcagggauggcuucuccggcugcgugcuaccauggccuccgugauggugggcucuguccaucucugccucgggaugccuccuauagaagcgguccucucccucgggacugauggccuuggcugcauggcggcucuccuuuccuucugccacugagagaaguccaguuuucccaggaucugauuuacuacgcagauggaugacauagaucccacccaagucguccugcaccgccggggucauguuaucauauugggacaugacaggcccuuucaccuucugccgagcacggcucucucuccggauggacugcaugcgguauuuuuccauguccucaagaucccaugagguguaggugugcuucacaucagcagccggaggcaugcugacuacauuauggucguugggagagaaauagccagucacguuggcccggggacguggagccaaaccagcauaacuguacaagcucuuuccuugcagccuaggauuguagaaagcaaagucucgauugggaaggcggugaaggggucucaacuggacugugccauaggcauccacaucacacagggccccaucuggacuguaauaggaacuagaagaacuggaauaugggcuauaccuguaguggacccggccauucucaaaguaaggcugaagcugagugacaugauaaucugagcgggccugggaggacugauauggcuuauauugguacagaggucuugggcaguaggcuggcucaucaucugggggaacuucuguccgugaaaugggaacagagcgaaucauggaagacggcggagcauggagagacugcacucuccggaugguaggguacgguggaaugucuucgggguaacagguauuccugacagaggagcucaaagaagacacauacucgacccggcugcauggcuuggagugguguccagaugcguuucuuccuggggccacauauguguuauaacgaagacccauggaggcugguggcucugaccuggcaccauacacuuggugcugcuccaauuuauugugauggggagguacacucuggggacgguacuggcaguuuggagucauauugaaaugcaaacaguuaucuggaccaaaggguucaguggugacaucgggccuagcaaaggaggaguaaacuguuuucugagaagcaugcuuagguugugggacaggaagugguaaaggcaaugcaucguccacagagguggaugaagcagugacaaaggaaugauaauuugaacugcugguggcaucugcacugcuggaguguauggcagcaaucaucuuacucuccaucauccugguggggggcaguggugcaggaaagccacagggaugcgcagggacagacucggcgcgcaggugcagcagcgggacccgggcaccgucccgcacuuucucaggcaggccuggcuggacagcuguagccaugggacacugagcagcagcagcaccacugucacugaugaaggcagacgcagggucauccauggcucgagguucagguggccucucuggaacuggaacuacuccuugaaccuauugaaagaugauaauacuaugggucuauuuuuuguucccucuaugaaucaaguacuauuaaauuuguaacucacaaauuaaggcugguuggguagcagcuugaacuuucccaagccaugugguugcaaugaaucuguacccauuucuaggaaaagaaggcuugugcugcuauuuuguacaacacccaguauuaucuuuggagaaccauucaaaguuuucuaauuuaugagagguuuuaaaugcgagaugagguugccuauggcauaauuuuaauauacaaaccaaaagagagguuuagucaaguaaugcuguagagcuuaaaaauacauacccggucuauuagucuagcucagucucaacacaaaggacaucuuguuaaauuaagaguuaauucuaucaucuggggagacuuuugaaauucacaguuguacacaguuagcaguuuuagggcuucaaacauagggaaaggcaauauucaaaucagaagcuacugccucucuccuaccuuugauuccaccuuagucuggccaaagauaauccucauacugaaaacaugcuauccuugagaagcaguaaacacagcauccuccacuaaggucuaaaaucuuaaguccuauuaauaguucaaggugaccauauagaagaaaaacaaccuguggcacuuucuuaaaauaugaggaaauucaggaagaaaccuuagcauucugcauacuacauucucucauugaaacaggcaccugacuaugggacaaacugcuggugaaugcuaggaaaguaacaaaaaaucccaaggcacuauaaucucuuauacuuccaaaaagucugcaaggcagacagucuuacgaauguuuugagaaugaaguauuuucauuguguaacugugaauaauuggcagaggguagguaaaugacuugcccaaagucacaaugagucagugauggaguuggaaaaaaauaagaaaaagcaacccacaaccguaaagcccacuuugucucauuugauccugaucucuuuguguuacuggaauaaacuaccgagacacuuuaggaagaaaagggagcagguacaguuaagcuauagucaucuaggagcuacuccuuuccuggggaaaagccagcaucaagguaauggcagacuccaaccucaaaugggaacuaucucauggaaaccagccacagggcuuaaaaguaauuguugugucugacucaaagauaacaacacacccugcugaaaagugacauaccuuugguaauaguauauuucaucucacugauaucuuccccuucuuaccuugugggaauuauuuaauccuauauugguugcugcuuguaccugccccacaacugguggcugcucugcagaucucugggaaggcggagggggaaggggacgauuaguucugugcgugcgcugaaguguggcagcagcaaaaucagcagugguggguuguucagccacaucccagcuggcuuccuuggugcucauuugggcuguugcuggaguaguugucauguaagucaugguggcugugcugguauucucuucgggggacccagaaggaggguagauuuuaucgcuagguaaauuaggaggugugggagauuugucugcaaauucuaaagggugauggaguuuauccacacuugcaccaagauaagaaggaggcugaucuccacuguagaaacgggguggagacugguccugauccaagaaggagacaguuggcauacuguucuucccagacuggucuucagggaaacuuacaugaucaucagacuucucugagucuaagggaacugaaguaauucuggccuuuucuggguccccagauaaauaugcuugauguggcugauucccuguuaagucuacuuggugauguugcuccccagauucaguuguguuggaauggguaggauccccaguagcuguugucucugguagaggauggucacaguuuccuggugcauuauucuggagguggaacugcucugcuggucgaucgguuuggaaauaggccuuaucuagagcaacugcagaguaagaacuggacagauuaucuucaguuguagccaccgcuaugucuccauaauuuguauacccagccugagaggucccuggucucuucaaugacugaguugaggcuugcugugcggacucagcuaaugcuagcgccaacauucgggcaacauuuuucggaggcggugguggugggauaagagagacugaacugacaggaacggaauccugaggggggucauggguaacugcuccuagugggaaauugggaaaaaaaaugagagugaaaagguagcuuacguuauccuaaauggaaagccaaacacuccccaugugaucauuaaaaaauaggugccuuccauauuucaaaauggcaauccaugaucuucuaucccacaugcaaaugcuguugaaaacacaucugguucagaaggaaaacuaaaacaaacaguguauaaagacugcaaucucuucuugaauuguuacagagaugggggggaaaaaaagcaugucccucaccuggcucagaaaagauugcuuagaaaacaagcuucaagugcuuguagacuguuauuaugaacaguuuuuacauuugaugguguagcuggcuuguuaacuuggaaggcuacaauaaagauauuuuauuagaagagaaaaacagaaucaagagcuacgcaguugugcaaaaauuauccacgaauucucaccguccaaagagauaaggggacuuuugugaagauuugaagcaggaccauuggcccuuuuggggaguuuuguuggacugcuuuuaauuuagggcucugagccaucagcaccacccagaaaagcauucucuuugauuaaaggcuagcuguggacaaauuucucucuuaaaaggcacagauggcacacaggauugaagaucccucuuaacuuaaagaaagaauggaggaaaacaaacgguaccugucugagucuguccagaagcuacagccuuacucugacugcuugagacagacugauccucuuucccuggcaauucuacuucuucagcagccaccugguccaggggcuggacuucagauucauaugcuucuugggcaacugucucauuuguuuucaucuuuacuaucugggugggggaucuauuuguggcaucccuuucuucaacgcauuugucccagguugaagaugaugcauucugagcugugguauuugagacuguaccaaugacuucugacacccguggugguagggucacugaaauuggcucagauaugcucauagaaggugauuugcuuaauuuccguccuaucuucggagagaaagcauagacgaccuuuucaguaaaggaggauggcuuagaugauuuaucuucaguugggcucaaguccaggguaaagaauggacucaguuucuccugaagaggagagacagguucagagcuugcugugcuuccuggagucugacauuggcuacuaccuguuucugcauccuuuuuauuggcacuugguuuauccuuggaguauccuggugaaucuaaaaaggaagcaccacucuccagacauucugauucggccuuaggaggacuacauugaaaugacauuggaucaaaauccaggcuggcuacuccaaugucuggugggcucaagucaacauccucagcugaaugaggagacauaagggcugggauaugaagcagcccuccuuccuccucacucucauugucaugaggcagauuaucauaggaguuacagcgguuccccagcauuucuccauuaaaagaggcagacagugcaucacuggaagaucugggucuucugggucggaagagcuuagaaucaccuggaaaaaaugaauaacagugucaaaguaagaacaucguagauacagaaugcugugguaagucaccuacucagcacagcaguaacuuacuaucuaggugaaggaaguguuacuucucauuuucuuucugaaaauucuuucagugcacacagaucauuuacacuugagauaacagaacuccaaaaccaaaugcuaaauagcaaacaugugauagaaucagagggcgaaugcaguauuucauggucuggagaggaaaagaacucagaaugcuuggauucuauuacuaauccaacacugauucuuggugugacuuugggcaaguuuuucauuucuuugugucuuauuuuaucacuggccucauaugacuuaugagguggaauuaaucacuuugaguggcauuuugaaucuauaauagcaaaauggauguuuuuuuuguggggaaacauccuuacaauauucaaauuucuaaauaaauugaacuucucaauuaaaaaaucuucauaaucccauaaaguauuuacauauauuuaguaaaaaauuccuuucagauacuaaacaagaacuucauuuuuuucuuuaagaauagguuuuaaguuucccaagcagucuucaagaguggcagagaguauuacauaauuuuacgauguugcuaaauauccaacugguaaaaaagaaacucucuauucuauuaggauuauuuuaauugccauaguuaaaaaguaauuuaaagaggcagaaacuaucuuaauaaauauaaauauauuggccggucacagcgguucaugccugugaucccagcacuuugggaagcugaggugggcagaucaccugaggucaggaguucgagacuagccuggccuaaguggcaaaaccccguaucuacuaaaaauauaaaaacugcuuaauuauacacuuuauaaaauuaugcucccgggcaugguggcgcaugccuguagucccagcuauuugggaggcugaggcaagauaaucacuuaaaccgggaguuagagguugcagugauccaagauugcgccacuguacuccaaacugggcaacaaagcgagacucugucuaacauauauauauauauauauauauauucacaaauguauugaucacccauaaaauuaauuccuuacaaauaucuucugcuuaacacuaguauccaccuagcuugcugcauuguuuuguagguuaucuugacuaguuuaauugaaaaucuuggaaaacucuuaugcucccauuguaaaaucuaaaggaaacaguaauaacacaaguuuucacuagauauuaauaaauauaaauaguuaacuugaaauauuuuggcuacuuuuauguaaacugaauagcagucaugccaaaaaugaaaagauuaaagacugcuuccaugugaaagcaucaaugaauuuuaaucugaauaauacuaaauagacacuaguauuccuaggaaaugaguuaauagccuauuuauuaagcacagauauauaaaaauauacucaauugcaguauuccuuuaugcaauauauuauagaauaaaaugacugaugcuuuuagucuuaccaucaacugcauggagagauguaagagacuccucacuuuuagcugaacggaggguuccuucugcccugccaccugaagaauaaaaaacacauagugugaagauuucuuauuuguuacauaugugguuaaugggaucgguguuuuucuugauacauuuaaacuuuugagagugauuagcuguacauuuugacagcaauuuaguacucuauuacauaauguguuauacugcacauuuugacagcaauuuaguacucuauuauauaauguguuauacuguucucaaaugguuucccgugugaaaaaucucuuuucuaaaggauuaugaauuugagcagagagauuaacuaagaugcuucuuucuuuuacauuuccuaaagaccaauaugauaucuugaaugacaucauacuggauuuagagugggcccuacacccaaugacugguguccucguaagaaaacacagagauggccauguggagauggaggcaaagauuggagggaugcugccacacaucaaggaaugccagcagccaccaggagcuuggaaaggcaaggaaggauuuuucccuggagccucuggagcaagcacagcccugcugguaccuugacuucagacuuugagcuucuagaaccaugagggaaaaaaauucuguuguuuuuuaccacuugacuugugguaauuuguuaugggaacucugggauacuaacacagguaacuuuacguacauaugugaaucuuauucgcuaaauaucuucauccucuuuaaccccuuggcagcacuacgaacacuuucuuuuuaacccccuccuccccugcugaggauagcaugcaucucuuuuuuucucugccuaccuuuguaaucauuucuucuuacucuccucucaugacaauucuuccuuucccaccuuuaaacauugcuucucuccagcauucagcccucagcuggcuucuuuucacucugcucccaucuccugaaauaccauucuuagucuccugucaguuaggugaaucccuacuucuccuugaaaacccauaucaaagguuguuauuuccuaaccacuagucccuccucuacaagaguugacaauuccuaccacaacugucucauguaacuauuucuuuuauuuuuuaagagacuaugucuugcuuugucauccaggcuggagugcaguggcacaaccauagcucacugcagccucaaccuccugggcucaaguaauccuccugcuucagccuccggaguagcuaagccuagagguaugugccaccaagccucgcuuauuugcaauuuauuauuauuauuauuauuauuauuauuauuauuauuauuauuuuguagaugcagggccucacuuuguugcccaggcuggucuugaacuccuggcuucaagcgaucuuccugacuuggccucccaaaguguugggauuacagguguaagccacuguaccuagccuaaaccacuauuucaauaacuaugauucugcacuaaaauuuacuuucucacacguaugacuucccaauuugacuuggaaggcagagguacuacccuaauuuucuaucugcagagccugcuaucaaaauagcuagcacaugcucuacaugauugcaaacugaaugacgaauuaaaugaauugaacauuauacuucuaacauuaucuaagaaguacuacuauccuuccuagauucagaaguuguuaauaucaauagaauauggcuuuuaaacuauuuuuaaaagaguacuuuuucgacaguaauagauuuauuugaucuaauaagauacucuauuaaugagacaucuaauaaaaaauaccuucuuuaguuaaaagaguuauaaacuugaaaguuauguugaaacaguuuugaaauuuuuuagaucuguaaaaauacagaucaauaaauuuagauaccauagcaguauuuauuuacaacaauauacaagguauaugugaauuuaaucacauuuacacuauauauaaucuauauaguuuccuuaagaaaagaaauugcauacuucuacauauuuauauauaauuuauguuacucuucaauuuaggaauaaagaaucggugagagaagacacucuguaugugugacacaacugugaacacguuauggaagcagaucauaacaauaugugaagaacgugcccagaacaaccgaagaccaucaugacagcagcagaagugagaaucucccaggcacucaccuuucagagccauggcuuucaucucugaaggcucacucucauuccgcugcagcuuucguuuagaaacagaugaugauuuccccaaguugaaaaaggaacgccagcuacccacaggagacuuuuucaucuuauuuugaggccucuuucuaugaaagagaaaaaauaaucaacauuaagauagccaugggucugucuuuucuuacagaaaagaaaugaacacaugacagaaagaaccaaacaggcuggagaagcauaagugaaacaguaagcaaacauccaccuuccagacagcacacucuacacagugcagccaaagcagaaaauggauaguaaacaugcagauuuuaguacuaguaaauauuuucacaaagaucauuuuuauauauaucuucauauuuggauccaaccucacaaacugaaaaauaagugaaaauaagacguaucugggaauaggaaauauuaaguguccaaaaauaacacagaguuaaagaaaaugauuuuaggugugaguagagaauaaaggcaaacaaagaagacaaggauuaagaauaauaacaaacauauacugaaugccaggcacugugcuaccugccuuauauguaauaucuccuuuaaaucagauacaaccacaugagguaaguacuauuauucucauuuugcagccaaggaaauuaugacacuaagaaguucaaauaacuucuuuaacauuauaaaacuauuaaaugauggagucagaauuggaacccaggccaaucuacaucccaguaucuacucucuuaacuacuacuccauaaauaaaucuuugaguaaauuauggaacuagaauauaaaaucaagaugcuaaagacaaacucaggaugacaaaguaagaguauguuccaacuuuuugcugauagaauguuuuuagucacaggaagugaaaggaaguuagaggaguauacuaaaauacgggaagaacaaauucuaaaguuauauuaguacuacccaauccagagaaucaaaauccuuacauucauguguaauagccaaaggaguagcagagacaucaaaaauaacuuuuacauacauuagucuuccuacuauaaccuaguaaagaagauacagaaaccauguuauuaucauuucuuuagaguaauagaauuucagagcuggaagggacauugaaagagugaacugcugcagugguucucaaguccuagcagacaucagaaucaccuggaaaguuagaugaaugaccaguugcugggucccacgcccaggguuucugauucagcgggucuggggugugacuggacgacugcacaaugugcacuucuagcaauuaucaccaggugaugcugaugcuguuggcugggagaccacacuauuaaucucuucuaaccuuaaugugaaaccaaugucaaacaagucacuguccauuccugacuuucugaacaaacucuuccaacacagcuuauuucuaaacaacuuuauaaacaacauaguucagagagcaaaaucaacccauauagugacaguauauccuuauuuuuccaaacaauuuucccuauaccacugauguucuucuuuuauaaaauuacaugacauuguaaagcaagaaucauuugcaucauuccccaugaagcgguaaguaucauccauauucgaauaaacagguuucucugggacuagccuagaauucaauagaguaauacuaaaauacaaaauuaaaagcaaacuaaaagaaaauaauaggacauagcuaugaaaaucauaucccaaaauaggauuuaacaaauuuuaccuuucaagugggaacucaauuaugguaugaaauuuccccugaagugcagcagguccuucuccuacuucgauauauuuauuuuccgucacaauuggagaauugaccugagcuuguguucgugccugggccucuuccaaugucagcaguuugguggauggagaggauaccaggagggacuugggccuugauagagaagcuucaaaaagaaaaggaagcugaugaagagagucaacuacgugaguguauucaauuuguuaguaucuaucucuccaucuaucuaccuaucuguuguuucaaauuuucuucaaguauguuaaauagcaaaaaccauagugcuuuauauuaaaugaaaaacugaaggggacauaccaguggcacacauacauacauauaaaacccuuuaauaacuguuuuccuuucuuaaaagauaugagaaaagcuuuauauuaaauaaaaaacugaaggggauacaccaguggcacacauacacacauauaaaacucuuuaauaacuguuuuccuuucuuaaaagauaugaggaaaggugaucaaucacucagauauuuuuaguuuuggaagcaauuuuucuucuucuguuccacuuuauacuuuaauacacaucaauaaugaacgacaaguuuuuuaaugugucaugaacuuagaucacaauaggucucauauguaguauucacuauauacacacaaaauaacugucaaauugugcauuuugguaagcagccauacauuauuagcugccuuauaccagugacacguuuuuguuguugcaauaagaaaugcaugguuugcuacuccucuggaagcugagacacacccuccugguaggaagggccaucggagccguaccugcccccucuugcauggccaugcugauucugccgcugaacagcacaucaacgugauucaggaugaacucaacaaccacagacugaauccucacuuccaugaaagcugcuguuccacugaagcaggcagauucuaucuguuuugaucugugagguaaacauuuucaucacagaguuguaaagauagcagucgucaagggccucuuuuuuuaaacguguaaaucucagacaaacagaggaagaaaucauacuuuuacugucccuuagcuaaggcccaguugccuguuuuagggagaugcaaauaaaaagaacagauuuguuuaaucuuuuaaaaguuuccuuaaagaacacugaugaaucagccuuuuauuuaggauuaguucuacuaaaauuaauaagugaaaugcaaauuaccuuaacagguuuggagcccaaacaauugcuagauuuuuugcaugcauauuugugauggaacaauagucagcuagaagagacaagugucucaucaggaacuccaguguucuggaaauaaaauacaacauauuaacagaaagaaacaugaugcagcaguauagaacauaaaagccugcuaauuaauuccuaaguuugcaauagcaaaaugaagaaagggaccauacaaacccaagagaacuuuuuuuuccugcuuaacagguugaaauauuacuauuagaagugaaucuuccaccaaagcuaguuucuggaacaaauaauauuuugaaguuaugccauucuacuugcagcagacauacuaacaggaaaggauuucaacacuucuaugaaagaaaacaguaaugucucaaaagccuuaaaacaguuacaagaaaaauuccaauaggcaucaaggggagaauauuugagcaaaggauaugcuuuugaaauaaagagccuaauucaaauccucauauucugguuuaucuugacuacuuaaaauuugcuuuacuuaaacaauuccacauauauugugauuaaacaauagggaagaguacuuuugaaaacaagacaugaucaccuuaaauguaaguuaaaccagguaagugccgugugugugugugugugugugugugugugugugucugugcgcaugcacacacagagguauuaucuaucaccuagcaugucucaaagcguccuaccuaauagugcccagaguaaaacuacuaaagacaacgggcugggugugauggcuauugccuguaaucucagcagucugggaggcugaggcaggcagaucacuugaacucgagaguucaagaccagccugggcaacacagugaaaccccaucucuacaaaaaguguaaaaacaauuagcugggugugguggugcaugccuguagugccagcuacucgggaggcugaggcaggaggauugcuucagcccaggaagguugaggcugcagugagcugugaucaugccacugcacuccagccugggugacagagugagaccuugucuuuaaaaaaaaaaaaaaaaaaaaaaaaaaggacaaugaaugggagacagaaauauaaggcuguauuauaugaaacaguaaugaaagauaaaauguggucuacauccgagccacaaagauucagaugggccuaacaugaauuugagaggaaaaggaauaucauaguuagacucggcauuaggcauuguucaagaggcuuuuaccagcagucucauuuaauucucauaauagcucuaacaagcacagaauuaccauuccccuuguaccgaggacaaagucaagguugcugggguuccacagacuagcaguggcagugcugcauuucaaaucaaggucagaguggcuccaaagugccugcgcguucaagggcauuguaguugcuuuacaguuaaaaugguaauucucugucucugcuguauauaauuaagagaagacaaaccgaagugaggcuggccuggguaugacauagaggugagaagcuugagaaacguauuuagaucgcaaggacaaaaaaccaaacaccgcauguucucacucauaggugggaauugaacaaugagaucacauggacacaagaaggggaacaucacacaccggggccuguugugggguggggggaagggggagggauagcauuaggagauauaccuaauguaaaugacgaguuaaugggugcagcacaccaacauggcacauguauacauauguaacaaaccugcauauugugcacauguacccuaaaacuuaaaguauaauaaaaaaauaaauaaauaaaauagaauaaagccaggcuccucagccaaaaaaaaaagaaaaccauguaaaauuuuauuacuugaggaaggugaaugaagggaaugauuaaaggacuucaggaauguauuuuaugagaauugcaaauuuaaaaaaccaaagacaucuauuugguuugccuaucugauuauaaggaugucuuuaaaaguuaauguagaauuuuagucaggauuccacaaaaugagcacuuuuauauucagcagaugagagugugaauuguauaaaacuucgcaaccuggaacguaauuuggauauuauugucuaauauugagaauaauaauuuagauuuccagaauuucacugccaggucauuauccuguaauaaaaaacauaaucuagauaccauguaaaaggauggcccucauaguaauauucaaaauuggaaaaggaaggccgggcacaguggcucacaccuguaaucccagcacuuugggaugcugagguggguggaucaccugagcucaggaguuugagaccagccuaggcaacauggcaaaaccccaacucuaccaaaaauacaaaaaauuagcugggcaugguggugugugccaguggucucagcuacuuggggggcugaggugggagaaucacuugagccugggaggcagaggcugcagggagccaagauugugccacugcacuccagccuggguaacagagugagacccugccucaaaaaaaaaaaggaaauagaaaacaccccauaccaccauauauguagauuaaauaugcaaauuaugaaagguuaaauaacauggcauauccaaaugagagaacaugauggaaaauuacgcuuuucaagaacaucuaaggaauucagaaagguuaauguuaaaauuuuggauaaaaagucuauaucaaaagauauacaaaguaggagauacacacacauauaaguuauagugaagaaaagaguuacacaagauauuguauacauuauaaagcaggagauauacauguacauauuaauagcaggcaagguaugaaauccagguagggcauacaugguaaguaauauaauauauauuagaagacaggcaaaguggauaauauuaggauauauauacauauaaguaucuauagucaagcuauaaaauagugugcagaagauauaaaacauauaugcaguguauauuauugaacaucuaucugcaagacucuauucuggaaauacagugauaaacaagacagaauucaugaccucaaguaccuuauguuuuagaaagauuguauacagauagucuccaacuuacaaugguucaauuuaugauuuuuugacguuuaugauggugcaaaggugauaaacauuaaacagaaaccacaauuagaauuuuuuuuuaaauggagucucgcuuuguuguccagcuggggugcaguggcaugaucucggcucacugcaaccuccaccucccaaguucaagugauucuccugccucagcccccgaguagcugggauuauaggcgcgugcuaccaugcccggcuaauuuuguaguuuuaguagagacgggguuuugccauguuggccaggcuggucucaaacuccucaccucaggugauccacccaccucggccucccaaagugcugggauuacagguguaagccauggcgccuggccuauagugcugauuuuugaaauauauacauaagcaaugucauuuugaaaaaaaaaauuaaauuacuuaauuugcauauuacuagaacauccgcugaguuuaauuucuugucaguaauuggaauuuuaaaauguaucuuuuguuucuuugcauacuggaaucuaguuucuacuguugucuuuuucuaacuggcaaaguaacuuucaauuuuauucuggcuuucucagacauaaccauaaauauuuccaacacuccaaacuaacacacaaaucaaauuagguuuuaaaauguagcaacaacaauaaaaccaaagaagaaacuaaaacaaacaaacaaaaaacccccaaguuuagucagccaucccuuuguccauccauucauucauucaaccuuuaaguaccuauggaaugcuaaacagugugccaggcccuggggaucuaaggacaaaugaauaucuauacauaaacauauacauauacauauagguacacauacauauagugugugugugugugcguguguguguguguguguguguguguguauauauauauauauauauauauauaugaaauggaaguuuaauuagaacuccaaggaaguuuaaauagaaauccaaaggaaaaaaaaacguuuacaggucaaccgacuucuaccucugccugguauuuacccacuguggcugaccuguagugugguggggggagcugcuggaugacaucguggauuuuuaucagccuuucuucaucuguugcugcugaaacugcauccuagaagagucacaguacaaaauaaacuagugagcucuguuaguaaaaaugaaaguucacuuacaauucaguuuucacucugagaucaacuugcuuugcucuuggaugugaaauggcgaggaaacacaacauuguauucaggaaguaaacuguuuccacacagugugaacacugagaucuacgaaacuaauuuuaaaaaggcuugauggucaucaguauuaagugugacaagacuagcagcucaaagucagaaagcacaagaaugacaaugugaaaacagcaaagaccaccgacuagcuggcaauauuuguuuuuuuaaggagucauuucagucacagaacuauuucuuacaugugaccaaaccaaaguucauguguuuugaacaaaagcacagcaaaguuccacaaagaauuagauucaaaaguagccuguacucacagaaaauuucucauacagcugguagguaagcagaggguuugggaguucccggaaguacagcuuacauagggaacccacagaauggauguccugaacauacgguucuuucgucaggucggggacgugcucagagucaaauucauggcugacguagacagaagaggacaagcaaaucauuugauugaggagagcaaauaugugucuuaaaaacagaaagcauaagcuccaaaaguguucagcucuaucucagugaguugcuauuaucuuccauuaauuauauuucauuuaaguuguguuuggacuucagcaacaacuggaugucuuaguacaagauagaugucuuucuauguggaaauuaagggcacagcuuuaauauuaaaauggacaauagccucugagauacauaugaaugaacagcucuuauaguacaacagucugaaaacaggacuccuaauugcuaaugacuugaauauccaauauuuuggcaauuccagagacuaguguugaauggcaauugaucuaugaacaauuaugagcagaaauuccucagauacagauuguacaacacagaaaugcuuucccgaagcaggauaaaaaagucagaaacaacauaaagcaauuccuagcuaacaacaaauuuuaauaggcaggaaaaucuguaucauuagaaugaguaaaauaaaaguuguacgcagaauaguaaggcagaguaagcucacucuccaggagguuaauuaauauucauccacgggcaugagaccacuuaucaucuaccuagaggauuaauguguguguacaauaugagauuuacuuugucuuaaacugaagacugaaacugucuuuaguacaaggacuaauuuauguauuuuucaagcauguauuucccaaaacugagaugggcucuaugaucuguuaaaguauuaaaaucucuacagaauaauggcaguuaucauguacuacaguaaaaaagaaaggguaauggcaugucaagaauagucuagaauccaagagauuaagcaaaaauaaaauauugcaggcacagaguuugucacuguuuuugucucagagaagauuuggggaggaugugaaauauguagagaugcauacuugaacauaaacacagaaucagggucaaaggagauuagaaaauguuccauucccauccauuuuaauuaacaccuaaagaauaauuuuauuauaaugcaaauuuccucucucauggcugucaucgguucaaacucaauuuguuaaaaucuucaaacacuauaaagaggcaaaauacaaguacugaagagauuaaggugcaugguucucugauacuacagaugaaaaaaaugccauuuagaaaaguauacagagacaauaacauguauauuauuuccuauuuuaucuaaauuaucuuuaaugaaaauagguuaucaaaguaagugaaucuguuuuaaaauauuugcauuuuaauuaguuaagaaggagugaaaaagugccauauaagauuuuaccguagucucuggauauuggaggcaacaccagaaaggcgauagauuccauccacgaugccauaucucucaaugaaugcugugcagcuuugaagaaccugcggcacuaaagagaauuuguaaagaaacagaugaaauuguaguauucacuggaaccaaaguugccaaaaaauaagauugucuuaguuuacaaaaguaaaauaaaauuuguaaauuaaaguuaaaaggagcaaaaauuaauccacuacaaaaaaugaugaggguauauuuauuuaauugcccaccuaaauuagauaacuaauuccugaauaaucaagacugguucuaugucaugauauuuaagugaguaagagaguucauacauuauuaggacagucuuucuucugcaguagacucauuuagaucauguuacaguuacacauuacagcaaagugaacuguuuaguccuaacaccaugccagauuuuuaagaaauacagcuguucagcugacuuucauauauagcaaaugaauauauaaaguuaaaugcuugucccaacaacauaauuacuuguaagugcuacaaaguuuugcuucuagaaaaggaucuucuauauuuucauaguuaaugcaaauucugacuuuauucaaucaacaaaacaccaauauaaugcaaagcccaaggcaauuucaaacagauggaaucuuguaauuuccuggccauauuuacauuaacuuuauugacauuuugacuuuauauuaucagcuuguaauacagggcacucucucugguuagcucuaugaauauacacuggacagcuaugcuggggcaugcaguauaaaacagaauuuucaaaauauaugauaaagcauuuuauaaccauucaaacauuuacagcagcugagaauuuaacaauaguuguuuugcaaugcagauugaugaguuuacagacuuuaguaugaucauuugauaggguuaauuaaaauccuugaaaagaaaugcuuggaaaauuuggucugcaaagagcuacuauacuagagaugaaacauucagaguggcaaaugaaacaaauaaggcauuuuaauaagauaauuuuagugaauguauuucauuaacaguauauugucauuccuuuauuauuauaaccaacuuuuccuugguuuuccugacuuuuauuguccuucaugcaauccaucuuuaaauucugucagauccuauaacaacauuuaaaacuuaaccucaucuuugauuaaaaaaaucaaaaaacaaaaaccagcagcugauaguauuaaguacuaaauauaugccaggcuaaguacuuuacaaugcauacucucugauuuucagagauauccuacaaggaaaguacuauauauucccaauuuuuacagagaagaaauuguaucuuagagagaguaaguuuuacccaagggcaggcaggaaacacuggcagaagugagagauuccaacucaggcaguccaaguacagagccaaugcuuuuguuuuguuuuuuauuucacacacacacacacacacacacacacacacacacacacauacauauaucuuuuuuuauuauacuuuaaguucugggguacaugugcagaaugugcaguuuuguuacguaaguauacacaugccauggugguuugcugcacccaucaacccaucaucuacauugaguauuucuccuaauguuaucccuccccuagccccccaaccccccgagaggcccuggugugugauguuccccucccuauuccauguguucucauuguucaacucccacuuaugagugagaacaugugguguuugguuuucuguucuugugauaguuugcugagaaugauggcuuccaacuucauccaugucccugcaaaggacaugaacucauccuuuuuuauggcugcauaguauuccaugguauauaugugccacauuuuucuuuauccagucagagccaaugcuuuugacuacugcaauauacugccuggcagagaaggccuuucauaauuuacauuuaauuauuauuguauuuccauauuccacaacccuaggccaagugaaguguuaccuuuugccauacaaaccaaccaugcuaugacuucuucacaaaacaauuuccucuagcuggacucucucccauaacgcucuucguauagaaaaaauucuuggcuauuguucaaaauccagguaaacuaucacucuuuagcgagccuucauugaauacccacaaguagagguggcugagcacuguguucuaugugcucauagaaaaauauuucaaaauuaucauuuauuuguucauacaacuauuacccuuuucugacugugggcucuucaagagcaaaaccaugcaucguccaucuuuguauauuuaaaacucaggaacaccguccugacacaauguauaaaauuagcaagugaauuaauuuaccagugcccugagagccugaaauggucauuaucuggucaaguuagcagggaaggaaccuuaguuuucauaugaauacauuuucaacuacaugcuuucuaccucuaaaaauauucaagacuuucaguaacaagaaaagguuaugguuauguaguaaagaugaagggcagguagaauugcuggguacuucuuguggauuuaauugauauuagaagcaaccucugugucgaaaugauaugcaaaauacauagcaucuuuauaaaagcuuggguucuauuucucacauugucccaccaaugauaaacuuggugucuuagguuucaauucuaaaaacuggaaguggaauaauaaaauuuggggcuacaaaauuucagucuucugcuucaaagggaauguauuuagagauuacugggauaauuaacaucauuacuuaggaaaauaguuaaaauucuuuccuguaaagcacugagaagaugcuucucauuauauaugcuccaaaugagcaugcugauucacccagguacacaaaagguuugucuucaagaaaaacccuucagagcacaguauuuuauuuccauauuaucaggcucuccgagcacacauaaauuuuucauaaaaauaagcuaccauuuauaaaaaaaaguaucgguaauuuucauuggauguguauaucuguguguuauuagauucauaucuguuuauucuuccaaauaaguaggaaaacauugaaaauauggagaauuagaggucuuuuccugauaauauguccaagucucuacacacguaauacuucauggcaagcaucugaaucguuuucuuauauuuuguguucccugaguagaaggacugaaugucuacacaaaaaucacauaaugagcuuaauaaauaaaauuacauaacuauuacuuauaaguuuaagggaaacaaaugagucauuuaauacaaauagguggcaaaaugaaagaaaagcauaaacuugaaucuugaagaaaaggagcaaaaacugaaaaacaaugucagaagaaaaaagaagaaaagaucuguuuuauuuuuucacgaaagaguaggaaagcaauauaagaaauccaauauauuuuguaaaaaaaauccuaguuuuaaaaaaaggcuauuuacuagcuacccccaaaccaucuaacaaaccagccaaaugcacagcgaauaaugacccagucaaaauauaacauuagaaaccuccaaaaugcuuccuccaaaagacgguaugacuuucagaaucauucccacauucuccacauaauacacuucugauuuacuuugauuuuacauucuuaguuuuuaaaauaucaucauacgacaacagaauaagaaguacauauuuaaauuaaaaucgaugauccuuuagauuagaauauggcuaaaagaaguaggaaguaaguaugacaagaauugaucuuugauuuuuuuuucuugacaguuuugguuucguuucugcucuuuucucuucauucauucacucgcucacucacucaucaaucauguauuuauuaagucucuucuauuuuccaggcaucaugaaagcauuacagauacagacgaaaaagcugaguuccaguuucagggagaugguuuccaggcuaaagggacaugaguacagugugacuuauuagaaugugcaucaugauucuaccuaauaugacuaccaaaaggauuaauuucugguguuaucugggccuugcuuuuuccuacugugcucucauuuaaaguuuugugcauaucauacaacacagaaauauguucaggcaacagagaguccucuccgaggguuucaaaauauuuguaauauuuuguaccaaacauaauuuuaccuaguuuucuauaaaacucucacuauuuuguuuuagugaucucaauucaaacuuuuaaugaaauucaguuuuaaauauguacaccaaaaaaaaauacuaacucuuaugaaaaaaaucaaugauaccagaaaaagaaauuaacgucacaucaccaccaccaccaccaccaccaacaacaacacaacauuuuaaagcuauagauaaggaugccaaaguaggcugcgggcaguggcucaugccugcaaucccagcacuuugggaggcugagacagguagaucaccugaggucaggaguucaagaccagccuggccaauauggugaaacccugucucuaccaaaaaauacaggaaaaaaaaaaauuagccaggcaugguggugggcgccuguaaucccagcuacucaggaggcugaggcaggagaauugcuugaaccugggagguggagguugcagugagccgagauugugccauuacacuccagccugggcaacaagagcaaaacuccguaucaaaacaaaacaaaacaaaaggaugccaaaguaaaugacaaaucaguauaaucuaugcucaaaaaaaguacuaugugggcagauuuuuauuuacuucuuuugugggcagauuuuuaaacaaucaguucuacaaauaacugugauauaauguuuaauacacucaauuauaaacaccgguuugugauagcuaaaacucuaugauaauccugauugaacagcagggaccacacauaaaagaauaaaaagacaacugccuugucaggcuccuaugugauuucuuacaacacuuuguacagaagacacaggucaaguuugucacuugcuccaacagagagguacucagaaguuuagaaaguauaauaagauaaucucccuauaaagcugauuuuucacuaggaaauauucagagaauuaaccauuuagcaaaacaaaauuuaaaaaaaauuuuuauuuuauauggaaugcuucacgaauuugugugucauuuuugugcaggggucacacuuaucucuguauuguucaaauuuuaguauaugugcugucgaagcaagcacauaaaacguaauuuugauacgagcuuccuucucagaaaaaucuagugcaagguuaauuuuauuuaggguaaagacacuauauuaaagucuaaacuuugagaaagaacaauuauauaugauauauaucaauauuauauauacuguaugugucucaucucuccucacaauuauguauauaauauauaaucauuuuuucuucauuuuauucuaauuauuuuagaguuuaaaauauauaaucaauucucauuguuuuaauuuagacuuuaaaauagucucuauauauauuuguauguguaaauauauacacacauaugauauaacugugguuauaggucauggacaauacauaugaagucuuuuuuuuuuuuggagauagggucucauucuguugccuaggcuggagugcuauggugugaucauggcucacuguauccuggaccuccugggcucaugagauccucccaccucaaccucucaaggagcuggaaccacaugcacgugccaccaugcccagcuaauuuuuuaaaauuuuuuguagagacacugucccuacaaaaaaaucaaugacaaaaaaucaaugauaccaaaaaacucuguuccacucaaauagauuuuaucauaauuagggaacagaugaacacuguaguuuaaccugcuauuuuucagaaagaagugauauaauagccucuguccuccccuaucauccuuaugaagaauggaaacauaacugaaacuucuaaguacaacuaaaauugaauugauauuugaaagcuaaugagcauggcaggacaaauuggaaaacucucuuucauuuuuuuuucuuuuuuuuuugagauggagucucgcucuuguugcccagacuggagugcaauagcaugaucuuggcucacugcaaccuccagcucccagguucaagcaauucuccugccucagccuccugaguagcuaggauuacaggcaugcaccaccacacccggccacuuuuuguauuuuuaguagagacaggguuucaccauauugggcaggcuggucuugaacuccugaccucaggugauccaccugucucggccucccaaagugcugggauuacaggcaugagccacccugcugggccucucuuucauauuaaugaucacaucuaagcaagguuuaacauguuacaugguguuaaacgugccauguugcccaggcuggucucaaaccccuaggcucaggugcucuucccuucuaggcuucccaaagagcuaagauuacaggcaugagccaccacacccagcccccuaugaagucuuaaaaucugaaaaaacugaaauuccucacauauucauuaaaucaaagacaaacuacuaaaucacucagcuauuaaaaaaccauuuuauuuccuaauuuuuaguuaauaaacuucaaagguuucccuucuccugcuaauuuaggcuucauuugaauguucaaaugaauauccuucuuaugaauauuuauucauuucuuaccaacccugaugaaacaggaaauuauuuuaauaugccaaguauaauauaucuggccuuggucuuugagguuucuagcuccuaaaguuuacugaauuucaauuacacuuuaaggucacaaguuaauuuuuuuucuagucauuugaguuuaacuuggcaaagagggauuaaucuuccaggauuauuaaauucauuucuaauauuccucuaauuuuuuuaauugaaaaagcaagacaacuaagaaaaaaaaaucucaacaauauucucuaauacuuuaauuauauucauuucucauaucaccuaaguauccagacuuucaaaaguuguaucuaccauuuauagauaauauuuuucagguuccuacacuguauucaaacuuauuuuauuuauuuauuuagagacaggguuuugccuuguugcccaggcuggaaugcaguggcaagaugauagcuuacuguagucuccaacuccugggguccagcaaucccccgaccucagccuccaaacuagcuagaaguaugggugugugccaccaugcccagcucguuuuguauuuuuuucuguauaaaugggguuuugcuauaugcugcccaggcugguguaaacuccuggccuccagcgauccuccuaccuuggccucccaaaauacuaggauuacaagcauaagccaucucacacagcucaaacuuaaaauuuuuaacagcuucaacauuuauagaacauuccccuguaugggugugguggcucacgccuguaaucccagcacuuugggaggccaagguggguggauugcuugaguccaggaguucgagaucagccuggccaacauggcaaaaucccaccucuacaaaaaauacaaaaauuagcugggugugguggugcaugccuauagucccagcuauucaggaagcugaggcaggaggacagcuugagcccaggaggcagagguugcagugagcugcgauugggccacugcacuccagccuggaugacagagugaaaccccaucucaaaaaagaacauucucccaaaguuggguauuucguuuucuuuguucucauacauuaugcuaugaugaacacuuuuauuucuauuuaauuauaacauuaagauaagucccuaaggauggauucauuagaugaaaggaacacuauaaagugucuugcuaugaaaugucaaauguuuuccaaaaagguagugcuaacucagaaccuucugaaaccaacgauucugaaccuauugguaaaaaucacuacuauauuuauggcacuggauaucauaauuuagaaaaauagcuuuguuauuuuaauauuuaccaaaguaaaaugguauuucaaaaucgccuaaagauacauuuccaugauuacaaauaaggauaaacauuuuucuguauuuuguuuauuauuuauagcccugugacaguuuaauguuuguaucuauucuccauucuuuuacucaguaauuaaaauuacuuuaauuuucuaaaaagucugaaaugauauucucauacacuguaauagcagcauuucaucauauccaaaaaaugauuauauuuccuugucuaugguaccucucccucuacacuguuauuuuucauuauaugaaaaguauauauauauuuaagucaucucuucauguuuuuuguuuaaaucugagaaagcuauuauuuauuuuaucucaaaacaaaaucaauucacauuggcaauuuuguaaguuuaaaaugguuaacuuauacauuugaaguuuauauucaguaugaugaagugugaauuuuuuucaaaacugcuauuuaauuaucucaguauguauuauaaauagcucuuccaugugacaugguucuaaaaccauacuuuuuucucacaauggauucuuauguacaguaagaacuauuucugaacacuguaagcuguuucacucacauuucauucucagcacaaaacucugccuuuaaaaagaaaauuuuuuuuuuuuggagacaaggucuugcuccgucgcccaggcuggagugcaguggcgugaaaucagcuuaccgacccccaccucccaagcucagaugauucucccaccuuggccucucaaguaacugggauuacaggugcguacuacuaugcuggcuaauuucuguauuuuucguagagaccaggucuugccauguuguguaggcugaucucgaacuccuaggcgcaagcuaucugccugccucagacucccaaagugcugggauugcagacgugagcuacugcacccagugaaaacucugcuuuucuaguuuugaauauuguuuuaauauauaguaaaacuagaugucucccauccuauuacugauuuuuuucuuugacauucucacugguugaguuuuccaugugcauuuaguugcaaaaguaauccucagggguuuuuuuuguuuuuguuuuuuuagggaucugcauuaaguugguauuaauuugggaauaacaucuguuugaaauaacauuuugucuacucucucaagaaacaugguacaguuugcauuaaauuccuaaguccacugauauucuuuaaacaaugagcaagaccuuaauuugaacuugauacuaucaacucaguauuauuauuauuacuuuaccauuguuuuucacuaauggucuucucaaaaggcacaauggguauuucccauacuaauuuggaauuucauaaucaccuauuucugguacuuagcaacaucacagguagauccugccuucaucuucuggcauuucugaaagagaugcuagaggaaagugcuauuuuuaaauauaaaaggaaaacuccuuuuuuucuuucccuccuauccauccccccauccaacaacuaaauucuugauucauaauuuaauuuauaaagaaaggaauauagauuccuauaaaaaauaaaauacagauucucuacaaaaguaaaaugaaaaauaaaaauuagccaggugugguggcacaugccuguagucccaguacucugggaggacugccugagcccaggaauucaaggcugcagucggcuaugaucacgccacugcacuccagcgugggcaacaaaucaaggcccugucucuuuaaaaacaaaaaaaauuggaagauugauuuuggcauuuuaugucucaaaacucugacaguuuuuuuuccauaagaagaauuagauaaauauuuuaggauaaaauguggguggcaaaacuggcugaagaagcuaucuagggagaaauagaaacucaggcaaaauaacagggugguuguaauauauuuugugugaauguccuacucuucccgaauagaacacgaacaucucuaaugccaaagugcauucuuagacuuuucauucucagcuccauccagaacugaguaccugagaaagcuuaguacaugcauugaacugaaaugaaacagguaucauuugacuaaaucuacuccauaauugguuauagcaaaccaauauggagaggucagaaacucagaguauaagcuugcacauuuuauuuuuaccuucaaaaccagaauuuagaagguguucccccaggucacaaccaaacacccucucuuucaagauuccccgcugcuucagcuucuguuuuguuggacgagacuucaugaauguucguaagaacguaaugagcuugccgugcuuuuuagacacuaaaaaucaauaaagagaaaagaucuuaguuguggcaagagguuacauuuuacuuagcauaaaaacaaacauaucucaagaggcugacagcaaaauaaucuauuaugaauauacuuuauaaucuuuaggaaaaugucaguacaaguuuaagcuaagaguuguguuauaaauaacaucauaauuuuguacuuucuuuuuguugcaggaagucagggaccuugaauggagggacuggcugaagccauggcagaagaacauaaauugugaagauuucaugggcauuuauuaguuccccaaauuaauacuuuuauaauuucuuaugccugucuuuacugcaaucucugaacguaaauugugaagauuucguggacauuuaucacuuccccaaucaauacucuugugguuuccuaugccugucuuuaaucucuuaaucccaucaucuuuguaaacugaggauguaugucaccucaggacccugugaugauuguguuaacugcacaaauuguuuguaaaacauguguguaugaacaauaugaaaucugggcauccaaaaagaacaggauaacugcaauuuucagggaacaagggagauaaccauaaggccugacugccuguggggccgggcagaacagagucauauuucucuucuugcaaaagcgaauaggagaaauaucgcugaauucuuuuucucagcaaggaacagcccugggaaagagaaugcauucccagggggaggucucuaacauggccgcucugggagugucugucuuaugcaguuguagauaagggaugaaauacgcccuggucuccugcggugcccccaggcuuacuaggauuaggaaauuccugccuaguaaauuuuagucagaccgguucccugcucuugaacccuguuuccuguuaaaauguuuaucaaugacaaugcaugcacagcgggacaugaaauuuuaucagcaauucuaauuucgcccugguccugugaucucgcucugcccccauuugccuugugauguuuuauugccuugugaagcaugugaucucugugacccacacccuauucguaaacacccuccccuuugaaaauugcuaauaaaaacuugcugguuuugcagcucagggagcaucacggaaccugccgacaugugaugucucccccagacacccagcuuuaaaauuugucucuuuuguacucuuuaccuuuauuucuuagaccagccgacacuuugggaaaauagaaaagaaccuacauuaaaauacugggggcugguucccccgauaucuucucaccaccuuaccuuaugagacugucagcaaauuuaaauguuguaacccaugacguuugaaucaagcuugguaaaccagucaucuucccaaugcauacuuaaggauguuacaggauuauaagaggaaccugaguuuuacuguaauauauuacuuuggagaucuuuauaauaaguaagacuuaaaaugguguaaaagcgguuugcauuucuugucaauuuuuaaauuauuuuacuugaugguuagaaauuuucguagcacuuguaaucuguugaauauaacugaaaaaagaaaacucuuucucauuuugcaaagaggacaaucccauaaugacacagaacacacuugucaaccuaauggcuauauaaauacaaaacacacacccacacaagcaucagauaguccauuaacauucgucuauaauauacuaaguacaucaucuuaaauccuuuauagaucaaggaaaaaggugaguaaauuaauauuugaaaaaauaauuccaccgacugauacauuagaaagacaacuaaaaaaacugaaaguaaaucccuuaaaaaugacuuuugcugagaagugcagcuuauagggauaauuaugcuaaaagucaacauacaacaauaucaugagcucaaagauuagcuguuagauagaagacuaagccagauggccuaaaucccccuacuaaguuugcagaugauuacugagagucuuacugaagccuacuauacauuuaaaaaaauuuucauggguacacaguagguauauauauuuauggguacguauuuugauacaagcaugcaauguguaauaaucacaccaggguaaaugggguauccaucccaucaagcauuuauccuuuguguugcaaaaaguccaauuauaguauuuuaguuauuuuuuaauguacguuuaaauuauuuuugacuguagucagccuguugugcuaucaaaugcuaggucuuacucauucuuucuauuuuuuguacccauuaaccaucccuauuccccacccccccaccauuggcuuauuacccuuucuggccucugguaaccauccuucuacucucugucuccaugauuucaacuguuuggauuuucagaucccacaaauaagugagaauguacaaaguuuaucuuucugugcuuggcuuauuucacuuaauauaaugguguccaguuccauccauguuguugcaaaugacugaaucucauuauuuuuuuauggcugaauacuaccccauuguguauauguaccacauuuucuuuauccauucaucugcugaugaacacuuaggcugcuuacaaaucuuggcuauugugagcagggauacaacaaacaugggagugcagauaucucuucuauauacgaauuuccuuucuuuuggguauauacccagcaguaggacugcuguauuguauaguaguucuauuuuuaguuuuuugaggacccucaaacuauucucuauaguggcuguacuaauuuacauucccaccaacaguguaaaaggguucccuuuucuccacauuuguuacugccugucuuuuggauaaaagccauuuuaacuagagugagguaacaucucauuguaguuuuaauuugcauuucucugaugaucaaugauguucaguaucuuuuauacaccuacuugccauuuguaugccuucuuuuaagaaauggcuauuuggaucuuuugcccauuuguuaaucaaauuauuauuuuccuuugaguuguaugagcuacuuauauauuccaguuauucauccuuugucagauggguaguuugcaaauauuuucucccauucuguggguugucuuuucacuuuacugauuguuucuuuugcugugcagaagcuuuuaaacuugaugugaucccacuguccauuuuugccuugguugcccaugcucgucugguguuacucaacaaaucuuugcccccucuaauuguccuggagauuuuucccauuuuuuuuuaguaguuuuauaguuugaggucuuagauuuaagucuucaauccauuuggacuuaauuuuuauauaaggugagaaagaggggucuaguuucauucuucugcacauggauauccaguuuucccagcacuauuuauugaagagacuguuauuuccccaauguaugcucuuggcaccuuugauaaaaaugaguucacuguagguguguggauuuguuucuggguucucuauucuguuccguugguccaugugucuguuuuuaugucaugcuguuuugguuauuguaacucuguaauauaaucugaagucagguaaugugauuccuccaguuuuguucuuuuagcuuaggauugcuauggcuauuauuuaguuccauauaaauuuuaguauauuuuuuucuauuccugugaaguaugucauugguauuuugauaggaauugcacuaaaucuguaguuuggucuggguaauauggacauuuuuaacaauauggacucuccgaauccaugaacguggaauaccuuuccauuuauuuguguucucuuccauuucuugcaucaguguuuuauaguuuucaucauaaagaucuugcauuucuuugguuaauuccuagguauuuuauuuuauuuguagcuacuauaaaugggauugcuuucuugauuucuuuuucagauuguucacuguugggauacagaaaugcuacugauuuuuucauguuaauuuuguauuugccacuuuacugaauuuguuuuaucaguucaaauaguuuuuugguggaguauuuaggaucuccaaauauaagaucauauuaucugcaaacaaggauaauuuggcugcugcuucuucaauuugagugcccuuuauuucuuucucuuuucugauugcucuagccagaacuuccaauacuauguuaaagaagagugguaaaagugggcauccuugucauguuccugauguuaaaagacuuccaaauuuucuccauucaguaagaugcuagcuaugggucuguaguauauggcuuuuauuaugcugacacauguuccuucuauauauauuuuuugagggguuuuaucaugaagggauguugauuuuuuuuuuuuuuuuuuuuugagacggagucucgcucugucacccaggcuggagugcaguggcgcgaucucggcucacugcaagcuccgccucccggguucacgccauucuccugccucagccucccgaguagcugggacuacaggcacccgccacuacgcccggcuaacuuuuuguauuuuuaguagagacgggguuucaccuuggucucgaucuccugaccucgugaucugcccgccucggccucccaaagugcugggauuacaggcgugagccaccgugcccggccaagggauguugaauuuuuauuaaaugcuuuuucagcauuaauugaaauguucauaugguauuguccuucauucuguugauaugauguaucgcauguauugauuuauguauguugaacuauccuugcaucccugggauaaaucccacuuggccaugaugaaugaccuuguuaauguguuauugaauucaguuugcuaguauuuugagaauuuuuugcaucaauauucaucagugauauuggccuguaguuuucuuuuuuugaugugucauuuguuuugguaucaguguaauauuggcuuuguagaauucguuuggaaguacucucuccucuauuuucugaauaguuagaguacaauugguacuuguucuucuuugauuaaauguuugguaaaauucagcaguuaagccauugaguccugggcuuuucuuugcugggagacuuuuuauuauaauuuugaucucauuauuuguuauuggucuguucagguuuuggauuucuucaugguuugaucuugguaggcugaacaugucuaggaguuuauccacuuauucuagauuuuccaauuuacuggcauauaguugcucauaauagccacuaaugaucccuugaauuucugcagugucaguugcaaugucuccuuuuucauaucugauuuucuuuauuugggucuucuuuuuuuuuccuuagucuggcuaaagguuugucaauuuuguuuaacuuuucaaaaaaucaacuuuuucuuuuguugaucuuuguuguuuuauuuucaguuuaacuuguaucugcccugaucuuucauuauugcuuuuucuucuacuaauuuggguuugguuuauucuugcuuuucuaauucuuuaaaauacauugcuaggguguuuuucuuguuucucauguagguacuuauagcuauaaauuucccucuuaguacagcuuuuauuguaucccauagguuuugguauguuguuucuguaaucauuuguuuccagaaauuuuuucaauuuccuucuuaaucucuucauugacucaccgucuuucaggaguauauuauuuaauuuccauguguuuguauaguuuccaaaauuccuuguuacugauuucuaauuuuagucuguuguggccagagaugccugauaucacuucaaugcuuuccuuuuuuuuuuuuuuuuuuuugaauacuuucagauuugugugaccuaacauguggucuauccuugagaauaauccacaugcugaggagaagaauauguauucugcagcuguuggaugaaguguccuguaaauauuuauuaggucuauuuagucuauagugcagauuagguccuauguugauuuucugucuggaagaucuguacaaugcugaaagugggaugcugaagucuccagcuauuauuguauugggaucuaucucucucuuuagcucuaacaauauuugcuugauauuucugggugcucuaguguugggugcauauauauuuacaguuguuauaucuuuuggcuaaauugaccccuuuauuaccauauagugacauucuuugucucuucuuauaguuuuugucuugaaaucuauuuugucuuauguaaguauagcuacuccugcucuuuuuugguuuccauugacauggaauaucuuuuuccaucccuuucuuuucagucucuguguaucuuuauagaugaaguguguuuccuauaggcgacaggccacugggucuuguuuuuucauccauucagccacucuaugucuuuuauugaagaguuuaguccauuuacauuugauguuauuaucgguaaguucagacuuccuccaaccauuuuguuaucuguuuacugguaguuuuguggucuucuuuuccuucuuuccuuccuuccugucuuccuuuuaguaaaggugauuuucucuggugguaugauacaauuucuuacuuucuacuuuuuguguaugcauuguauauuuuuggauuugaguuuaucaugaggcuugcaaauacuaccuuauacucauuuuuaagcugguaacaacacuguuugcauagauaaacaagcaaaaagaaaacuaacagacuguaugcuuuaacuucauccucuguuuuuaacuuuuuguuguuucuauuuauaucuuauacugucuacaucuugaaaaguucuaguuauuauuuuuuauugguuuaucauuuagucuucuacuuaagagcaguuuacacaccacaguuaguguuauaauauuccaugucuguguacuuacuauuaccagugaguuuuguaucuucauauaauuucuuauuguucauuaaugucguuuucuuucugacugaaguauucccuuuagcauuucuuauaggacaggucuacaagcugaaauuccucagcuuucauuugucugggaaagucuuuacuacuucuucauguuugaaggauauuuucaccagauauacuacucuagggcaaaguuuuuuuccuuuagcacuuuaaauaugucaugccacucauucucucucaaucuguaagguuuccacugaaaagucugcugccagauauacuggagcuccauuguauguucuuuuuucuugcugcuauuaguauccuuucuuuauccuugaccuuuggcaguauuauuauuaaaaugucuugagguagucuuuucuggguuaaaucuguuuaguguuuuguaaacuucuuguguuuggauagcgauaucuuucauuuugggaauucucuguuacuaucucuuugaauaaacuuucuaccccuaucucuuucucugucuccucuuuaaggccaguaacuuagauaugcccaauugagacuauuuucuagaucuuauaggcaugcuuaauucguuuuccuuuugucuccuuuguguauuuucagccugucuucaagcuuacuaaucuuucuucugcuugaucaauucugcuauuaauauauucugauauauucuucaguauuucgauugcauuucugaacuccagaacuuuugcuagagucuucuuaauuauuucaaucucuuaaacauaucugauagaauucugacuuccuuuucuguguuaccuugaauuucuuugaguuuccucaaaauggcuauuucgaagucucugucugaaaggucacacaccucuaggguuggucccuggugccuuauuuacuucauuugguggggucacguuuuccuggauggucuugaugcuuguggauguuugucagugucugagcauugaagagucagguauuuauuguagucuucagucugggcuuguuuguaccuguccuucuuaggaaaguuuuccagguauucaaaagaaguuggguguugugaucugcaucacaaugcaagcuguaucugcauuaguggacaccccaauucaauaaugcuguaguuccugcagauuuguagagguacugccuugguggucuucgauaagauccagaagcauucucuggauuaccggucagagacuuuuguuuucuucucuuacuuucucccaaauaaacaaagucucucucugucucugugauaagcuaccuggagcuggggugaaacaagcaccccuguggccaccaccacugggacggcacugggucaaacccaaagccagcacagcacugggucuugcccaaagcccacuguaacugcuaccuggcuacugccuguguuuguucaaggaccuaggacuguauaaucagcaggugguaaagccagccaagcuguguuguuccuuucaaggcagugaguucccccaggcccuagguggguccagagauguuguccaggagccagggacugcagucaaaagcuucagaaaucuaccuguuguucuacuauauugcagcugagcuggcacucaaaccaugagacacagucuuuccuacucuucucuccccuuuccauaggcagaggagccccaucccauggccaccaccaccacagggccacagggaguacugccagguuaccauugauguucacuuaaggcccaaaggcucuugucagcuuguggcgaaugcugccaggccuggaacuuauccuucacggcagugggcuccccucuggcccagggcgggucuagaaaugcugaccaagagccaaggccuagaaucagaguccccaagagucugcauggugcccuaucccacuguggccaagcugguaccuaaggugcaagacaaaguccccuuuacuuuucccaagcagaaggagucuuucaccauagccaccacagcuaggaauaagcuggcuuucacuugaagccagcauaucucagagucucacccauggcccauggcauacuacccagguaucacugcugguuauucaggguccgagggcuuguuagucugcaggugaugaggccugcuaagacugaguccuucccuugaaggcaguggguucccuucuggccccagguguaucuagaaaugugguccaggagcuaggcuagaaugggggccucacaacucucaccagugcccuuuccuaccauggcugagcugguauccaagaugcaagacaaaguccucuuuaauuuuccuucuucucuucccaagcagaaagaagggaucuguuuuggagucacaaaccguccugccuaggguaaggggagagguggcacaagcacucccuuagccacccuggcuggugucucaguaggucaugugccccucaaguccauuggcucugggcccaguucagcauuaagacuugccuaggaguugcaguccuugcggccuagacugcuuuucaaauuuauucaaggccccagagcacuuuagcuugcaguggugaggcuuguugcagcuaaguucugacggcugggacagauuuccccucugucuagggcugucuaaauggccccuccauggguaggcaucaccuaaguucaagcugguuuugcuuuccacugugacagggcagcacuggauucaaggcaaagucccaaaauuccuaaguucucccucaagagagagcacagauucucucucugugccacagggccacuaccaggggaugggggaggggguggcaaaggugauuuaagacuguuuuucuuacccucucuagugcuucuuucagcaauaggaagguaaaaucagguacuaugagugcucaccugauuuuugguuucuuugaggguauuuuuuuaugcguauaguugugaaauuuggugcuccucaaggggaaacaaucaguggagccuuuuauuuggccaucuuccuuugccccuccccuauuauacaguagugagugaauccaaaccuuaacauuccugaacagaugaagacuccugagggaaccuugugugccuagaguaacuuauggccuagauagaacacuagaugggcuauucuacacaagauuagacaucugccauccauuucuuuucauuuuauggaaaacauuauuuacagacauuagugucuuuuuuauagacuacacaaggugaccaaccauccugguuaguccaugacugacaaguuuccugagacauggaacuuuccaggcuaaaaccaguaaaagucuuggacaaaguaaaacaaagcaguuauucuagaccguaacacagauuaaaugaaaaaaaauuauuauuuucuauaccaccuguuaaaacuuacuugcaaucucaauauaauguugaugcuaucucugacauguaugcucugaaacucuggguaaauuacaaccucuguuguaucugagauuccucacaguaaaauuaaauuacaugcucacuuuucuacuaaugagacauuuauaguauaguugguuaacuucagaaguuugucacauauaauaucacuauauuaaaaguuacaggcugguguaauuauucuccucuaguugcuagcagauuguguauuaugaaucuuuguuauagaguggccaucaaaccauuuauguucauuuuuagacaucuuccauaugaacuuuaaaauaauuuugacaagauccgcagaaaacuaauaaguuugguuugcaacaauuuaacauuauacaauaauuuggaagaauuuuaauuucuauaauauucaauauuucuacauggaaagaguaugucauaauuuuucuaaaucuguuauuaucucucaaaagauuuuucuaauuuuccucauaaaggacacauuccacauauuucuuauuaggaauauugcuagguaacuuaauuuuuuuuucugcuuuaguagaauaacaccuugcuucaauuaugcccuuaacugguaauuacuaguaugcuggaaaacaauuuuuuuucuucaacuuuuauuuuauguucuggaguauaugugcaggaugugcaagucuauuauauaaacaugugccaugaugguuugcugcacagaucauccaaucaccuagguauuaagcccaguauccauuaacuauucuuccugaugcucucccuccccguaacuaucucgacaagcuccacuguguguuguuccccccaugcauccauguguucucauuguucagcucccacuuauaagugagaacaugcaguguuuaguuuucuguuccugccuuuguuugcugaggauaauggcuucuagccccaaacaugucccugcaaaggacauaaucuuguuccuuuuauggcugcauaguauuccaugauguauauguaucccuuuuuuuuaaucuagucuaucacugaugagcauuuggguugauucugugucuuugcuguugugaacagugcugcagugaacguacgggugcguguaucuuuaaaacagaaugauuuacauuuguuugggauugcugggucaaauaguauuucugcuuccagaucuuugaggaacugccacacugucuucugcaaugguugaacuaauuuacauucccaccaacauuguaaaagugcuccuuuuucucugcaaccuugucagcaucuguuguuucuugacuuuuuaauaaucgccauucugacuggcgugagaugguaucucauugugguuuugauuucuauuucucuaacgaccaguguuguuuguuggcaggaugagugucuucuuuugagaagugucuguucauauccuuugcccacuuuuuaaugggguuguuuuuuucuuguaaacuuaaguucccuguagacucuggauauuagaccuuugucauauggauagacugcaaacauuuucuuccauuauguaggcugucucuucagugugaugauaguuucuuuugcugugcugaaucucuuuaguuuaauuagaucccauuggucaauuuuugcuuuuguugcaauuguuuuugguguuuucgucaugaaaucuuugcccauaccuauguccugaaugguauugcccagguuuucuucuaggguuuauauaguuucggguuuuacauuuaaguuuuuaauccaucuugaauugauuuuuguauaagguguaaggaaggggucuaguuucaauuuucugcguauggcuagccaguucucccaauccauuuauuaaauacggaauaccuucccuguugcuuguuuuugucagguuuguugaagaucagaugguuguaggugugcaaucuuauuucugaguucucuauucugggaaaacaauuucuuaaugcauagcucacaucugaucauuuacuaaacucucaauaauuuuagaaggauauuaguugauucuuuugaauuucauggauauguaacugugucaaaguaaauauggccauucuagcuuuugucugauaguaaaagcuucugauuucuguuucagauuuuguccaaaacuuccaaaauacauguuaacaguaggcauuuauauuuugaugcugaaucugaugaaaauaauugucaaauuugguaacugcauaugauguauauaagaaagcauucuuuaaguaacauauuucuaagaauguuucaaaggaauggaaagugaauauuaacuauuaaucauuuagcaacaaaugaguaagugucugccauaaccuaggaacugcucuaagucaugagauuacgauggggaacaggagagacaagguccuugcugucacagagcuuacugauggcagacaaugaaugauuaaauaguaauacggauauagccagcauuuacuuuacacuuaguaugugcaaguaacuaccuaaguguuuauauuuauuaaucauucauuucucacagcccacuauuaggaaaauauuuauacccauuuuuagaggaauaaacugaggcagagaaugcuaaguuaaugugcccacugucacauaaccaggauuccgaaucagggcauuuagcacagaguccaaacucuuauccacuaaaugauacugccuaaaugaaggcaacaaaguaauaucagauuauuuauaguggcuaauaaaaaaauaaacagggugacguauuagugacuugaaagaaacugcauuaaacagagaguuaaggaacaguuucucugaggaagucauaucugagcuggaagccaugagagggguagggagccacgggacagugguaugaaaugaggcucaagggguauguaaaggcugggagcauaggccagaauagagaguuuacaaauaaacaauuuuaaacauuucaaaacauuuuaaaacacuggguuccuuuaaaaauaaccaaauauguuuaucagaaacccaaaagagcauuaauagggaauugguugaauaaauuaugguacaucugcacagaggauuauugguuggcuuuuuuuuuauuuuuaaggaggaucucuaccuacugauagggaguaaucuucaggauacauuaagucaaaaaagcaaagcagagaacagcauauuuagcauaagaaaggaugaggaauacacacaucacacacaaauucacccacacaaauaugcauguacaugugagcuuauuuuugcaaaaagaaauacuagaaggauaaacuagaagcuaauaaaaauggguuaaaaacaacagguggggaaaggguaaaggguaagaauaggaugugaaacuucccugaguguaucuuuuuuauauagcuugacuucugaaucauguuaauguucuuucuacauguucaaaacuaaauuuaaaauauuuaaaaaaggaccacgugcuuagugggauauauucuaaggaccaaaaaacuccugcaaaguaauauuuaacuucauccaacuccuuuacuauugguaauaauauugguaacaacuuuauacauauugugggacaaaacaaagauuuuccaugugagagaaaaugagauacaauuauaagaucuaaaagguuaagaagaaaaaccuguaaugucaacuuugacuuggaaacaucaacaugaacucaugauuaaaacacucacacacuuuccugaagcucuauccacuuuaaaaggcuuagaaauaaugauauauugguugcaaugaagaccucuggucucagaucuugggugcuaaauaaaauuccuuaucaaaacaaacccagaaugcaagucagaagcaggcaaagcagaagaugagaauggaaagcuugucacagaaagcaaggggaugcccacagcugagggaucccugagucagacucuuguggacacaucugggacgauccacacaucauaaagaaugguuauaacugaucauaaaagaucaaauaaauaaaaauccugagucaguaguaauaguauccaaaagaaagaaagggaaaaagugaccauuuucaacacaaaugaagggagaacauuuuuuaaacugcagcaguagucugccauauugaacuaggcuucucaacaguagagaaaagaacacauucauuuccuucacaucgauuagcaauuuuauaacuggaauuauauacugaccaauaaacauacaucuucacaauucagugguaagucaacggaaacauauuuauaguuaugauccuccaaacaaacucuacuacacaauaacaccucacuagucaaaagcagucugugcacaacuggacuucccaggacauuagguaacugacucugcuucuugguuuggcaaguuuagaucaggaacaaggaaacguggcuaucuuuuccuguuaggguaaagaguauucauguuuauuuuuccuaaauagugacacaaggcgcaauuaaguaagaguugcaacagagcauaaaauuaagauaauggagggugucacuggcaacucugugcccccauuuggcacuccagggcucugggaaacugugcugacauacgugcagcucuggcuucuacucugaauggccacuuugcauugucaccuuuccacaaaacauugcuacguagauuagaacuucacaucuaaacugggugugugagugggagggguggauauggucucuucuugcccaucuacaucccaaucugagacacugaaauaauggauauucauaauggugacuagucauaaagucuuacgugauuccaaaagccuucaaaggaagauuaaacuauguucugcauaguuucagcgcugcuggugauguuauuuuaauuggacuccucuucauugugguagacaguaagaaguucuggcauacauaauuaaauaaucaauuauuuaucaagauagauuaauuucccugccuuggagauuuaaauaaaacuauucaauuuaauuauacucaaauuugaggaucuaguaacacuuccaaauauaaaucucuuaaauuaguuuucuucauuuuaaacuuucuucccauuucuuagacauuaaaguaaccaaaaagagcuuauuugggacacaagcacugauccccaccuguugcuuuccuguucaauauuacuaguuacuaccuuuugaggaggaaaguaucuaauacuguuaauucuaucagaagauuucuacugacgaaggcaggaugugggguuagaugauuaagugcuuacaaacccauuucuacagaacacuggcaagcaaggcugugaggauuaagguccaccaaacauccuggauuagagacacuaaaaugauaccaaugguauuuccacagauaaaauauauaaaaaauaaaaugcaaacaauacuuagacaaaagcaaaccauacuacuuuguauucaaauuuccuacuucagagcuaaaauacaacaugugccacaauguuauuuagacaugacacacuuuauauuugcaaucuuuuuuuaaaccaaagacaaacccuaccaggccagucuuuccaguaguuaaaagccuuugcaguaugacacacgaccuaguaucuccaagguaaaucuuuaugauaccaauaaccaguuuauagagagauacuaaaaaacaugcaguucguuaagccauagugaaccuuggcauggagaggcagggcagugcuguuuaauuacaccagcguaauacuuccccagcaaucccaacgaauucuugcuugcucauaauacuuucucuaaaguucuaggaauugguucccagaaauguucuagacugacuuaagauaaaucugggcuuggauuaauuucugaggguguauaggaaaauggucugucccaagauaauggccucagcaguaaguuuauuugauuauauacaucaaauuuuaggaaagguaaaaaauucacaacgucaaggagacaaaauuagaauguaguagugggaauauauuaauaccugugcagauuguucugauuaaaccaaagguauaauaagguaugacuguaauguuuaacauguccaguggauuuuuacagauuguauauaauauccugucuuuuauucaaaguucccaaacagauuagauaaccacuggguagaaauuuaagugaggagaauacaaauacaggcaacuggauuacauaauguuuaagguucucuuauaaucucacaaauucuaucauucucagucucuguugcauaccuuaaaguacuuuauguuaaacagauauuaaaagauuugaauuuuaauuuaaaauuccauaaauugcuuuuauuuaaagcacgacaauauaucuauucacgcuaaugaauaugaagaaagaauuuuucucuagacaacuaucaaauccauuuaaugaacuaaaaauguucugaaaauucugcucuucaaaagaaaauauaacaaauguuaagaauuggaaaaaagugcugaaacaaaacuccuauuguauuauaccuaguuuuaaccugacuacuauuuaaaagccuacuggcuuaaugcuuaaucagcuuuguauucacauaagucucuagagaccaguuuuaggauacacuaacuggaaaacacgaccagaagacacaggccugggguaugacugcccuggaaaaucaggagcuaacguacugauagaaaguauuagagcccaaugucaauguacuuauuuuuaaaaauugcucaauacuuugauuauacagaaauauuuaagagaauaauaugauaaauauccauguccucaucaugcagguuuuucaaaucuuaacauugugccacauuauuuccucagauuauuuucccuuaaguauaaaagauagagcugaagccacuguuuccgcaauccuauucuccuacagagagaaccuguauccugaauuuagcauuuaucauuuccauccauguaacgacauacuguaacgacauguguauguagccauaaacaauacuaacauuuugcauguuuuucaaauucagaaauggaaucaucugauaucaaacuuucugcaaaacuguguauucugagauuuauccacggcacuugugguucaguauaucacuuaaacuacauuacaauauucucuuuuaaguauauaccacaacuuauauuuccauucuccugcugucagaguuuacaaguguuuguucuuacaauccugacuacacuguauaaucugguaagugucucccugggcacaagugacaggacuucucuggcacucacguuuaggaggaaaauuguuggguuauagaauaugcuacuuuucaaccauauuucaacuuugcuaaaauauuaucuaaaaugauuuaucaauauacacucuaauuagauguauuuuucaguccucauucuucaaaucuuuguucuacuuagcucugucaaauuucugaaauuauauuucacuuuaauacgcauuucugugacugcuaaucagaauaggcauuguuuucauauguuucauauggccauucaguuuucuucuucagugaaauaacugaucauauccuugcccauuuuucuauuuuguugucuuuuucuuacugaugaauaagaauucuucacauaauacagaaaugaauccuuuacguauuauaaagacugacuccaagucuaugguuuaucuuuuauugcacaaauuuuuaaaugucuuuagguacagaaaucauucuguacuucaagagauuuuccuuauaagucauaaacauauugcccuauuucuucuaaaaacuuuugcuuuuucauguuuuuuagggagagauauauacuuuuuuccauauguauaaucaacuauucugccaucuuuaaucgaauaaccuuuuuaucacugaauuguaagacugauucuaucuuacgugaaaaaugcauauagcauguaagacgucuguuucugaguugucucauuucucucuaucaauaccucacuuucuuaauuuguaagucuuaacuggaaagaugagucccuucauucacuauuauuuucuaaaacugccuuauuuuuagccauuucccauuucacauaaauuuuagaaucagcuugucaaauuagaaggagaaaaaaaacuuuuuggaaucucauugaagcugcacugaauuauagauuauuuuggaggacagacuucuuuaugauacugagcuuucuuuuccaugaacauaauagaucucuccacuuauuuacaauuugcuuauguccuucaauaaauuguucaaauuuccuuucauaaaagucuuacgaacuuuuguuguagauagucuuaggaacuuuaugacuuucuugauguuauaaaaugguguuuucuaaauuacauuuucuaaucauuuauuauugguguacagaaaugcaauuagcaugguugcaaaggguagacucaggagucagaccucugggguuccaaucuugccucugcagcuccuaacgguaugauuauggagaaauauuuaaauucucaguauuucauuuuccucaucuaugaaaaaguuuaggccaggcaugguggcucaugccuguaaucccagcacuuugggaggccaaggcgggcagaucacaaggucaggaguucgagaccagccuggccaacauggcgaaaaccugucucuacuaaaaauacaaaaauuagccgggugugguggcgggcaccuguaaucgcagcuacucagcaggcaggagaaucauuugaaccuggaggcggaggcugcagugagcugagaucgugccauugcauuccagccuaggugacaagagcaagacccggucucaaaaaaaaaaaaaaagaaaaagaaaaaaaaaguuuaaaauaauaacuacugaacagcauuauugugagaauuaaaugaguuaaaauuauaaagcacuuagugcuagacagaaaaacuuaauaaaugugcuauuguuauuuuuguauuauuuaucuuuuauucagcaaccuugcugaacucuguuauuauuucuuaaaauuugacuguagaaucaucuggauuuauaaaucugcaaauaauacacauuugauucuucccuuccaauccuuuuaauucuuuuugucuaacuucacuggaccuccaauaaaugccucucuuguuccugacuuuaaauagauuauuucuuauguuucaccauuaagaauaaaauucacuuggguuuguuggguagaaaccuuaaauauacagaaauuaccuauccccaauugcuaagauauauaaaaggaacaaguguugaccuuuaucaaaugauuucucuccaucuauuaagcugauauuuuaguuugucuuguuuaaguuuugaaugagguacacuaaauuuguaacuacuuucuuuucuugcuucugacuuuguuuuuuauuauuauuuuuauuuauuuauuuauuacuauacuugaaguucugggauacaagugcagaacgugcagaaggcuugcuuuuaugcuuuuauauuuuuaaauacuuuuauacuccuacuuuccuuguauccuuugcagugacauaaaugagugcaauagacuugaaaaggcaaguggcaauuuaaaaaaauaacagccuuaagccagggcaaaguuccgucuuagcaacuguaauaaauguaagaauacuguaaacauauuagaugugaacuucuaguaaaggaagacaaacacagaagaacuguauugggugaaagcaccaagaaagaauggaaaaacaacaauaggcaucagcaaauaccuuaaauagcagcaaagaaaaaugacaucgauuuacaguuagagucuuaaguaaguaguugaagugaacuguguacuuaguauuuucaaauuuauuaaaaggaauauugccaagaguuguaaaacuaaacuuaucuuuagcaagcauuguuauaugacccaaaaggaucuuuaggcaacugagaaaguuucugaaaaacuuuaguucgcauucaucuugggaaauaugugauaugaaucuuacucagucuauagccuugauuauaucaguuaaauuaguguaagcuuaaccaacaaagcuuuuauuuacaaauaacuggacucaaauuaaucugugauucacuagaguaauaacucuacaaaucuuuuaaauaaaaauuuguagguaguugggcaagauuucaauaugcaauguaaauauuaaaggaacugaacaaauacuuuuuccaauaauacagaaauauuacaaguauucuauagaaaaauauacccuuuugaaacuuuuccuuuuuauaacacaaaaagacuuuaacauaaauaaggcuuucauaucauuaugacuaaugauauaaaaguucuuuaagccaaugacuaaaaauacacaugaauaacucuggcgauguguuuuuccaguuuuacaaaaaauaucauucaaaucagaguaaagggguuucuugcaaaguaaacccagccaaguuuuguuugauggaauaaggacaugcugaagaaauucugucacugacuauuccuaucucugugaaucuucuggucuguuuugugauagcucugcccucucucuggcaccacccacugaccugcucccaguccuacaaaggcaguaugaaggaaaagguaaauccuaacccagauagucaacaaaaauugaaggaaaaucuagaugcuacaguaauaccauaacgauaauuauuguauacauaaugauuauugagugcuuacuauuuuacugugugccagggcuuuacauguauuaacuaauuuaaucuguuuguauuaacaucacauucaaaauaauucacauucaaaauauaaacaagucucuaaucauccgaauuaccuccuuaaaaguugauaucaaaagaacagguauguuaaauaaauucuaauuaucucccaucacauucuguguaauaacuuaaauguaauaaguuaucagaauuacaaaacuuuauuccuuuccucucuucuauauaucuauuucuaauuaucaagauaauuuauuauucauauuucaauucauuuucuuuaguuuauucgguaauauccuauaauaucuaaauacacaguugugugugugguaaaaacauguaguaagcauaaaauguuagcaauccuauuugaagauuuaaaaauacauccuugaaccaaugaccuagucauugaaagcuuuuauuguuuuccaauaauaagacauauagucuaauuaaggucauccauccaaucaugacaucauuggcuaagguaugugcuagugaaaaaguaccagaccaagaauguggagagacaguuuuaaucccgauucugccaauaacucacuauaagauuuuagaaaaggaaauuaagcaguuuagaccucagauuaguaauaugaaaaaugagaaguuuaaccagacaauacgauucuagauuuuaaugaaaauaccugagaaaucauaaaguacucugagaauguaugaagugucaauagcauacaaagcucuaaaaucuaagaaacauaccuuuaguuuagggaaauuuaucaggagaaaaaaagacaucauuuaaaacgucauuggagaacuuugucaaaaaaaauuagguucucuaaaucaucuuggaaaaaggcugguauaaaaauuuaagauaaaaaaaucacuguuaaagguuauuaagcauauuagguuuaacacuuuuuaaauuaauuuuaauuauuuaguuccaugaaugcuuaguaguaauaaggaguccuuacauaacuaauuuacauaacaugcuuauaacuguuucuuggacuugaugcuuguacuaccuuuaauugcuaaggacauucacaguugcuggucaugccauaugguauacuguuguuuacuucuuuauuugcuugcaaguccuuggucaacaguacaauggucacuuauaauauucuuuguauuagaaaaugccacauacuuuauaaaaauuauuuuuugacauagguuucaagaguuuacugcaguaaaagaaaaauaagguaaauaucaucuguauguucugaacuucugaaaacuuauaaucuaucagguugacgcucacaaagcaaaauucucagugucucucuaggaaccacuuuuuaaaaucaggaauauaacaguuuuucagccuugggcuucauuccccacuccuaucccaaguauaugucaaaaauuuuuuuuagauaaauugagucuugaauuuuaauguacuacaaagcuauuguagaguaggaaaguacagaaucacuuuugaucaauauaucacaaacaacuuuggaaguaagaggaaaaaaacacaguucuuuaacugauguauauaacagcugcaagggcugucucagaaaagcuaucugggaccggaucaggaauuaaaugaaacaguuugcuauuccaaccucaaaggaauaaaaccaaguaucucagaaauucauauacaugcaaggccacauuuaaaauagcaccacuaguaauggcucuugacugaaaaaugggaaagcuacuaacaguuauauaauucaaacaggguucuaucuaauuaugagagaagaguagacauuucaaaaggcauuacugacuggaaugcaaaugaauaacauuaagggaucuagaaaauaaaucuguaguagauuuuagaaaagaaucuuuuagacacagaagagguaacaacaauucacugagagaaagagagcagaaaaugggccacaaacugcuucuucagaauauccagcacaacucauguugaauggcauaccaaugguuaacuaaaauauugggauauuugaauaaaacuguaucucuucuccaggguuaaagaugaaaccaaagcaacaucacuaugcugcugcccuuccuagaggaguacacaaacuguuacaacacagaaccugcucaugcuagaccuuuaaaaaucauaguucccuugggaaaauggucauacgguuaagauaagacuauuauuaucuacauuacacacuuacuuuucuagaagcuacagauuucaguuauaaauaucaaagaagguucaaauuuagauuauguuauuuuagguugauauaaauaaguuacaccuuuuuccugcuaaaagugauacuaauuuuuauuucgaaauuuaaauuacaaauuuaaaauaauaaauacgauugguucuguuucucgacuugguacaaaaucaaaguaagaaguauuuuuaacuugcugacuuuaccaccucgguuauuauauaagagacuaugacuaauuucauuucuaaaaacagaaaaggaagauuugcauuuuaccagaagcaggaggaaaaaacaugaaguagauauaaauuccugacacuuaaaguauuuuaaaauuggaaugggauauuauauacagaauauagauuuuaaaaccugcuaagaaauuuuaaauugucugggcucuuauuuuuccaggaugaacuaguacuacuugauaagaagcuuaaaagcuaguacuaucucaggaagacaugcuuguguauucuuacaaaaauuaaauauaacacacacaaauucuuaggaauucagguacaucaaagguaacaggacuaccaaaauauacauuaguucuagaaauuggaaaacuuagaaccuuaauuuuaaugguguaaaaacucucuuuugagauaaauuuuugucagauuaaauuguaaucacauguacuuuaaugucacaguccucugcacuuuauuaagcuaugaaguuugguguggaacuuugauacuaucagaggugguuuuugauuuuguggguuuuguuuuguuuugcaggaaguagaggggaaaguuucuauauuuggugaguauggaacugacaaugaguucuuguuaaagaaauaggcuuuggaaucagaccaaaggguuauaauucagucccuaaucacuuuccaguugcaagaucuugagcaaauuaccuauuuaagucucaauucuuucacucacaauggaaaugacccuaacaacagcucucacuaagguuacuaugaugcuuacaugaaguguaugugccaaacauuaaauucugugucaaucaauaggagcuauuauuacuacuacaauuucuuguuacauuucaucugaaaacuuugagaaucccugagguacagggcuaaccagaaaacugacucagcuuuccagaaccuggaaucuggcuaucuauccuggaaucagcacugagaacauggcaucacuuucuaguccuuccugcucuaauuuucuuaaauauaaacuuaaccuaagacauuuuagauuucuaucuuccacuaaaugccauauagcauucuuuuuuaaaaaaagaaaucauaguucaaaccauuauuauaugagcaguagaugcuuuuuuaaaaagcugacuaugaaaaugagcucuaaauucugaaauucccccauuuaugguuuuaaaaauuaaaauauugcugucauuuaagcacuagugcaacaauccuggaaagaaaaauguucaaccucuguuaagaaguugaacauacuaaucagcccuauuaagggcugauuugugauucagagaaaauucuggucuccauguuauuuuaaugaaaggcauuuauuaccgaggucuaaagaaacaccauauacauacggaacaccaccuuagugguaaaaucucugagauuuaauacaaaauauuuuauggauggagaugguuauccuuaccaaugccaauaccaaagaggcggggaagaaccauacuugaagggaaaaggccagaaagguuacuucuucgugcaaacuugaggagccucuuuacacagucuaccaaauuauuuuaagugcauuagcacugcccauuuccauuaaucaauaauugaaauauuauuaacccaccaggaaaaaaauuaaaaagaugauauaagcuggcugcuuaagaaauaaaggcagguucuuuuaaucauaaaaacuuuuauuauauuaaacuaauguauagaaaacaagaaauaagcugauuggaaauaggagaaaaaaagauauuucuugaaaccgacugggaacaucuguguuguacaaucagcaaagccuacuucaaaaaguauaaacuuuuugacaaacaugacaaauacuaauguucaagugcugaauuucuagauaauuaaauaauuaaccauuuaccuaagagagcaaccaagguaacaugugcccaaauauaaucuaaacauaguuucagugaaaaauucugaauguugcuugagucaaauauuuaaaugacugauugagaucuccuuaccucuuguugugguacaaguuuuaagaucaauacuuaaaauuauuccaaaugacuauauuuagcaguagauucaucaggauacaacagcucugcauuccguacaagaguguagaaaauaaaucauaauccaacugguuccaaccucaccaccacagguuaacuucaaguuaggucccacaucacugccggguuccagcuguuuucaggacccccugcagcagcaguuuucuuggcccuguuuucaguccagucaguggagcccagcaagccagcaagugugugggagagcucugccuccaggagcuuaauccuccucucucagcacauacugcuuugcaacaccacagaaacgccccagccuaaacucacacuugcagaacaggcuucaccagaagagcuccacccaucaaccccacacaggugagcacuuccugcucagaaaacaccaguaugaaauugauauuaaauuaugucuuuucucuuuuuaaaaguuaauugcuuuucaguuguuugcuaaguaggugggagacaguguauccaauaaaaaugauagcacuuuaggcuccuuuaaaauaagaaaaguaauugaucaaguaggaaguacugccaguaaaaggcugaaucacuaaaacaacaggauaggcugagaaaacaaaucuuuuaauaucuuugcugauacugagcuaagauuguuauucuacuaacacauuuuuuuaaguaucaacuuacacagucucugugugaaaaauucuaagacaaucucuuaugcaauuauuagggaaaaaaauaaaaaagguuucuucagaaugggaaauccagaauuaaacaaguuuucccaaguacaaccuucuccuucauacacuacacagauguuaaauauguaacucuccuucacccauggagucccaagguacuucuuuuccucuaccagagacauucauuagcaaaagugaaaaucuuuggcaacuauuaucaaacugacaaucaaucucaauucgugacuuuuuaaagcuuuaaagauucuuauuaguuauuugcauaaauacaauauaaauacugagauucaauacuucuacuaaauaauaauacugaacuguguuaacccaauuauguauuuauugaagaaacaaaugaauuggaaaauauuuacauauuuuccauuccaaugacuuuuuacuaauauuaauguaaauucuacccucagguauuuuuuaauuuacaaaauaauguuauagcacuuacuaugugccagacacaauucuagguauuuaaaaacauuauuuauccuaaucuaaugaaggcaguucuauuauuaucucaucuuauagaugaggagacuaaggcagagagaugaagcaauuugccaaggucccauaacaguaacuggcaagagaugagauauccagggaggauucaucaugcaccauuccaaaaucuucugcuguugauugaauuuauucuuuccuuccucuuugaacauagcucugaacauagaauuguugauaaaugguaguccacaauaaaaaacaauaaauuuaugugauuuuaaaauaagaaagaucauagagaauuccaguauguggcaggaacaaaacauuuugaucuuuaccaaugggacaucugcagauuauugaauuuagcugaauaggaaacaaggcucuuaaaauuuacuccuauuggagaaggcaaagccacucuucuuuucuuuaauuuuaaaugaauaacaucucucccucccaaccucuuccuuaguacuaaagacagcaagggagggcaagggaaaaacaaaagagagagaggaagaaaaaagagaaagaagagaaggagggaugagggaagagagugagaaaaaagaaaguacauauuuuuacuguagaaaagccauuugggaauacuuagaacaaucuguaagccccauauauuacuuaacuuauaaacauccauguuuauguuauguaauauauauguuaauauauauuauuuuaucauauuauauauaacauauuauuuaaguaauauauguuauauuacuugacauauauauuuaaguaauacauguuauuacuugacauauauauuuaaguaauauauguuauauauuacuuaacauauaaacauugauaggaauaacuguauuccacaaucauuggccugugugugggagauuaaugaugauaauucucaucugaaacccaaaaagcuguacccuaaugccauauaaaaauacaugguaagaaaaagagugcugccaaagcuggugaauuuggaguaaggucugcaucuaguuaacuguauugugaccauguuguuuccugguuuugauaauguacuacuauauaguuauguuccaacuaggagaaauugagugaugaauccaggggaucucucuguacuauuuuugcaacuuccucugagaucaauuauuucaaaauaaaaagucaaaaaauauaauugacugaaaagaugcugugccaucuagugacuguguaggagaggucacuuguuuuucucucauauuuaacaaaauguuuggugacuaucccccuauuuuggacuaggauguaucuuugcaugggugggagaggcaaaaggagaauucacuggaaaaggaauggcuuuauucuaaucauucuaucauaaaaacuacuugaguggggcugggcacaguggcucacauuuguaaucccagcacuuugggaggccgaggcaggaggaucacaaggucaggaguuugagaccagccuggccaauauggugaaacccugucucuacuaaaaauaaaaaauuagccgggcaugguggcgcaugccuguaaucucagcuacucaggaggcugaggcaggagagcaggagaauugcuugaacccgggaggcagagguugcagugagccaaguagcgccauugcacuccagccugggcaacagagugagacuccaucuuggaaaaaaaaaaaaaaaaggccaggugcaguggcucacaccuguaacaccagcacuuugggaggcugaggagggcagaucacaaagucaggagaucgagaccauccuggcuaacacagugaaaccccaucucuacuaaaaauacaaaaaauuagcugggcauaguggcgggugccuguagucccagcuacucgggaggcugaggcaggagaaucucuugaacccgggaggcggagcuugcagugagccgagaucacgccacugcacuccagccugggcaacagcgcaagacucugucucaaaaaaaaaaaaaaaaaauuaccuggaugauucaaucccuucacagcaugucugcaaauucugccagcuccauggccaaaauauauccagaagcagaucacuucucaucacuuacacagcuaccauacuggucuaagucaccaucaucucucaccuggcucauuucaacagccacugccagccccucuucuucuaccuaucucugccuuuccucuuaacacagcaagcaaagugauccucuuaacaagaaccaaacaaaaacugcucaaagucuuccacugccuacccaacuaauucugaauaaaagccaaaaccccuauggugacacccaggccccagagaagaucugaucccucuccccucuugaccucaucuuaugucuucacccacugcucuagccaaccuggccuuccuccugacccuuuaccaagucugacacacauucaacucgguaucauuacaccugcuguuccgucuuuggaaagcucuuccuccagauuacaugcagaucuccccuccucaucuccuucaggucuuuguucaaaaguagguuucuaaugagccauucccggaccacccuacccucccuugaaaauuauaaccccacauaagccacuucucagcauuuccuagucuuggcauccgucucucagguuuauuucucuucauugcccuuaucuaucauacuauauuguuuauuuauuuauuuacugcucuccuucuagucacacgugaauacaaacaccaaaaugguggaauuucugucugguguguucacuguuuuagccauagcacuuaguaugcacucgauaaauucuugaucaauuaaugaaugaauaucggaaauggccaaaagcggaaaagccucuuuacucagggcaagaaaaagacugauuagggggcuacucccagcacugacuaaagggcauauggguuuaggaaacauuuuugguaacuauaaugaaaacuguucaugcuuauaauuaccaaucaagaacuguuuuggagcauccauauaaaagacgcaaauuacuauaaaauacaacaucugccaacaaacaaaaccacgcagguggggaaaaaagacauauagaaagugaaguaucaaacucaaaauuuuuuugagagaaaugaaugugaacucaggugggcugaaugcaaauucaaguuugucaaagaguggccuagggaaccuucacacaaaaaaaugguaagucagucacaagcgagggaagggggaagcccagaguaccuugggaagagaguaaggaaacacguuagugaagcugaauauagguaagaaauggggggaaaaaauggcugcaaagauaaguuaguuccacuauuugugaaacaccuucaauucuacacugaaaauuuuguaucuaauucuggcauagagggaggauucacccaaauauucugaagauaagaguuacaugaugaaagcuguacuccaaaauuuuaauuugauaguaaauacuaggauggauuaauucaacaggcauucguuguguaaccacuacacacacagccuggggaggagaugaagaugaaugacauguuugucacuuaugaagaaaguacaauuuagugaauaugugaaauaacugcuauuaaauuugcacuaguggacuagugguggagaggagaugggauuagggagaggugggucagggaagcuuucauggaagaaguggauucuggccugagucuugaaauauaagcaggauuucaacuggccaaaauggggaaggcauuucaggguguaggaacagcaggagcaaagugaaagcuaugaagccacaugccauguucagaaaacacaaggagauuccagucaaguacacagggagaaauacuauacuaagaaaauggaaaagaaugacuggaaaugcuacaauguaagagaguuuggggauauuuuuuaugcauagugaagaaaaauuaaaagauuuuuuuaaauuaaaguggcauuaggaagggacgaugacugaaaacaaaauuagcaaauuaaguagguuccuauaagcaauucucuuuaaccucaauucagcccaucuuuugcccuaauuucuguucuguuuauauaggccuuauaaaaauguaaacacauuuuauuuacuccuauuguaguaaaagcaaaaggaauuaaauuuuuguuuugacagagagaacaaaaaucuuuaugucuauucaagguucuauagugggcagaauucuggguuuugcauuaacuaccugcacacaagcuaguuaacccaugucaggugcauggcacagggcuuggugcgcagucagggauauguaagcgcuggcugugauuaccaucaggugucaggagauuucagcaaauccuacuugugaagccucaggcaggugucuuaagcuuccaguugcuccauuuguuaaaaaaggguaggggccgggcacgguggcucacgccuguaaucccagcacuuugggaggccgagacguguggaucaugaggucaggagaucgagaccauccuggcuaacacggugaaaccccgucucuacuaaaaauacaaaaaauuagccgggcguggugcaggcgccuguagucccagcuacucgggaggcugaggcaggagaauggcgugaacccgggaggcggagcuugcagugagccgagaucgcaccacugcacugcagccugggggacagagggagacuccgucucaaaaaaaaaaaaaaaaaaaaaaaaacggguaggaaggggaggggauggaaauacauucccuaucccuagcaagcucacaggguugugaccagauucauguccaguuuaaacaauggaaauguaaguauucauaaacccuaaagcacuuuauaaauacaugguauuauaaauuuucuguuuuccccugauacagagugagaaaauauuaucuugaucuauccuuugcaauguauuuggggagaaagcuucccaaggcacuuuagcauuuuaguacuccuuugacucuuucaucagugccucugaagguagggauuuuaacaaucugauucuuaacacacuuaagcauuuguucaaugggaagcauauucauauucggugcaacacuccaaauagaguaaguaaaaaccuggaccucuuuuaguugacauauaaauguguggucacuucuuacuaaagugacaugcaaagaaacauggcuacaaaagagcaaaaaguguuggaaacugaaaaaagaaagaaaauagaaacaauccaggagcaagcaagugaaaauuuagaacaaaacaacuggaauuagguaauacugaauguaaaauaacauaaaaagcaagauacuagaggacugguuuccugaaacaacacuacaaauaaaagcccggcugguccaaaguuacugaguuaucucaauagauuguacccaugucaguuacagaucuauuucccuguucuacucuuuucugucuucucacacaugcacuuaacuagucuuaaagaaaaaaaaaaggucucagcuuuaauguauaucuguuaacaaaaaaaaaguuaucuucaaauaaaacagaaauuugugaugcaaauucuuagaccauucaaagaagcuccuucccccaccaugguucugugaaaacuacuguaaugaauguuuccuucauguacugugauauaguuuagauauuuguccccacucaaaucucauguucaauuguaauccccagugcuggagguggggccuagcaggagguguuuuggucacaggggcagaucccucauggcuuggagcuguacuugcauagugaauacucgugagaucugguuguauaaguaugugguacucucugccacucucucuugcuccuacuccugccacaugaggugccugcucccacuucgcuuucaaccauaaguaaaugcucccugaggccuuucuagaagccgagcagaugccagugccaugcuuccuggacagccugcagaacugugagccaauuaaaccucuuuucuuuauaaauuacccaaucucagguauuucuuuacagcaacgcuagaauagacuaacacaacugugauaucuuggcauguagauuuauaucaauaaauaguaucuuaaauaaguaucuauauaaauuaaauauaguuucugauacucaugaauuuaaauaacauaguaaauaaacacaaaucaauaaauaacaguugacauucacuaaguauccaggggucuuaaguaccuuauccauaaucuuugaaauaauaaucuugccucacuuuucaguuauggaaauugaaaaucagagaggccaaauguguauacccagacaauaaaauguggcauagggauugaacccaagguugccugagcuuuugucccuuuaacccugcugcuuuucacacagguauauaaauuuaacaccugcauuaaaucuagugucacuaguguccauuuuaugggguagaugcauuaagaaggaucuuagaaauuaccuguuugggcaggguagaguuaacaggagauuacaaucuauuucuucauauucugcaaaauaauacaugcucauugugauacggacaggagaaagggaaacacuggguagaagaggguggucccuggcaagggccacacucucaagccuggaccuaugacccaaagugagaacaugcauuccuguuucccaccccuacaauuguugccuuuuccaaaaccaccuuggccugacccgcuccuuauccugugcccauaaaaaccccaggcccugccagcagagcaguagagccguagagcagcagagaauaagagaagcagccggacguuugagagaagcagacugacuucagagggagggcucgacggcaggacuucagaggagaguucagcugggcauggucaaacuccaggggaggaccaccuuuccacuccauccccuuuccagcuccccaucccucugagagccacuucuaccgcucaauaaaauccuccacauucaccacccuucaauucauuugcgcauccugauucuuccuggaccccagacaaggacuuggauacaagugcaagaggcugucacacugacccuccacugaguuaacauuugagccacccauggauggcaacgguaaaagagcacacuguaacacaugcccucuggggcgccaagggucguggguaacuucuagaugcugccaugggccugcacagaguucugcuccuaccaguugcccagaggugcucauccuugccucugcacccacucaccugcgugcugccccugagcuuugaauccugcaaaggggccaagggaacuauuccauuucaauuauaaaaaaauuaaauaauacacaaccaaauggagaaaaaaugaaauguuucuuacugucuccauaaucccauuccccuuugcaguuacguacauagccuucuagauccucuuucuaugaauuuauaaugggauuuuacuguucugugauuugccuuuucauuuaacaauauaucagagaaaaaguucucugguuuaguacauaggcuucuacuuacuuugugguggaugcaaaguaauuuacaguauaaaaguaccaaaaguauuuuuugaaaauaugauuuccaacauuuguguauuaaagcaauacugcaaagaauauucaucuggauggaaaaaauauuuuuuaaaaaugcaaagugaccaauucaaaaauagaaagagacuuaaauaggcauuaauccaaagaaaauauacaaugggcaauaagcacacaaaaagaugcucaauaucaugacauuuccguauaauucccaccuggaucaacagaacauuaccaguacuccagaauccucucuccugcccaucccaaucacugaccuucucuuuccucuccaaagguaacugcuauccuaaguucuaauaccacagagcagucuugaacucuuaggauuuugaacucucuacauguauacaugaaacuuuacaguguaaguguguauaucaggacauucaauacuauuuuuugugagauucaaucauguuguugcaaacaguuuuaacucauucauuuuuacugguguaggggaauuuacuguauauaucuucauuuauucauuccaccauguauacacccauaaguuuugccaguuuuuaacaaauggaaauaaagcuguuaucaacauuucuaugcaugugucuuagucuguguacaugaaucucuauauacaucuaaaaguggaacugcuggguuacaguuguguaucaacuucaauagauaaugccaaugauugucccaaauuaauacucccaucaucagcauaugagaauuccuauuaauguauauucuugccaaccuuagauaucauuauccuuaaauuuuaauuauucugguuaaguauguacuaaagagucaauaaggcuucgaucugcauuuuccuaaagacucuuuacaacuccuuugucagauacgcauucugcaaauaucuucccacacuguaaucugcccuuucacugucuuaagggcauauuaugauaaaguucuuccuuuuaauuguuuaauuauuaagcuuuucaguuauaauuaauacuaugucuaaagccaaggucauaaagauauucuauaguauuaucuucuaaaaguuuuauuguuucgucuuucacauacagauuuguaauucuccuggaauggauuuuuguguaugggguuaaauaaggaucaggcuucucuuuuuuuauauucagauguccagcugacucaguacucuuuauugaaaugacuguucuuuugaaacugcccuccaaugccaccuuugucauaaaucaaguaucuauauagacacagguuuguuucuggacucuauucuguuccauugaucuauuggucuaucuguacacaucuauaccaacgucguaauuagugaagcuuucacaauauaucuugacaucuauuacaguaaguuucccacuuuuuuguucuucuaaaucgucuuugguauucuuggcucuguauuuccauauacauuuuagaaucagucaucaauuucuacauagauuccaacucaaagcuuggggcauuuuucagcaacucugucuugauggguucugaccuccaauuuuuguuccccuagcacuaugaugaccuccucuacuccaucagcagauauccuaggggaauaaugucuccauaugcaggggucacucuucagauuuccuucuguuucaucaccuuaucacaauaauugcuuacaguuuuauuaacucucuaaugcuucaaagauauguuuuuauacuucugucaaaauuuuuuaacuguccucagagggaagguugccuaaaucacuagucuuuuauuuccagaaguuaaugccucaaaauaagcucugcuugcuuuucuucucuguucuccauuucucccacucuuucccucuucucucuucuaucccccaccccuccucuuucuuucuuucugguggaaaagguggaugaugcaaaaagauggggaauuccagcauagcaauuauuguaaaaagaccauuuagcuuuaugcgagaaaagaaaaauacgagaauugaagaauguguuagguggccuuaagagaagacugaccacacauagcagagugaggaaucacugaacuugaugauaggacaacagaaaguauccaaacugaaaacaaaaaaaaaaaaaaaagagagagagaaaaaaagaaaacaggagaucgugccacugcacucuggccugggagacagagcgaaacugucucaaaaaaaagaaaaagaagaaaaagaaaacagaguaaaaaaaaaaaaagaaaaaacagagucugagaucugugagacaauaucaaauaauguaacugauauguaaaggagaggagaaagagaauucggaaaaagaaauaucugaaaagagaauagcuaugaacauaaagccuucaagaaaagugucaguaaauagcuccucagugacuugcaagcaaaacaaacacaaagaaaaacaugugcuuccccuuccaccuuuccccaccuagaccucaucuuccacuauaucaugcccuagggugacugaauaaaaugacaauuucuuauagacaagcuucccccucuuuuguuuccucuccucucucucucucucucucucuaucaaacucuuaccuucuuuuuccuaagguaccauggguacuuucuaucuuggucaggauauggugauuaauuuucuguacacacaaauaauugaacauauuaauaacauuuaagaacagauucaaagagaauauuuuuccuauguuacccuuguuguguaauaguauaggaacuugaaauuuucagucucaaacuauagcuguaucuuucagauuuggcaucuaacagugacagauggcaauguuaaaaauaaauagaacauucaaguuguuuauaccguaggcaaagacaguuuuaaagugugaaacaagcccaaggcugacagaauucacaucauccuuuucaaaauguauuaagaauguacauuuuggcuggguacaguggcucaugccuguaaucccagcacuuugggaagccaaggcaggcggaucacuugaggucaggaguucgagaccagguggucaacaugaaaccucaccucuacuaaaaauauaaaaauuagcaggucguggcggcaugugucuguaaucccagcuacucaggaggcagaggcaggagaauugcuugaaccuggaaggcggagguugcagugagccgagaucacgccaccgcacuccagccugggugacagagcaagacuccaucaaaaaaagaaaaaaaaagcacauuuccuuaugccaacucugcaaugcugcucacagaagacaaaauacuagcuuuugaagguacgcuagguuuuucuuggucauucuuaauuuagaaauaacaaugcuaugcaggucuacaaauacaaaccuguuuuccagaacuaucaauaacugauuaacuuucccaaugcuaaaugguucuggagguuaucccuacuugaagugucauuucuccauucaaaacaugagaaugggccaggcacgguggcucacaccuguaaucccagcacuuugggaggcugaggugggcggaucaccugaggucaggaguuugagaccagccugaccaacauggagaaaacccguuucuaugaaaaauacaaaaaguuagccgggcaugguggcauaugccuguaaucccagcuacucgggaggcuaaggcaggagaaucgcuugaaccuaggaggcggagguugcagugagcugagaucgcgccauugcacuccagccugggcaacaagagcgaaacuccgucucaaaaaaaaaaaaaaaaaaaaaaaaaagagagaaagcacuugauugauacuaacacaguuuauuuuaaugccaauauuaggcuaaguuuuaaaaacccaauuuauaguacaucugagucaauacuaucaaagaugagacauaauaacuaauauaaguuaagcuuacaccacagaaagauggauaaaaauaugugcaggaaauuaaauguuugauguugaauuuuaguaacuucaaaauaaugaccauaaaaacccauuauaaucucaacagaugaauaaaagccuuuggaaaaauuccugcacucuuuuaaacacuugacacacaagaaacagaagggaacuuucucaacccugauaaaggacaucuaugaaacccccacagcuacuuaaugguaaaagacuagaugauuuccccuaaaaucaggaacaagacacggaugcuuguacuugagauuuauauucaauauuguauuagagguucucacaaggaccacugggcaagaacaauaaaaagacauccagauuggaagggaagaaguaaaaaguggcuacuguagauaccauaaucuuguauauagaaaaucccaaggaauccacuaugaaacuauuagaacuaauaaacaguucagcaaggcuucaagauauaacaucaacauacaaaaauuauauuccuauggacuugccaugaacaauaagaaaaugaaauguuaaaauucccgguacaauagcauuaaaaagaauugaauauauuuauaaagaaauucaacaaaagauauauaaaacuuauacucugaaaacuacaaaauauugaaauaaauuaaagaaugucuagacugacugggccuaguggcucaugccuauaaucccagcacuuuuggaggcucaugcgggaggaucacuuaaggccaggaguucaggaccagccuaugcaacacagugagacauugcuacaaaaaacuaacaaauuauccuggcacaguggcacaugccuguaguacuagcuacucaggaggcugagguggaaagaugccuugagcccaggaguuugaggacuugugaacuaugaucacaccaucgcacuccagccugggcaacaaagcaagacacugucuccaaagaaaaaaaauuaaaaauacaaaagaauaucuaaauaaaugaaaaacaucccuuguucagggauuagaagacuuaauacuguuaauaauauuucccgaguugaucuacagguucaauauacucucuaucagaaucccauccuacucuguagaaacugacaagcugauucuaaagccauaaggaauuacaaggggcccagaaaagccaaaucaacccuuaaaaagaagaaaaaaguaggaugacuuacacuuccccacugcaaaacuuacuacaaaacaacaguaaugaaaacaggguacuauuggcauaagaaaacacauauagagacugggcacgguggcucaugccuguaaucccagcacuuugggaggccgaggugggcggaucacgaugucaggaguuuaagaccagccuggccaacaugaugaaaccccaucucuaucaaaaauauaaaaaucagccaggugugguggcacacaccuguaaucccagcuacuccggaggcugaggcaagagaauugcuugaacucaggaggcggagguugcagugagccgagaucgcaccacugcacuccaaccugggugacagagcaagacucugccucaaaaaaacgaacaaaaaaagacauauaaaucaauggaagaaaacuggaaauucaggaauaaaucuagggucaacugugucuagggucaauugauuuuuccaaggguaucaagguaauucaacaggaaagaaauaaucuuuucaacaaacagugcuagaacaauuggauaaccucaugaaguuggaccccugccucaucaccauacacacaaauuaacuuuaaaaaaugggucauagacuaauauguaacaucuaaaacuguaaaccucucagaagaaaacacaggaguaaaucaugacuguggguuagccaaagccuucuuaaauaaggaaucaaaagcauaaaugacuaaagaaacaucaaaaguaaaaacuuguaugcaucaauggauacuaccaaagaaagucaaagacaaaccacaaaacaggugaaaauauuuguaaaucauuauuaucugguaaagaauuuguaucuagaauauaugagcaacauuuacaacucacuaaaaaaaacacaaauaacccaauuaaaaacugggcaaaagugggagguugagguggaaggaucacuugaaaccaggaguuugagaccaaucugggcaacaaagcaagaccucaucucuacaaaaaauuuaaaaauuagcugggcacagcggcaugcacguguaaugucagucauucagcaggcugagucagaaggaucauuugaggccuggaguugagggcugcagugagcuaugaucacaacacugcacugcagccuguggugacaaagaaagacccugucucgaaaaaaaaaaaaaaaaaaagaaaaagaaaaaagaauaagcaaaggauaugaauagauacccuccaaagaagaugaacacauaaccaauaagcacauauaaaaugacuaaacaugauuagccaaaaacaaaaugcaagucaaauccacagugagauacuacuucacaauuaagaaggcaauaaucaaaaaaauccaaauaaaaacaaguguugacaaggauauggagcaacuggaagucucauacacugcugguggaacugcaaaaugguacaguuacaccaauggugcagcuggcaguucuucaaagauuaaauauaguuaccauaugacccagcaaucccacaccuggacauauacccaagggaaauuaaaacauauccacauguaauauuguacaugaauauucagagaagccaaaaauggaaacaacuccaaaugaauaaacaaauaaaauguggcauaugcauacaaugaaauguuauccagcuauuuaaaaagaaggaauuaaaacagaaguacugauacaugcuacugcacaggugaaucuugaaaacacuaugcuaaguaaaagaagcccaucacaaaagaccacacauuauaugauuccauuuauacaaaauguccagaauagggaaaucaauaaagacagaaaguagacaagugguuguuuagggcugggagcaguaugaggggagcaguguccgcuaauggauaugggauuucuucaugaagugaugaagguguucuaaaauuaacuguggugauggcugcacaacccuguuacacaauuuaaaggguaaauugcacgauaugcgaauuuuaucuuaauaaagcugaguuuucaaaaaguuaaguuuaaaauaacgccguauuuuuaaaaagaaugaaaucuacaguuacgaaugaagauuuaccaaacaaguacccacuuaggagcuuuuuaaaaaaguuuacccaagaaggauaaaauugcuucaaaaagaacugagaauccugacucaaguagaacugcagaaaacacuguuuugaagcauuuucucuacugaacaauaaaguuagucuaaaauaaacaaauuccaaugagagaaaugggaacaaugauucccuagucuccugugaagaaauaagcuuugaaagguauuauuaaccuuuacuuaaauacuauuagcaaagauuguuggauguaagcuuugggagcagaagugggaaaauaccaaaagaguaaagaauaacuguuuuuuuuuucuuaacucuuacauacagguccuaaaacuagaaaauacuaucauaagguaaacaguucaaauuaauucugaggcccagaaauuuuuucuucuccuuuuauugggaggugggaaaggacagaagaaauguaauauagcuaggaaaaauaaguuggaugacucccucuucucuccaaagcuuuuuagacuuuguuugaauuuuuuuuuaaucgacaucaucaaaaaguuucagaugaggcauucuguugaaucuucccaaaacuaaaucaccucaauaaacaccgaaauucacauuuucuugauuuuuauccccuucaacaaugcuuuauuuguaauauauucuagauauuuaugcagcacuguaaguauacuguauaaguaauaagaaaugcuguuuaaaauaguuuugauguucauaugcccuguuaaaauauacuuacuuuucauuuauuaauuuucaguuaauccuacaauuucuauguuaguucuuuaaaccuauuuuuuaaaucauuuuauucauuaaguuacaaugcuauuaugcaacuauaaaaguaaauaaugacaaagcuuaauggagcaauugccuaaaaauuugagugcauguaaaccuuuucaaaaugaucaacagagauauaagaauacauuuaaaaaucaaaaccauauaaaauuaagaauguuaauuauuaugccuauaaaugcaaaacuagcaaaacaagcuaaauacuugacugacagaaaaucugugucuucaagcaguugauaaaauaacuacacuagugaaaaaaguguacucaccugguuuuggcacugaguuggucacugacuggggaacuuuuugguuaauuaacucaacacaguguccagggaagagucccaccugaugaaaagcaacaaagaaaggauucuaaaccagcaaacagaccaauuaugugaacacugccaacugaauuccaguaauguauucuacagucccucccaaaugauucuauuauuccaagacucuaaauaacagaugaugccaauuacacaaacaaauaauaaaacaaucuguugcuaugaguacauaaaguuaucuguuuuauuuguccaaauaucuaagucugcuuuuuuccuuuuaguuuuuaauuucccaaucuuuuuuuacaugaauuaaaauauuuagucugacaaugagcuaugcaugcaaguagguaaaauuuuauaauuuaauaaugcgcuuuacugaaaucucaauccaguuauguugauaccucuguugccaacuuauguuuauugacuucucuauggguuuuuuaaaucaacacuaagccacaacucaaacuuuuugugaauuuucucuucacucucucccagguuucauaaaaaaaaaaaaaaaaagacaugacuaaaauaaauguguaaaauaaucucucauuuaaaauccugguauucacugcuuuuaaaaacuaguagcgcauggaaaagagggaaaguaagagagaagaaaacagccaaucucagcagugucaacagacucuggcuuugaggaacacaccacagugaccuaguagcagaaccgcaggcauugcuuuuggcauuguaacaagccguauuaggaaaaugcugaguuccagaucauccagagauacuguauagccaaaaggauaaauaccgagauaaacagccuggaaacaaaagcaaagaggaaaucuuuaucaauauuuauagauguuuccuuagauaaaaauauaaaugggcugccaugcagcagauguuaaagcugaaauaugaaagcuccaucacuuuguguaucccucuguugacagacucuggggaagaauggaauaguuuuccaaggguaugauucaucaccaaguucugagcuguauaauuuccaucugugugaaauuauuuucacauacucauuugcuacauucuuauuucaauuucuagauccauauucuaugguaguuguuaaaauugugaagauauaaaccaguuaucaugagcugaaaagggguauuaacagauuaucaguuuuuuuguuuuuuguuuuugagacagggucucauucugucacccaggcuggagugcaguggcacaaucuaggcucacugcagccucgaucccccaggcucaaacaauucucgcaccucagccuccugaguagcugcgacucugggcaugcaccaccucaccuggcuaauuuuguuuauuuuguguagagaugagguaucauuaucagacuaucaguuuuguucacaagaugugaauuugggauuccuaugcacugccuuccaaaaugaugcuuuagguauuuguuuuacuggugaaauucuuuaauauauucuacucaacuuccuauuuuacggaacaaguagaaaugcuuccaagacugauuagaaccagguaagagucaacuuaaaaaaaucuucauuuuuuuuucuuacacaagucaguuaugagaggggauaugggacaugguuaacagcguagccucaaguaaguguuccacccuccauaaaaggguuuggaaagcgauuauaaaagucucaggucguaaauuaaacaaauguauacaaaaaugcauuuguaaauaaucuuuguuuuuacaagucuuugcaauaaacugucaguuuggucuccagcagagagagcuggaggaguggagcuuccagauguagucuccggugugagucccagcaauggagaccuugaugcuaugagcucuggagacucucaugaagaggacuuggggggaugaagaagugacugggaaacugcucaugccgaggagaugggaggugcccuggaaauagcugcuucaggaucuuaagccaugacggauagaauguuaaaagucauuccacaaagugguguguuucaaugcaaaggcuagagaacuguaaaaaggugguuaccaaggcugggaagauacaacuauuucaagagugacucugaaaaagauccugaugccuugagguacccuucugaaauucaaguaacaauguacaaauaucugccuuguuucagaauuuauggaguauacaauucauguuucuaaaagagccuaccugcagcugguuuccacaucugaaauuauagugcucuccaagucacauagcuggaaauuaaauguucaaguucuaccuuggccccaauuugauguuuggugcucucuggauugaguugaauuauguucaagcuuugcaauuucacuugugguaaaggcucuaacauuuucucuuucuaugcaaauuucuuuuuuucuuuuuuuuuuuuuuuuuuuugcgcaacggagguucguucuuguugcccagucugaagugcaacgacgcgaccucggcucacuguaaccuccgccucccagguucaaacgauucuccugccucagccucccaaguaacugggauuauacgcgugcgccaccaugcccggcuaauuuuuugcauuuuuaguagagauggguuuucuccauguuggucaggcuggucgugaacucccaaccucaggugaucuacucaccuuggccucccaaagugcugggauuacaggcgugagucaccacauccugacucuaugcaaauuucuugaaggagaauugcuugcauauuucuucucugccuucacagaaggcagaguuucuuucaaacuuaacugaggcaucaguugcucuuuggcuguuucuuaccaugauuauuaacaauaaguuuguggcuuggguuugcaaacuguacuguuuguugcacugaucuucccauauaguaauuuuuaguuggugaaaaaaauuaacccucaucugaaauuaacauaucaguuuuuuuaacuagucucagauuuuaaaacuugcaauaaaguggaaacucauugguuuuucuugcccuuucgaacucuuguaauugaguuuucaucauguuuuauauuaaaguguuuuauauuaaacaaguuuucaucauguuuuauauauaaagcuaacacauggcuacaaaaaagaaguaucuggguucaaucuuaagucugccacucacuagauuagguuuguaacuuagccucuuuguguuuuaguuucuucgucuaaacaugguaauaauaaugccuaucucauaagggauguuaugagaauuaaaugggcuaguauaaauaaaaugcauagaguaaaaugcauugauuuguuaacuaaauggucuaguaacaacaugaucuauuaacuacggcagccuguuucguacauuauucuuucugcagccguggcaauuucuaaagcuuuaacccauuuauggcagagguugcaaaauuuuuuugugaaaaaucagaacuuggcgaugaccuugagcaguaagauauaaauaacucccacaagcuuagcguuccaauaauggaacacuaagcauaaauggguuaaugcauaaguaaaugcuauuauuaucccaguauuuggcuaccagaacugcuagagggcucuagcuccuccaucaaauggauauuacacaaaaugccaccuuuuggauauaucugcugaaguuuccugacucucaaauaucauucuuucuaaaacauucuaauucauuucaauauauaaaaucugcaacugccugagagaaaaguccagauucuaaacuuggcucacccauuuacuagguucugugaucuauggcaaacugcuuaacaucucugucuuaguuuccuaauuuguaacguuagggauaacacuaccuauaccucaaagaguuuaugugaaaguaacugccuaguuucuaaguucgaguaucuuuuggcaaaaaaaaaaaaaaguuuuccaucacuucccacaaagacugaacaaagagagcuuaaugcacuucucagggaacuauaucacauacauuaguuacauuuucaccuuuuaaauucaucacaaugaauuagguuuagguauauggggaaaugccacugcauacuauacagagguagaucuacaguaggcucaccuaauaccuaacuccaaucccugcccucuuguuuuacuuuaucauaaguguaauaucacuaacuacuagcuaaacuagacaguuucccagacucccuauauucaggcaaagccgcaacacauguaaacacagcucugcuacuauccugucuccuccucugugccgugagcacaggugucaugacuagaucugucguggucaucacuugaccauaagugaaaagcugagagaaccuuagagacuccugccuggcaucauuaagcugcugacucagcacuagaaauccaucaucuuuuccgcucaguuuuuuguuucuugaagccaaaaucacuccuaaacaucaaggagucuuuuaaaagagucaguucuaugaauuugugaaaggcaaacagauuccauuuuaccaucacaaaauuuucaugauaaaaaauuguguucucuugaaaauauuacacacgagaauggaacuaacuuuaaaaguacaguuaaugaacacuuauacuuuucuaaugaauacuucaccuaagauuucaccaaauaguaacaauuuugauaaaaugucaaaugguaaaaagugacuggaacucugaaaauaugaucuauuagcuaugucaucuuguucuguaucuuauucuuucugcagcuguggcaauuucuaaagcuucaauuuacauggcuggaaagggagagcagaauuggguauauuggcaggggucaaaaugagauucaacuccaggaagagaauggaagauggagaaaaagccagcaucuagggcccaugacgguaaagaaguagguaauaaaaacacaguaauagaaggaaaagaacaauguagagacagggcuggaacagguuaggaauggucuugaaaagaggagaccucccuguugacuguuuucacucaagucuuugaaauaaagcaaaaagccaccagacaugcuaaucuauaccauggugugcugguaaauguuuaacaacuagcucuccacgggggaaaggccuucauuuccaguguuuuccagcgcccaccguauacacacucccaucauggcugguuucaagcuaccaacuugauacaacugaacacaaaauuggaaagagaagcagaagggcacucaguuauacaguauugaaagcauacagauagaguagcuggaaauaacuucaagagcauaaaugguaaaaugugguaaaauaauuacaaaauauauuugauuauuaccuuuguuuuuaauacaauucauuucauuguaaauauauauaccuuaauuuuuaauaauggcuguuuuuaacaacuguccuacaaaauuucacaguuggcuccagcugaccacugauguauauucauacacuucguccugcgccuauccaccucuaacagcuucugauaaucaguuucuaguagcuuagcaagcauauggcucacccucugacucuaggagaaccaggagagauguaaagggaacagacuguaaucugguucuucugaucuucuucuaccuuggggaauacucagacuaaaaagaaaacccgguuuggcuucuaaagugaguguaugugcugaaaaauacuuugguguaacuuaaaaggaauauuagagaagaaacuacugcaauaaaauaagccuggagcuuuggaaacaguagaguuaacaacagaaccuaauccuaacuauagucucuuugaggcaaucaacaaaaaccuaaaaaggaauucagcauaacgaucaugugcuuaucgcugacuuaaaaaaaaaaauucuuggccgggcgcgguggcucacgccuguaaucccagcacuuugggaggccgaggcgggcggaucaugaggucaggagaucaagaccauccuggcuaaaauggugaaaccccgucucuacuaaaaaaaaauacaaaaaauuagccgggcaugguggcaggugccuguagucccagcuacuugggaggcugaggcaggagaauggugugaacccaggagacagagcuugcagugagcagauaucgagccacugcacuccagccugggugacagagugaaagacuccgucucaaaaaaaaaaaaaaaauucucuucuauugguuuauuuauuuaauuuauggcuagcgaaucuuuagcacuguuggcguagccaaacauuuuucaaauuaaacuuaguagaagcacugcucacuccucaaaauauaucacagauuuuucaauuggaauuauuuggccucagaguguuaaaacuccaguuuuucauuuucugacuacaacuuccuauccucucaggucucuaguguugauauucuauaacaacaaaaguacaaacagagacaucccauccccuucacauuuccccccaagguacuuauccccacaauuccagguuuuuuuuguuuuguuugcuacccaauauggacccugugauugagcauuuguuuuaaaucaguacccuuuaauuuccuugcaauauuaacuuccugccaaaccaauccagcaaaccaccacaacuaaaucaauucacuaccauacuugcaugucuguguacugcuggagaaaaaaaaaaaucacaucacuaaggagauuugaaccaauacaaauucacaggcuauuguccagaaaugccaauuauuuucuccccacucccgaaacaugcuuaaagaaccuaaucuucuuuagagucucugcccagucugacuaccauggccugccaacaccaucccagcacaguugaucaaauagacgguaagucaaugagucaauuaguuugucugcuaugauuuuggaacuaguuccaaaucuucaaugaucuccauugaauuguuagaauuaggaaauauuuuuccaaacaaagaagagaagagacaaagaaacaacaguugcuacacaccaaaggaagcaaaaaccagaaauaaguuccucagguccuuacuuuuuagcucugguuccauuuacuuauagccuaguaauucuuguauugggcucuuugagauauuccuaccaauucccccaccccccacucuccuuguaugucccccaaaagcacaacauugcuucugguuucuuugccuuauuuauacuguccccuugaaugucaacucccuaauuuccauuuaaauaaaaaauuacucuugcagccggauaugcagguuugagagucaaaaacaaagcuaaagaucaggacauaaaucugagaguugggcauaaauaugguuuuuaaaguugagaaagugaguaagauagcaagggacaaagaguguagaauaagaaggcaguccaacaccaaacgucagaggucuaguagaggaggguguccuggcaaaggagacugugucaagucaguuaagagaaaaaagucucuggaaaaagaaaaucagauacuaaugauaguuuaaguaaggaguaguaaaguaucuauuuuuuuuuuucauuaagccaaacagagaccacuagugauaaaagagaagaaccaaagggugaaggguuuaagaauauauuugugacaggugaauguaaucaaggcucuagaaucuacacuggaaaagaaggauaguaaaggcaagaaguaauugaugggcaaaaacugggaggaacaguggaaugauaauacuaagcauaauacugaauauugaacauaauuguuuauuguacagcaaguagcugaggggauuaaauuucuuuucccaguugccauaauacaauaucaaauaagacaaacuagauuacgguugcuuuaaaguuuuaauuaauuuguaauaccuuucagccuuggaaggaguaagaaaaggauagaguaggcauuguaaguggaaagacacauagaaaaaaaagacacaagaguagaaaaaagcaacuuguguacuaagaggggaaauaauaguuacaucuggcagaacauccaguuucuaaaacagagcagugcaaaguaagacugguaagugagaauaaagucggagauccuggaugaucuuguauaccgucacaaggaguuuuaaguuccuucuguaggaaauaaaagugacacauucugagcagaagcagcacaggaacaggcauguucuaaaaggaaaagcauucgccuguauaccuuucaagcuggaaggaagggaggaagauaagaagcaguacaccacuucaggaauuugcaaaauaggcuaggaaagagaauaaaaccuacaguguaugacaacagcaugaaaaaggaaggacaguauaugaauguaaacgacacagagguagaagagacagauaugaucaacuggauuggaugcaugaacaacaugaagucaagaaugcuccugcaguuuuugcuuccaccuuaacugagguauaguuaacccaaaguaaacugcacauauuuaaaauguacauuuugauaaaacacccaugaaacuauuaccacaaucaagauuauaauauauccaucaaccccaaaaguuuccuuauaucucuuuguaauccuuccuucccccuauccucccaucacugcuccucgggcaauuacucaucuacuuuuuaucacgauauauuacuuuccauuuucuauaauuuuacauaaaugaagucuuauguaauauacucuuuuuugucugccuucuuucaugcagcauaucuuugaggaucacucauguugcuguauuuaucaacuguguauuccuuucauugcuaaguaauauucuauuguauggacaccaccauuugucuauuaaucugcuguugacagauauuagggucguuuccaguuuuaaacuauuacauauaaagaugcuaugaacauucauguaugaguuucuauauggacacaugcuuuuucuguaaacaguuagaucgugugguaaguguacaguaauuccucccuuaacgucauugauguucacauuggaaacugugaacugacuuacucugugcugugggaacuuaauucuuauuuauaucaacuagccaaugauaaaauugguuucauuagacaguaugucauuuugcuuaaaguugcaguuuccaagaaccaaccaacaacauuaagugaugacuuacugaguguuuaacuugagaaacugcuaaacuguuuucaaaugaguugugacaucuuaaauucccaccagcacuguaugagaauuccaauucuuccacauccuugcaauuuuaauaaguaugaaucaauaccucauuguuguuuuaaccuacauuucucgaaugacuauugauguuggauaucuauguauuaauuugccauucacauauccuuuugaugauaucucuuccaaucuuugccuauuuuuuaaauugaauugcuuucuucuuuaauuuugagaguuuuuguuuuuuaaaaaauagcaucucaguauguugcccaggcuggccucaaauucaugggcucaagcaauccuccugccucagccucccaaguagccgggacuacaggcacaugcuacugagcuugcccagugagaguucuuuguauguucugauacaaauccuuuaucagauauaaucacugcaaauauuuucucccagucugugguuugucuuucuguacuaguaaauaugacuuccaaagagccgaaaguuuuuuuaaaaaaauuaauuauuucuuuauuauacuuuaaguucugggauacaugugcagaacaggcagguuuguuacauagguauacaugugccaugguggucugcugcacccaucaacuugucaucuacauuagguauuucuccuaaugcuauccguucccuagucccccaccccacaacaggcccaugugugaugcucccaucccuguguccauguguucucacuguucaacuccugcuuaugagugagaacacgugguguuugguuuucuguuccuguguuaguuugcugagaaugaugguuuccagcgucauccaugucccugcaaaggacaugaacccauccuuuuuuuauggcugcauaguauuccaugguauauaugugccacauuuucuuuauucagucuaucauugaugggcauuuggguugguuccaagucuuugcuauugugaacaaugcugcaauaaacauacaugugcaugugucuuuauaguagaauaauuuauaauccuuuggguauauauccaguaaugagauugcugagucaaaugguauuucugguucuagauccuugaggaacugccacacugucuuccauaaugguugaacuaauuuacacucccgccaacaguguaaaagcguuccuauuucuccacauccucuccagcaucuguuguuuccugacuuuuuaauaaucgccauucuaacuggugugggaugguaucucacugugguuuugauuugcauuucucuaaugaccagugaugaugagcuuuuucucuuauguuuguuggucacauaaaugucuucuuuugagaagugucuguuuauauccuuugcccacuuuuugauggguuuguuuucuuguaaauuuguuuaagagcagaaguuuuaaauuuugaugaaauuaaauuauuuuuaugaauuguucuucugacgucacauuaaagaaaucuuugccuaauccaaagccacaaaaguuuucuccuauguuuucuucuugaaguuuuacaguuuauacuuuauaaacauuuagguauauuggcugggcgugguggcucacgccuguaaucccagcacuuugggaggcugaggcaggcagaucacaaggucaggagaucgagaccauccuggccaacauggugaaacccugucucuacuaaaaauacaaaaauuagcugggcgugguggccugcgccuguagucccaacuacucgggaagcugaagugggagaaucgcuugaacccaggaggcggagguugcagugagccgagauugggccacugcacuccagccuggugacacagcaagauucugucucaaaaaaaaaaaaaaaaaaaaaaaaaaagagacaucuucaccuaauccaaagccacaaaaguuuucuccuaaguuuucuucuugaaguuuuauaguuuauacuuuauaaacauuuagguauauuaucuauuuuaauuuuuguagaugguaaaauaaauaaaguuuacuuuggagacgucuggauauccaaguguuccacugccauuacaucucuucacugaacugacuuuugaacuuugcugaaaaucaguuguccauguguacaacuguauguauguauuucaggacugucuauucuuucccacugaucuacuuaucuaucuuuccaccaauaccacacucucuugaaaacuguagcuuuguaguaaaucuucaguuaguguuaguucuccaacuuuguucuuuuucaaauuuguuuuggcuauuauauuccagguccuuugcauuuccauuugaauuguuuaacuugcuuguauauuucuacacaagagccugccugggauuuugacuuagaucaauaugggaagaaacgucaucuuaaaaaauauacagucuuccaacccauaaaaacaguauaucucuccauuuauuuggaucuucuuuaaugucucuuagcaauguucuguaguuuucaguauauagcucuuucacaucuuuuuuuuuuucagauacaguccuaaguauuuccuauuuuuaguacuauuauacauggguuuuauacauuuucugacugaagugaaugcugcaagucuguggacuacauuuaggauaacaaggucuucacauaguugucccaaguauuuauauuuaaaaacauacuguguauuuuaaauacauaaauuacuuuccuuuuauuucuccuuuauaucugaaaauuuaugcugacuuuuuugaaaguguauauuaauggaaguaguuaaauaauuuguaaauuccauuuuagaaugacaaaaaaggauuuuagaaaauacuugucauaaagaggggguauuaggguuuaauaagauuaagaacuacugccacagccauuuugucaauaauuucuauaaaauugaguuuuuacauguauacauauguaacaaaccugcacauugugcacauguacccuagaacuuaaaguauaauaaaaaaaagaaaaaaacuaaaaacaaauaaaguguucuuuaaugcugauuuaaaaaauugaguguuuaagccucgguugguaagacauauucugauguuauaaauuaacaaaaagcuaucaaguaggaaauuuaucuccaacaucaauauaucuaauggcacuaauaagaaaaaguagcaacaaauaaaacauaaauuaagaaaauguauuuauuucuaugucccaaaaggaaaagaaauacaaaauuaaaagucaucacgcuuguauucugguccuggcuauaccacguacuuacugucuuugugaaacagaaaaauuuaucuaaauuugucuccagauuucuaccauuuuaaaaugauaguuuagaaccagaugguccacuaucaucauccacuauagaaaaaucuaugauucacacaaguaaacaagcagagccacuauuauucauuaaauuauuaccaugcucuguuauaugccuaaaaugcauaggcuucaacagaaacucugcaauauacaguguaaugacaaagggcuaguuguuuaacccuuuaugcuuuaguuucuucaucuaaaaugagaucauuauaguaccuucauggaguuguggaauuaaaagguuagugguaagcacuucgaaaagcacaccuaaguacucaagaaauguuagcaauuuauuucauuugcauuaucacauaauuccccuucucuugaaauuaugucacagaugaaaacucacaguauaauaugauuucccauuacuuaacuggagaguaaacauuuugcucuauuugauuuugaauaaugaaaagaugcagcuuuggauucuaggauauuacaugaauaugauaguuuuuacauaaauaagcagagaaauaagcaaauccauuaagcuacuauacaagauaagguuucugaauaucugccccuugaaauaaagaugauuucucuaaaacuaaguuaccuggagccacauuauacucuugagguaaaaaaaaaaaacugugcuguccaagaaucgcuucucugauacuugugcacgaaaacucacaauauuuggggauaacuaugaaaaacgaaauaggugauccuugaucaucucauggaaaaccaagagaacaugggguauauaaaauucugucacucucuaagugagauucuagccauuagauuaacugugucccagaugugcuuuacggaagauuuucugaggggagggagaaacaaaacacaauuucuaaacugugucugauugcucccuuuaccugcacacaagauaaacagugcgagccuacaucagcaguucucauguucugugcauaauaaucaucugaaaaaccuguuaaaauucagacuccugaccccauccccugagauucugaugaucaauacccauuuuuaucacguuucucucauucagauaccaauggcuccuagcuaaaacucugagagacacugcacauaacaaacaauccuaaaauauauuaacauguuguauuuguguaaugccuuuaccuagaaaaaaggguuuucugagguaucaccucauauuucuaacaaucauuuacagacaagaacacaaaucuauuaauaaugccaguuaguuuaaaaauaaaaaaaagggaagaguuuuuacuuuuacuuucugaaguauauuauaugaugaaauaccucagacaacaaagaugagagauucaauauacuccuuaggugacaaauaaaaaacacagauuucaaaauuucaaauuacuguaguuaauauaauuucacacuuccuacucccagaaguuuaagaaaagaaagagagucacaguauaauuuaaacacauggaugaacuuauccuucuguucccacggcuaaauuauggucugggcuagugcaauacuuagaauagaacuuggcaaaaugcaggugaguagcagaauugaccugcagcacacauggaccaaaauagucuuagauccuaccccacaacgacugaaacgaacuguagggcuuaggcccugggauuugauauuuaaacauagccuccuuuaaacauucaaguuuaagagucaguggcaaagggagaauaaaaagaauuacugguaacaaaaugaagagagcagaacagcacccuucaauacauuugguaaacacuauuccucaaacuaacuuuauguguuggaccuauuagaauggcuauuuuuuuuaaacuggcaauuaucaaauguuggugaggauguggaacagcagaaacucucauucacugcuaguaacaaugcaaaaugauacaggcacuuuggcagacaguguuguggcuucucaccaaauucaacauacucuuaccauaugauccagcaaugauauuccuugguauuuacucaaaagacuugaaaacuuauguccacacaauaaccugcacauagauguuuauagcaguuucauucauaauugcuaaaaacaugaaagcaaccacaagguccuucaauacuugaauauauaaacuguggcauauccaugacacugaauauuagauagugauucaaaaagaagcuaucaagccagagaaagacacagaggaaccuuaaaugcauauuacuaaguaaaagaagccagucugaaaaggccacauacuauacgauuccaacaauacggauauuuuggaaaagacaugacagugaaagaucacagguugugaaggguucagcaggaaaggaaaaauaggagaagcacaggagauuuuuagggcaauaaaacuauucaguaugaaaacuauaaugguggauacaugcuauuacacauuugucaaaacccagagaaugcacaccaagagggaacucuaacauaaacaauggacuuuaguuaauaauaguauaucaauauugauucauuaauuauaacaaaaaguaagccccaaaauuguuucaacaguugcaagguaugauuugagacuguauuuuuuucugugugauucuggcccuggugcuccuuagaccacucuucuagaaacagugcucagucagugcuguagguaaacucagcuaaucagcugaugguugguaaagaucagcauuuugcugauucuauucaauguacuguaaagcaaaugugaaugacgggaagguauaggugaggggagugggcagggguauuacaugaaacucugaacuaucugcucaauuauucuguaaaucuguaacuauacaaaaaucaagucuauugauuauuauuuuuauuuuugacaaggucuggcucuuggcucacugcaaccuccaccugccaggcucacgugguccuccugccucagccucccaagcagcuuagacuauagacauguaccacuucgccugggucaguuuuauaauuuuaguagagaugagguuucaccauguuggccaggcuggucucaaauuccgggguccaagcaaucuucccacuuuggccucccaaagugcuaggauuacagguaugaggaaccacauccagcucuauuuuuaaaauauuaaaaucacaauaccaccacuauauagcaugaguucacagcaauauuaaggaaggaccacugcacagagacuugugccuucucaugcccugacagcuggccagaaaggagaucacacacacauagugugaccuugacaaaagaaaacuggaguccagaucacaugccaugaacacaucgagcugagcagagcugcaaaugcagacauaucgggccugggugucaacaacgagcuucagaaaguguugcagcagcgcucaagagggugacaccucagcucacucagccuccaucaugggaagcaguagcccacauccuugcuccucuucccuucucuccugagagaggccugcacuaagucaucucaaucccuaggaaaaccaccggugacagccaacaccaagacgaggcccucguuuccuuuacacugcuagggaagacacugccaccucugugacgcacagccuccuccguguucugcagccggagcccaguugacaggguucacauguaaccagagccaggcgagcuggcugaccgaggugcaugcuguuccccgccuggccugugcaccugcugacagaagcaucagugggucaucggacauccucucggcagaagacauaugcaacacugugcuccaguguaaccuccucuaggaagcccuccugcaccuuccagggaauccuggugagcccuacucccuacucaucagagagaccccaaggagaguacugaggucugcuaguccuccauguccugccugccuugagccugaaaccagccuggcucagguagggaccuguuccccaccaagucuauguaagagagucccucaggugccuucaggccagcccuaaagguggcucaaccagcuucuccauucaggacugguugacaucuauuaugggcuaaaaauugugccccucucccccaaaauucauaauguugaauuccuaacccccagaaacucaggaugcgacuacagucauuucucaacauagcugggggauugguuccagaacccccucauauagccaaauccacacauacucaaaucccacgucauauuccaaaagccugcccuccauauaugaggguuucacaucccacaaauacuguauuuucaauagcguuugauaaaaaaaaaaaaaaaaaaaucuguguauuaguggacucgcaaaggucaaacacacguuguucauggauuaacugcguauuuagagaugggaacuuuuaaagagguaauuagguuaaaugagguggccccuaaccuaaucugacugauguccuuacaagaagaagggauuaggacacagacaaacacagagaggaaaggccauguaaggacacgcaagaaagugaccaucugugagccaaggagagaagccuuuugaaaaaaacuaaaccuucugguaccuuaacuucuagcuuccagaacuguaggaaaauauauuugcuauuaauuuuuaagccacccaguuugugguauuuuacuacaguagcccuagcaaaugaacacaguaccuaacagaccaauuaagggaugaauaaauccuagaaacagcucccacuggcagaaguaucagugggucaucuguuaugcccaauaacagaaaaaaaaauauacacacacacacacacacacacacacacacacacucucucucucucucucuauauauauauauaucucauauacaaucauauauaugugauuauuugcccccauccauaucagaauauaugaauauaugauaucccccauccauaucagaauauaugaaguaccaggaauucagacauaauuuacauuagagaaauuuuauaacucuagauauuauccuucuaacaggagucaugaaaaaucuucuuauaaagaacauguuucccuauuaacuuuagacuguuggcuggcuuuucaaaauuaaaauuuuaaaauagcuuuugauguaucuacuacacaaagugagguccacuaguaagcuaaacucaugguuuucaccccuacugaggccccucagggcugcugcagaaggccugaaggaggccagccaggugggcugcauggggauaaggcccagcguuucccacuuaaaccaaucagggcagcuccaugguuacuuuuucuugcacugagguucugcgcaugauucuguuugauuaguaauuccacuggauuaaaagaaaaaguauaaaaaccaccgaacuaagcuauuauuucaguuaaacuugaaaaucaggauguggaaagaugucugauguacaguuaccaugauugucuuccucucucaacagagugucucccaggaggagcacacgcuuacaauuuaaaaauaccuaacaaagguaggggacaucaugaacagucugaagaguuuuucuccagcauacaauugauuaaucaucacacaaaaacauaacacgcaguaacagcaauguucccaccaguaaacauguaugcuuugcaguccacaguuggcuaaucuuuacacuauauuucuugcugguugagcaggaaagauguuccuuuccauaugguagaaaacugacaugaagaacguuaauaaucugagagugaauguaaaaaucaugcuuagugcucuucaggcaaugagauggagcagacuuagaucucagucccuacucccuucacuuaacugacuuagcauccugacuacuuauuaaaccucucaaaaacuguuuucucuccauaaaaauggaggacaguaacuaccuagaagcuuugugaaauuaaagaaaacacugcauguaaaguacugagcuauacuuugcagguaacagaugcucaacaugucuccucuuucacaccuuucccugcaauuaaccaugagugcucuuagaaauggacuaauguguagaaacagcaaggaaugcugaacuguggauuccugccuuaaaauacugauuugcaauuuuuuuuuuuuuuuuuuuuugagguggagucuugcucugucacccaagcuggagugcaguggcaugaucucagcucacuguaaccucuaccucccggguucaagagauucuccugccucagccucccaagcagcugggauuacaaacaugcgccaccaagcccagcuaauuuuuguauuuuuaguagagaugggguuucaucauguuggccaggcuugucuugaacuccugaccucaugauccacccaccucggccucccaaagugcugggauuacagguguaagccacugccccuagccugaauuucuuuuuaaaaaaaguuugacaguaacauuuaaagacuuguuccugguuacacgggcaccccccacaucaauaccucuucucacaggcacacuccaacaugauccauggagauacgauugccuuucuaagaccaaucaagaugaaaaauagcauuccuauaggaaagauuuuucauuaucgguuacaaaucaaucuuugaaguuagaaauuucguuuuuguuuucaauaauuuguuuuggcaauaaacugauguuuaacuaguuuuagacuaguuaauuuauacucacuuugaaaagaauuaguuuguuuaggcaaugaacuaauugugugcgucucaacaaaacuuugggguauaaagcuauacacuuagcacacaaucaguacugaauaaauaucuguuacauaaacaaagggaagacaaucauagaauuuaaauguugagaaggaauagagagauuuuaagugaaacccucugauuuuaagaagaaacucaaauccaaaaaaagcaaaugacuucccuaagguguuacacauagauagauagauagauagauagauagauagauagauagauagauaagauagacagacagacagacagacagaagaaaguuaguaguaacaucaagaccacaacauaacuauuauuuuaaagccaaauuaaucuuuugaucaucuuugagacccuuaagucuauuguucauuuccacuaacaugaagaacugacuccuuaauaggaaaaagauaacuguagucuucuauuuaguuuuauauuuaaucaaaagcacuuauucauagcugguaagaaaucagagcacagauggagggggaucccaauagcacaaacaagaagaguucugggguaaugugauaggguuuuucuggucuuaacaaccaaauuaaauuacuauagaugcuuucauaauagggaaagggauagauaaaauuaaacuuguaaaauaaaaaccagaauucuuuaaauuuaaaaaucaacacuuauugauuaaaaaaaaauuauacaucagaccuggucuaauaagcauguucuauuuuuauucucacauauuuaaucuucaagauaaucaugugagguaaacaauagucccauaauccccauuuuacaaaugaggaaacugagacacagagaauuaaacaauuugcccgagacaacacaggauuaaaacccagacaaucuggagccagagcccacucuuauccaccaucuuauaauguuuuaaauuguauuauuauguuuuaauaaaaaauauauuuuauaaaaagcuaauaauucauuuuuauuuaauauguaguuagaacucaaaguauuuauacaaugcuuaucaaauuucuaacaauauagcaggagcauuuuauuuauguaguauuuaguaacacuuguauaaguagaccacaaaaaaccacaggcuauauguuaaggauacaacuuuaaggcauuuucagagacuccucauaaaaaguaguugcuaagucagucuaauagauguuauuaucaggucucaaaacuguuuagccauaaaguagucccuccuuaucugcaagaaauauguuccaagaccacucagggaaugccugaaaucacagauaguaccaaacccuaggauacuuuuuccuauacaugcauacguaugauaaaguuuaauuuaucaauuaggcacaguaagagauucauuacaauaacuaauaaucgacuaaaacaauuaagucaaauaaggauuacuugaacacagcaccuuaauaccucaacagucaaccugauaacugagagggcuacugaaugacuaauggggcaggcagcaucuacaguguggauaugcuggacaaagggaugauucacguccggggugggacagagagagauuuuaucacacuacucagaacagcaugcaguuuaaaauuuaugaauuauuuauuuuuggaauuauccauuuaauguuuucgaaccuugguuaaccucagguaacugaaaccauggaaagggaaaccguagauaagggacuacugaauauagaaaaagaaaugagauugcuuuagauucuguuguucuguaauuaaaaguaaguuuacauaacaguuacaaugccuuuuuauagagaaauauuaaucaaacugacuuaauuccagagaggaaauauaugugaaucccgauuaacaaccuguauuaaaagcaaggucacuccacaggccuuguaaccuaaaaguggccaugaggucugagaugcuauucacauuuuggcuucaccaccauuuaaagaugaaaaaggagauaagaaacaaccaaaauaguaauuagaaaaggaaaucuaaaucuauuaucauuacuaucugcauuuucuaucguugcagacaaaauuucugaugacaaaguccauuaccagcacauguaaacaaaaguauuacugaaucauaaaaaaacuuuccuuugaauuuucccacaccuaauuugcugcugccuaccuggaauccgugcuugccucuccaccaugugcuuaacacuuucgggggcaugucaauaacagaaacaaugucucccaccuaggagaaucaaaauuuuaagcaaaaugguuuuaguuaaauuuuaaaccaauuguuauaccuagaauuuaaauccgaacuguaugaaaagguaaaguacuauucaugcucuggccaguaauuuccaaaaaaaguaccauuucuuuuuaaaaaucauuuaauuaucuuaugauuuguuaaagagaggucuacaaaaaguuaagcagcacaaagacugugauucaacuaacacaggugcaguaacuucagaaagccagauucauagcauaagauuuuuaaugcuaggcaucacaccauuaucaucacuucuguuaaaauacuguuacugcugucacugagagugaucagauucacuuauaaaagauaauuuuaaauauucauguuuagaaacaguaacagauucccuuaauauuacauuuagugagugcuuaccaugugccaggcacuguacugagcucuugacauaucuuauuuaaucauacagaaaagggccuaggauggguuauucuuaguaaguauaaaauuugaugacaacuacacuucuuucaauagauaguaaaauauaauuauauccacuaaagagcuaacuuucuucacuguaaaagaaaaacuacugaguuuaaacucauauaaaaucauaaauauaaaaauuacaauaguuuuuaauaauauauucaauggaaguuauauucuucaaucaaaagaaaugcugauaucuaugauaaaacauaguuaagaacuucagagcaauguuacuaacauauacuauagagcuuuaggaauuuuucuuuuguauauucacaacugaucuuacauaucauguauaagccauuuuguaaagccauauaugcuaacaucaucauuccaagaccuacauuucuuucuguacagaaccuaaaaguuugaaaacaguucagauucuaugcaguaaaaaguuauacuguuauuucuuaaauuuaguaacugucagcauuuuuuuucucucauuagccaauauauaucuuuagaggaaaaaauuuaauuccccuccuuuuauaugugguagcaagauguguucauuucaccuuuuaucuguucuuuaacucaaucuuucaacaauaugugaaaaaaaauguaucauuggguauuguuuuuagguacaaaaacacaaaaagacagaccuugcuuuccagaagcucaaugagacaaagaggagaacaaucaugauuaaauauaauaagugauauaucagcaauaagccaugagcacaguucagaaugacauucaauucagguuuugggggguauguauuugcauggagugaggggagggagaucaagaaugacuucccagacaaaacaggagacacuuaaccucaguuuucaaggaugaguacugucacuuaaacaaaaauagaagauauuacaggcugaaauauaaaagacuauggaaaaaccuggugcuuuucauuuuuuuaaaaauuaaggaaaugguuaagaacagucaaagaugaggccagaaaguuagcaagaaccaaauaacaaacaaccacuuuaacuauuuaccucuaaggucaguucgucaggggcccgagcaguguaccucuugauaacaugggcagcaccgacagcaggaguguugauggaugacuccucaugaaccaaaaggugauuucccuuauuaucaaucuaucacaaagaaaauguacuaugagauaaagacacuggacuugcaaaugcuucuuugacuaucuauaaaagaaauucauuuuaauuuagagauacaauaacccaaagagucuuaaaaaaaaaaacuaccauuuacuggguaguaaaaauaugcuagucauugugcugugccuauaacauauacaguuuaauuuaauccucauaacuccaaaaaaaaauacuuaucaucauuuaaaggugagaugcuaaagaugaaagaggcuauguaauuuacaagagauucaauacuuuuuccaagaucucaacgcagguuggcccauaguucuauauucuuuccacuuuccaucuugcauucccaauuuccagugggaggagaaaacaauauaacucuacauaugcacauuaagaauaaauauguaaucuauuuacugaauaauguuucacucaauacuuacucuuaaaaaggacccuuuaaaaaguugucccuugcuaauaacugaaaaauauuuucaauuacuaagucaacuaaaaaaauguacaccuugcugaauauauacauuaguauacuaaacaccaaaauaacagguaucaucgagauucauaaaauauauuaagauuaguuuccaagauuaucaaagaaagauuugagaugaaaaaauauuucguguaucacguaucuauccucccagaugcugagaauauacuucauuucuuugauuccugaagcucaauagacaucaaaauuauguuaauaucaaauuucuuaaguagauaauuuaaauauacauuuuucaugaaaagugaauuaggaaauaccuccauccagguaagggcgggcccacaguugaucuuguugccagcgauagcugaaaggcgugacagguaagccauaagcaucugagugaccgacugaaaagaaaaagaucaguguaacucugaguaaagauacuaugcucucuggcagggaaaacuggaugguuucuggaagaaaaaaaucuauagaucuuuaggcauuuuaauaguuacagaggacucuucacagaaacuuaccaguagcacuaugggcacuuacauagcaagucagccccugucucaugcagagcuucaauuucuagccccuuaucaucagcgaucauacuauuccaugguuucuaauuuugacacuuucuauuuuuguacugaauaugcaaaaagauaacuauagcagauacauauuuggcuuuucugccuaaauuucccccuacuacucagaaacccuuuuccccaagacccacuguaaucuuccaugcacauggccuguggcaggagcagccauguucauacgugauccuauaccaugguucagccgauugguccaggaauaugccccaguauuaguuggaccaaucaagagcuaacccaggaauuaggaauugugacacagauucuagcucagucuggcugcucucuuaaaaggggauaaaaaccugggaccucuugguaguggccauguuuuaggauaaucugagagaaaaaaaugaaacagaaaaaaaaugaaaugaagcagaaaugggaaaugcagauaaagggacuuucagguuuucuaugguacaaagagauccguguuuuaagacacuccugagacccugcugcaguguccguuauauuuuagcacuuaaugaacccacugaaucucagaacaucacuuuauuuagaucugguagggggaguggcuuacaccaauuuuuaauuauuuccuugcauccacucucuccuccuguaacucccaucaguagaaaccucucuggaccuauucuccaugacucccaacuguucucucacaacuuuuuaacuuuccgucccuuccagggguuguauucuuauaaaugacuuggcuugaucauucaacucccugacuuucucuucagcuggguacauucuguauggaguccaguuacucagguuugcucuuacuaaauuaauuuaaaugauccuauauucguuuacaacaucucugauuuuaguuuauuuaaauccauuucaugaaugugacagcuucacuuucucucagaggauaguaaucauccuucgaaaagccuuguuuguaccucucaguuauuuuauuuauucaguuucuauguguaaacuuucuaguuuccuuguguuuugcggucuuguugcacuuacauguuuaggcuauauuuacuuuuccccauaaaccuuaucccaucuacuuuuuaagauuccuuacaauuuuugauucccaaugguacuuuugguuuaaugaugcuauaaagaaucucuguuuagaaaucuuuuacguuuuuacuauuuauuuuuuuguaggggugaagguaggugcauacacacagcaugcugucauaaacuacucaacacuguuaauauggaucccuuugaucaugaaaggcaauguuuuuccauauuuuugcuuccacuuuuaugugcucucuggagaauguuuugcucauauauauugcuuguugauauauuguuaugaguuguuuucccuuauaaaauuacacacugaaccuacuuucauucuaaacauuauauuuaacauuacuaacuuuucaguuaugaaacaggcaaguagucccaggaaucacccugcguguucaguauaagcuuuuguuuaguauacagacaaaaacuucugcaaacucauauauagugauuaccucuguacuaaauguacuaaaugcuuaccucuggacuguccuucagggugucagaacggggaaguucugagagcugggaaaaucuucggucauaaauacacagaugaagauguuuaucaaguacccgaaaaucuucauaacuucuuuuaacaauccaacuuuuucccuauugguagaaaaaagaaacucauauaauucaccucuauugggaaauacuuaugaaucaggccauauucuauaaugugauuuuauucaugagauuuuauauuuucuaaugagaaguuucuauuaacuugauaguuaauagcuaaaacugugaaacacucuaauaaguuauauuacauuaaaaggccaauaauugaaaauaagauagaacucuccaccaucccucuuccuacugcuggucaaaauccacugccucacuuucagaacaauaacugcuaaaugguuaaaauaacaugugauuuuaaaucuaccaaaaagaaaaaaaccauagguaggagaauauuaacugaaauuaaagaaaaauaaaaucagguuuugauuuguuacuaccaacauuuucugugacugagaucggaaauauacuaaaaaaccaaaacuacugaagucuuccucuauaaauauuugauauucauacagcaucuagaaaccucagcucucccugccucucaggccuuccuuucuuugcccaaucucacaagcucauuuuuuaaaauuacacucauaaaggauauuuauuagauacuaucuucuaaucuucucuugaaucuaucacuucuuguucaguccuauagcccaagcuucaguaagaaccaucaucauuucuuaccugaaauauugcuaaugugccuugccuuugaacuccuccccugcacccccaacuacaaaauacagaguuuaucagcucacaccgcaacaacaacaaguccuucaaaagcuccuguggugaguaaugaugagcaaaucccgacuguauagcauauaguuuugcaauguaauuuaauuuuuauguagagccuuuuggcucauaaaaaucuggagggucugaaagaaaaagccuucagagacaccaguuccuccaucugccccagacaacuggagcagaaacagaggguaucaccucaugagagggugcugauuucuaaucacuagugucucaaaaauuaacaugauaaacuugcauaaucccacuuuggacuguaauccuccacgacauagacaaaaagucauuaccagcucccucuuucagaggguucuaagaaugaaauaauagauguggucaagacuucuacacuugaccuuggcugaaaggcagagaagcaaugugacugagacuuuugaagaacaguguccuggucccuauucuaagagaugcuaauucacuaagucuggaaagggauccaguuaguucugacgaucagccugaauugagggccacuggucuacaggauuaaacccaaacuauccccacauuucacagcuuuuaucaucugggcccugucuaaauuuccagacugaucuuacuggcuauuacuccaugcccuuucuuggcuuccaguuauauugaaugauuugcauguauucgauucaugagcugaauguuccuuuccuugccuucaugauucuguaagugcuguuuguucuuccugucauguuagcucuuucuuugaugcuuugcucaagcaaacuccuuuauuuucucaguucuaucacuaccuucuacccaaagcauuccugggaacugccaaguuaugauguacaagcaucauuuuauuucaaauuugccaaagugguaacaccaauuuauucacccaacaguagcauaugaguucccacugcccccaaauccuugcaauucuuggcaucaucagaauuuacagcacugcuaaccagauagaguugaaaugguaucuucuuuuaauuuacauucccuugauuaugagugaagcuuagcaucuuuucauuuguuauuaagauuucuuuuuguaugaauugccuauuacuaccaaaauccuguucauuuucucuauuacaaugacuuuuauguauugacuucuagaagauuuguuuacuaauauauuggaaaaauaaucuucauaauugacauguauuguaaaacacuuuauccaagucugagacuguccccucaauuugcaguaucucaucaaaaagaaggaacauaaaacuuuauuuccuucuuuaugaauauaaucacagauuagguaguuugcugaaauuuucacacagguaugugaaagaacaaguaugaaaauaaguauccaauaaaauaauuuaaauuuucaucugaaagagaaggccuuacagccaucacccauaguauuucaaauuuauccauuauaucuucugauuuggguguggccuacaguguuuuuagaaacugcauuugaaaacauuuagguacagcacagcaagcacaaguuugccaaugucauuaccacacccagccauuuuccuuaacuaacauuaccuauacagaugcugaauauauuuagauuuaccaacuccugaaauaaauacacagcuaauagcuuggcucuaggaccacaaugucccaauugugaauccugguuauuuaagaauuaaaucaaauaaaucaauguaaagugcuuaguaguaggcagauagaaauugcucaauacaugcuagcuauuacucucuauuaauuuggagaacuuacucugggcugaaccuaccaaaaguagaaaacaagguuuccaaacaaauucucaggauauuuagcagaacaagcaaccagucaccaauguucaacaacucaaaagacaaaagaacauucuuaacaauuacuuuuuagugcaucaggguuucagucagcuaaaaguuaauauaucuuuagagaucaaagguugcuuuccauauuggcugaaucaucagcuucagcuuuggagaauaaaaucucaaauucaacauuauuguuuuggaauaauucagcaugcccuggugaucauucacuuauguuuuguuuuucugcuccuuuucacgagaagauguauuaggcuucaacuccaaacauguguacaauuauuccaugguauuaaaggugaggagagaaaugaucugcaauuugguaggcucacauuuauuacuccuuuggaagaaguggucaagaucacugaaauguaguccugcauuuuuuggugccuggugcuuguagaagagaaauuggcuuugcuucuaauccuuuuucagccaacacucuuuaggaaauagagaguguucugguguauuauaagguaaucuuugcuaguuggaauaucauuuucccuugucuuacauaauagauuucuagagcuacauaagugugaaacagagggaagaaagaagaaaaagagaaagaaugagaacagcagccaguaauugagaaugcaagaucugaauuuauacuacccuaggcuaugugcuaaucacuugaccauauauaacuauuccacaguuuccucaucuguaaaauggggaggcuaauaguaacugggguugucagaagaguaagugaaauaauccacguaaggugcuuaacagacucccuggaaaccauucauuaaauauuagcuaucacuauugguauuuuucucacuguuaaagcugucuggaauaaaaauaacuuuugcaugcuauauugcucaugcaucuaucaugcauggaguauagcaggcaaauauuaguuugguuaaauuguuaacaugcccagccagacacuagaacaaugccuccacuaauaaagacugauuuugaaaaagguguuuaaacuuccaaacugacagauuugggaguucuaagaugacaguacaauaauugauaacaagauuauaaauaacacauuuguauuuaaguuuauguugcaaugucuuauacuuucuuagcauuaauuccuaaaaaugugacauuagcagaaacuggguuaaggguaaauaggauauuucuguucuauuuuuauagcuuuucugugagucuaaaaucguugugaaaugaaaaguuaaaauaaauacauacaaaauuccuaaaaauugacacguuguaccaauuuuuacugcuugggucuauuucaaaugcauccucacaaauacuaaaaauaaugacuuaaaaauuuuccaguaggugaaaaacuguaucuucuuucauuugccuuuuauugacuuaaugaagcuaaacacaauuucauauuucucagucacuuuuauuucuucuuuuauaaaaaauucauauuuuugccaaccuuucuacugaguauauuguauauuacuauaacauaucaucaaacuacaguauaauuguauguuuaaucaaauuauuugauggaacuauuagccuuuugagagcuguaaccuacuuaggccuuugagagcuguaacacucagugaguuacaaucaagaaaauuccuugaauguauacugauguuauuuauuaaaugguuuauuacacaauauugaacuuucugcuuaaaagaucucaaagagaaauuaguuagucuugaaugggauuauaucaaacuaaaaagcuucugcacagcaaagaaaaugauuaucagggcaaagaaaaccuccacagauugggaaaaaauacaucuuauaagggguuaauaucugaaauauauuuuaaaaauucaaagaacucuacagaaaaaaaaaauaacccaauuaaccaaugggcaaaagcacugaacagacauuucucaaaagauaacauacaaauggucaacagauauuaugaaaaaaugcucaauaucacuagucauuaggcaagugcaaauuaauaccacaaugagauaucaucuugcauccgucaaaauggcuauuaucaaaaaggcaaaagauggugucggcaaagcuguagagaaaaggaaacaagggacuccccauacacuuuuauuggaaauauaaauugguacagccauuuuggaaaacuauauggagguuccucaaaaaacuaaaaauagaauuaccauaugacucaauaaucccacaucuagauauauauccuaagaacuugaaaucaguauaucaagaagauaucugcucuccuugguucacuauagccuuauuuacaauagccaaguuauggaaucaacuuaaguguccaucacuggaucaguagauaaaaacaaaugugguauacguacacaauggaauacuauucagccuuaaaggaaauccugucauuugcaacaacacugauaaaucuggaggacauuaugcgcaauaaaauaagccuggcaaaaaaagacaaacaucacauggucucacauguagaaucugaaucaacugaauucauagaagcagaguugaauggugauuaacaugagcugaggauagggaaagugaagagauguuggucaauggguacaaaguuguaguuaggaggaauaaguaauaaguaguuaagguagaaaaaauaaauaacuucagaauaugaaucacuaaaaaaagaaauguguuggucucauuugcuucaggcauucuucccacagagguauuuaaaauauauuuuuaaaagagguauuaaaauauuuuuuguuauacgcuuuuuauuuguucugccagcucaacuucuaguucauuugguuuuguguuaccaaguaccacauggaaaugacaggccauacaaaaauacauucaugauacaguuccauuucagaagugaucaauguccgucuaguuacaaaguaaucacuggacuucugguuacuggucugcuauguaaggagcucagaagucacugguuaacaaguaaaaagcugaacaaagugaaaaucaacagaucuuucuuagaucuguuacagaaguggggucacggaacaaaucacuaucccccucccaaauuagaggcagacagguaaauacagagaauugcacuuacccacagcagaaauccacacgcagaaaccucugugggaaccagugcuaggguaggaaaacuuaaucuauaauugauaaauugcuagaggcucagggaugacaagucugagcaauaaaaacucccagagaaccccgucacgggagccacacacuuuugugagcucuacuagguccucacaguaaauaucugaaaaaaaucuccuugugcucuuaagagggacaggagaaaauaaacuucugaaacacacccaaacacuauguuuucaacaaagucugcccucaggaaaaacucuuaccacagccucauuuucuggaguaagaagaaaauacagcuccagcuucuucaagcuuuccacuggggagaagaggaauaccaaacuccagcccacuccagucaucguguccuaccuaaaggugcaggauggagggcugugaacugagauucacgugugaaguucacaguucagaggcacaggcucacaaaaagacugagaccuaaucacaggauuauggaaugcuucccccuacacacacaccuuaccaucacauuacuaacgggcuauuuaacauacuucuuugacccaccuuauguccaccuucaacaaaaaaucacaacgugaacuaaaaggaaaaaaacaccguuuaaaaagacugaagacacaucagaaaaagagucaaagauggcaggaauguuggaauuaucagaccaauaauuuaaaagaacaugauuaaucugcuaaaagcuuuaaggaaaaaguagacaauaugcaagaacagauguaagcagagaauuggaaauuauaacaaagaauaaaaaaaugcuagagaucaaaagcagaaaugaugaaugucuuugauggauucauuaguugacuggacacagcugaggaaagaauuggagcuugaggguaucacaauagaaacaaccaaaacugaaaugcaaagagagaaaagacuaaagaaaaggaacagaacaucuagaaauugugggaaaacuauaaaagguaugauacauacauacugaaaauaccagaaggagaagaaauggagaaaggagcaaaaccaauauuucuagcaauaaugaccgagacaccaaaucaccaguccuggaagcucagagaacauaaagcaggauaaauugcaucacccuccucaaaaaaaaaacaaacaaaaaacaacaacaacaaaaaaaaaccuucagcaaauccaagauaaagaaaauaucuugaaagaagcugggaguuugcgggggaaacaccuuaccuauagagggucaaaaucggaauuauauaacauauucucagaaaccacagaagcaagaagagaguagaguaaauguuuuaaguauuaacaaaauaaccccuacccagcaaccuagaauuccauacucugcaaaauuaucccucaaaaaugaaagagaaauaaagcuugucaaacaaaaauugagaaaauuuguggccagcagaccugcucuguaagaaauguaaaagaaguucuuuaaagaaaaagaaaaugacacagaucagaaaccuguagcuacauaaagaauggaaaaguaauggagaagaauaagugaauguaaaauacaacuuugguuccuuauucuuaauugauacaacagauaacaguuuguucaaauaauagcaacaacaauguacuugacuauguguguuuuacauauauauguguauggagguauguguauauguauauacuuauguaugauuucuauauguaaaaugaaugauaguaauaauacaaaggauagagaggaauuacaaauaauuuuuauuacaaggcaccugcacaauccaugacgcaguauaauuauuugaaagugaacuaggauuaguuguaauguauaucacaaccuguagugcaaccacuaaaaaaaaaaauuuuucuucuuuuuuugagauggagucucgcucuguuacccaggcuggcgugcaguggucugaucucggcucacugcaaccuccgccucccagguucaagcgauucuccugccucagcuucccuaguagcugggacuacaagcaccugccaccaugccuggcuaauuuuuuguauuuuuaguagagacagguuucaccauguuagccaggauggucucgaucuccugaccacaugauccgcucgccuuggccucccaaagugcugggauuacaggcaugagccaccacacccggccuaaaaaaauuuuuuuuaauguaauugauauucuaagaaaggagacaaaauggaaacauauaaaaugcucaauuaaaaacaaaaaaagagaauugaucauaaguguucucaccacacaugcaaaaaaagguaacugugaggugauggauauguaacucagcugcagucaucaucgcacaacgcauacacauaucaaaauaucacauucuacaccuuaaauauauguaauuuuuauuugacaauuauauauaucacaauaaaguuggaaaaaaacacacaaaaaggagacaaaguauggaaaacaaaaauaggaacgaagaacaagggcaauaaacagcaacaaugacaggcagauauuaauccaacuacaucaauaaucacuuuaaacaucaguggucuaacauaccaauuaaaagacaaacugucagaguggaucaaauacaggacccaacugucuaaaagaaaucaacuuuaaauauaagauagauuaaaauaaaaugauaaagagaugccauacuaauuuuuuaauuaaaaaagcaaaaauagcuauauuuacuucagucagagcagacuucagagcaaagaaaguuaugagggauaaauggggcacucaguaaugucaaauggaucaauacuccaagaagacauaaaacaaucuuuaauauuuaugugcuuaaaaacagacuaugaaaguacugugaggcaaauacugauuaaauuacaaggagaaauaauuacaguuguaauuauuuaacacccucuauaagaaauuauuuaacaccccccuauuagaaaugaauagauccaguaggcagaaaaucaauaagaaaauaguugacuuaacaguaccaucaaucaacuggauauaauugauauugauagaauaccuuaacaacaacggauuacacaugcuucugaggcucauauggaacagucacuguaucuuggggaccacauucuggggcauaaaacauaccauaacaaguuuuuaaaaaacagaauucauaauaugucugcucacagagugucagagguguuugaaccagaaggacuccaucuugaagaggugcugagugaaaugaggcugagaccuacugggcugcauuccgaggagguuaggcauucuaagucacaggaugagacaggucgguacaaaauacagaucacaaagaccuugcugauaaaauagcaggcgguaaagaagccggccaaaacccgccaaaaccaagauggugaugaaagugaccuuuagucauccucacugcucauuauacacuaauuauaauguacuagcacgcuaaaagacacucccaccagcaccacaacaguuuacaaaugagauaacaacgucaagaaguuacccuauaugaucuaacaaugagacaaacccucaguucugggaacuacccacccuuuuucccuagaaaacccaugaauaauccaacccuuacuuagcauacaaucaagaaauaacauaaaaauagccaacgagcggcccaugcuguugcucugccuauggaguagccauucuuuauuccuuuauuuuucuaauaaacuugcuuucacguuaugggcucuccccaaauucuuucuugugcaauauccaagaacccucucuuggggucuggaucaggaccucuuuucaguaaugagaccacaaggaauuaaacuauuagucaauaauagaaaaaauuuccacaaggaauuaaacuauuagucaauaauagaaaaaauaguugaaaaauaccaaaaaauuuggagauuaaaugacacacuucuaaauaaaacauggguaaaagaagaaaucucaagagaaauuacuaaauauuuugaaccaaauaaaaacaaaaauacaacuuacccaaauuugugggaggcagugaaagcagugcuuagagaaaaauccauagcauugaacgcaugcaucagaaaagaagagaggagaaaaaugguggcuaggaggcaagacuaacuugcagaucccacucggacagacagaacagcauguggaggcucacaucaugaacucuuccucccaaaaccaucccaggaacauaccaggaaaaccaaaagaagucacaaaccguuggaaaaaagcaguuggcugcugcaaacuccaugagacagcugaaaaacugugagugccccaagugugaaagggggaaagucugccucugaacacucauccucacuggggaacccgaaaauccagaucauggaagaaagauuuaaccuuaccuagagcagaaaugaauuuagagagcugagugaaauauaaaaguagaagcagcagcuggaagagcccuguagacacuuuccugggcacuuccuggucccuagagaggcccagggaagccauuucugacuuuaucucacagggguucuuugggagggaugccaguggaacuggggauagaccacaggaaaaaggaaaguuccagcucaauucuguaauaacuuugaugaagcgcaaauuuuccuacgcagaauccagguuggguugggagguaaacaggaagcacagauaggaguacagaagacaagguagauggggaggggugaagccugaaagcccugcguguuuucucagcagggaggcuuguagccuggggcaagauuucaguccugcucaccagcugacaggauauaaacuuggugcuguugaugggggacagugggaaugagacuggccuuccuggcugcaugggagcuggaugaaacccgucacugccaacuuuccccaacuucccuagcgaccuguaugaugcagcagaagcagucauaaucccccuuagaucauaacuccaauggccugagaaucacaccccaucccccacagcaccugcagcaacccucacccaagcucagauccgccuaacgcuacccccaccugauggucuuucucuaccugcccugguagcugaagacaaaagacauaaucccuugggaacuccauggccucacccuucaccugagaaaccaaacuacuuauccaggagaccuuagccaagcuuguauccccucuauacuaccacagcugaugcucuucaaagcgccaccgccuggcuggaagcaaaccaacucacgccauuacagcaacucauuaaaaaacugcucuaagaaaggagaaaaugacagcuaauuccacaaccuguaacauccuggcuaaccacaggaccugagucuguccaccugacaacuucacugcuagcauaacaagcauucaaaaaacccaguaugcuaaacagaacaaccaaggacccucacagagcccacuucauuccucugcuaccuccacuggggcaggugcuggcauccauggcugagagaccugaagauggaucacaucagacacuccccagcaccagcccggagccugguaacuccacuggguggcuagauccaggagagcaauaacaaucacugcaguccagcucucaggaagccccaucccuaggggaagggggugagcaccacaucaagagagcacucugugggacaaaagaaucugaacagcagaccuugaagccaagaucuuuccucugacauaguccacccaaaugagaaggaaccagaaaaaacaacucugguaagaugacgaaacaagguuaacacccccaaaagaucacgucagcucaccagcaauggauccgaacaaaaacgaacucuuugaauugcaagaaaaauaauucagaaggcuaauuauuuauuaauuuuuuugagacagagucucacucugucacccagguuguagugcaguggcacguucucagcucacugcaaccuccgccuccuggguccaagugauucucucaccucagccucccgaguagcugggauuacaggcauacaccaccacgcguggcuaacuuuuguauuuuuaguagagacaggguuucaccauguuggccaggcuggucucaaacuccuaaccucaggugaucugcccaccucagccucccaaacugcuggguuuaaaggcgugagccaccguacccggccagaagguugauuacuaagcuucuuaaggaggcaccagagaaaggugaaaccaacuuaaagaaauuuuagaaauaauauaagauauggacaaaaaaaucuccagagaaauaacauaaauaaaaaaaaaaaucacaacuccuggaagugaaagacacacuuagagaaaugcaaaauagacuggaaauuuucaacaauagauucaaacaaguaaaagaaggaacuucagaacccaaagacaaggcuuucaauuaacccaauccaacaaagacaaaggaaaaaaaauuaaaaaaugaacaaagccuucaagaaguuugggauaauguuagaugacuaaacguaacaauaauuaguauucccaagaaaugagagaaaucuaaagguuuggaaaacauauuugagggaacagucaaggaaaacuucccuggccuugcuugagagccagacauccaaacauaagcucaaagaacaaccaggaaauucaucgcaaaaugaucaucaccuaggcccauagucaucaggguuucuaaagaaaagaaccauaagagcugugaggcaaaagcaucagguaaccuauaaaggaaaaucuaugagauuaacagcagauuucucagcagaaaccuuacaaacuagaagggacuggaagccucucuuuagccuccugaaacaaaacaauuaucagccaagaauuuugcauccagaaaaacuaagcuucguaaaugaaagaaaaaaaaguuuuuuucagacaaacaaauguugagagaauucaccacuaccaagcuagcacuacaagaaaugcuuaaaggaguucuaaaucuugaaacaaaacuucaaaauacaccaaaauagaaccuccuuaaagcauaaaucucacagggccuauaaaacaguaacaaugaaaaacuaacaaauaagguauucuggcaacaacuagcaugaagaauagaauaguacaucacaucucaauacuaauguugacuguaaauggccuaaaugcuccaccuaaaagauacagaacaccagaauggguaagaauucaccaaccaaguaucugcugucuucaagagacucaccuaaguacaaggacucacauaaacuuaagguaaagggguagaaaaagauauuccaugcaaagggacaccaaaagugagcaggaguagcuauucuuacaugagacaaaacaaacuuuaauguaagaacaguuuaaaaagacaaagagcgacauuauauaaugauaaaaggacuaauccaacaggaaaauaucacaauccuaaauauauaugcaccuaacacuggagcucucaaauuuguaaaauaauaacuacuagaccuaaaaaaugacagauggcaacacaguaauagugggggacuucaauacucuccugacagcacuaaauaggucaucaagacagaaagucaacaaagcuauaauggacuuaaacuauacccuagaacaaauggacuuaacagauauuuacagaacauucuacccaacaacugcagaauauacauucuuuucaucaguauauggaucauucuccaagacagaccauaugauaggccacaaaacaaaucucaacaaauuaaagaaaaucgaaauuauaacauguacucucucagaccacaguggaauaaaauuggaaaucaacuccaaaaggagcccucaaaacuaugcaaauacauggaaauuaaauaaucuguuccugaaugauuguugggucaacaaugaaauuaagauggaaauuuaaaaauucuuugaacugaacgauaacagagacacaaccuaucaaaaccuuuuggauacagcacuaguggugcuaagaggaaagcucauggcauuaaaugccuacaucaaaaaagucugaaagagcacaaauagauaacuaaggucacacuucaaggaacuacagaaacgagaacaaaccaaacccaaacccagcagaagaaaagaaauaaccaagaucagagcagaacuaaaugaaauugaaacaagaaaaaaaaauacaaaagaaaaauaaaagaaaaagcugguucuuugaaaagauaaauaaaaucacuagaccauuggcaauaucaaccaagaaaagaaacgagaagauccaacuaagcugaauuagaaauaaaugggagcuauuacaacuaaaaccacauaaauaaaaagaucauucaaagauauuaugaacuacuuuaaaugugcauaaacuagaaaaccuagaggagauggauacauuccuggaaauauauuauacaacccuccuagaguaaaccaggaauaaauagaaacucugaacauaccaauaacaagcagcaauacucaaaugguaauuuuaaaaacugccaacaaaaaaaaguccaggaccagauggauucacagcugaauucuauuagacauucaaagaagaacugguaccaauccuaauucacacuauuccaaaagauagagaaagagggaaucuucccuaaaucauucuaugaggccaguaucacucuaauaccaaaacuaagaaaagauauaacaaaaaaaagaaaacuacagaccaauaucccugaagaacagauguaaaaauccucaacaaaauacuagcuaacugaauccaagagaauaucaaaaagauauuacaccaugaucaaguggguuucauaccaggaaugcaggggugguuuaacauaaccaagucaauaaauguaauacacaacauaaacauaaaaacaaaagucacacaaucaucucaauagacacagcaaaaacauuugacaaaauccagcauugcuuuaugauuaaaacccucagcaaaaucaguauggaagggacauaccuuauaaaacucaucuaugacaaacccgcagcaaacauuauacugaacagguaaaaguugaaaguauucccccgagaacuggaacaagacaaggaugccuccuuucaccauuucuauucaacauaguacuggaaguccuagcuagaacuaucagacaagagagugaaauaaagggcauucagacugguaaagaggaagucaaacugucgcuguucaccaaugauaugauuguauaccuagaaaacccuaaagacucauccagaaagcucuuagaugugauaagugaauuuaguaaaguuucaggauacaaagucaauguacacaaaucaacagcacugcuauacaccaacagcaaccaagcugagaauacaaucaagaauuuaaucccuuuuacaauaguugcaaauaaauaaauaaauaaaauacuaaggaauauaccuaaccaaggaggugaaaaaucucuacaagaaaaacuauaaaacacugccgaaagaaaucauugaugacauaaacuaauggaaacacaucccaugcucauggguagaaucaauauggugaaaaugaccauacugccaaaagcaaucuagagauucaaugcaauucccaucaaaauaccaugaucauuucucacagaacuagaaaaaacaauccuaaaauucauauggaaccaaaaaagagcccacauaaccaaagcaagacuaagcaaaaagaacaaaucuggagguaccacauuacccaaauucaaacuacacuauaaggccacagucaccaaaacaucaugguacugguauaaaaauaggcacacagaccaacggaacaacagagaacccagaaauaaagccaaauacagcuaacugaucuuugacaaagcaaauaaaaacauacaguggggaaaggacacccuauucaacaaaugguggugggauaauuggcaagucacauguagaagaaugaaacuggauccucaucucucaccuuauacaaacaucaacucaagaugaaucaaagacugaaaucuaagaccugacaccacaaaaauuauggaugauaacauuggaaaaauucuuccagacacuggcuuaggcaaagacuucauaaccgagaagccaaaagcaaaugaaacaaaaacaaagauaaacagaugagacuuaaacuaaaaaucuucugcagaguauacaaacaacccacagagugagacaaaaucuccacaaacuaugcaucagacaaaggacugauauccagaaucuacaaggaacccaaauaaaucagcaagacaaaacaacaacaacaacaacaacaacaacaacaaauaauuccaccacaaagugugcuagggguauaaacaguuaucaaaagaagauauacaaauggccaacaaacauaugaaaaaaugcucaacaucacuaauuaucagggaaaugcacaucaaaaccacagugugauaccuccuuacuucugcaagaauggccauaauuuaaaaauaaaaaaauaacauguuggcauugaugugguaaaaagggaaaacuggugagaauguaaacuaguacaaccacuauggaaaacaguguggacauuccuugaagaauuaaaaguagaucuaccuuuugauccaacaaucccacuacuggguaucuacucagaagaaaguaagucauuauaggacacuugcccacacauguuuauagcagcacaauuugcaacugcaaaaaauggaagcagcccaaaugcccauuuaucaaugaguagauaaagaaaaugugguauaccaugcaauacuacucagccauaaaauggaacaaaauaauggcauucacagcaaccuggauggaguugaagaccauuauucuaagugaaauaacucaggaauggaaaacccaacauuguauguucguacaaugugggagcuaagcuaugaggacacaaaggcauaagaaugauacaauggacuuuggggacuuggcagggggaugaugggaagaagggauaaaagacaacacauugugcacaguguacacugcucaggugauggguacaccaaaauuucagaaaucaccacuaaagaacuuauccauauaaucaaacaccaccgcuuccccaaaaagcuauugaaauagaaaagaagaaacaucuaauaacaauaaucuaaguuuuaccuuagguaacuagaaaaagaagagcaaauuaaauccaaaguaaagaaaagaaaauaaauacuaaaaauuagagcagaaaucaacaaaacugaaaacagaaauuaccaaaaccaaaagugaauugcuugaaaaugucaauaaaauugagaagcuucuagccaaacuaacuuaaaaagacagagagaaauacacaaauuacuaacauuacauaugaauaaggaccgucacuacagaucacauggacauuaaaaggacaauaaaaaauauuaggaacaacucuaugccugugaauuuguaacacagaugaaacuggccaauuuuuaaaaagauacauccaccaaaacucacacaagaagaaaaagauauaggccuuaaagaaaucuaauuaacaguuaauagcuuugcaaaacagaaaccaguaagcccagauguauucacugguaaauuuuaccaaacauuuaagaaagaaauuauagcaagucucuauaucucuuccagaagacagaugcagagagaagugucuaacuucuucugggaggccaacauuuuccuaagaccaaaaccagacaaagacauucuaagaaaaaagaaaaaaaaaaaaaaacuacagacaaauaucucucaugaacauacaugcaaaaaucaucaaugaaguacuagcaacuauaauccaacaauauauaaaaacaauuacaugccacuaccaagugagauuuaucccaggaaugcaaggcugguucaacauuugaaaaucaacuaauguaauccaucacauaaacaggcuaaagaagaauaaaaaucacaugauuucaccaauaaacacagaaaaagcauuuaagaaaauccaucacccauucauaaaaaacucucagcaaaccagaaauaaagggaacuuccauaacuugagaaagagcaucuacaaaaaacguacagcuaacaucauacuuaauggugacaaacuugaaacucucccgcuuggaucaaaaacaaagcaaugauguucuguaaucaauucuuuucaagauaguaucagaauuccuagcuaauacaauaagaaaaggaaacccaagguauacagauuggaaaggaauaaaacuuuguuugcagaagacaggauuaucuauacagaaaaucaaaagaacugacaaaaaacuccuggcacuaauaaaugauuuauagcaaggcugcagaauauaagguuaauauacaaaaccuaaucaguuuccuacauaccagcaaugagcaagagaaauuuuguuugguuuuauuauuuuuuuuuuuuagagacaaagucucacucugucauccaggcuggagugcagugguacaaucaugccucauuacagccucaauguacuaggcuuaagcgauccucuugccucagccuccuaaguagcugagaccacaggcacacaccaccacacauggcuaauuuuuaauuuuuuuauagagaugagaucucacuauguugcccugaucucaaucuccuagccucagucgccaagcauuccuccuacuaauccuuccaaagugcugggauuacaggcaugagccagcacacaacaaggggaauuugaaauuaaaaauauauuaauguuuauaguagcacccaaaaaacaaacuacacagacagcuauauaucuaacaaaauacaccuaacagcuauauaaggaaaacuacaaaacucuggugaaagaugucaaagaccuaaauaaauggagaaauguugcauguucaugaauaagaaggcaauauugucaagaugccaguucuuccaaaccugauuuacagauucaauacaauuccagucaaaaucccagcaaguuauuuuguugauacugauucuaaaguauuauggagaagcaaaagacccagaaaaaccaagacaacacugaaagaaaagaaaaacaaaguuggaaggcugacacuaccagaccucaagacuuauaauaaaaccauacuaggcugggugcgguggcucauaccuguaaucccagcacuuugggaggcugagacgggcagcaggagcuugacaccauccuggcuaacauggugaaacccugucgcuacuaaaaauacaaaaaaauuagccaggcgugguggcgggcgccuguagucccagcuacucgggaggcugaggcagcagaaaggcgugaacccgggaggcagagcuugcagugagcugagaucaugacacugcacuccagccugggcaacagagcaagacuccaucucaaaaaaacaaacaaacaaacaaacaaaaaaaaaaaacaaaaaaaagaagccauacuaaucaagacagcaugguguugccaaaagaacagacaaauugaucaauggagcagaauagagagcccagaaacagacccauauaaaagucaacugacauuugacuagggaacaaaggcaauacaauggacacaugauacagacuuguuaaaggguguuggaacaacuggacauccacaugcaacaagaaaacgauucuagacacagaccuuacaccuuuuacaagaauuaacucaaaauggaucacagacugaaugaauguaaaauacagaacuauaaaacuccuagaagauaauaaaggagaaaaucuagaugaccuuaguuacagcgaugauauuuuuaaaaaacacaaaaggcaugauccaugaaaaagauaaauaauaaucuggacuucauuaaaauuuaaaacuucugcucugcaaaagacaaugucaagagaaugagaacauaagccauaaaucgacagaaaauauuugcaaaagacacacugauggccgggcaugguggcucacgccuguaaucccagcacuuugggaggccaaggcgggcggaucacaaggucaggagaucgagaccaucccggcuagcacggugaaacccugucucuacuaaaaauacaaaaaauuagccgggcgugguggugggcgccuguagucccagcuacucagaaggcugaggcaggagaauggcgugaacccgggaggcagagcuugcagugagccgagauugcgccacugcacuccagccugggcgacagagugagacuccaucucaaaaaaaaaaaaaaaaaagacacacugauaaagcacuguaaaccaaaauacacaaaguauucauaaaacucaacaguaagaaaaugaacaaccuaauuaaaaaacaggcaaaagauuugaacagacaucucaccaaagaagacagauauacagaugguuaauagcauauaaaaaugcucaacaucauaugucauuagggaauuccaaauuaaaacaaugaaaugcuacuacauaacauauuagaauggccaaaauccaaaaacacugacaacaaaugcuggcaaggauguagagcaacaggaacugucauucauugcugcugggaaugcaaaauggcacagucacuuucaaaggcaguuuggcaguuucuuauaaaacuaaaaacacuuuuaccaugcaauccuguaaucaugcuccuugguguuuacccaaaugaacugaaaacuuauguccacacagaaaccugcgugcaaauguuuauagcaacuuuauucauaauugccaaaaccuagaagcaacugagaugucuuucaguagaugaaugaauacauaaaaugugguauaaccagacaacgaauauuuuucagugcuaaagugaaaugaacucucaagccauaaaaagacauguaggaaauucaaaugcauauuacuaagugaaagaagccaauccaaauggcuauauacuguaugaauccaacuaugugguaucuuagaaaaggcaaaaacuagggagacaguaaaaagaucagugguugucagggguuagagaaaagggaaagaugaaucagagggacacggaggauuuuuauaauacuauucuguaugauacuauacuggugauacaugucauuacacauuuuucuaaaccuauagaauauacaccuccaagaguaaacccuaauguaaacuauaaaguugggcgauaaugauguaacaauguaaguucaucaaugauaacaaauguaccacuguggugugggaugucaauagugggggauguugcaugugugucaaaacauggagcuuaugggaacucuauauuuccuguucaauuuugcugugaauguaaaacuugucugaaaaauaaaaaguuauuaauuuuuugaaaaauaaucaucuuccaucuaaguaguguuacucaaaaaaauaagugucaacugccaaccacacaaaugccuucgggagcuucaaaaaguuaaggcagggaauuagauuucaaaauguaguuccucauauauucaugaagugauuucuuucaacuucuuaaaaauauuuuuaggccagcaaaaagucuaaucuuuuauauacaucuccauuuauaaaauuaaaacucuaacacauaauuugcaaaucaucuaaaacuacguuaaauucacugaguaaaauuauaaaacuaguaaauacuuuguauuuucagcagauauaaaacaagaacuuuaaauguaaaguacuuucauauguaaaaacauagccuugauuggcugggcacgguggcuuacaccuguaaucccagcacuuugggaggccaagguggguggaucacgaggucaggaguucaagaccaucuuggccaacauggugaaaccccgucucuacuaaaaauacaaaaauuagcugggcacuguggcaugugucuguaaucucagauacucgggaggcugaggcaggagaaucacuugaaccugugaguuggagguugcagugagccgagaucacaccacugcacuccagacuggugacagagcgagacuccuucucaaucaaucaaucaaucaauaaaauagagccuugaucaaccaauuuccaaacagacugaauaaacaaucagaguauuuuuaaaguucaaugacuuuguaaaggaauaaaucaaaaucucuuccuuauauacuccugccaaaauuuuaauuugcuaauuuuucaucuuaguaauuauugcuaccagcugggcacaauggcucaugccuauaaucccagcacucugggaggcagagguaaguggaucacuugagcugguucauggccagccugggcaacacagcaaaaccuugucucuacaaaaaguacgaaauuagccaggugaggcaggaggaucacuugagccugggaggucgaggcuguagugaacugugaucaugccacuguacuccagccugggugacagagagagaccuugucaaaaaaaaaaaaaaaaaaaaaaagagcaagcauuacuaccaauuacuaccaacuacuacuauccaagcaugacaaaaaucaacaauucuugauaaggcugaggaugcagaaugagaaaaaaauaucccaacauauguaggaucagauuucuaugauaagaauuuguucuucuuucacucauuuauucacuagcuauuuacugaccacucacauggugcuaagcacuguaguaagcacuagagaugcgauacagaaaugauaaacaauaaaccuuugacuucuuagaauuuguuucuagugaggaaaacaaauacuuuuuaaaguaaacaaacacauaaauaaaaugauaguuucauacucugaagaaauaaggagggaucuacuucacauagggucagaaacagccuuucuaaggagguguuaucuaaaucaaguccuaaagacugggaagcuaccagauguagcaagagcacagugugaacggagucaugggaugaucaaaguacaggaaagaacucaggcccuuuuacaaacugcccgaaagcuggugugaccacagcaugcgagugaggagggaugguccugacaugauguagaagaggcagggauacccagauuguguaggacccucguagaccucgguaagcaguuuggguuuagcuccacaugcagugggaaucuauccaagaguuucaaccacgauacuaacaauauuugauuuacauuuuauaccauucuggcaguuuauaagguuauaauagauuauaggaugcaaacaucagcccaaacaagagaucaugcuugagcuagcuugguaacaauaaaaauggaaagaaauggacaaauuuuagaaauaacugucauucuaagaacagucuuugcuuauguccuuggaagucccuuugucaugggauuaucugaaaaacaauggaugcuaucaauuaucuuuuuaaauggaugaaguucaaugaaaagagagagagagggagagacuuaaaucucagccuggcccuauccuaaauacagaaauguaugcaaguuacucaacaucaaugaacagcacguuacucaucuaugaaaugggaauaaaugacaccuaccuuucacagaagcauuaugagguuaaauaaaaauccuggcaaucugccuauauauuuuguucaugcacauauguucuauaaauguuaauauuuacucccacuccuguaguuaacagcauuuucuaaugcccugaauggaaaaggaguuacuuaauaucaaggaaugcauuuuugaugauggaauuucaagcaugagaacauuagagcacaggagauauucugaggcaaggaagcauuccccugaaaccaagugauuaacccaccuaccaugacacaagagcauucagauuacuguauauauuuauaaaauacuugaucuucagaaaaaucaaacuauuaaauauugaugaauucugcuuaaaauacaaagguaguuaauacacucuuaacuugaauaggaaccauuaauaucaacuacuauaaagcugacagugaaacauuaaaauccuaaguauuuuacuaagcaacaauuauucuuauaccaacaaaacuagauuuacagaaggaaaagaucaaaacaagacuuuuauuacagcacagguagaaaaaaacgcccaccacagaugggcuuaaauuugccauuuuaaaaugaacauuuaaaagcugaugcuuauuugcuaaagaauaaagcacuaaaagacagaauacuuuuaggaccugguaacacugauguuaaacucacaaaacguuuuauucuguguaguggggcucaauauaauuagugucaggguuuaucuaauuuuggccuuuuaaaauuauuaaauuuuauaucuacugugacauauuccugagauuacuagaauuuuuauuaauuuccauuaauuucaaacuaaauacauuaacuuucuugagaagguuccucauccacaguagcugaucuguuuguucucucaacagacaccuuuguucguuuacucagagaacagaauaaaaagauaagggaggggauaucugcagcacgacauguaauucuaauuaauuacuaugaaagggagggaguugugggcucaccacagcaucacagaccuauuauucaagacaucuuaaaaagcauuuuauccauggcuaguauucagcuaagacacaccaauauggguaaaugagaucgguauaacuaguaucuguucuauugcuuuggguccaugcuguaucagcuguuuaaauauuuuuacuaucacuaagauuacaguccccaguuggccugggugcucccuuaggggcucuagauuugaagguuccaaauguaaacuggaagacaguuuacaauucugggcucacaauuuagaaagaaauaaaaacuuuuaagggcaggcacagacacauuucaaaguuuccaagauaagacugaaagaaaucaguaucacuuaacuuacagaaagaaaaaagaucacagccaaucaaucugucacuuuuauaagcuaacagaauaagagaagaaaggguuaagaugaaggaccaagaauuuugguuaaauaaaaagaacaucaagugauauuauuaaaaaguagaaacugacagagauauaaaauuuguaaauaaguagacucugaaacagauuacaucaguguauaaugguggucuuaucugaagauuaagcaguuucucaaauuuguuauagagugaaauagacacagaaaaagguggcagucaagaaacugaaauccuuguaguccccacugcuaacacucuguauagcuuaggacaccaacuucaguaauuuggaccucaguuuccucacuugcaaaauuagagggucuaauuguaugucuuuuucucucuuaguuauaaaaaaguaugauucuaggcuaauauggguuauggcuaacacaauaugucaagaauacaggaguaagccaugggaauauaucaaugauuacauacaaugaggcaaagaacaggugcaaaugcauuauuacaaugcacuaaauuacuacuuugauauaacaaaugguauaccaaguaguaugaaauuuuuuaagaagcuugacaagauacuuauaccaggaaacgaacuaucuaucuaggucacuaauacuguacaugaauauaaaaaucaaguaacaauuauacguuauaauauuugguaccaaaauaccaugcuugccuucugaaggucauuuuaaaaaacagcacagauuuuuuuuuauuuuuuucauguuaugcuuuguucauaagaaaaagaacauuugcauucucgaagcauauggaaauuaacagugagaaaaaagagaugcuaaaaugucuuagguuguagagggauuaagaaauucauuccugacauaccaacgauguacucuagauaaaaaagauaugauuuucauccaucuauuaguaaucacuuaucauaaaugcacucaauauuuucacuuaaaaauuaacucaccaaauggaagcauuuuaugaaauaugacaugaaacuuaguaauuaagagcuucccuacauucucaaagaagccaaggugacaugcaauaaaacauauauaaacaauacgugaauuuggccaucuuacuuauuuauauacaagcuaaaauuugauuuccaauccuauacucugacaccuaaaaagaaacgcacuuaauucugguaaguuuuccuuaaggugaccacaacuaaaaacuucaguauaucacacacgaugaaagcauuggacuuuuuuggaucauuuagcuucagguacaugauuaauacuuuuugagaaaaaauauaaaugcccauaucuuacucucucccaaagauagcugaaaacuuuguauagaagaaagcuuuccuccuaaaugcuuucuuuacaaugacuaauucaccaguaggcaaaaagcucaaagaauguagaauaagugaauaaaagaacuauacuaagugcuuacaugaugggggaaauaaucaaugcuacaaaugacauauuuuaagucucauuaagaacaagucauggucauuaccuucaaaacaguuccaauauuaaaagucaagaaauaacaagcuacaaaaacaugcacauauccuauuguuacaccgaagagaaacuuaaugucucaguuagaaaaagugugcaucugaagcagagauaacauaaucuacucuuuugccauaauaugugaucaauagcugaaucauuuaauguagugaucaauaaauaucuuuccuuuagucuuaauaaaaguauuuucacuuaaggguauagauuaaagaaugaaacaaaaaaucuugauuaccacagucauuguuauuuacucauaagugucaaaagccuuaggaacuuucuaaaagugcaaagaggagacaugcaaguugcaaugcucaacucuacauuccauguaguauuguaugaauacacuuauuucuguuuuaaaauaauaccauuuauuuucuuacaauagucauuauugcacaaucucauuucaguauuauauaaguauuuuucuguggauuauauccuuuaggcaaaucacguuauagaaauaaauuuaaucaucacucaaccuaauucuuaacuucauaugaaauggagaauacauucacaaaaucaccugacaagcaaucugcacgagguagaccagcucuuuagauucacagccauuuuucauuacuucauucuguucuucugaaagugaaagcuacaucacagaaaaaaaagaagagggggaaagaaagucaugauuaguaaacgagaauaaacuaagcauucauaauaccuggagcaucaucuccgggugagcaucagcuuaaugugagacauaucuuauaugagaacuucauugcuuaaggcagaugaaugaaggacuugguguuucagauaaaauauauaucuguaucuguguagcuuacguauaagggucuucacuuccuuaaucuauuuaguacauacaugaaacuaagcacugagagauaguaugacauaacaguuuaaaagaguucagaccuuauuacauagauuaaaaacuggcugcagauaacagguugggccuauggacguguuuaauuucaaaaucaccauguagugggguggggaggagguggggaugguuaauggguacaaaauaaacagaaagaaugaaaaagaccuaguauuugauagcacaacaaggugacuauaguuaauaauaauuguacaguuuaaaaugacuaaaauaguauaacuagauugucuguaacacaaaggauaaaugcuugaaggauggauaccccauuuuccaugaugcuauuauuacacauugcaugccuguaugaaaacaucucauauaccuuauaaauauauaaaccuacucuguauccacaaagauuugaaauuuaaaauuucaaaaaaaaauucaccauguaggucugcauacuggauuuuaguuuuauuuaaaccagcuaccgacauguagaagcuaagagguuucaugugaaaaauacagauuucuggcuucuacugaaaaaucagaaaauugggaagauuggaccuacauucucacacgggcaacaacuagcuacagcugagaaaugaccaucaccuuuaaaugagguguauauuccccaagaaaguuugucacagaacugacuacccuguaguuuuuuugccaguaucuaggcugaguauuaauugucauucaucaugcuacuugcuuuguuauuuuucuuauaccccacuugcuuuacucacuuauguuacacaccugccccaucuuuggacgucaauuugcaaacgcggucccagagauggacaacccugaguucaaauguguuuauaauuugcaauguaauauugaccuaccugcuuaggcucucaacuggaaaaugaggaugauauaauauuauguauucucaaguuuguggguauuaaaugagaugaugcauggacaguguccacccagguaacuaauacuuaauaaauguaauguaccauuauaauucauacuauaugaaguacaagguugaugaagauauauucucuauugaggaaagugguaucacaaaguauuuuuuuaaacuucagauauuaaguacaaguuguucacaagauaacaaucauuuucccauuagcccaaaaaagccagguuaaugauaaaagcauaguuuaaaaaagaaauaaaauaauuaagggugaaaagaaaccuacaugaacuaguuuucagaaagugacaacacuuucaugagacagaagugacucaaagaugugcuuggacgccuggcagagauacaagagaaaaaagaaucuauguuagacaggguaaggagaagccagccaaaccuugaguaacugcauauaaacuaaagugauaaacuaaaauuacacuguaguguaaucacuaaagugauaaacuaaaauuacaacucucuguagcagagaguugacacucacccaucaacugauucccacagguacucaccagggauaucgggugaguaaaccaaggcugcaggagaggaagagaacugagagaaugaaccugugaaguaugggaagccuccccaaggacaaggcagcuaaccucccuugacugggagcagggcagugaaacagaggaaaggagaacuggaagauaccccucugaaggcacucaggacacucaacaacugaaggauggagguggcacagaaaagcugggagaaacugcaggccuucacagcuacccucaaagcucuugcauagggcaaggggaagagugcucuccagaggcacaaaauacugggggaaagaacuggacagacaagagaauaagcauccaggcugcaaagcagagaaagagaacauguucucccucaguucagaagaucugggcuucauagcaaagcacaaagauaccuucagcaucucaccacucuucaguuuuccuugugaaagaaaucucagaaccuuaacuucaaaauauuuaaaguagugauaaacucaaucaaaguaaagcugucauaaaagaccagaucuuaucaaauacagaucagccugaugcagcaccucauuucaacagacugaaagaagaagagauaagcccuuuccuggagguaaguuuacugacuuuagucucagcuguuucuuauauauuucacauuaaagaauuacaaaacacacagauaagcaagcaaaugugacacauggucaugagaggcaaggguaaaauaaagcagacacagaauugggccagauauaaaaauaauaagaaagagaauguaaauuaaauauaauugagauucuaaaauacaguucaacaggcaaacaacacgcaaaagcacacgagaaagagaagauucuggaaaaacggcagacucaccaggaaucgaucuuuccaccuagacaauaacugcacuggcagaaucuguccgguggauaacuauuuugacaacucugguaucuacugaaggccugcuacuuccaagggaaggcuuggaugggaaacuguaguucauuuuggucaacaucagcacuuaagaaaguaacagcucccuauacccccccggccccgccccgccccugccaccccuauagcaggcagcugugcacauacuccuggagcagcauaaacauaccuuacaagagucaagacagacaaaaagaacacugccuccaaauuucagagaucuaugcuguggcugcggaucacugcuuuggauugcagaggugcagacaaauagcuauguguccauuacaccuagcuccacuguuugcaggcccaugcuccucuggcuaaagugacuggcagcagacauaaagggccaacgcccuuuuccuucccugucccccuugauuuuucucuuuuuccuccuuugggaaaauauaauagacuagggcauucaaaagcaacugaccuauucaaaagacuuacagagaaaauuagaaagugacugcacacucucagagaaagguacagacuuaggaaagacaaaagaagacauuaaguuccaacucaggcugaucuuuggcacagagacggacaagaacaauaaaaaacaaacaaaaacaauaaaaacagcagucccuggggaagaaggagaaucugguuuucagaguuaccacaucauuagauucaaauguccauuuuucaaaaaaaaaaaaaucacaaggcauauaaagaaacagaaaguaugaaccuuucaaaggaaaaaaugaaucaaaaugaaucaugguggcucacaccuguaauccagugcuuugggaggcugagacaggaggauagcuugaggccaggaguucaaguccagcuugagcaacauagaacaccaucucuacaaaucuacaaauuuuuuuaauaaaaauagaaauaaaaaacuguuucugaaaaagaucugauaguagguuuacuagacaaacaacuaucuuaaagauguucgaagaccuaaaggaaguuguggaaaaagucaaggaaacauuauauaaacaaaauagaaauaucaauaaagagauaaaaagccuagaaaccaaaaucaaauuuuguagcugagaaguauaacaacugaaaugaaaaauucacuagagggauucaaaggcagauuugagcaggcagaagaaacaauuaguuaacuuaaagauaagacaaaagagaugauugaguaauaggaagaaaaaauaauugaagauaaguaacaagagccuaagggacccaugggacacccucaagcaaaccaacauacacauguaggaguaccagaauaaaaaaagagagagaagggacaaagagauuauuugaaaagauaauggccccaaacuucccaaauuugauaaaagacaugaauaucaacauccaagaagcucaaugaacucuaaguaagauaaacucagagagacccacacuaagacacccgauaaucaaauguucaaaauacaaagacaaggaggcaaucuugaaagaaucaagauaggagugacucaacaccugcaagggaucaucaguaagacugggagauuucucauuagaaacuuuaaaggucaaaaaacagcagguaaauauauucaaagugcuaaaagaacugucaaccacuaauucuauaaccagcaaaacuguccuuaaaaaguaagggagauguuccuagauuuuaaaaaucccaacuucagauguucccagauaaagaaaagcugagggagucaguuaccacuagaccugccaaacagaaauucucaagggauaccugcaggguaaaauaaauuaaaacacauacacacaaacacuacuaacucaaacccuaaugaagaaguaagaacucaauaaagguaaauauaugggcaauuauaaaagccuguauuacuguacaaugauauguaacuccacuuuuuguuaucuaaaugauuuaagagacuaauacuuaaaagaaaauuauuagucuaaaggcuagcauuauuuauuuuucuuuuucuuuuuucuuuuuuuuuuugagacggagucuugcuccaucucccaggcuggagugcaguggcgcgaucucggcucacuacaagcucugccucccggguucacaccaauucuccugccucaaccuccugaauagcugggacuacaggugccugccaccaugcccagcuaauuuuuuguauuuuuaguagagacgggguuucacuguguuagccaggauggucuugaucuccugaccccgugauccacccgccucggccucccaaaguguggcuagcauuauuuuaacuuugguuuuaauuccacauucuuuccuacaucauuucaaaggcuaauauauuuuaaaaauuauuuauguuucagagcagaaaaauguauaaagauguaauuuugugauaaucaacaaccaaaagaggagaccauggagcuauuacaggagcagaguuuuucuauguuaauaaauuuaaacuggcauaaauucaaauuugaauguuauaacuuuagaauguuaaauguaauccucauggcaaccacaaaaagauagcuauagaaugugaacaaaagaaaauaagaaagaaauuuaaacauuucacaauaaaaaaucaacuaaacacauuuaaaaagcauuaaugcaggaauauagggaaaaaagcuauaagauauaaagaaaacauauagaaaaaugagagaagucccuccuuaucaguaauuacuuuuaaugugaaugaaauaaacaguacaaucaaagacagggauuggcagaauaacaaaguaacauaauucaauuacagugaugugccaccauaacaacauuuuggucaaugacaaacugcauauaucacagugggcccauaagauuauaaaaccacauucuuacuguaccucuuccauguuuagagacacaaaugcuuaccauuguguuacaacugccuauaguauucagcagauuaacauucugaaccaguuuguagccuagaagcaauaggcuacaccagauagcuuggguguaugguaggcuauaccuauucuaaguauguuuuagagauauucacaacuacaaaaucaccuaauaauauaucccucugaaaauaacccuguuaagugaugcauuacuauauauggugguuacaggagauacacuuuagacccaaauacacaaauagauugaaaguggaaggauggaaaaagauauuccaugcaaauugaaaccaaaagagaguggaggugacuauacuaaaaauaaauaaaacagacacuaaaccaaaaaguuuagaaacaaaaaagaauaguauaugauaauagaagguucaauacacaaagaagauacaauuauaagcagugggggagaacaagguggcugacuagaugcagccaggugaaacagcucccacugagagaccaagaugacuggcgugcuucuaacagaucuucagagggaaggcacccagaguguacacaaggaagacacagaagcuaggcugaagggggagaaagcugggaacccugcauggggcuacugugcacugcaccaggacucguuccuggaucccaacagcucccggggaagaggugaauugaacuggcaaggagcaaccugcacucgcuacaggccucugaaacccuggcaggcagagaccccccuuugaccaccauggacacuugaauuggcagggagagcuucuuagagaagugguaggggcagcaauccaguugauguggagcccagaagguuugaugcaggagcauccauagcagagcacauuuaggaguggucaugcccauaagcucaacuugcaaccauagguggcuuuacuucaaggggaacugcuagaccugaucucugcaagauggucuugcccaucagauggggccaguucaaucugaccaucccuuggugugcuggccucucccaaggacccagccuggccacacaugcuugcagggcagccucacauguccugggagcuauaucacagcuucugcaaugguggaccaugccugaccuguggagagcugcagagggguggcaucuaugaccaugcaucagcccagacucccuccccauaugucagcuuccccugaggccauggcaacuccacacaucacuuugcuggcacaugucaguaugggcagguuucgcuuuccuuucuccaccagugaacaagagugcaauccacccuaccuccaccugccgaccaccacuguagacggagccuuggugggcagagccagccaaccccaacccugccugcacccugcccuuauacuaacacugcacagagaacagcgaauccucucccacccugagugaccacuucugcuuauguggcacagagaaggcaccuagaccugcgcccaccagcucccaagccaacaccaccuccagcacaacugugugcacaguaaccaacagagggccuccacccaccacccagcugcauugccccugccacuguggugaaugcccauagggagccaagcacccuggcacccacuagcacucugcugcagcugcuguuacaaggauggacccugcuaucaccacacuaugaaaugcuuugacugucaccacccauuggaguguagugaccagcaguccaggagcacuuugguccccaccaacacaguggauuccuaaccucaaggagacagagaacaaagucuggauguaauacaguugggagcagagcgcugguccccccaaaaauuuccagaaaugaagccaaucagcugaauccccuucauaacacaaucaaacccuaaaggucaucaaauaggauaaaagggggaaaaaaaacauccaaaggccagcaaccuaaaagacuguacauaagcccacaaacaugagaaagaaucagcacaagaacccugaaaacucaaaaagccagagugccuucuauucuccaaacaaauguauccucucuucaguaaggguccugaacuggccugaaauggaaauagaauucagaauaugcauaggaaugaagaucacugggcuacaggaguacacuaaaacccaauccaaggaagcuaaaaagcaugauaaaacaauacaggagcugacagacaaaauagccaguauagaaaauaauguaaccaaccugauagagcugaaaaacacacuacaagaaguuuauaaugcaaucacaaguauuaacagcagaacagaccaagcauaggaaagaaucucaaagcuugaagacaggcauucugaaauaagacagacagacaagaauagagaaaaaagaaugaaaaugaacaaauaaaaccuccaagaaauaugggauuguguaaagagaccaaaucuacaacccccugguggcccuuaaagagguggagagaauggaaccaaauuggaaaacguauuucaggauaucauccaugagaacuuccccaaccuaacuagagaagccaacauucaaauucaggaaauguagagaauucaaguaagauacuucacaagaagaucauccacaagacacauaauugucagauucuccaaggucgaaaugaaagaaaaaaugugaaaggcagcuagaaagaaaggucaggucaccaacaaagggaagcccaucagacuaaccacagaccucucagcagaaacccuacaaaccagaagauauugagagucaauauucaacacucuuaaaaaaauuccaagacagaauuucauaucuggugaaacuaagcuucauaagcaaaggagaaauaagauccuuuucagacaaacaaaugcugagggaauuaguuaccaccagaccugccuuacaagagcuccugaaggaagcacuaaauauggaaaagaaaaacuguuaccagcugcuacagaaacacacugaaauaagcagaccaaugauacuauaaagcaaccacauaaacaagucugcaaaauaaccagcuaacaucaugaugacaggaucaaauccacacauaucacuacuaaccuugaauguaaaugggcuaaauaccccaauuaaaagacacacaguggcaaacuggauaaagaaccaagacccauugguaugcugucuucaagacaccuaugucacaugcagugagaaccacagguucaaaaugagggaacuucuaucaccuaacaacaacaaaaacaaaaacaauuuaaaaaugggcaaaguacuagagaauagacauuucuccuaagaagauauacaaaugaccaguaagcacacaaaaagauguucaaaaucacuaaucauuagcaaaugcaaaucuaaacuacaaugagauaccacuucacauacauaaggacaccuauuauccaaaaacagaaaacaucaagugcugguuucaaauuagagugacuaaaacccuuguacauuguuggugguauucguacugccacuguggaaaagagaauggugguccucaaaaagcuuaaaaggagaauuauuauaugaccuagaagaauuacuauaugaccuagcaauuccacuucuggguauacaccccccaaagacaaaacagagucucaaagagacauuuguaaacccauguucacagaagcauuauucaucauaacuaaaaagcagaaguaacccaaugcccaucaacagaugacuggauaaacaaaauguggugcacacauuuacacauguauacaaacaggcaaaaugaaauauuauucagccucagccuuuaaaaagaaaaaauucugacauaugcuacaacagggaugaacacugugcucauguuaaauauaccaaacacaaaaagacagauacuugauucuacauaugugugguacuuacagcagucaaaagaaaauaugggaaauccagcagagauuaaaacuaugaaaaaaaguuccauagaaaaugcgaaaaaugauuuuuuguaucagauuuuaagagcaaacuggcaacaguaaaugaaaggagcagugaacuugaaaacaggucaaugaaaaguauccacacugaaucacuaagagaaaaaaagaauaaacaaaaauaacaauacaguucagcucccuaagagaaugucaaacacauauaaccauagauauaauuggaguaccagaaggagauaagagagaaugaagcagaauaucucaggagauaccagaugagaacuuuccaaaauaugugaaaacaucagcuucaaaaucaagaaacucagugcaccccaaacuaaaugaauaaaucaguacuaaacauaucauaauuauaauuuugaaaaggaaagauaaagaaaaaacuuucaaucuauaaagaaaaaaacauacaugacucaugguggaaaaguauaaauaacagcugacuucucaucagaaacaagagaggggagaagacaaaaagaaaacaucuuuuaagugcugaaagaaauguugucaauacuauuaauauaauucaugccaauaaccaucagaaauuaagcaacauaaaaauauucacaaauaaaaauaaucugaaagaaucugucuccaguagacuaguccaaccaaaaaacuaaaacaaguucuucaggcuaaagagaaaugguacuagacaaaaacccagaacugcaggaaggaauaaacaguuccagaaauaggaaauaucuaaguaacuauaaaacaccuaacaucucaacaguaacagauggaacgguuuaagaauaucuuuuaaguucugagaaaagagauuuaccaagauguuauucauaccuaaacuaucauguaaaaauaagagccaaaaaaagcauuuucugaugaacaaaaacugaagaguucccaccaacaaaaccucaccaaaaaaaauuucuaaaauauguaccucagaagaaaagggauucuaaaagaauaaacugagaaguaagguagaaauauugaacaagaaauucaggaaauaaguuuauaaaucgaaacaaauuuagcuauauaagaauaguauuuaauuaugaaagaugaaaaguuagaauuaucauccugaacaacacuaacauggaggaaagagugaucacaguuaaaauauucuaaaugcugauacuuuaugacagaaucagagauaccaaaaaauuuagccuuuaaauuagguuuuugaguuaugauuuuaauugcagccauaaaaagaauagaaaaaugauacauauuuucuauuuucugguuuccaaaccaaaaggaagaggauaaaauuuuuaaaugucaauaaccuuaaaagaaauuaagacuagaaauaaaauuaaucucucuaggaagaaauggggaggaaggcauaaggagagagaacauuucagaaaaaaaaaagcaaggagauaagaagaaaagaaaaaacuaaaagagaaagaagauggccaaauggugucaauaaaaugguaaaguagguggcuacaagcuucaaucccuccaaaaaucacaaaaaacaagcacaaucucucagagucaacuuucucaguacuccagaaaacaguaaaggguuuagaauaaccaagagaucacugaaucaaggaaaaagccacuucaaaauaggaaagcuuuguggcauuuuuacuugugcuugccccaaaccucucuggcucagcaguagucuuaaugaugccaacccucaccgggccugaaaggaauagacagacccuauucacaaacuauuguuugucucuucuaaccugucuagaggcuaccugaagaacugaugcaaggugcuuaccuacauuucaccuaauauggaacucauucaaggaggaaaaccauuaaauauugcuuaaaaauacaguaaggcaaacaaaaacucuacaacuaucuggagcaaaaaaauuauauuugagacauaaaguaaacaaccuaaaaucuaagagggaaagcugaguagagaggucucugggaaaugacagcauucaaaagugccuggguauauggaaguauuuugaaagccaugcacacgcacaggguaggacacauacucacaaaaagcuaagaagucccuagguuuucaccuccagcugaccucuaggauaaguguaacaugaagggaagacgaaggcagaccuguaaacagcuucgcuagguguugaaugaguauuccaguacagaagcaacacguaaagaccggagaaaguggcuuuuucauugauuuuuauuuuucacuccuggcauucaaaaaaaucccugacaaaacacuaccuaaacacaagcuaaaagaagaaagacuuuacuaaauacauaugacaaggaauacagucuucacuaaaacaguuuggaaaaaaaaaucaccaaacaaaccgcagccaugaacaaugaaaaaaaucaaacucuuaaggauagacgaaaacccaguuuccagaguuacuacacuauaauauucaaauguacaguaugccacacaagccacaaguuauacaaagaaacaggaaagcacacauucaucagaggaaaaaacaaaaacuguaccugagaagucuauauaugggacuuaacuagacacuaaauaaacuguauucaacacauucaaaaaguucaaagaaaccauggacaaagaaauaagggaaaucaagaaacugauguaugaacauaugagaauauuagcaagaaguuauaaaguauuaaaaaaacaaagucuggggccaaaagguacaauaacuaaaguuaaaaucugacuagacaaaagacaacagauguuggugaggcugcagagaaaaggaauugcuuauauacuguuguugggaauguaaauuacuucagccauugucgaaagcaguuuggagauaucucaaaagaacuuuaaaaacagaacuaccauuugacccagcgaucccauuacuggauauauauacaaaagaaaacaaauuguucuaccaaaaagacgcaugcacucacuuguucaucacagcacuauucacaauagcaaagacauggaaucaaccuaggugcccaucaaaagugagcuagauaaagaaaauaugguacacacauaccauggaauacuacacagcuauaaaaaagaaaaaaccacguccuuugcagcaauauaaaugcagacagugguuauuagccuaagcaaauuaacacaggagcagaaaacuaaauaccagacguucucacucauaagucggagcugaacaucagguacuuacggaaauaaagaugguaacaauagacacuggggacuacuagauaggggaggguggcagugaggaaaagauuuaaaaacuaacuuuuggguguuauucucaguacgugggugaugggauuacuuguacccuaaaccucaacaucacacaauauacccagguaauaaauacacuuguacauguacucccugaaucuaauauaaaaguugaaaaagaaaauaaauauucacuagauagcucaacaacagauuugaucaagaagaagaaagaaucagucaccuuaaagauaagacaaguagauaaaauguaaugaacagaaagaagaaauaauuuuaaaaauuaaucagugcuuuaaaaaaccuaugagacccaucaaguggaccaacucucgcauuauggaaaucuaagaaugaaaaagagaauggggcaaauauuauuuuuuaaaauaauggcugaaaucauuccaaauuugaugaaagacauaaaugugcacauccaaaauccaaagaguuccacaccaagacacacuauaaucagauuuuucaaaagacaaggucaaagagaagcucuugaaggcagcaaaaaagaagcaacuggucacauauaagugauccucaaaaacauuauaagcuauuuucucagcugaaauguugaggccaaaagguggagggaugauacauuuaaaauacugaaagaaaaaccuagucaacuagcaauccuauauccagcaaaacuauccuucaaaaauaaaggagaaauuaagacauucacagauuucccccaaaaaauagaacugaaagaguugaccaacacuagaccuaccccacaagaaaggcuaaacaaaguucuuaacauugauauaaaaggacacuagacaguaacuuguagccauaugaaaauaaaaagaucuccaguuaagguuaauacaugggcaaacacacaccaguaauaccgaaacucugguuuagaaccccacuuuuugcuuucuauguuauuuaaaagacacauucauaaauguauguuauugggcacaugauauauaaagauguaaucugugacaucaaugacuuaaugauggcgauugagcuguauaaaaguacagauuuugggccggacgugguggcucacgccuguaaucccagcacuuugggaggccacagcaggcggaucgccugaggucaggaguucgagaccagccugaccaacauggagaaaccccgucucuacuaaaaauacaaaauuagccagauuugguggcacaugccuguaaucccagcuacuugggaggcugaggcaggagaacugcuugaacccaggaggcggagguugcagugaaccaagaucaugacauugcacuccagccugggcaacaagggcaaaacuauguuucaaaaaaaaaaaaaaaaaaaaaaaguagagcuuuuguauagaauugaaguuaaguuggcauaaauucaaaauaaacuguuauaguuuuaagauguucuauguaaucacugugguaaccauaaagagaacagccauauaaaauauacagaggaaaaaaugagaagagaaucaaaaugucacuaauucaauuaaauaagaaagaaggcaguaacagcaaaaaugggggcaaaaaauauaagacauaucgaaaacaaacagcaaaauggcauaaguccuuccuuaagaguaauuacuacaaauguaaacagaguaaacucuacaaucauaaggcagagauggagaacagauuaaaaauagacacaauccaaccacuugcuuucuacaagagacucacuuuagagccaaagauacaaauauguugaaaaugaaaagaugaaaaacuauauuccguguagaugacaaccaaaaagaccuggguagcuauacuaguaucagacaaaauagacauuaggacaaaaaugaacauuauauauugaugaaaugagaaaauucaucaagaacauauaacaauuauaaacauggaggccccaagcaaaagagcaccaaaauauauaaagcaaacaugacagaagugaagggagaaauaggcaguucuacaaaagcacuaguugaguucaauaugaccuuucgauaauguauaggcuagaauauuuucauauguuuguugaucaccucucuaucuucuuuggaaaaauaucugcucgagcccuuugcugauuugugaaguggguuguugauauuuuguuguugaguuguaauaguucuacauuuaauuugcuucagauauaugacuugcauuauucccauucaguggguucuuuucacugucuugauagugucuuugaaugcacaauuuuuaaauugauacauaauauuuuacauauuugugaguuacaugugauauuuuguuacaagcacagaaagcgucauuaccaaaucaggguauuugggguuuccaucacguuaaguauuuaccauuuuuauguacuggaaacauuucaagaucucucuuucggcuacuuugaaauacacauacaugguuguuaacuauagucauccuacucugguauugaacauuguaacuuacaccuucuaucuaacugcauguuucuucccauuaaucaaacuucuucaucauguugccccuucucagacuguuauucuacucucuaccuccauuagaucaaguuuuuuagaucccacauguaagugagaauaugcaauauuugucuuucuguggcuagauuauuucacuucacaugaugaccuucaguuccauccauguugcugcaaaugacagaaauuucauucuuuuguggccaaauaguauucgauugcauauauauauauauaccauacuuuaaccauucgucuguggagagacauguggguugauuccauaucuuuguuauuggauuccauaucuuuguuauuguaaauagugcugcaauaaacaugggaguguggguaucaauccgauacacugauuuacuuuccuuuagauacauaugcaguaguguaauuguuggaucauaugguaguuccuuuuuuaguuuuuugagaaaucuccauacuguuuuaaauagugcuuguacucauuuauauuccugacaacaguguuuaagaggucccuuuucucugcauacucacuggcaucuauuauuuuuuguauuaaaauauagccauucuaacaggaguaagauaauauaacucauuguggguuuugauuuguauuucccugaugauuagugauguugaguauuuuucauguaucuguuggccauuuguauaucuucuuugagaacucuauucuuauccuuugcucacuuuuuaaugagauuuguguuuuuuuauuuuuugguuuuuguuuguuuuguuuuuguuuuugcuguugauuuguuugaauuccuuguauaacucccuugugggauaucauuuacaaauauuuccucccacuccaccagcugucucuucagagacucugucgauuguuuccuagcugugcaaaagguucuuaguuuaauagaguaucauuugucuauuuuuguuucuguugccugugcuuaguucucagccauaaaaucuuugccaagaccaauauccagaaguguuuccccuguuuucuucuaguaguuuuauagauucaggucuuacauuuaaguccugaauccaucuuggguugauuguuuuauaugaugagagauagggguuuaguuucauucuucuacauguggacauccacuuuucccagcaacauuuauugaagaggguguguccuuuaucaauguauauuuuuggcaacuuuauaaaaaaaauuuggcuguaaacacauggauuucuuucuggguuuuguauucuguuccauuacucuacauguuuguuucuauaccaauaccauucuguucagguuacaaugcccuugucauauuuugaagacagguagugugaugucuccagcauuguucuuuuugcuaaggauuucauuggcuauucagguucuguuuugguuccauauaaauguuaggauuguuuuuucuauuuaugugaaaaauggcauugguauuuucauagacauuguauugaaucuacaaauugcuuuguacaguauggucauuuuaacaacauuaauucuucuaauccaugagcaugggaggucuccauuuguuuguguccucuucaauuucauucaucaguguuacacaauuuuacucauagaaaucuuucaccuucuugguuaaauuuauuccuagguuuuuuguuuaguuauuguaaauacgauugccuucuucuuuucauuuucagcuauuucauuacugcuauauagaaauauuacugauuuuuguauguuaauuuuguaucugcaaauucacugaauuuauuuaucagaucaaaaaguuuucugugaagucuuuaagguuuuccuuaauguaagaucauauuugcaaagaggcacaauuuaacuuccucuuuuccaauuuagaugcuuuuuuauuuuucucuugccugauggcucuggcuaugaauuccaauacuacguugaacaggaguggaaaaguuggcauccuugucuuguuucaguucuuagaggaaaggcuuucaucuuuuccccauccaguaugauguuagguguuggucugucauauaugaccuuuauuauguugaaguauguuccuucugugucugguuuguugagaauuuuuaucaugaaggauuguugaaucucucaauuuuuuucugugucuuugagaggaaacgaugguuuuugucuuucagucggcugaugugauguaucauguuuauugauuuguguaugucaaaacaucuuugcaucccuggaauaaauuccacaugaucauggugucuuauuuuuugaugugcuguuggauucaguuugcaaguacuuuguuaaguauuuuugcaucuauguuuaucagggauauugaucuguaguuuucggauuuugguguuaugcuaaugcuggccucauagaaugaguuagggagaauucucuccucuucaauucuuugaaauaguuugaggagagugauguuaguucuuuguaagcuugguagaaaucagcagugaagccauccauuccugagauuuucauuguuagaagacuuuuuguuacuaauucaaucucauuacuccuuauugguauguuccgguuuucuaagucuuccugauucaauuuuaguaggcugcacgugcccagaaauuuauccguuucuucuuggucuuccaacuucuuacuguauaguuguucaugacagucucaugaccuuuuguauuuccguagcauccauuguaaugucuauuuuucuuuuauuuuuucccccuuucuuuuuuugagacagagucucacucuguagcccaugcuggagugcagcagcaugugaucucagcucaccaccaacuuccacuuccuggguucaagcgauucuccuaucucagccucccaaguagcagggacuauggcacauaccguuaugccuggcuaauguuuguauuuuuaguagagaugggguuucaccagguuggcuagacuggucucaaaacuccuggccugaagugaucugccugccucggccucccaccugaggucaggaguucgagaccagccugaucaauaaggugaaaccccgucucuacuaaaaauacaaaauuuagccagacaugguggcuugcaccuguagucccagcuacucgggaggcugagacaggagaauuguuugaacccaggaggcagagguugcagugagccaagauugcaccacuguacuccagccugagugacagagcaagacucaaaaaaaaaaaaaauuucaccauuagucugaggaacugauggagguuccuuuauaagugacuagaugcuuuucucugccuguuuucagaauucuugucuuucacuuuugucaguuuuacuaugaugugccuuggccuuuuugaauuguaucuauuugggaauuucugagcuuccuguaucugcauaucuaaaucuccugcuaaaacuagaaaguuuuaguuaguuuguuuuuuuuuuaaauuaguuuucuaucccuuucacuuucucuucacuuucugggacaccaaaaauucaaauauuuggcugcuucaugguacauuaaaaacuuuccaugcagauauccuuucuucucagugauuuucuuaaaguuaucugggaacucaucugcugccucuugggugacagaagcagguucuccuguuacccugacauuuuuaaagccaaccucuuucuaaaauuaccaaaccauccuuugcuggcauuaaauucuccagcuuuagacucuucaccuuccuuuuacuuuacauugucaaaauauaaaucaaaauaccaaucaaaagcaaaugacugcuuuucucaaaucauauuauagucuauaaguaugcccuucuuauagcaauccugcaccgacauaaaagcugcauuuucaauaugagauaaaaagguauuucacaaaaagugcaagauguucacaccuacugcuauagcugcaauaacagcuucauuaauuuucuuuuuuaaaaaauaauaguccuuacaacagauugaaauggcagacaaauguggcuguagaccucauuuauaguucauaucaagcaauuuaccucuuauuacaaugucaugacuuuucucugcuucuugggagcauuuccagcaucacuaguagcauuuuguaugagucucgugguguuauucaagguuuaugguauugcaccaaauacaaugaaaaguauggaagaaccauaagagaucacuuuuuacugcaauacacaaugcacauacagagaugauuaaguaucacacaguguuuuaaguggauccuuguaacacuugaauucacaauagcaacaggagguggcuacaaaauuauuacaguaguacaguauguacuacauuaaacuguaugcaguuauaauuuaauacugcaccuuuauguuuguuuacauuccucuugauuaggaaucgcaccauguucagucuguguuuauguaagucuugauaaauuuuaacuuuuuauaauauauuuguguauuuuaugguaguaagcuauaaaauagacuaguauuuauauauauauuuugcauucaugacauaccuuuuucuuaguuuuuuuccagauuucuaggcugcaugguucaucugcaaguuuuuucaaauugcugcaaaacucuaaaaaaauuuccaauauauuuauuuuuuaaaauucacauaugaguggacccauacaguucaaacccauguuguucaagggucagcuguaccugagauuuaaguagggaucgcuauguauuuaaugaauaaacaaacauugucuucucccugaaauauggugcuuaguuucaaaacugaauucgucaucuuuccucacauauucuccuccuccuccugaauucacaaaacaaacuguacuacuauucacccagcugaccaaccuaaucgcccuagauucugcuacuucuccuccuuuccacacaugcucucuuuuuacauuuccaggcucaaggucucauuuuucaccuuugauucuuuagucucucaugucugcuaacacuuaucucuuacagucauccccuuuuuuccuacuccccacugcuaauucccugguucuaggcccccuuacaucuggauaauuacaacaguauuucaaauggucucucuccaucuccaucacacauugaucaugguacucccuucucaaaauccugcaauacuuucucaguucuuacuaagaaagcaauugauggucucacuuauaagagggagcugaacaaugaaaacacaagcaccuuugucuguacuauuuuuccuuggcugaggguucuucacuucuaucucugcauauccaaauucuauucaaucuucaauaaagaugaagacuuuugaaugccacaggacauaaucucucucaccacugaauaccuacaagcacuuuuauaacauuuauaacauuguuuuucucuuaaacuuauugguauauuacuuguuuucucugaggaaagauuaucugcuucaucagugguacucacauagguggcuagcacauacaagauauucaauaaaacuauccuaagagaacuguggguuuuaauacacccuauacaugucugaauauuaauguauuuuaugcaguaccugaacuacauguacaaagacuauacacuaugaaggacugaacuauauuugccuguagaaauuuaugacagcaacucagugauuuaaauaauuuucacuucucaauuuaauaauauuucaguccuucaucuauuagaaauggcaaacaggauuuccaaaucccacauuucuaaauuucuuccaaaucuaucuuuggaguuauuuuuccuguauugaguucacuuuucuaucaccauggaaaccaauuacaauuaguguuguuaggaucuuuaaaaauacaacucuauucagcaagucuucaaauguucagaaaaguucuuucuccauauggagaauggaaaucaguagcauagagcaggguaaaaauauaccacccacccacagaagaaaccauucaccaaagccuaaucaacggauugcaaauggaacacggaaagaguucuuuucuuuuauucaucuuuuguaguucuauaauggcugcaauuucaugugucauaccuaugggguuuguaaacaaguuuucuuucaccucacagccuguguagcagacguggagacacaaaaaaaugauuucuguuguauaauauuaugugguccacccacccuaccuucaaccuccuaauauuugacacugaaaauacuacuuuaaaacuacugaguucaggacgccaagaggaagaauaauucuacagcagaauuacaucuuacaugguuaauaagugaaauaaguucuaauuccagcacauaaggcgaaaaucaauaaaaggcaaaauuacccuucagauuuaccaggaaaaagcuagagaccuacaagcaucuuaacagaccuaagaguuuuucuucccagaaugggaauagagcacuguuuucucagcugaguaucugauaaaguaaccgaugugcucaucuuuaaacacuagaaucaccaucaguucacugugaugcccaucauaugaagaauacauggaaaaugagaccaaauaacacgacagcagaaucacagcccucaucuuacugaugcucacucaagaacauauacuugucaggaaacugcuucauacauauuuucacauuucagcauggucagggcuuucuaagcaaagagcacuggcaccugggcuaagggacugaacuuaacccaguaacccuaaagauggagcccucuagagauaaaaguuuucucucucccccaagccauguuuacauuccagaguguuugugaaauacagauccuugcuucuuuuucccagagauuuuguuuacauuucagagcaaaggucucucucucucuccaucucgagaaaggagaaugggcaggaaugccagcuauccuguauaagcuucaaguuucauaagugcagaguucucuugugguaccaaaucccacuuguaaacacaggauaucucugguugucaccauaucacuuuauggagaaccagggccuagggaaccaacauaaguuacuuuucaaguaaacaagggcuuaauuucugguccagagacuugauguuucugcugggggaaagggaggcuacagagagacagagaaagagagagugagaauguguguagugugucuguaguugugggaagccaacuuguuagcuuacuaguaggaaaacaucucagacucuucacaguuucagacucaacaauacuauaaguaaacugccuguaaauuauggcugacuccacuauagauauauuuuuucacaguccaaccacuuuuacacaucuaauucuuggacugaauaaucucaaacgagauacagugaaaauccaguacuuagaugacaguggaacugaugacucacuaucugaacauuucauuucaaauucucuccugaaaggacaaugauuuccuuguauaagagggaguauacugcagaacaugcagaaaaguaaggcuaagauuuuuauuucuuuugaggaaaacuaaacuuuguggccagggugagaauaaaauuagcauggguuuuauuucaaaugauuacacauguaguaacaguacuucuguauaagauuuuuuuaaacugaaaauauguacaaguuaauuuuucaaacugcaagugucuuaacaaaauggggagagauaaccuuuucauuaauuuauuuuuauuaaugaugaaggcuuaacugauaggaaguacucaggugaagucaguauccacugccucaauccugacaacacuguccuugggucaucaggacaaguaugacuucccacauuuuaaagaugauuauuugacuuuaccuaagugcuucccuagaacuucugccuuucucuaaagcccuuuaaaauguacugcacaauuauuaugucauuuaauucccauaauacuuuaugauauaguuagaauagauauauuuguuucuauuuuacaaaugaggaaacugacgaccagagacauuaagaauuuacuuaagaucacaauggaaauuacuuaagguuacacugcaguauuauguaucauacuuuuuaaccuucaacuacauuaaagaugcgagauacucuagaaccaucauuuacuccuuuuuguuaaaguauuaguugagucagucuauucuuuucuagcaauacaaaagaacaugcagaauggcucuagugucaggccgccuugauucaaauacaguccacaaaacgguuuaagaacuugaguaaguucuuaaacucuuuuuaccuaaauuucuguaccugaaauuguuguggagcguaauugagacaauguggaaacaguauuugauauaaugccuggcucagacaaaacauucaauaaauauuggcuuguauuuuuauuguaauucugauuacuacuuuuuaaaugaaacuucaggcuuuuaaaauuguuugcauuauuaccccucaauauuccuacacucaggucaaacuuuacuacuucuuuccgccuucccagcaucaaggcagaaaugcauguaaugauagaaagccaugacagcauuuucaagucccuugcaggcagcuugcauauagaaagcucgagacacagauauuaaauucauacuuuuccuauuccuuauuuauacaaaaaccugaacucuaccauucagguuaauuuaacuuaauguuuuguaugaaauuggauaaaaagaaacacaucaagugauaacuucagauaaccagaugauaaagaaaauacaaaucaaacauauccuuuucccccccuacacacuagauggcgguacaacacaaagcacagcaggaacagcgcugccucaaacucaucauuucuuugcguguuacaagagauuccccccgcuucuuacugaaaaauauuuugugaaaugugaauuaaccuuuguuuuuggacugcagaauaauacaacagggaaaauaagugcaguaacaauaaauuugcagaauuuuaaacuacauguggcuuuacuuaaaacaaaaagccccuucuaguaauuauuuuuuugugaaauuuaaauuucucuaaacuaaacauaagacauuuaugaaucaaaaccuguagaauuuggccaaacuacuauucacaggaaaauauccaaacuuaaaugcacuuacuaaaaaguaauaccuaaaaacaaaugaaucauuaacaauaccuguugcauucuauuucucuaaagcagagauuaaguaguauauguuguguaauauuaauauuugacaaaguugguuuaugacgaagcuaguuuuugagaggcaaauccuaguaggcaauacgcauuauucucaacucuuuucuggaaaaaaaaauauaagaaaaacuaaacuuucaauucaagaaacaaaaggaaaguuuaugcuuagaaauuaaugguaugaaaaauacagaaaaaaaaauuugguugaucaguaaaaccauaagcugguuccuugauaagaccaagauuuaauaauaucuuguguacaacuuauaacccaugaauuuaaaaagcuaaauuaaaugaacaauuuuuaagaaaauauaaaugauaaaaauugaucuaaggagauacaaaagaaccuaaugagcaauaaucaaaucauaaguugaaaugguaaguaaagauggcaaagauuaaguccccaguugggaaccaguuucaaaagguuuuaacaggaaaauucuacuaacccuucaaagaacagguaauucccauuuacacaaacuauuccagugcauuuauuuaaaagggguggagaaugggauaggggagcagaaauuccccagacuuaggcuagugggacaaguauagcacacagguuaacuucaccaacaaacacagaugcagaaauuauaaaaucuuaguagaguguaaaaaaggaauuuguuuuuaaauauauauauaacucagcauaaugugucucaggaauauaaagauguuucaacaagcuacuucuauuacaugagcaauuaucuguacuaauuuuuacagauauuaauagcuuauucaagcuccauggaaguagacuaaaauaagaauauggcaugguacaaccuauccucccccgugcuguuauaucucuguuccucuccaccuuaucacaaccucaaucagaacucauaguucaucuacaauuucuuagcuugaaggaacauuagcugucaccuaguauucuaggguaucuaggaaccguacuuccuuuucagugugaagauaaggaaagcaagaccaaggcuaacugcaccagcuggucauacccauucuacaccacaccagcaccuuucuccucagcauauuaucucuccuauacuacacauuacaacugaauguaccaaauugagacuuaaacaggaugguuacauaauuuguuuuauaauaaauacucauaaggaauauauauucuuaucauauaagaacaaauuuaaaaugauuaauaaaaacaaaauaguaaaacagcauuuuaaaaaccaauuguaucucuucuucaaauauaaacucauucauccauucaucucauucaucuauuauucauuaaacaaauauuuauugaguaguuuuuaugugucaaucacuguucuagauguugaggggaagaaaauaaauaauaaaauauuuagcaugccgaaugguguuaagugguauggagggaaauaaaacaaagagagggagaugaggaaugcuggugacuauaguugcaaucuuauguaaggaaggugcagucugggaagauagcacuggagccaguacuuuuaaaagaggagguagcaagguguguggcuguccuagaggagcauuuuaaguaaaggaaacaaaaaguaccaaggcccugagaagggggugagcauacuggcagaaaacaaagaggcuacuguggcuggaucacccugucugaggggaagagaagaaagaugaggucggaaagguaaggguacacucuguaaauccuuguagagaaguuucagaaaucuggcuuuuacucugaauaagaugaaaacuaacuggagaguuuuuaaaaagugacaugauuggacuuacauuugaaaagaaucauucuugcugcugugccaaauauagaaggcuauugaaauaauccuccccaaaagacaaugcuuuaguguaaggugauagcagagaagcaggugggcaugguuagauccuggauuuauuuuaaagauggagccaaaaaaucugcugauggacuggaugugaggacugacagaaagaaagaugcccaagaugcuccacgguucuuggcuggccucgggaacugaaaggauagaguugcuauuuaccaagaugggaagucagcagaaagagcaggucugaaagacuguucuuggcacgcugcaaugauugagguguuauuaggcauccaagugaagaugcagggaagucaguuggauauacaaggcuggaauucaaagaagagaucauaaaauuguccuuuguacauuacauaucauuauaugguaaugauaguacugacccaguaaaaguacugacaugucuaaauuguuuuuuaagcaacugugucuuucagacuaaauaaaauugaucauuggaauuucuaacauauaggauuaaaaauaacuauuucauuccagaacuaaaagccagaaaguuaaagauuauuuugucuggauuuuuaaaauguagaagacguuaacaucucugucauacuaggauaugauggccaacugcaauuauaaacuuucaagaucugaagagaagaaagagcuauaaacauaaagacaaugaaucuguaaaucuaagagaaauuucuaagaucagagugaaaaagagaagguaugucacugcagaaugucccagaauugguacauauuaaaaagcaacaaccaaguuggccaauugacaguaugaauaaccuacugauuuauacuagagcugcccagcauacaacugaugaucuauuauugacacauuuuacuaaguuuucuuacuuguuuucucuucagaacauauuccaaccuuauauugaaaauaaaggauucauuucccauaaacacguuuagaaucaaaugugcuaauuuuuaccuauguaaaaagcaagauguuuauaaaaugauaaagaauaagaacugagacauaggaacuuuauuuuaacugccuguagcagauagaacauaggauuguuuagagguuaauaugauuguuuuuuuuuucuuuaaauggcauucaaucaguccaucaaaauguaaaaccuuauacuagccaaagagagaacagcaacccaagauaaaaaacauaagcauguaagucaagccaggaugcuauuauaguucuuuugcuacacaacuuaguuaauggaaacuaauguuuuccuccugaugguaucuaacauggguugaauucaaccagaagcagaaggcaagcaaaacugguagaugugauauguagaggccagucuccaaagacacagaacagaggcaggacaaaacugggcaggagagcugugccaaguagaggaccauaaacacagaaagaagauucugguguggacuggcaaggugcagcugggcugguuuccuuugaaccaccccuaucuuccauacuccaggccuccuggucaaucaauacaauccugaaacaucucacucauacaccucauacaagcagggucacaaacugaguuaguaucacaucuuuuuuuccuucuucugccugaguaauggaauucuacaggguugaaguaagugcaauggggaaagugaaacaugguguguaaucuaaaaugaagauuacaggucuguucauugguaaaagucuaccaaauguguucucccauaaaaauuagacacaguccuccaauuaagaggacuggacucuaauaaccagcauuuaacaaaaucucaggagagccaaacgcagcugaauaacaacugucuauucccuacccacaucuucaaugcagccauuauaaacucuuuaaauauaaaauaauaaaaguuuagaacuaugauacuauuuagcacaaccucauucaccucauaaaggaaauaaaaccaaagaggcuaagcuacuugcccaaggucauaaauuuccuaagaagcaaaaagaaaauuagaaucuauguuugugaacuaaggccagugcuuuuucuauuucauuauacaauguuuaccauuaacaguuuuguuuuuauuuuaaaucagaugcuuuagagauuuccuaaccuuucauauaauguuaacauuuaaauauucuuuggacuguuuuuagaucucuagccuccuauuucuuuucaauuugcuaaaacuccucacaauguuuacugcccccaaaagaguucauucaaccuuguaaagauuaaaaaaaaaagcaaaauaaauuaaguagaaaauaauuuaccuaaauugcaagcugaguaaacuaaaucacucaaacagauauaucaaaugcuuaacagucacaaaaugaaaaauguacucauuacuguuuucuuaaucaguucuuccugaccuaagaaauuuaucauguuaacugcaaucucaaggauauacacacuaauggaacaaaauauccuuuguuugaugucacagcauuauaaaucucuagugcuauuuuaaacugucaauuuauuugaaauagaaauguccuucacuuucauaaauccuauagaucaaauucaucucacuuguuuaugaaauaaaauuacaaaaaguagcacacugugacacaaaucagucaugucucaggaguuuucuucuggagagacagugguuagggcaaggacaggaaguggacuaccucuacauguuguguguagaaaucaagacuuuuuuuucuauuagccuaauuugaaagacaauguaaaggguggcuuuuguuccccuggggaaauauaauuuuuuaaauaaccacaaucuagcuauuuuuuagguuuuuaauaguuuuuucacauuaauauauauauaauguacaaaggacauuaagcugccaaugauauaagagcaaaguauguagguugaugucaaguuagauucaauaauuuguaugugaaugaaaaggcaguaacaguaaaaacauuucugaaaaagaagaauaaagugagaacacuuuaaucuaccaaguaucaaagcucacaacaauuaauuaagacaaguuuacauaauuucagaauagaaagucacuacacaaagccauggacauauggacaugauacaggaaaacggagggggacaggacugauuuuccuuaacugauacauguuagugugaugguuacuuucauaugucaacgugacaucaaguauuugucaauagaagagaagaaagauuuuaccucaaccaauaagacaucaauuaaaaaaaaaacuacuucaaagugucaucuauuagauacagauauauagauaagcaucuagauauaaagguaaauguguaaaucuuaauucaagauguaagaaauauuucaguauaccuguaugcugccgaacucaacauucucauaauggaaaugcgcacauucagccaucuucggaaagugaccuuuagugaaggguaaccugaaacacaugaaauaaauaagaaacgagauagugaaacaguaaaaauuacuaaguuuaagggaaaaauacaguggauuuaagagcucaugcaagcaaaaauauuucguaagcacaugcgcaugagccacacauauccgcacaaauccucuuaaaaauacacugagucagaugaguauuacauuuaguguacagaucaaaacccaaaauaaaaaaagcaucaccguuaucuccuaauuuugacccgaaucaauguccauagaaaaacugcuauuuucggcaaauguuauggaaacuguggacagccagcuucuaaccagaagcauucccaacacaaaguagaaaaccagauuuuaccugugaauguugucacagcccaucaguccuggagugguggaccugaacgcagaaugaacauuuuuauccuugucuuuccucuacuuacacaugaagcauaacuaucuaacucuacuaagugaaaagaugguuuuccucuuuaaaacugauuacuuucagguacacgaugaauaguccuuguucaaaauggcacagagaccagaagaguuuuggauuucagauuuuuucagauuuuggaauauuugcauauaucuaugggauaucuuggggcugggacccaagucuaaacacaaaauucauuuauauuucaaauacauuuuauacagagccugaagguaauguuauacaacauuuuaaauaauuuugugcaugaaacaaaauuuuaacugugaacacucacguaaggucaggugugaaauuucccauuugugcugccauguuggcacucaaaaaguuucacauuuuggagcacuuuggauuucauagcuucagauuagagaugcucaaccuguauuucacuuaacagucaacucuuggcaucuacuucaugcuccucaaaggcaaaccugaaaucuaauaaucucauaacucaaacaauaaagcugauauuucugaaugaaugagagcaugcacuaaggguaccaagaaugacaugguuagacuguuccuaucaaacaacuguaaaauaacagaaaaugacauaaguugcuucaagaacaaaaauaaaguauauuuuagaggaguggauaaucuauaggccuauuccacugacugcugagucauaauuuaaggauuagcaguugcacaguaacagcauauuuuuguaaaaagucuaaauaaaaguuuuaagagaauugaagaacugauuuccauucguaggaauucauuuagaauccacuguaaaguuauacucacuuuuucacaugcuuaaccuucauacuggcuguacugccacacgucuuaagaguaagaucuccaggaaucucuggaacaucugcgccucuugccuuaaaaaauaaagacaaaauauuuauggcuauuacuuuaguauuacacuuuuuuaaaaagcagguuauaauuuauguuaauaguucugcugacuuuuuaccuacaaaauauaucuugguuuaauaaucuuaaaauuacugaguuuuaauuauuaagaauauaaauuauucaccugauuuaaauauucagcuuuacuguauaagggaaauuuuucugugagaauaagaauuuucaugcuuuuguaaucaaauuucaaaaccagcuauuauauaccucaauacgaauuaaaauuuccccuggaaguuguuggaauaaaauaaccuuuguuaaaauaauuaauaaacauuaaaaugcuaauauaaaaaaagaaauuaggagauuaaaacauguauuucucacaccaaaaucugaacaugacauguauauaauacuuccaaauuacuccuuagucugucacaguuuucauaguggugaauucuuaacuucagugauacaaucaaguauaucauuuuuuaaaaaacaaaaugaaaaaucaaaaaguucuuaacacucuggacaaaauaaaagucaaguccaaauaucuauuuuaaaaauaaauuugugcuauaauaccuaugacuuauaauuuuaaaaaaacuuaaguugaauuaugauagcccaugccacaugauucaauaggggcgaauaaugugagauaagcaguuaaaguaaguugggaggagaaucacaaccuuaacuuuugcaauguuuucuugugagaaaacaaaaaagccagacaguuuacauacuuuuuuuuuuaaauaggacuuuucaaagauaugagguaacaaugcaugaacuuaugagaauuaaaccuuguuacaucaucacagugugcuggguucaauuuuccuuuuugaggguuuuuuuuuucuuagcaaauuuaacuauuuauaaggguugguauuucaugaucaagacuucuuagauauauuuuuacuccuucuuagaggucucccaaagaaaacagaguauuacuagauucuuuaguaaugaaacagaacucauuccaucuugcggcuaccacacggauucaaugaaacuuuuuauaaauaugagguaacaucuugucuuauuuuuccucuaucuugaaacaaaguuacuucauaauccuagguauuauuucaucaguacucaucaucauucaauuauacccuaucauacuagaaaaaaauuuuaagacuaaaauaaaaaguauauuuuuaaaaagggaaaaugagauaauauccuagaaaaagcguugacaaacuucuuaaagagccaggcgguaaauauuuuagguuugugggccacauuaucuuugccacuauucaauucugcuauugcaguguaaaaguagcuacuuauaaaugaccaaacacagccauguuccaauaaaacuugauaugcaaaaacaggcauccaacaagguaaaguucgcaaaccccuguccuacaaaguugaugccacagugaaauaaguuaucauucaguuuuuauacuguguugccuaaacugccucaucuucaagaagguauuuaaaaagcuuggagacaccaucuuucuagucugcauuucacuuucauuuaauauauucacuaauucaauaguuuucauuuucuuucacuuauagaaaagagaaaaacacugacaaagaaagauaccuuauaaugaacagauacaugaaaagguggguacaaagagacaacagcacucuagacucuaauaaagacggcaaaacaaccacguacaugauauaucagacuaauuauaauauccuagaugaauauaguauugaguauuaagaauugagugaacaauauauuucuaaggacaaaaaaggaaauacaguauucuccaguuggucauucaacugaaaguacuuuuucaugcaauauucugcgacaaccuggaucaccugguuuugccauuaaaaaaaagugaaagugugacaauacucuuucaucuuuuaugauguuugugcaccaaaauuuacuuaacagguucgccaagcuuagauucuuacuaaaauuucuaauaaaguggcuuuucacuacucuguauuguucauaaauugacuuaaaaauauaaaagaauaaaaaagaauccacuagacugaguuaauaaauggugaugacuuuauuugguagacuggaaauugaaacguuagcuuucuuuugaaaacaagcucuuugugcuagcuggggaggccacuguuccuaaauacaucucaagagaaaacgagaaaaccugcccagccuauaauccgaaugagggaggaacaucauguaccacacaccucugcaaccacaacugacuggacuguagauggaaacaugacccaaagguaaauccacaggcuaugcaaaagggccugacgggaaaaccucugccuaaaaagacaaaaugauaauaauuaggccagugaaccaaacaacgguccaaaaagcuucagaggauucaagaaaauauguuugaaccaauaguucaacuagucugugcccauguauguucuguccagcaauauuuuccuagagcacagaaaaguuccaggaauauccuagccucucaguauauuuuugugaaugaacaaauacaauacacuuuaacauaacaagguuuugucauuuacucuuucaagaugaagccaguagaacugaaaggaaaauacuguacuauuauucaaucaccugaugaacuaauauuuucaccuacauauuuuaaaaauaaaacaaauuaucuuaaauuucuauugagagcacauagcuugaguuacuuauucuguugcuccaaaccaaagauuaagaaaguucuuuuuuagaaaauaguucauuaacugauauuuauucauaaaaauaacaaguuuuccuauuuucauguuauaauuaucacuuaauuaugcuucuaaaauaagaguuuauaauaucaucaacacaguaacagcaucauucaucaacagaacauucaaaagaccucaaaaggcaacugaacauauguucauaaaagcacgcaccauuuacauuuaaacucucuaugugucuaucucuagcaauuaacuggcuuccuggaaaauuagacaaaaacauuaaggaaauuaauggauucaauaacaauuuuuauuuccucacucuucccuacuuguuuacacuauauaauucaacauguucauuaucccugccuauacaacccuguccccaaaauccaauucaaauccaccuagucuguuuaauccuauaccgauaauuuugccaaaugcugauacuuuccuucauuaaucuuucaaaggauuuauccuguauacaguauauuggggcauuucauuauauuuuuauucaucuuuuaaugcaaauugccauguaguguucucuaauaaaagacuuuuccauucaucaagaggauaaauuccuugagcaugaagccaauggaauaacauguguacauauuuuacuaguauuugacauccacaauccccauuaaaacacuaaaauuuagcagccuucaaggaaaacaaagaaacugaguauuguuaacuacccuagaaaagcacauaaagauuuuaucucugauuuuuaauuccccuagaugacauuauuaucuaugaaagucuacaguuaacaaagucauuuuaauagcucuaauuuuaugauuaaaaauauuucccuccccucccccucccccucccucuccccggucucccucugaugccaccaaaguugugaaagccgaggcuggacuguacugccgccaucucggcucacugcaaccucccugccugauucuccugccucagccugcagagugccugggauugcaggcccgcaccgccacaccugacugguuuuugcauuuuuugguggagacgggguuucgccguguuggccgggcuggucuccagcuccugaccgcaagugaucugccugccucggccucccgaggugccgggauugcagacggagucucgcucacucagugcucaauguugcccaggcuggagugcaguggcgugaucucggcucgcuacaaccuccaccucccagcugccugccuuggccucccaaagugccaagacugcagccucugccuggccgccaccccgucugggaagugaagagcgucucugccuggccgcccaucgucugggauguggggagcgccucugccccgccgccccgucugggaugugaagggcgccucugcccggccgcgaccccgucugggaacugaggagugucucugcccggccgccccgucugagaagugaggagccccuccgcccggcagccgcaccgucugggaagugaggagccccuccacccggcagcugccccgucugggaagugaggagccccuccacccggcagcugccccgucugggaagugaggacccccuccgcccggcagcugccccgucugggaagugaggagccccuccgcccggcagccgccccgucugggaagugaggagccccuccgcccggcagccgcccaguccgggagggagguagggggcagcccccgcccagccacugccccgucugggagguggggggcgccucugcccggccgccccgucugggaagugaggagccccucugcccggccgccaccugucugggagguguacccaacagcucauugagaacgggccaugaugacgacggcgguuuugucaaauagaaaagggggaaauauggggaaaagaaagagagaucagauuguuacugugucuguguagaaagaaguagacaugggagacuccaaaaauauauauauauauuuuacccuuacuguuugaagcacacugcuaaaugaucuuccagagggccugaucuaauucacacugcuaccaaguaugcacaagagugccuauuuucugacaaccucacaaacauuaaauauuauucaaucuuuacuuuuuucauucugauaguuacuucuucaccuuucuuuuauaauuaacaaaagaguugaacauaacuucacauuuugguugguauguaguuauugguauguguaauacuguuuucaacuuauauucucuaucuucaagauuuuuuaaaaauuaaguuaaagcuagucauauuuguaugacauaauaugccaacauaguuaauagcuuuccauuaaaauuauaaaccucgaaauuggaggccuuacuuagaccuucuaauuucaagacuuauuauaaagcaauacuaaguaagacaaagugccacuggaguuaaggauaaacaaaugaaugaaauauaaugcaauccaaaaaaggcccacacguauacgauaaaaguuuauuuaugacacaggagccaaugcaauucaaaagaacagcauugucaaucaaucagaacaguacaguuuuuaaaaguaugcaaaaauuaagaauaaaacuucaaucuucucuuaaauaauauacaaaaauuaauucaggauggaaauucauucauuaugaaaaauaaauauucuaaaaauaaacacaauaauaaaucugagguaaguagcaagaagcaaaaaaaacucauaagcaaaaaaaauuaauacauucaacgacaucaaaauuacaaacaaggaaguuauacucaacauauauaaagaaauccuuguaacaaaauaacuaauaauccaauuuuuaaacuugcaaaaaaaaaaccucaacaguuauuucacagaacagaauacuaauagccaauaaucaagcuacucagugucauuauucaucaagaaaaagcaaaauaaaaucacaaugaaguaacagugcacaccugccaaaaagcccaaauuaaaaauaaaguagaauaggguaccaguguuggcaaagaugcauuggugguuagaguauacaacagcauagccauuugggaaauuguaugauaauuaauugguaauuccuacuaagcauacuccaugauccuaugacuacacucccaaauauguaucccccuaaauuauuucacauguacaacaaaaacuuguacauaaauauuaacagaagcuuauucauaaccacuaaaaauagaaacauuacaaauacacaaagagcagaaucagugaauaaauuauggcauacauauauaugcaauggaauucugugaucgaaaaauaauuauuaauauauuaaacaacaugaauaaaucuaacaguuguuauaguacaugaaagaagacagaagaaaaaaaucuugcugucuuauuacauuuauaugaaguucaagaauagguaaaauuauucauagaaauaaguguuacaacuggcuggugagaaauacgaaaaaaccuuaccaagaacuguuuuauaucucgguguggguggugguuucacagaaguauacaagacaucaaauggacaaacauuagugcauuuuacucacuuauguguguguguguuaaacuucaauuaaaaauuaacaguaaaaaggucaagaggaauuuuuauagaacuuuagcugguucuacauucgucuggaauaguuaugauaacuacggaaacaaugagaaaugagagaauaauaauauuccauagaacugaaaaagaaugaugucuuucacacucauuuuauaauaccaguuaaccacagauaucaaaaccacccaaagaaaacaggacaagcagccuuggagagccagagaaugugggcaaagucuccaauaaaaaaccacccaaaaccacuuuuaagcaaccagaucucguaagaacucgcucacuaugacgaaaacggcaagggggaaauccuuccccaugaucccaucaccucccaccaggccccuccuccaacuuugggaauuauaauuugacaugagauuuggaugggcccacaaauccaaaccacaucaccaggugaguggugguauggguacuuaagagccugagugaaaacccauuuuugaguagagaaacaauaaaggaagacccuacuguauaaagucuguggggauaacccuugguauuauuuucucucucuucuugcauuacuuagaccugacagcagcccaaaucaggaaaaauagugcaagacaagacuuuuuuguuuuuaauuuuuauuuuuaaguucugggguacaugugcaggaugugcagguuuguuagagguaaacaucugccauggugguuugcugcaccugucaacccaucaccuagguguuaagccuagcaugcaugagcuauuuuuccuaaugcucagugcaagaguuuuaaaacucuuaaagaauuucaucuuucucacgaaagaaaacaagaaaagcagucuuggagagccagagaaugugggcaaaguccccaauaaaaaacggcaggcugggcgcaguagcucaugccuguaaucccaagacuuugggaggccaaggcaagaagaucgcuugaauccagcaguuugaggccagccugggcaacagagggagaccccaucucuacagaaauauuuaaauguuagccaggcaugguggcaugugccuguaguugcagcuacucagugggcugaggugggagaauugcuugagccuaagguuaaggcugcagaaagccaugauuaugccacugcacuccagccugagcaacagagcaagaucagggggagaaaaaaaaaaaaaagcaggauaagaccacagugauccccaugaaacugaacugauguugaaaacaccaccuauaaaaaucuagaugaaacuucaaucugaacccagccaggcugcugucuaauaaagcacaaaucaacacucuccagaggauuucaauaaggagucagagucucacagcauaauauucagaauguccaugacauaauuaaaaauuacuagcuauaucaaaaaccagacaaauaugagcuauuuccauaggaaaauacaaccuagaaaugucaaaucugaaaugaaacagauuggacuaaucagacaaagacuuuaaaacagguauuauaaacacacugcauuagauauuggaaccaauggaaagacugaaauucucuuacaaaaagaaaauaaaaacuauaaaaaacccaaauauaaauuuuagaacagagaaauguagcaucccaaauaaaaaauacuggcuuagcuuaauaaaauacccugagacuggguaauuuacaaagaaaagggguuuaguugguucacgauuccacaggcuguguaggaagcaugacuggcgaggccucaggaaacuuacaaucacagcggaaggcaaagaggaaggaggcacgucuuacauguuuagagccgguggaagaguaagcagggggaagagugagcaggaggaagagugacagagaaaagagucagugaaccugauaacagacaaaaaaucaugcaaucugaagaaaagauaguuaauuuuuuuaaaagacugacaaaauaugaacagaccuauagauagcuaacggacaauaucaaaagcucuaacacucaugucuucgaagucucugaagaugagaaaaaacacaauaauacaggaaaaaagugaaauuucugaaaacaauacaaauuuauugaaagauauauauuuacagauucaagaucacagaaaacaaaacaaguaacaucaaagaaaacuacaaaccaaaacaucauaaucaagcuguugaaaaccaaauauaaaggaaguauucugagagcauccagaaacaaaaaagauacauuauguauugguauggaguaauaaggauuuaaaugacuguggauuucucaucagaaaccagaagacaguggagcaacgucuauacaauucggaaagaacucucaacccagaaaucugcaucaagugacaauauccuucagaaaugauguaaaaauaagaacauacuaagauaagagaaaacuaagagaauuugucaccaguagauaggcucuaaaagaaaugcuaaaagaagcucuucagggagaaggaaaauaacucagguuaacugaaauuuggcccuuccggcaugaagagagaacaacagaaauggugaauaauuaggcaaauauaacagauuauuaaucuccacuuacaugcuuuaaaauauaugugccaguugaaagcacaaauuauaaaacugucugaugaaaguuuaugugaucuauauaaaaacuuuaacauaacgaugguagauaagggaaccucgauggugguaggauuucuacauucuacuugaaguauaaaauaauaauuuuaaguauaauaugaaaaguuuaguaaauuggaaccaagaguauguaaaaaagauaaaaacacuacgaucaaacagaucaucccaagacuguaggggagaaaauaaucauauagucaucucugaggcaguaaaaacaucugaaaaaauuccaaacccuguucauuaaaaaaaaagagagcgagaacauccuuaaugugauuuuugaaaaaguauccagaaagaaacuaaaggucuauaguacuuaaugaugaaauauuuaaaguuucaaauuugguaccaagaacaagagaaggauguauguaccacaucuauucaucauuauucuggagugccucaccagcguaaucaggaaaguaaaagaaauaaaagacugugcacaugugaaauuugaagaauucacaaacucagaauuaaucaaagaauguaucaaggucucuaggcauaaaguaaauacacaaaaauuaacuagauuugaaacauauuagcaauaaacaugcagaauauaaaauuuuaaaaccaauuuuaaaauuccaacuauaauagcauugaagaaaacaucaaauaccuaggaacauuucuaauaaaaaaugugaaagaccuugcuauguucugaacaucuguguuccaucaaaauguguauauuaaaaccuaacgcccaaggugaggguaguaagaggucaggccuuugggaagugauuacaucaugauggcucugcccucaugaauggaauuagugcccuuauaaaagaggcaugagcugugggagccuguuuugucuuccaccaugugagaacacauaaaaggugccacaucuaagaaagaaacccucaccagacacugaaucugcuggauugaucuuagacuucccagccuccaaaacuaugagcaauaaauuucuauuguuuauaaauuaccaagucuaagguauucuguuauagcagccagaacacauugagacagaacucuacacuaaaaacuacaaacauuguucaaaaauuaaagacaaucuaaauagauauauuauacaugcacaugugccucauuugcauagauuagaagauacaauaaugucaaggcaucaauucuuccccaauauuaucuguagacuuaucugcagaaauugggaaacuaauucuaaaaauguauauagaaaugcaaaagacacagaaguaccaagauaagaagggcaaagcuggaagacacuacuuaucagauaucaaguuuuacuguaaaaguauaauaacuaagacagugugguaucuggucuaagucuagaaaaauggaccaaaagaucacaauagagaauucagacagcagccaacaauaugguuaucugacucaugacaaaggcaccaccgcaauuaagucagaaaaaagauggccauuucaauaacuguacuaagucaaucugauuucuauaugaauaaaaaugaacgcuggccgggcgugguggcucacgccuguaaucccagcacuuugggaggccaaggcuggcggaucagaaggucaggagaucgagaccauccugucuaacacagugaaacccugucucuacuaaaaauacaaaaaauuagccaggcgugguggcaggugccuguagucccagcuacucaggaggcugaggcaggagaauggugugaacccaggaggcggagcuugcaaugagcugagaucgcgccacugcacuccagccugggcaacagagcgagacuccaucucaaaaaaaaacaaacaaaaaaagaauguugacccaaaccucacaucaugcacaaaaaucaauuuuaaauaguucacagacccaaacauaaaagguuaacauguucuucuauaaaguaccuucaugacauugggauaggcgaagauuucuuaaaaggacacacacggaaaaaacaauuauuccgacacccuaccgaauuuaauaaaguggacuucacuaaaucuaagcauuucugauuaccaaaugauaaaauuaagcauucaaaaagauaagucagagucuaaaagaagaaauuggaagauaugucucagauaaaugacuagugcccauaauagauaaagaacuucuaaacauuaaccuaaaaaaagacaaccuaacagaaaaaaaaggcaaaacuugaaugagcacauuacaaaagaggauaucucaagggucaauaagaauaugaaauggugccaaacauaaauaaucaucauagaaauaaggcccacguaagauucuauuacacacagaacccuggcacaaaaacuacauauugcaggauuucauguauaaaaacaacgauuaccuuuggugggaaagauaaugacugagagguacucaagagagauuucugaauuucaggaaaaguucuauguuuaaaucuggguggugaucacauaagaagaaaacauaagcaaaaagucauaaagcuguaagauaagguuugugacuucucuguauguaagauauaccuaaauaacaaaguaaauaaaauuaaaugggaaaaacagacaauagcaaggaaguggaaaauuauaggcuaaucucauuaaacacaaaugcaaaaaacauaagcuaaauagaauaauaaaucaaaucuaucauuguguuaaaaacauacaucauaagugaauuaaauuuguuucaagaaugcaaagauggcuuaauagaacaucuauuaagucuuuaauuaaaauuaaaaugaggaaaaagcauuagauuauugcaauagauaacagaaaaauugucugauaaaacucaacacccauucaugauaagaacuaccuagcaagacuucuggugcagaguaguagauugaaaacauauuuaccucugcucuuucuuguaucuuaccaaacuaacacugauuuuuuuaaaccauuuucuucuuauacugacaaaaguacaaaaugccauaugcauccauaaguauaagguuauucucugcaggacuguuucuaguaacuaaagggugagaacaaccuagaugucuaucaauaagaaaacaguuuaauacacuauauugcauccacacaauggaauagucuuagcuauaaaaggaaugaggaauacuucaauuuauugcuaugaaguagucuucaguauauaugaacugaaaaaaaaaagcaugguacaaaaacagguuaccuucuaacuaaaagacuguaaauauaaaaauauauauauguguuuucuuacacuuaaaaaaaaugggaagauaaacuaaaaacuaauuuagaugcuuaccuaggagggaacaaagagauagggauggaagauuuuucugaaugucucaguuuuguaguucagauuuuggggucauguaaguguuauaaguauuuguaaaauuaaauuaaauuaaauuaaaaugggaugaaagggcaaucccuaagaucaaaaaacaaauaaaacaaaugaacuuaauuauaaguugguaccuuaagcacacagagaacaauuaccucaaaugacagugaagaaaaguacuaauaauauauuccuagugggauauguccuagagaugaaaggaaacaaacuguuugggaauagugacauuaucguucugaaacuauuaaaagaagacgauuaaagcaaacaaauaguuguuaaugucacuaaaaacuaagguuuuaaucauaagagauacaaauauaaaaucgaagaaauuaaggagaaacccauauucauuucuuuuuugagggugugugucuguguguuuaaauaaggcagcuagacugacaguggacagucacaugcagaugauguauuaaaucuugauuauggcacagcauauaguguuuuaugauacacguguguaagauuauaaaaugagaauucaauacuaauacaguuaaauuugaagcugauuaaauacuaaagaauguucagugucaauuacuguacauuaacaugcagcaggaaggagguagaauaucacagggcuuuuuuauucuuuucuuaacauuuuaauaaaagcacauuaaaauauaugacauacauuuaucaaauuuauagauaaaagaaaacugaaauggacauucacaaacugagugacagaauucaaagagauuuuuaaaagcugccaagacaaaccaaaugaaugugaaguuuaucaauaauaaaaacugaagcccugaauuuaaauucaaaauucaauuauauaaguauggggauggggagcaaacuguuugacaagaauucauguaacaagaucugagaucuauaguuuaccacaagcuuaauauaagccacaaguauacccuuacugguaaaaaaaaaaaaaaaaaaagaacaaugccgucuuaaaaaguagagcaucucuaacaagggaaauauuuguaucccuauaaucugaaccaguuaaaccacauagagaacaguucauccauuucaggaaaauacaauuugauauggaaaacuugcaaaacuaggaauuagcaauguuuuauucugucuacuucacuguuuccuaauccaaaaaaauauucuaccauuccuccacuguacagacccuuuaaagaaucuuucaaauagcuuguuaucuuggucccauauucaaagugcuaauauugacuggguaacuguaaacugacuuaaaaguaguuuaacacacuguguucugauacagaaccacaaagcuggcuacuucuacauucagccccaccacaagcccauccucuccauauuauuuaugugucuaacccuuucaaaacacuauaaacuccauacugacagguauuaacagaacaccaaugaguauuaccaauuuuuaacuaagaaaacaaaauagcguauugagagauguucaacauaaucacagaguugaaagauaacucauuuagacauuccacuguaaagaggaaacugagaccaagaaagaagagauuugcauaguguguuaaucacagaauuugaacuggauuuuuaucacaaaaccuaccaugucuaaaacaggcauauaaaaaguucagaaacaaugaaguuuuaaaaauaaaaaauuagaacaaugagaaauagcuuuccucuuaucaaaauuuuauauuuuaaaacuuucuaagacugaaaacaauggcacaaaagucgcuaaacauuacuuauuagaauaugaauuaauaaaacccuuuuggcaaguaauuugggaaucuccauauuaauuaguuaaguaauucccuauaaaauaauaguaaaaagaaaaagcaaaacucaucauaaagguauuaaucuaaaugaaaaauauauaacaaaacucagucuuauuaauuaaacagcaauaauauguccuauuacuguauagucauuaaauauguuuaucaacauuuucauuuaacaucaacaacaacagauuauauauaugcuuccccugcccaaucgauuuuaugguauauuagugaaauuaaaauuucuaaaauaucuguaauuuccauugacaaaugucaauugauaucguuugacuguguccccacccaaaucugaucuugaauuguaacucccacaauucccacaugucaugggagggacccagugggagguaauuaauugaaucauagggggcgggucuuucuugugcuguucucguuauaaugaguaagucucacgagaucugacaguuuuauaaagaguucucccgcacaagcucucucucuuugccugccgccauccauguuaagacaugacuugcuccuccuugccuuccgccaugauugugaggccuccccagccauguggaacuguaaguccauuaaaccucuuuuucuucccagucucgaauaugucuuuaucagcagcaugaaaacaaacuaauauaucaauguuaucacguuaaauauauuaugaaguauaaauaccagagaaaacauguaagacugugguaggcaaaauucuaaagagggucucccuugccccccaagauucccaccccaugguuguucaaucaaucuagguacugcugagaauagagggugcaaauguaauuaaaaucccaggucagucgaucuuaaaauauaaaaauuaucuggauaggccuaaucuaaucacaugagcacuucaaaaguagaguuuucuccagcugguagcagaagggaaagucaaagauuugaagcaccaaguaccaccccuggcuuugaagccugagggggucacaugagagggaauucaugcagccccuaaaaguuaugccaccacaccucccacaaugacagccagcaaggaaacagggaccucagaucuacaaccauaaggaacuggauucugccaacagaaucugcagaugagaacccagcccagccaauacuuugauuuccgcuuuaggagacccugagcagagaacccaguuaagccugcccagacuucuaacaugcagaacugugagauaauaaauggguauucuuuuaagcccuuaagcuugugauaauuucuuauacauauucaacaaaaaacaaauacuaacaacaucuaagaccuuaggaauuucugagugcucucagauuuuauaugcuccuuuaucucucauggaaguaaaacucuuucccaggacuugggauguaaagccucagaagcuuuugccucccagcacucccaggaccccauugaaugcaaugacuucaguaccaucccaaaccaccuucuuaaggcuuccucaaaggaguaagcuaugcacuugaaggcaaauccuagaggaaggagcaaauucugcaggugagauagguaacuggagggagguacacagaucugacacaguucaauaaccagcucuccuaucucccuggcaaucuugcauuuuaagugugaagucuacaaucuguuccacaucccauucugcaguucucaagacaacacucuuucccccuaaagggaggaaaauuuaauuccuuucccuuuccauggcaacguuuuuuaauucccccuuccaaggugucuaccacuguguccacuagccagucuuuuucagagauauuuuccuuccagugaaacugccaauuccuuuaccuauggcaacucccauaauauacaauagggaauaugaaguuucaccugcacugcacagcaccuuaauaaucagguagaaugcuuauguuuaaauggaaaagcaaggaaauauaaaauuguauauuguccauaauuauuuuaaaaaucauauucccagacaugaugggaaaggagaauauaucccaaagcaauauucuuugaaacuaaccauuugaagacauuuguauaaggaaaaaugugcuuauacggauguucuguuaaaaaacucucagcauugccauaaaaaaggaugaguucauguccuuuguagcgacauggaugaagcuggaaaccaugauucugagcaaacuauugcaagggacagaaaaccaaacacugcauguucucacuuauaggugggaauugaacaaugagaacacauagacacaaggcagggaacaucagacaccggggccugucaugggguagggggauggggaagggacagcauuaggagaaauaccuaauguaaaugacgaguuaauggguccagcaaaccaacacagcacauguauaccuauguaacaaaccugcacguugugcacauguacccuagaacuuaaaguauaauuaaaaaaaaaaaaagaaagaaaaaaugguuaagaugguaaauacuauguguauuuuauuacaauuaaaaauaaaauauauaaaaucaaaaaaaaaaacucucugcauuguaaaaagccuauaccaaaauaaucucaccaccaugggaaauaggauuaugggaaagccucuuuuuuuuuucuuuucacuuuucuguauguuuuauuuuuacaagggaaagggcaaaagagauaaagggaaagaaaaaggaaagagagaaagagaaagucacaagcuagcuucuuccuccucugcguauuacuuacagcaaccauuugcaaauguaaaacaaccugucauaaaucaaugagauuagauaaucuauauaacuacaaugugcaaagcuaggcauucauauuuauggucaggaaagaacaagaauaaaaaugcuucuaugaagaaauuugcccauguuauaguaguaaaaaagauuuuuuuguuaaucacugaaccaaauuaugaguuaucugauauaagcuaucugaacaguaguggagaccccucucaaggcagaaaaagagaggaagaaauaccccggcucuuccccucuuuccgcccuccugucuuccacgugugcuucccauuugccaaaccgagccaaaagccugcuggcaaaggagccugagaaauguuauuugccaggaucggccuccuacaguagagaacagagcagacagaagguaggaugucccaacuccagaucuaugacauuaauuacugaacaguacagacauaauuacauauacaguacagguucauuuacauaaaacgcucucauacuuugacaaggcaccguagucaaauaacauacauauguauauuuauauacaugagaucaacugaauaaacaagguuucaauacuaaauuuguacugucaugaaaggcaaacuacuaaucaaaaugaguaguuaauaauuaagaacaauaaaacaucugaaauugccauggaaaaucagaaauaauaucacccaauacacauucauaaaggacaucaaaaugcaaucaguguuaaguauaugcugcuaucaaaguggaccaggauugcucuuuuucuuaaaggaaaaaaaaaaaccacuaaaauaugcauggggaaaguauaauaagacuugaucaaaguguucuuucuguauaaggcuaacaaaaagcaucugaaaauaauucugaggaaaaagugacuuuuugccacuuuucacuuuuuuuaacagauucaaauuuuauuuauuguauuaucuuuaucauuuguagucagaauuugacagaggucacagaagcuuuagauuaauguuauaaauauuucuugaaauggugacaaaaauaucauuucugcuuaaaauauagugaugaaggggaaaaaaauuuggccucuuaaauagaaaaaaaaauagcagcugucuauaugcugguaaaacugcauauauauauauauauaaucaacugaauaaacgagauuuugauacaaaauuugugcugucaagaaaggcaaacaggacugccaguuuccugcaguuuaaccauaagaaacacacauaaugaauuucugaaaugacauguuuuagaagauuuuaccauuggucuaaguauuguccccuuucuuaaaaagaacagagacaauguaggggaaauccaauaaguaguccuccuuuaucuguuauuucacuuuucacaguuucaguuacccauggucaaccucggucaaaaaauacuaaauggaaaauuccugaaaaaaacaauguauaaguuuuaaacugcaugcaguucugaguaaugugaugaaaucucacacagucccgcaccgccccacuccgucccgccuggaacaugaaucauuccuuuguccagugcaucuacacuguggacuacccgccggugacucacuugggagucaucucagugaccagaccaacucucaugguauugcagugcuuguauucaacucacgcuucuuugacuuaauaauagccccaaagcacaagaggagugaugcugccaacauggauaugacaaagaggagcuggaaagugcuucuguaagugaaaaggugaaguucucaacuuaauaaggaaagaaaagaaaucauacacugaggcugcugagaucuacaggaagaaugaaccuucuauccaugaaacugugaacaguauaucauuauaacuguucuguuuuauauuaguuauuguaaaucucuuacugugccuaauuuauaaauuaaaguuuaucaaguacauauguacuagaaaaaccacaguauauauaguguucauuacuaucugcaguuucaggcauccacugggggucuuggaacauauuccccuuggauggaaggaaacuauuguaccaucagaaagauagauuuauuaaaacuguguuauauuauuuugaacaacaauguuacuaaagugauucuuaaaaaauaaguaugucacaaggaauucaaauaacugaguuacaugugugaauauccgcaaaagaauuuugauauaacaaaauagacuuaaugcuaaaaacaaacuacaauuuucuuuacuuauucaaaauuguugcagguccuuagaaaaaucaucacuguacaguacuaaggaaaaaaauaauuaggcuuuuacauguuuauauauugugaguucagguaugagucuccacagaauauggcaauaauuauuuaaaauacacagacacuuucuaaaucgaaucugugaaugcuguuuagugguuucucucaaaauucuuuucagcguuaugcaccuccaucagacuugauaacagccuagcaauuuuacuaaaaaaacacuucacauauaagaaaacucaagagcucugaacuaaaaauagugcuaaauggggaauauuuccuaaugucuuaauaucugggcaccacagaccaggcucaggaacacauccucccauguguuaucuagcaccaccaauguggaagugccaaaaaccagaaacaggaaucaaagaaggugacagguaaauuucaguagcugguaauucacaaacacagaaauagccaucaaauaagccccaaggguaaauuguaucacuauucuuauucaauucucuauuuugagugggaacaacaggaugagaagacugaaggaaaaaacaugauuucugaaagugauuauaaaacuagcucuucugcagcaaggguguugccuuaaacuucacuucuagaaaauaucuccucagagagccaauuaaccacagggaaaaauuauucggaggcgauauuuaaaauaauuuggaaaaaacuauuagaaagcaccauuagcauaauaaucacaacuccucugcuaggcaacagcugguuaaucaaccuaaaauuaacacauuuacauauuagcaaagcuuuuaaauguuauacuuuucuauaacugagauucauccuuuccuucaucucagucccuuaucauuaaagauacuccuaaauucagaaggcucgcuaaaaauacaggguuccaacaauguauauaauuuuaccagacauuuuauacaaagguuccuaugaaacucuaagaacuuuaccuuuacagguacuuuauuaugguaaguuauugucagucuucagcgcugcuagaaaaugauacugaucucuuucuacacuugaauucuguguacauuagauuuacuaguaaaaaugugcaugcaauauuuaaagauauauuauaaauauaaaugauauaaauucugggaaaagaguaugaauagaagaaggguagaagaaaagaaagaccacaaacuagauguuuauuuugaaaaauuucuaauaaaggaagaaauagcaagauccuagaccaccaugacacuccaaguaagaccuagaagaaccauugucccuccaccugcauguuucauguaguuuuuuccuugaauaucuuguaaguuuuaaaaauuuuuugaaaggcuauacaacaaaucauaucaguaaaagcaacauccagaucaccuaacaacuuaaagagcaugcuugaaauauaguuuucaguuuaaugauuaacaauagucacaugcuuaagcauugguucaacaauucaaacgguuauaggccuuacguuaugaaacugccaauuguuaaaauuuugaccuauaaaauuaucaauuucauagacuccaacuaucagaguucucaguaacguauuaaauaacuucaauaauuaauaccacuugauucaugccagagaagucacagaaucuuuagccagagaagucauagaaucuuuagccagagaagacguaccacgggagaggauaggauagagacagacuuaacaguuguuuacugaagagcuccaaacaaacuggcaaaaauucaaaaccugggcuuugcauauuaaucaaugguuacauuugugaugguucacaaagcaacauaacauaaaacauuccgcuuuuaaagacugagaugauaaacaucacuagguccucugaauuaaaauucacucauaaaucaaaauaaacaguuaaacaucacacaggaauaaaagagcuaaggauacugauuuaaaaaacauuugcaaauacuuuuucuuuuauucaaauugaaaauguuuuuacaaguugauggguuaaaaagaaccagucuaaauuucaccuuaucuaugauuucaguuauccacagucaacugcaguccaaaaauguaaaaugaaaaauuccagaaauaauucauaagcuuuaaacugugugccauuucgaauagugcaaugaaaucuugcaguauuaugcucugucuuggccaggacaugaaucaucaccagcauauccacauuguauaugcuacacauacauuaguauauacaggguucaguacucuccgugguuucuuucucuucauaauuuuaauaucuuauuuucugaaagagccuaauauuuaauugauaaacaaucucacuguaaacuguaaauauuuuacuuuuaguaauucagaaaaacuauagcauuuuauuagauuucuugaaauacugaaucuaguuacagauuuaugaagaguacauaaccauaaauuacaaaaggauagagccccauuuuagguuuuuaccauuguuuugauuuuuaaaugacuauaauaaauauaaaacuccuuaaauuuuuaaguuccaaaauuuccagcuccuuuuuagauauguuuauuaaaaaacuaauauucugaugucauaacacaaaucaauaaaaauguaauacuuaagcccuuuuaucucugaaguaauuuaaaaaauuaaccaaauggaauugaguguaaauacuccauaaagggcucccuaaauaaaaaauuucacucucaaaguuauauuucacuuagauuauuauugagaaaaaagggucccuaacuuacuuauugcuuaaaaucaguaugauuuuugagagaaaugguaguaaaauuguggcucuaaucucauuuauacuguuuucaucauucacuacacacuuuugcaaccuagcauugcacuuauuuauucagagugaugcuuuauuuuuuuaaauagaagaaagauuauggcaccugcccucaaggagcuuacacauaaagaaauuaauaagaguauaaaauaagaauauaaugagauguuaaaauguauuauauaaauaguauuuuccauaagugcuuagacaauucacuguggauuccagaagugaaaucaguaauuucauauguauacagcauaugacauuuuaauacagaguaaacagaccaucacaugaaauacuaaugucaccuuuguuccauucaguaaauucaauacagauuuacugaagauuuaaaaauuguaggaaaaguaggggauugaaaaagaggcaaaaaaaguuacugaauguucuuucccuggaaugcuggcaccucugaggauugccugauuccauaggcguaugggauuuuguuugucuuuugauucagcuauuuuacaacucugcagagauggaacuugccuuauagaaaaaugagaguaauacagaucauuccuauccacagaaaugcaaacuguacccagugaaacagaacaguuuugccagauuuacauccauaugcaugcauuuuagaaugguugcucuauaagaguaugguaauuuuugaauucuccuuugaaccacuuuuaacaacugacuuguucuuucauuaauaaugaguuaaauaucuuuggcuugugcucauucuauauuucuaugagagucaugauuauauccucuuuuaaacuuuauccuucaauaaaaugaaaacaagaugaccccuacccuuccucaaagagcucacaaccuaguagggagacaaagacauuacuauucaacuagauuaauacaauaaggaaagcaucaugauacagauaggaacagcauacuauaagaagugaaauaaaacuauuucccaucugaaacuuuuaggaaagccuuacaucuuaaguuacuuacaugaauagacuuagggacaagauagaugguggauagcagacaaugcuaacguguagcucccacuuggacagacagaacaguguguggagaacaccaugaucuuuaccaugaucuuuugcuccaagaaccaccaaagaaauguaucaggaaaaucaaaagaauucaaagaucuuugaaugaagcagcaugccacugcaaauugcacaggacaggcaaaaaacugaguucccaaaguaugagagggagaaaaccugccucugaacacacaaccccacuggagaauccauaaauccagauuacaggaaaaugauuuaaacuuaccuagagcuuaaacaaauuuaaggacucaugaaaaacauaaaaguggaaacagcagugagaggaagugacuugcauguacucccagucuccagcucaagcccagggaagccauccccaacuauaccucacaggggccuucagggaaggcaggcagcagaauuagggagggaucacaggacagagaaagcuuccuacugaaauaaguaguaauucugacugggcgugaauuuccuugagcagaaucugggaggcaaacaggaauugcuucagauacaaacguaggagccacuggugacagacagggaggggcaaggugggaaagccaugcuugcuuucucagcaggaaagcucacagccuggggcaaguucugaguggggcacugcaggagccaggccagccucaccaacuaugagggaguuggguaaggccucuugcuacagcuaucacccauuucccugagaaacuauauagaacaacagaggcaaccaaaagccccucuggaacauaaccccauuggccugagaaccacccccucaauccccuacaguggccacagcaagccucacccaaggaaagucuaagcuuggacccaccuaaaccagccccaaccugaugguauuucucuauuuuccaugguugccaaacacaaaagauagaaacucuugggggcuuuauggccccauccaucaccugacaaacuaaaauccuuauccuggccaaugcagggcaagcacagaucccccuacuacuacuauagcugaugcucuuuugaaaaugccacccacaggcuggaggccaaucuacuugggccauaacagcaacuuaugacagaauaaucuugcugccaggaagaagaagacaauagcuaauuccacugcccacaacauccuggcuaaccaaugguccuuagucucuccauuugacaacuuuacugcuagcauaaccagcauucgagaaagccagcacacuaaacguaucuacaaccaaggacugggucuaccucacuccccugccaccuccauccaagcaagugcuggcauccaugccugggagaccugaagacagaucacaucacaggacucuuugcagacauucccuagcaccagcgcagagccugguaguccugcuggguggcuagacccagaagagaaauaagauucacugcaguccagcucuuaggaagccccauccucaagaaaagggggagagcaccacaucaagggaucaccccaugggacaaggaaaucugaacauuaagacuugaguuccacaccuuuccacuuaaacagacuaccaaaaugagaaggaaccagaaaaguaauucugggaauaugacacaacaggauucuacacuaccaccaaaagaucacaccagcucccuaacaauggaucuguaccuagaagaacucucugauuugccagaagaaaaaaaaaauaucagaagguugauuguaaagcuaaucaagaagacaccagaaaaaugugaaaaccaauguaaagaaauuuuuuuagaaaauacaggauauagauaggaaauucuccagagaaauagguaucauaaagaaaaaacaaucacaaauucuggaaaugaaagacacacuuacagaaauacaaaacacccugagaaguuucaacaauauaugagaacaaggagaagaaagaaguucagagcuugaagaaaauuaacccaaauuaacuuuuggcuuucaaauuaacccaaucugacaaagacaaaaaaaaaaaaaaagaauaaaaaaaugaacagagccuccaagaaauuagggauuauguuaaauggccaaaccuaagaaaaauagguguuccugaggaagaaaagaaaucuaaaguuuagaaaacuuauuuguaggguuaauugaggaaaacuuccuuggccuuccuagagaucuagacaucuaaauacaaaaagcucaaagaacaccugaaauauucaccgcaaaaaaaucaccugcacacacagucaucagguuaucuaaaucccucauaguuggugaggcuggccuggcuccugcagugccccacucagaacuuaagacgaaagaaagaaucuuaagagcugugagauaaaagcaucaaauaagcuacaaaagaaaaccuaucagauuaccagcagauuugucagaagaaacccuguaaaucagaagagacuggguucccaucuuuagcccccuuaaacaaaauauuugucagccaugaauuuuaucuccagcaaaacuaagccucauaaaagaaggagagauaaagucuuuuucagacaaaaaaauccugaagcaauuugccacuacuaagccagcacuacaagaaaugcuaaacagaguucuagaucuugaaacaaaacacugaaagacaccaaaauagaaccuccuuaaagcauaaauuucacagggcccauaagacaauaacauaaugaaaaacaacauauuaaggcaacaauuagcaugaugaauagaacaauaccucacaucucaauacuaacagugaauguaaauggccuaaaugcucacuuaaaagacagagaauggcagaaugaauuaaaaaaaaaaaaaaaauuccaccaaccgauuauuugcugucuucaagagacuccccuaaggugacaacucaacaaaacuuaagguaaaggggugggaaaagauauuccacacagauggaaaccaaaugcaaggaggaguagcaauuuuuauaccagaaaaaaacagacuuuaaagcaaaaacaguagaaaaaagacaaagagggacauuauauaaugauaaaaggaucaaucuaacaagaaaauaucacaauccuaaauauauacgcacuuaacacgaggucucccaaauuuauaaaacaauuacuacuagaccuaagaaaugagauagauggcaacacaauaauaguggggaaauucaauauuccacugacaguacuacaaaguacagaaagucaacaaagaaacaauagacuuaaaacuaaacccuagaacaaauggauuuaacagauauuuacuggacagucuacccaacaacugcagaauauauauucuuuucaucaguacauggaacauucuccaagauagaccaaugauaggucacaugucucuauaaauuuaagaaaaaucuaaauuauaucaaguauccucucagaccacaguaaaacaaagcuggaaauuaacucgaaaaggaacacccaaaacuguaaaaacacacgaaaauuaaauaaucugcucuucaaugaucuuugagacaacaaugaaaucaacauggaaauuuaaaaauucuuugagcugaaugauaauacugacauaacuugucaaagacucugguauacagcaaaaacggugcaaagagaaaaguucauagcauuaaaugcccauaucaaaaaggcuaagagugaaaacagacuaucuaaggucacaccucaaggaaacagagaaacacgaacaaaccaaacccaaacucagcagaagaaaagaaauaacccauaucagagcugaacuaaaugaaguggaaacaacaacaacaaaaccacacaaaagauaaaugaagccaaaagcugguucuuugaaagaacaaacaaaauugauagaccauuagcaagauuaaccgagaaaagaggaggcaagauccaaauaaggucuauuagaaacaggagauaauacaacugauaacacagaaauacuaaagauuauccaaggcuacuauuaacaccuuuaugugcacaaacuagaaaaccuagaggagauggauaacuuccuggaaauauacaacccuccuagauuaaaccaggaagaaucagaaacucuguacacaccaaguagucuguucagaguucaacaaguagugagauucaaacaguaauuuuuaaaaugccaacaaaagaaguacaggaccagauguuuucacagcugaauucuauaagacacugaaagaagaauugguaccaaucuuagugaaacuauuccaaaagacagagaaagaggaaauccuuccuaagucauucuaugaagccaacaucacccaaauaccaaaaccaggaaaggacauaacaaaaaaagaaaacuacagaccaguaucccugaggaacacagauacaaaaauccucaacaaaauacuagcuaaccaaauccaaaagaauaucaaaaauaugauacagcaugaccaaguggguuucacagcaggaaugcacagaugguugaacacaucuaaaucaauaaaugugauacaccacauacacaaaauuuauaagaaaaaaucauaugaucaucucaacagacacagaacuagcauuugacaaaauccaguaucccuuuaugauuaaaacccucagcaaaacuggaauaaaaggggcauaccucaagguaauaaaagccaacuaugauaaauccacaaccaacauuauacugaauagggacaagcugaaagcauugccccugagaacuggcacaagacaaggaugcccacuuucaccacuucuauuuaacauagugcuacaaguccuggccggaacaaucagacaagauaaugaaauaaagguguccaaaucaguaaagaggaagucaaacugucgcuguuugcugaugauaugaucauauaccuagaaaacccuaaugacucaucuaaaaaagcucccagaucugauaaauagauucaguaaaguuucagaaaacaaaauuaauauacauaaaucuguagcacugcuguacaacaacagcaacgaagcugagaaucaaaucaagaacucaaucccuuuuacaacagcugccaaaaaaaaaaaauuaggaauauaccuaaccaaggagaugaacuaucucuacaaggaaaacugcaaaacacugcugaaaaaaaucacugaugacacaaacaaauggaaacacaucccauguucguggauggguagaaucaauauugugaaaaugaccauacggccaaaagcagucuacagauucaaugcaauucccaucaaaauaccagcaucauucuucacaaaacuacaaaaaacaauucuaaaauuuauauggaaccaaaaaagagcccacauagacaaagaaagacuaagcaaaaagaacaaacauggaggcaucacauuacucaacuucaaacuauacuacaagguuauaguuacagaaacaguaugguacugguauuuaaaaaaaggcauguagaccaauggaacagaauaaagaacccagaaauaaagccaaauacuuauggccaacugaucuuggauaaagcaaacaaaaacauaaauuggguaagggauaccuauucaacaaauggugcugggauaauuggcaagccaaauguagaagaaugaaacuggauccucaucucucaccauauacaaacaucaagucaagauggaucagacuuaaaucuaagaccuaaaaccauaaaaauuuagaagauaauaucagaaaaacucuucuagacauuggcuuaggcaaagaguucaagaccaagaacccaaaagcaaaugcaacaaaaacaaaaauuaauaggcaggaccuaauuaaacuaaaaagcuucccuacagcaagagaaauaaucaccagagaaaauagacaacuaacagaaugggugaaaauauucacaaauuaugcaucugacaaagagcuaauacccagaauucacaaagaacuccaacaaaucagcaagaaaaaaaaaaucccaucacaaaguaggcaaagaacauaaauaggcaguucucaaaagaagauagacaaauggccaacaaacacaugaaaaaaugcuccacauuacuaauuaucagggaaauacaaauuaaaauuacaaugagauaacuucuuacuucugcagcaauagccauaauuuaaaaaucaaaaaauaauagauguuggcauggauguggugaaaagggaacacguuuacauugcugaugggaauguaaacuaguacaaccgcuauggaaaaugguauggagauucccuaaagaacugaaggcagaacuaccauaugauccagcaauuccaccucuggaucucuacccagaagaaaagaagucauuauaugaaaaagacacuugcaugcacauguuuauugcagcacaauuugcaacagcaaaaauauggaaacagccuaacuggcccuugaccaacaaguggauaaagaaaaugugguauauauacacuacagaauacuacucagccacaaaaaggaaugaaauaauggcauccguagcaaccuggauggguuuggagaccauuauuuuaagugaaguaacucaggaauggaaaaccaaauaccguuauguucuuacuuauaagugggagcuaagcuaugaggacacaaaggcauaagacugauauaauggacuuuggcacucgaggggaagggugggaggugagugaggaacaaaagacuauacaucggguacaauguacacugcuagggugacaggugcaccaaaaucucagaaaacaaccacuaaagaacuuacccauguaauuaaaagccaccuguuccccaaaaacuacugaaauaacauuuaaaaaaaaauuguaugauaaagaaggaguugaaaaucaagagucaauccaguccaucaccuauuuuguauagcccuugagcuaaaaguaguuuuuacauuuauaaauguuuggggagaaaagucaaaaaacaaugacuacugacauuugaaaacuaaauggaauucaaacauugguauacauaaauaaaguuuuauuggaacacugucacacucauuuguuauguauuauuuccagcuguuuucacaauagaauggcagaggugaauagcugcaaaaagaccacauguggcucucccaucaauccccacugcuacguggcacacuauacaguaucaaauuacaacugaacagcauuucaauuuccacguguauuaucauaccacauuuuuuaaaauuaccaauacauauacauaggaauaaaaauaagaaaagaagaaagagguggacuuugagugucauacuuuuaaggcacaggugaauaucuauuauuuuguuaucaaauuagaucacaaaacauuguguuuaucauacaaugacaccacagcugugcuaaaauaauggaauauacauugacacuaccaaacuaugcacucauuacaauauucucaacucacaggaaaguaacacucugaaaaauuagaaaauucuaaaacugaguacaucaccacacagaauuucuucauaaaaaauaacaagauugcaaccuaaguacauuuccuaguaguucauuuaucagcaagcaaggaaagucauuuaccaauggugaguuuaucaaaucacauuugauugcagcaguaaaagaaaugugucaaaaaaaaaaacaaauugguuuaaaucuacuggugagaauaguugcuuaaagaguugauugaggacacugggagguggcuggcaagauggccaaauaggaacagcuccaguuugcagcucccagcgagaucaaugcagaaggcgggugaucucugcauuuacaacugcaggacucgacccaucucauugggacugauuagacagugagugcagcccauggaaggcgagccaaagcagaguggggcguugccucaccugggaagggcaaggggucagggaacucccucuccuagccaagggaagaugugagggacugugccgugagaagacugugccgugagaaacggugcauucugauccaaauacuacgcuuuucacauggucuucacaaccugcagaccaggagauucccucaggugauuacaccaccaggacccugguuucaagcacaaaauugggcagccauuugggcagacaccgagcuagcugcaggaguauuuuuuucauaccccaguggcgccuggaaugccaacaagacagaaccauuuacuccccuggaaagggggcuaaagccaggcagccaaguggucuagcucagccaaucccacccccaaggagcccagcaagcuaagauccacugccuugaaauucuugcugccagcacagcagucugaagucgaccugggaugcucgagcuugguagggggagagucguccaccauuaccgaggcuugaacaggcaauuuuccccucacaauguaaacaaagccccugggaaguugggacagugcagagccaaccacagagccacaaagccacuguagccagacugccucucuaggcaggacaugucuguaagaaaggcagcagccccagucaggggcuuguagaugaaacucccaucucccugggacagaguaccugugagaagguggggcugugggugcagcuucaucagaccuaaacguuccugccugccaacucugaagagagcaauggaucucccagcacagcgcuggagcucugcuaagggacagacugcccccucaagugggucccugaaccccaugccuccugacugggaaacaucucccagcaguagucaacagacaccucaugcaagagagcuccagcuggcaucuggcgggugccccucugggacgaagcuuccagagaaaggaacacacagcaaacuuugcuguucugcagucucugcuggugauacccaggcaaacagggucuggaguggacauacagaaaacuccagcaaaccugcagcagaggggccucacuauuagaaggaaaacuaacaaacagaaaggaauagcaucaacauuaacaaaaaggacguacacacauaaaccccauccaaaguuaccaacaucaaacaccaaagguagauaaauccaugaagaugaggaaaaaccagagcaaaaaggcugaaaauuccaaaaccagaacaccucuucuccuccaagggaucacaacuccuugccagcaagggaagaaaaccagacagagaaugagucugacgaauugacagaagcaggcuucagaagguggguaauaacaaacuccuccaggcuaaaggagcauguuguaacccaaugcaaggaagcuaagaacuuugaaaaaagcuuaaaggaauugcuaacuagaauaaccaguuuagaggauaacauaaauuacuugauggagccgagaaacacagcacaagaacaucgugaagcuuacucaaguaucaauagccaaauugaucaagcagaagaaaagauaccagagauugaagaucaacauaaugaaauaaagcgugaagacaagauuagagaaaaaagaaugaaaaggaacaaacaaagccuccaagaaauaugggacuaugugaaaagaccaaaucuaucuuuggcugguguaccugaaagugacgaggagaauggaaucaagcugaaaaacacucuucaagauauuauccaggagaacuuccccaaccuagcaaaacaggccaacauucagauucaggaaauacagagaacaccacaaagauacuccucgagaaaaacaaccccaagacacauaauugucagauacaccaagguugaaauaaaggaaaaaauguuaagggcagccagagagaaagaucagguuacccacaaagggaagcccaucagacugacagcagagcucugcagaaaccguacaagccagaagagaguagggggccaauauucaacauucuaaaaagaauuuucaacccagaauuucauauccagccaaacuaagcuucauaagcaaaggagaaauaaaauccuuuacagacaagcaaaugcugagaaauuuugucaccaccaggccugucuuacaagaacuccuuaaggaagcacuacauauggaaaggaaaaaccgguagcagccacuacaaaaacauaccaaauuguaaagaccaucaacacuaugaauaaacugcaucaacuaacgggcaaaauaaccagcuagcaucauaaugacaggaucaauuucgcacauaacaauauuaaccuuaaauguaaaugggcuaaaugccccaauuaaaagacacagacuggcaaacuggauaaagagucaagacucaucggggugcugaauucaggagauucaucucacaugcgcacauaggcucaaaauaaagggaaggaggaagauuuaccaagcaaauggaaggcaaaaaaaaaaaaaaagcagagaaugcaauccuagucucugauaaaacagacuguaaaccacagagaucaaaaaagacaagagcuaaagggaucaauguaacaagaagaagcuaacuauccuaaauauacaugcacccaauacaggagcacucagaugcauagagcaaguuuuuagagaccuacaaagagacuuagacucccacacaauaacagugggagacuuuaacacuccacugucaauauuagacagaucaacaagacagaaaauuaacaaggauauucaggacuugaacccagcucuggaugaaacagaccuaauagacauuuacagaacucuccacucccaaaucaacagacuauacauucuucucagcaccauaucgcauguauucuaaaacugaccacauaauuggaaguaaaacacuccucagcaaaugcaaaagaauggaaaucauaacagucucccaaacaauaggcaaucaaaauaaaauucaggauuaagaaacucacucaaaaccgcacaacuacauggaaacugaacaaucugcaccugaaugacuacuggguaaauaaugcaauuaaggcagaaauaaauaaguucuuugaaaucaaugagaacaaagacacaacauaccagaauuucugggacaagugaaagcaguguuuagagggaaauuuauugcauuaaugaccacaggagaaagugggaaagaucuaaaauugguacccuaucaucacaguuaaaagaacuagagaagcaagagcaaacaaauucaagagcuaacagaagacaagaaauaacuaaggagcagaacugaaggagacagagacaugaaaaacccuuaaaaaaaaucagugaauccaggagcuaguuucuugaaaagauuagcaaaauggauagacugcuagccagauuaaugaagaagaaaagagagaagaauaaaauagacacaauaaaaaaugaugaaggggauauuagcacugaucccacagaaauacaaacuacaaucagagaauacuguaaacaccucuacacaaauaaacuagaaaaucuagaagaaauggauaaauuccuggacacauacaccuucccaaacuaggaagacaccuuccuaaacuaggaagaagucgaaucccugaacagaccaauaacaaguucugaaauugaggcaguaauuaauagccuaccuaccaaaaaaaaaagcccaggaucagacggauucacagccaaauucuacuagagguacaaagagaagcugguaccauuccuucugaaacuacuccaaacaccugaaaaagagggacucgucccuaacucauuucaugaggccaacaucauccugauaccaaaaccuggcagagacacaacaaaaaaacuaaauuucaggccaauaucccugaugaacaucaaugugaaaauccucaauaaaauacuggcacaccaaauccaggagcacauuaaaaagcuuauccaccacaaucaagucagcuucaacccugggauacaaggcugguucaacauaugaaaaucaauaagcauaauccaucauaacagaaccaauaacaaaacagaaccaaugacauaaacagaacuaaugacaaaaaccacaauuaucucaauagaugcagaaaaucccuuugauaaaauucaacacugcuucaugcuaaaaacucucaauaaacuagguauucauggaauguaucucaaaauaauaagagcuauuuaugacaaacccacagccaauaucauacugaaagggcaaaagcuggaagcauucccauugaaaaucagcacaagacaaggaugcccucucucaccacuccuauucaacauaguacuagauguucuggccagggaaaucaggcaagggaaagaaauaaaggguauucaaauaggaagagaggaagucaaauugucucuguuugcagaugacgugauuguauauuuaaaaaaccccaucgucucaacccaaaaucuccuuaagcugaucagcaacuucagcaaagucucaggauacaaaauuaaugugcaaaaaucacaagcauuccuauacaccaauaauagacaaacagagagccaaaucaugagugaacucccacucacaauggcuaaaagagaauaaaauaccuaggaugauaaaauaccuaggaugaugauaccuaugagaauaaaauaccuacaaugagaauaaaauacuuacaagggauaugaaggaccucuucaaggagaacuacaaaccacugcucaaugaaauaagagaggacacaaacaaauagaaagauauuccaugcucauggauaggaagaaucaauauugugaaaauggccauacugcccaagguaauuuauagauucaaugcuauccucaucaagccaccauugacuuucuucacagaauuagaaaaaacuacuuuaaauuucauauggaaccaaaaaagagccugcauagccaagauaauccuaagcaaaaagaacaaagcuggaggcaucacgcuaccugacuucaaacuacacaaggcuacaguaaccaaaacagcaugguacuggugccaaaacagauauauagaccaaugguacagaacagaagccuuagaaauaacgccacacaucuacgacccucugaucuuugacaaaccugacaaaaacaagcuauggggaaaggauuccuuauuuaauaaauaguguuacgaaaacuggauacccauaugcagaaaauugaaacuggaccccuucuuacaccuuauacaaauauuaacucaaaaugaauuaaagacuuaaacauaagaccuaaaaccauaaaaacccuagaagaaaaccuaggcaauaccauucaggacauaggcaugggcaaagacuucaugacuaaaacaccaaaagcaauagcaaaaaaaaagccaaaauugacaaauggaaucuaauuaaacuaaagaccuucuccacagcaaaagaaacuaucaucagagugaacaggcaaccuacagaaugggagaaaauuuuugcaaucuauccaucugacaaagggcuaauauccagaaucuacaaggaacuuaaacaaauuuacaagaaaaaaaaaaccaucaaaaaguuagcaaaguauaugaacagacacuucucaaaagaagacauuuauguggccaacaaacaugaaaaaagcucaucaauacuagucaucagagacaugcaaaucaaaaccacaaugagauaccaccucacacuaguuagaauggugaucauuaaagucaggaaacaacagaugcuggagaggauguggagaaacaggaacacuuuuacacuguuggugggaguguaaauuaguucagccauuguggaagacagugcggcgauuccucaaggaucuagaaccagaaauaccauuugacccagcaaucccauuacuagguauauacccaaaguauuauaaaucauucuacuauaaagacaaaugcacacguaugcuuacuucaacacuguucacaacagcaaagacuuggaaccaacccaaaugcccaucaaugauagacuggauaaagaaaauguggcacauauacaccauggaauacuaugcagccauaaaaaaagaugaguucuuguccuuugcagggacauggaugaugcuagaaaccaucauucucagcaaacuaacacaggaacagaaaaccaaacacugcauguucucacucacaagugugaguugaacaaugagaacacauggacacagugaguggaacaucacacaccggggccugucagggggugggggcuaggggaaggauagcauuaggagaaauaccuaaugaaggugacagguggaugggugcagcaaaccaccauggcacauguauaccuauguaauaaaccugcauguucugcacauguacuccggaacuuaaaaguauaauaauaaaaaaaucuaaaauaaauuacacauaauaauauuuuuaaaauguugaggacauuggaagcaaaucaauagucacuuaaaaaacaaggcaaaugauuucagugguuuuccuugacucuugguaagucaaaaaauggaaccaauauugcuauuguuguugaggagucaauguugagugugaaaugacugaagaauuagcuccuaugaacagucagcaugggacaacuacaggcaagaauauucucacauaacuugagcaaacauuaauucaguaaaaccugaaguggaaucuacuaagauacauuauaaccaauuuugguaaaaauauguguggaauacaaaaaggcuuuagauauacauauuuuugacauuuauuacggaacacuaaaugacuuugcuaaucaguuuuuacugcagacuugaugauauuucuuggugaacuuaauguacaauuacaagagaaaacauagcuuauauauaagaaacacugacgauaaagucaucuuaaugacaacuaguauucugagaaucacaaguaaucacaagcuacuguccaugcaucccaaauuaucaaauauuaaaacaagaagggagauuuccauucccauacaaauguguagugaauauuuuuuucugagcucaaacuacagguccaguaggguuuuucagaucacaugaaaaugcaaaguaaauuuccauacugcaaauuccauuuaacugugcaacugagaacuuccaccuaaucuuuaauuggaauugauuaacugacaauaacaugcuaaaaggcaaauaucaagaagagaaucuaacagaauucuauaaaugccuuccuagugacaaauauguucaauuaaaauguuugugaauuuaugucaguauuugcugugccugagugaaagacauuuucaaaaaugaaguaaguaaaauaucauuacagaucagcacugauagaugaauguuuccauuuuauuuugacagagaacacugacucuuaaccacaguuaaguaaaauguccucucccacaaaagaagaauuucuucauucuuauuaauagaucuguuacaaaaaguuuuaauaaacuaaaugaguaucucaaauguauuacgugaaaaacuacacugcugauuuuuccaccuaucccccaacaaaaacugcuuuuccagcaucucaguacuauaaauuccauucuucagguugacgaagccaaaaaacuugaagccauucuuaauauaucuucaucucauacucuuauuacccauucauugacaacagcugucuuuaucaguaaaacuauagcaucuaaccaauucucaccauaugugcuaucauccugguucaagcuaccaucacuauuuaccuacuaauuauaacacacagauucucuuuacuucuuuugccuccuccuacucacaguaaccugagacuucuuuaacauuuuaagucagauugugucacugcucagccaaaaauccuccaaugguuucccaucucacuaagcauaaaaagcaaaagucuucaucaauaaaguacaagaaacugcacgaucugcuuuccacccacccaaaccacuucucugaccucauuucuuucucauccaguuucagccacacuauccuauuuguguuucuuccgacuuguucucuaauccuaugccacagccuguaacuuguucuuccauugccuaaaaugauguguuuccagauaaacacacuacucacucccucaccuccuucaggucuuugaucaaaccucaucuucccacagaggccaucugugacuacccuauauaauuagcaccuauccuuucacacuguauuuuuaccacucuguaacccuauuacucugcccacagacucuacgacagugccaaguauacaguauucacucaauaaauauuuccugaauaaaugaacaaagcaacaaaauuuuuuguguaauguguccucaguuccuuuuccuuauauaagugcuauauauacauauauauguauauaugaacaauuguauaaaacugauuuaccauugcgcuaagaguuucuucccaaucaggccgcucucgaggguguacauuucuauguagcucuggaacaaaaucaucuucuucagaauguacugaggacuucaucuuccuagagaucaaaacacgaaagauucugauaagaauuuccaauucuaugaaagccuuccaaugaucacaauugaaagagcagaaaaacuacaugucagauuugaaguuuagcuaaaagagcuuaacugaauagcagugauccuuuauuucuacucuggcuuucagaggucucuccuaauguaccaaacaccugcuuuuauuccagaagauaaaauaagguuuacagcuaguuaaccuuuaugguccaugguuauuauauaaaaacugauuuuuaucaguucaacacaauuugaaccuugaaaagauuugcaacagcaauuaguuacucugaaucaauauuuacagaacugugcuaagcauuaguaucauuucagaauaaagaaaagauaugguauuucugguuccaaucaauggagcagagugcagcaaauaagcauuuucaaugagaacaacuaugaauguugggcaaaacauauaaaacagcuugucugaaggcaacagaaagcaaccaauacagaugggacauccagggcuacaagcuuugagauaaggaaagcccaaucaagcaauuuccacauuuaauccuucuuucuguauaagauaacuuuucaaaucaaucaugggaaauagagcccaagauaauaacuguaaucuuagugggaugagaaggcagagguuggaggcugggauuaccaaaguagggaggaauucaggaugcaaaaugcccccaaaaaagaccuaaagagaaagagcccagaaaucuacagcaaaauucaccucaaauuauuaacugaguccuaagcuuacaaauauguaggacaggaugccaagaaacccaaaacaaaccaaguaaagaggcaaguagacauuuuggcagcccaucaauggugaggagaugggcuggcaagcaagcacugccaagauggaggagcacugaaaaaccccugagcucuuaugugugacucuaaaaaagccaugccuuaagaguauggacaaaauagcaauagaaaaauucuaacaaagccccaaaccaagccuugacagaaucagaaguacgagaagaaaaauuaacugucuuuggaggaaaaaacauucuccagacucucugcaaaucuuucguucacauuaucuaguauccaguaaauauuaugaggcaugcuuaaaaaaacaagaacuagugaaaauugagaaaaaaaauagucaaaccagaaagacucacauuucauucagaucuuagcauuaucagaaagagacuuuaaaauggcauuugugauuuucugccuaugaugcagaaagcuguaaagagcaucaccccuagccuaguaauaauaaaaaaaaaaauagauaaucugaaaaucuuaacuuuucuaggacacaacagaaaacugaggucucagggcaaccaacuaguuuaaacacuauggaaacacaagccucucugagauuagauggaugacaagcaguuacuuuucugaacacaguauggggagaagaggaauacauaagaagaauuuaguuaaauuuuuaucaaauugcuaaaaacauuuaugauuuauauguucaauugaaugaaaguaaaaaauaagagagaaaugaugaauuucaacagagaauuggaagccauaaaaucaaauguucauuuuaaaacugaaaaauacaguaucugaaauuaagaacuaaccagauacauuuaguagaacaauaaacauagcuaaagagaggguuagugaacuagaagauaguuuaguagaaaauauccacauugaagaacacagagaaaaaaaggaacagaaaauacacaaaauaguauaaaggaugagagacuugguuuaaaaaaaaagaucucaaauaugucuaaauugaugacagagauaagggagauaauuuuuuaaaacaagagaaugugacaaaagcaauauuugaaaacaaaugcuaaaaguuuucaaaacugaugaaaucaucaaacuaaagauucaaagaaauucuauaaaccucaagcagaauuuuuaaaaauuaaaaccauagguaaauuacagucaaacugcuaaaaaccaaacacaaagagaaauccuuaaaagcagccagagaauuuuuuaaaguugacuuccaauaagcaauaauuacaaugggagaagacauuucaauggaaaagagaaaauaaugaaauuaaccuucagugugcuaaaaggaaaaaauauuuccaaccuagaaucuucugccucaccaaaguaaccauuuugaaagcagguaaaacaaauuauuuacaaaugaaagcugaaaaaaacuaccaccaagagacugcaauaaaagaaauaguaaagagaauuccuaauugaagaaaacugauuccaaaacuacaaaaacacaugaaaagaauaaagcacaaaaguggggaaauauaaguaaauacuguauaaacauaaaaauaacgucuuaugaaguuaacaauauauacacauuaaaaacacaaaggauaagaaauguacauucagucaaacaguuuaggauuucucuauugguugagaagugagaaaagcucuauuuuauggaauacuguauguaagucaaauauauguugcagucucuauagugaacacuagaagaacgagaaauaaauguauaacuaaaaagcugauagaggaaaagauuuuugaaaaauaaaacauacauauuaaucuaagagaaggcaggaaauaaagaauaagagaagaaauaauaaaacaaggcaaauaaaaacaaauauuaaaaugguaaacuuaaauucaagcacauuaauaauuuggaaagcaaacagacuagcugggaaagauacggagaaaucacaccccucauucauuauuagaaggaauguaaaauggcacagccacuguggaaaagacuggcaguuucucaaaauguuaaaacagagaauuaccaaaugaccaagcaauucuacuccugguauuuaaucaagagaaauaaaaacacgucuaccaagaacuuguacaugaauauucauagcaauauuauucauaauagccaaaaaguagggacaaucaaaaugcccagcaacugaaggauaaauaagcaaaaugcacuagguacacauaauaaaauauuauucagucauuaaaaaagaaugaagugcugauucaugcuaccacagggauaaacauugaaaacauuaugcuaaauaaaauaagucagaggcaaaagaccacaaaucauauaauucucuauauaugaaauuuucagaauagucaagcccauagagacaaaaauuauauuaguuguuuccagaggcuaaggagauggaaacauggagaguucuacuaauaggugagggauuucaggugagggauuucuuucucaaauguucuagaauuagauaacagugguuuucguauaacuucaugaauauauuaaaaaccacugaauuguacacuuuaaaagugaaucacauggcaugugaauucuuuuaguuaaaaaaaguaaauggacuuaaagaucccuauuaaaauacaaagacuauaagcagggauuuaaaaaccaacaacugcugggugcaguggcucacaccuauaauccuagcacuucaagaggccaaggugggcauauuacuugugcccagaaguucaagaccagacugggcaagacaguuggaccccaucuguaaaaaaaaauacaaaaauuagccaggugaaaugguauacaccuguggucccagcuucuccacaggcugaggugagaagaucaccugagcccaggaugucgaggcugcagugagccauguucacaccacuguacuccagccugggugacagaaaagcaacuugucucaaaauaaaaagcaauaacuauauccuaagagacauacuuuaaauauaacaacaccaaaagguagaaaauggaaggauuacaaaaacugauaccauguaaacacuagccaaagaaggcuagcguagcuauauuacaucaggcaaaguagaccuuaagcacaagguauuacuagaaauaaagggagacguuucauaaaagcaucaaauuaacagguuaacacaauuuauaugcaauaaguuguaaacaaaauuuguaugcaaaaaauaacagcuucaaaauacauaaaguugaaagaacuaaaaaacagauaaauccacuaucaccguuguagauuuuagcaaaucccucucaauggcugauagaauaagcagacaaaacuguaaguauaugacuugaacaauucaauuuuccaaugugaacuaacacagaacacuaaacccaacaacuacaaaacucauuuuuucuuucacauucuuuucaagcauauaugaaacauuuacaaauagacuaaaugcuagaagacaaagucucaacaaauuaaaaaaauuuaaaucaugaaucacguuuuauaaccaccgcagaacugcacuaaaaagcaaugacugaaagauaacuagaaauuccucuaaauguuuggaaauaaagaaacacaauacucaauaacucauaaaucaaacauaaaaaucacaauggaaauuagaaagucuuuuuaugugaaugauaaugaaaauacaauagaugaaaaugugugggauacaacuaaagagguauuuagcaaaauucauagcucuaaaugcauguuacuggaaauuagacaaguugaaaaauuacuacuucuaagcuucuaucacaagaagcuagaaaaagaauaguaaauuaauucaaggaaaguauuuaaaaauguuuaaauaacaaaucaauaaaauagaaaguaaaugcauaaaaaagaaaacaaagccaaagguugauucuuuaaaagauuaauaaaaugaacaaucccuagaauaagucugaccaauaaaaaaauggagaaucuacaauauagauaauaaaaagggagccauaaacagaaagccugugaacauuaaaaagauucuaaggcugggcugggcaugguggcucaaggcuguaaucccagcacuuugggaggcugaggcggguggaucacgaggucaggagaucaagaccauccugccuaauacggugaaaccccgucucuacuaaaacuacaaaaaauuagcugggcgugguggcgggcgccuauagucccagcuacucaggaggcugaggcaggagaauggcgugaacccgggaggugaagcuuugcagugagcugagaucgcaccacugcacuccagccugggccacagagugagacucugucucaaaaaaaaaaaaaaaaaaaaaaaagauugugaggccauuaugaacauuuucacugcaaugcaguugagaauuuaguugaaaugaacaaauccucugaggaacccaauucaccaaaccugaaacaauaaacaaaaagauuuguacaguccuacagcuauuaaacaaaauuaaucuguaaggaaacuccaagcccaaaugaauccauugaacucuuuuaaacauacaagccaaagauaauaaaaauuguauaaacauucuuccaaaguauaaaaauaaaaggaacacuucccaauccauccaauaaggccaagccagaguuuagagcaaaagcuagacauuacuagaagagaaaauuauagguugauauaaugaacacaguuauaaaacuccuaaacaaaauauaaaaucaaacccaguaauauacaaaaacccaguaauauacaaaaaggauagugaccgaaugaguuuuaguucaaaaugcaaauugauuaaacguucuaaaaucaagcccuauaauugaucacacuacacuauuaaagggaaauauauauauauaauuucuuucuuuuuaauuucuucaaaaaaaaaaaaaaacgggauacauaugcagaaugcgcagguuuguuacauagguauacaugugccauggugguuuguggcaucuauugacucguccucuacuuuccguccccuccccucacccuccaccccacaacuggccccgaucuguguuguuccccucucuguguccaccuguucucaguguucaacucccaauuauggaugacaacaugcaguguuugguuuucuguuccuguguuagcuugcugaggaugauggcuuccagcucuguccaugucccugaaaaggacaugaucucauuccuuuuuauggcuucauaguauuccauggugcauauguaccacauuuucuuuauccagucugucacugauggccauuuggguugguuccaugucucugcuguuguaaacagugcugcaauaaacauaugugugcaagugccuuuauaguagaaugauuuauauuccuuuggguaauggaauugcuaggucaaaugguauuucugguuccagaucguugaggaauugccauagugucuuccacaaggguugaacuaauuuacauucccaccaacaguguaaaaguguuuguauuucuccacagccucgccagcaucuauuguuuccugacuuuuuaauaaucgccauccugacuggcgugagauggugucucacugugguuuugauuugcauuucucugaugaucaguuauguugagcuucuuuucauguuuguuggccacagaaaugucuuccuuugagaggugucuguucauauccuuugccaacuuuuugaugggguuauuuaucuuuaucuuguaaauauguucgaaguuccuuguaaaugcuggauauuagaccuuugucagaaggguagauugcaaaaauuuucucccauucuacagguugccuguucacucugaugauaaguuucuuuggcuguggagaugguauuuuguuuaauuagaucccauuugucaauuuuggcucuuauugcaauugcuuuuggcauuuuuguuaugaagacuuugcccaugccuauguccugaaugguaaugccuagguuuucuucuaggguuuuuaugguuugggguuuuacauuuaagucuuuaauccauccugaguuaauuuuuguauaaggugaaaggaagggguccagguucaguuuucuguauauggcuagccaguuuucccagcaccauuuacugaauaggagaucucuuucccauuguuuguuuuugucagguuugucaaagaucagaggguuguagaugugugguguuauuuccgaggucucuguucugcuccauuggucuauaugucuguuuugguaccaguacccugcuguuuugguuacgguagcguuguaguauaguuugaagucagguagcgugaugccuccagcuuuguucuuuuugcuuaggauugucuuggcuauauggggucuucuuugauuucauaugaaauucaaaauaguuuuuucuaauucuguaagaaugucaaugguagcuugaugggaauagcacugaaucuauaaauuacuucaggcaguauggccauuuucacaauacugauucuucccaaccaugaagaaggaauguuuuucuauuuguuugugucaucucuuauuuccuugagcagugguuuguaguucuccuugaagaggcccuucacauccccuguuaacaguauuccuagguauuuuauucucuuuguagcaauuaugaaugugaguucauucaugauuuggcucucugcuugccuauuguugacaaaaaggaaugcuugggauuuuuacacauugauuuuguauccugagacugcugaagcugcuuaucaguucaaggaguuuuugggcugagaugacuggguuuucuaaauauaaaaucaugucaucugcaaacagagacaacuugacuuccucucuuccuaccugaauaaccuuuauuucuuucucuugccugacuucccuggccagaacuuccaauacuauguugaauaggaguggugagagagggcacccuugucuuguacugguuuucaaagugaauguuuccaucuuuucuccauucaauaugauauuggcuguggguuuguuauaaauagcucuuauuguuuugaaauauguuccaucaauaucuagcuuauugagaguuuuuaacgugaagggauguugaauuuuaucaaaggccuuuucugcaucuguugagauaaucaugugguuuugucuuugguucugaagucuacagaacucucuaccccaaaucaacagaauauacauucuucucagugccacauggcacuuauucuaaaaacgaacacauaauuggaaguaaaacacuccucaacaaaugcaaaagaacuaacuucacaacaaacaaucucucagaccacagugcaaucacauuagaacucaagauuaagaaacucacucaaaagcacacaauuucauggaaauugaacaaccugcuccugaaugacuccuggggaaauaaagaaauuaaggcagaaaucaggaaguucuuugaaacaaaugagaacaaauagagacaacauacuagaaucucugggacacagcuaaagcaguguuaagagggaaauguauagcacuaaaugcccacaucagaaagcaagaaagaucucaaauggacacccgaacaucacaauuaaaagagcuaaaggcaagagcaaacuaauccaaaagcuagcaaagcacaagaaauaacuaagaucagagaagaaaugaaggagauagagacaugaaaaacccuccaaaaagaaaaaaaaaaaaaucaacaaauccaggggcuguuuuuuugaaaaaacaaacaaacaaacaaacaaacaaaaaaccacuagcuagacuaacaaagaagagagagaagaaucaaacagacacaauaaaaaauguuuagggacaccacugaccccacagaaauacaaacuaccaucagagaauacuauaaacaucucuacacaaauaaacuagaaaaucuagaagaaauggauaaauuccuggaugcauacacccuaccaagacuaaauuaggaagaagcugaaucccugaauagaccaauaacaaguucugaaauugaggcaguaauuaauagaccaaccaaaaaaaaaaaaaagaaaagcccaggaccagacggauucacagccaaauuuuaccagagguacaaagaggagcugguaccauuccuucugaaaccacuccaaacaauuaaaaaggagggacuccucccuaacucauuuuaugaagccagcaucauccugauaccaaaaccagaaagaaacacaaccaaaaaagaaaacuucaggccaauaccucugaugaacaucgaugcaaaaauccucaauaaaauacuggaaaauugaauccagcagcacaucaaagagcuuauccaccacgaucaagucggcuucauuccugggaugcaagucugguucaacauaugcaaaucaauaaauguaauccaucacauaugauuucaauaggugaaauuuaauaccuauucauaaauucuuuaaaauauuuuaaugaaaauuauugaaaaacacaaauacagcuaagcaucacacuuaacauugaaauacuaaaugauuucccacugagaucaugaacaaaucaagaauguugucuucuauucaacacuguacuugaggucuuauucacuuggggaaaaaaagcaagaaaaaauguaaaaauuggaaaagaaagaggagccaagauggccaaauaggaacagcuccgguccacagcucccagcgugagcgacgcagaagacgggugauuucugcauuuccaucugagguaccagguucaucucacuagggagugccagacagugggcacaggacagugggugcgcgcaccgugcacaagccaaagcagggcgaggcauugccucacucgggaagcgcagagggucagggaguucccuuuccuagucaaagaaaggggugacagacggcaccuggaaaaucgguucacucccacccaaauacugcgcuuuuccgacgggccuaaaaaauggcgcaccaggacauuauaucccgcacauggcucggaggguccuacgcccacggagucucgcugauugcuagcacagcagucugagaucaaacugcuaggcggcagcaaggcucggggaggggcgcccaccauugcccaggcuugcuuagguaaacaaagcagccagaaagcucgaacuggguagagcccaccacagcucaaggaggccugccugccucuguaggcuccaccucugggggcagggcacagacaaauaaaaagacagcaguaaccucugcagacuuaaaugucccugucugacagcuuugaagagagcaaugcuucucccagcacgcagcuggagaucugagaacaggcagacugccuccucaagugggucccugaccccugacccccgagcagccuaacugggaggcacccccaagcaggggcagucugacaccucacauggccggguacucccacagaccugcagcugaggauccugucuguuagaaggaaaacuaacaaacagaaagcacauccacaccaaaaacccaucuguacaucaccaucaucaaagaccaaaaguagauaaaaccacaaagauggggaaaaaacagaacagaaaaacuggaaacucuaaaaagcagagcgccucuccuccuccaaaggaacgcaguuccucaccagcaacggaacaaagcuggauggagaaugacuuugacgagcucagagaagaaggcuucagacgaucaaauuacucugagcuaugggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacaugaagaaugcagaagccucaggagcugaugcgaucaacuggaagaaaggguaucagcaauggaagaugaaaugaaugaaaugaagcaagaagggaaguuuagagaaaaaagaauaaaaagaaaugagcaaagccuccaagaaauaugggacuaugugaaaagaccaaaucuaugucugauugguguaccugaaagugauggggagaauggaaccaaguuggaaaacacucugcaggauauuauccaggagaacuuccccaaucuagcaaggcaggccaacguucagauucaggaaauacagagaacgccacaaagauacuccucgagaagagcaacuccaagacacauaauugucagauucaccaaaguugaaaugaaggaaaagauguuaagggcagccagagagaaaggucggguuacccucaaagggaagcccaucagacuaacagcagaucucucggcagaaacccuacaagcuggaagacagugggggccaauauucaacauucuuaaagaaaagaauuuucaacccagaauuucauauccagccaaacuaagcuucauaagugaaggacaaauaaaauacuuuacagacaagcaaaugcugagagauuuugucaccaccaggccugccuuacaagagcuccugaaggaagcgcuaacauggaaaggaacaaucgguaccagccgcugcaaaaucaugccaaaguguaaagaccauugagacuaggaaguaacugcaucaacuaacgagcaaaauaaccagcuaauaucauaaugacaggaucaaauucacacauaacaauauuaacuuuaaauguaaauggacuaaaugcuccaauuaaaagacacagacuggcaaauuggauaaagagucaagacccaucagugugcuguauucaggaaacccaucucacgugcagagacacacaucaaaauaaaaggauggaggaagaucuaccaagcaaauggaaaacaaaaaaaggcaggaguugcaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuuuucagcaccacaccacacccauuccaaaacugaccacauacuuggaaguaaagcucuccucagcaaauguaaaagaacacaaauuauaacaaacuaucucucagaccacagugcaaucaaacuagaacucaggauuaagaaucucacucaaaaccgcucaacuacauggaaacugaacaaccugcuccggaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaacaucgacacccuaacaucacaauuaaaagaacuggaaaagcaagagcaaacacauucaaaagcuggcagaaggcaagaaauaacuaaaaucagagcagaacugaaggaaauagagacacaaaaaacccuucaaaaaauuaaugaauccaggagcugguuuuuugaaaggaucaacaaaauggauagaccgcuagcaagacuaauaaagaaaaaaagagagaagaaucaaauagacgcaauaaaaaaugauaaaggggauaucaccaccgaucccacagaaauacaaacuaccaucagagaauacuacaaacaccucuacgcaaauaaacuagaaaauauagaagaaauggauaaauuccuugacacauacacucuaccaagacuaaaccaggaagaaguugaaucucugaauagaccaauaacaggagcugaaauuguggcaauaaucaauagcuuaccaaccaaaaagaguccaggaccagauggauucacagccgaauucuaccagagguacaaggagaaacugguaccauuccuucugaaacuauuccagucaauaaaaaaagagggaauccucccuaacucauuuuacgaggccagcaucauccugauaccaaagccgggcagagacacaaccaaaaaagagaauuuuagaccaauauccuugaugaacauugaugcaaaaacccuuaauaaaauacuggcaaacugaauccagcagcacaucaaaaagcuuauccaccaugaucaagugggcuucaucccugggaugcaaggcugguucaauauaagcaaaucaauaaauguaauccagcauauaaacagaaccaaagacaaaaaccacaugauuaucucaauagaugcagaaaaggccuuugacaaaauucaacagcccuucaugcuaaaaacucucaacaaauuagguauugaugggacauaucucaaaauaauaagagcuaucuaugacaaacccacagccaauaucauacugaaugggcaaaaacuggaagcauucccuucgaaaacuggcacaagacagggaugcccucucucaccacucacuccuauucaacauaguguuggaaguucuggccagggcaauuaggcaggagaaggaaauaaaggguauucaauuaggaaaagaggaagucaaauugucccuguuugcagaugacaugauuguauaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucacauucacaauugcuucaaagagaauaaaauaccuaggaauccaacuuacaagggaugugaaggaccucuucaaggagaacuacaauccauugcucaaggaaauaaaagaggauacaaacaaauggaagaacauuccaugcucauggguaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaaaagagcccacaacgccaagucaauccuaagccaaaagaacaaagccggagacaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaagaacaagcaauggggaaaggauucccuauuuaguaaauggugcugggaaaacuggcuagccauauguagaaagcugaaacuggaucccuuccuuacaccugauacaaaaaucaauucaagauggauuaaagacuuaaauauuagaccuaaaaccauaaaaacccuagaagaaaaccuaggcauuaccauucaggacauaggcaugggcaagaacuucaugucuaaaacaccaaaagcaaugccaacaagagccaaaauugacaaaugggaucuaauuaaacuaaagagcuucugcacagcaaaagaaacuaccaucagagugaacaggcaaccuacaaaaugggagaaaauuuuugcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacauaugaaaaaaugcucaucaucacuggccaucagagaaauacaaaucaaaaccacagugagauaccaucucacaccaguuagaauggcaaucauuaaaaagucaggaaacaacaggugcuggagaggauguggacaaauaggaaaacuuuuacacuguugcugggacuguaaacuaguucaaccauuguggaagucaguguggccauuccucagggaucuagaacuagaaauaccauuugacccagccaucccauuaauggguauauacccaaaggauuauaaaucaugcugcuauaaagacacaugcacacguauguuuauugcggcauuauucaugauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucucaagaacaaaaaaccaaacaccgcacauucucacucauaggugggaacugaacaaugagaacacauggacauaggaaggggaacaucacacucuggggacuguugugggguggggggacgggggagggauagcauugggagauauaccuaaugcuagaugacgaguuagugggugcagugcaccagcauggcacguguauacguauguaacuaaccugcacauugugcacauguacccuaaaacuuaaaguauaauaauaaaaaaaaauuggaaaagaaaacauuuuucuuuauuugaagacauaacauguaaauaaacaaucuaaaagacucuauaagcaauuuagaauuaauacauuagcaagaucacugguuuacauggucaauauauuaaaaaaaucguguauuuacauauaccacuauauacaauuauuuauuaagagaaaaaauaaaucaacaauacuaguuuuaauauuuuucauacaauagacuacuacucauaaauaaaaaggaauuugcaaaaaguagaugaaucucauaaauguugugcaacagaagucagacauuagaguacaugcuauauaauucuauuggcauuaaguucaagaacaggcuaaauuaaucuauugugacaaagucagaauaaguuaccuuugggagaaguacugacuagaagggacaaagguuuugugugugcuagaaauaaucuauaccuugauuggguugugauuaucuggguauauauuuuguauaaauuuaucaagcuguacauuuaugauuuguagacuuuauuauauguguuauaccucaaaguguaaaaguuuauugguaaauguuacacaguuuaagagguauaaaaauuauauuuauauauacauuaugggccaugcaaugaugaaccaacucaauaagaaauuuaguauccauuuauuugacucucuuguucuaugcuuuuaaaauuauggacaaauuuuaugcuuaaaguguuugauuguaguuucauaucuaacaaaaaagcuguaguuaagggcugccaaccauaauaccuaaguaaccuacugcuguauuuuuuaccagaguuuucuguaaaacaucuucagacuuaaaccugaaugcauucaaugaaaaugaaaaauaggagagaaaacuacuucccccaaauugaaagauuaugggaaccagccuuaucaucuugcuguuucccucacuaagaaauuauguaaauaucugucacauauucacuuuauuuguaugagauucuugcucauaacuuaugaaaaauuacacuugacaauguugaaguuccacagagaaguccaagcggauuuccuucucaagacaaauauagcauauuacccaggaacugcaccucagggacuguucacucccaggaauaucuuuucuucaucccuggaauaaauuccaagcaggauaucuuucucuuucuauucuuccgaucgguuuuuguuuauuucuuauucuucgccaaauuugguucuggcucugcaacaguugucgccaguuacuauccacugguggcaacaauggcuggaaguccauuuuauggucagaccauuugauaucuacucucuauuagcaacagagaauuugguuuguuagucaauuuuugucugucuguguacaaauaugccucaauuccacuggagagaacagcucuuugagauauguccgaagugcucaguuugguguucucuauucauuuuacccacggcugaugauauaaaucugagacuaccagcguucugugugccuggaacugauaaaagucauuaucugcuuaucauagggugcaauaaauuuuccuacuuuucaaaggauauuaauaaauuaaauuguaaagccucuuaaaauacaggaacucuguucugguuagccuauguggacuaauaaucacuuacauaaaucuaauauucccagaauuccuaaaaaauaaagaaacuaacccucuaacaccgaugaggacaguuacauugguggugacuauggaacagagguuugcugaagccaguuggaauucaguuuuggucacuucccacucaaaaugucuuauauacuauaauucuucauauguauuacaauugaaccauacacaaaucaaaaaggcauauaaagaaaaauuauucccaucccugucuccaaucugcccaauuccaacccauuaaauucucuaccugccaagguaaucaauuuccaauagagucuucuaaacuuuauuacuauagcugcauauauucacacauaaauuauucauauguaugaaaaaauacagccacacagaguauaaaagcaauguguaaauaugcugcuucuuaguagguuuacacauuguuguauaccuuguuuuccucuaacuuuuccuggagacuuuccauaucaauacauagaacuucuuugcuguuuuuacaacuauauaauguuccccuguguagcuauuccuuaauuuauuuaacuaauccccuacugaugaguacuugaauaaauucuuuccaaucuacugcuauuacaaacaaugcuacaauaaguuugugcauuuauaugucauucuauauauguacaaauauaucugaaaaacaaauuuucuacaguaaaaaaaauauuuuuauauauuagcccauuuuucuauuggguuguuggacuuuuucuuaaccauuuuuaguucuuuguauaucaaggagauuaauccuucaucuguaauaugaguuucagguauuuuucccaggucgucauauguccuugcuuacuuuguuuuuuguaaugcagauguuuuauauauuguaauguagauauuuuauguaauguagauguuuuuuguuuuauguagccucauuucucaacccuuuccuucauggcuuuuucuuuuacugcuuuaaaucauaguucaaaaugccuuccuauuauaaaaaaaaauuguguuaauucucuauguuuucuauuaccuuuuuuuuuuuucuggagacagggucucgcucuauuuccagggcuggagggcggugguguaaucguagcuuacuauagccucaaacuccugggcucaagagauccucccacuucagucuccugaguaccugggacuacaggcagguaccaccaugccaggcuaaguuuuuuauuuuucuuuuguagugacggggucuugcuauguugacuaggcugguuucaaacuccuggccucaagggauccugccacuuuagccucccaaaaugcugggauuacagacaugagucacugcacccggccuuaaaaaauuuuuuauguuuucauuuaguacauuuaaaucuuugaucauuuguaauucauccuugguaugagguaggauuccuauuuucuuuacuuccacaggugaauauucaguuucuccaaaacuauuuacugaauaguacauaucaucuccauuagcuuuugagaagccaucuuuaccauaccuaaauauuccuaugaacguggguauauuuucuaggauuuccauucuaccccauaauacuucucuucaugucccacaaccaauggguuuuaauuacugagacuaagacuucacaauacaacaucuaguugcaaaaguccucuauauccacuacccuuguucuuuuucuuuuuccuacaaaguuucuugguuaaauuauuuagccaagaucaauuuauuuaguuuuuuaaaaaggauucuuaucaucacauuaaauuuauaaauuaccuuaaacuaacaucuuuauggugcuguguauuuccaguuaugaagaagacauauucuucaauuguuccaaacuucuuuuauguucuucaaugauguuuuacauuuuuaucauguagguuuuagaguuuguuguuaaguuuauuucugguaucucaucuuuguugcuccugaaaguggcacuuuuucuuccauuguaucuucuaacuaguuauuguuugauauacuauuuuaagcccuguuuugcagauaggaaaaguggaaugcuugaccauaucuucaucauuccugaugugguaaacuauuuuuuucuggaagaccccaccugccagcugaagaagacacugaagcagccauucacacuccuaagacccaccaaauugcaugaaaggcaccacgauucugccucagugaauguucccugcagaaaaguuuccucucaaaaccuaugaaaaaaacuucccaguggacuuccaauccuagacugcauauaugugaggaagcaaaucucuccuucuccaagugucucaaaaaucauuaaguuaaauaggaaaaaauaaauccuuaacagaaugguaugaauggcaccagaaggccagagaucagacuuugauacacuucugaaagacuaaaagacugaaaaacuuaaaagcaagugguaucauacugaccuaaagagaaaaacagaaguucaaaggcuauaccccaccccuuuccacaacaagagagaugcuugcccccaggguacuaacaaaaacuggaaaauuacccuguaaaguaauuuaacaacugaccagaaggacuagggcuccuaaugugggugugugcaccuaagacaagcaaggcagagccauaugcaucaugggggcuacugaagaaaacacagcaggggaaagggcaaagaagcgcagauacuuugcuuagcagcuaaaagauagguucugaacagucagaauaaaacagaacauguacacugaaugaauaaagcuccaaagcucaaaaagaaagaaaauaaccuaaauuuauuauaaaaauaccuuguguguauguaucuauacgugaagaacccuuaaaaauaauuuaucuacucaaauugaauuugaacaauuaaaaaagaagaugaaauuagcuaagagaacaaguacaaaaaaacuucaauucacaaaguaaaauguaaaaagaaauauaucauaaaauaaaagauuaaggggacuuaauagaggcaaaggcaauaauaggaaacaaaaaaauuucuucccuaacacaaagguuugacucuguagacugaaagucacuaaguuccaaaauaaagaacucacuaagcuccaaacuaaagaacggguaacaaaauauacauaacaauaaaaaagaaacucuuaacaaguagucuggcaaaaagaacauguuaccuacaaaggaaaagaaaaaaacagauuggcauuugagcuuauacaagaaaucagagaauaucacccagagaacuuaacugaacaaaaauacuuaagaacguaucaggcaaauacaaaugauccaaaacugauacauuaagauagaaugugauacagagaagaagcaacauaaacacuaaacaaugacacacuguuggugggacuguaaacuaguucaaccacuguggaaguagguguggcaauuccucagggaucuagaacuagaaauaccauuugacccagccaucccauuacuggguagauacccaaaggauuauaaaucaugcugcuauaaagacacaugcacacguauguuuauuguggcauuauucacaauagcaaagacuuggaaccaacccaaauguccaacaaugauauacuggauuaagaaaauguggcacauauacaccacggaauacuaugcagccauaaaaaaugaugaggucauguccuuuguagggacauggaugaagcuggaaacuaucauucucagcaaacuaucacaaggacaaaaaaccaaacaccacauguucuuacucauaggugggaauugaacaaugagaacacuuggacacaggaaggggaacaucacacaccagggacuguuguggggugaggggagaggagagggauagcauuaggagauauaccuaauguaaaugacgaguuacuggguguagcacaccaacauggcacauguauacauauguaacaaaccugcacguugugcacauguacccuaaaacuuaaaguauaauaauaauaaaaaaaugacacaaauaauuaaaucugaaugaaaagcaaaaaacauuaaacugacggaggcagaaugggugaauaaaagaguuucaaaagucucaucuagaaguaugagacugagagaaggaggaaguuaaaguuuccuaaagaucuuauuuuauaaggaagagaaguagaggagaagagagaaccaugauuuaaaacacaaacauacauacacagaaagagagagagaaaaccugggugaaagaaaucauuuuauuuucaaauagagaaaauacauguaugauuaugagaacauggaaauggaaacuaaucauuaauguaaagaaaaguauagcgcaacuuccaaaauuaaguaucugggaagguuuugccugcucugaauaucaucuugcuaagcuagucacuugacauauuuaauuuaaaaaaaaagaaaauuaacuaauuuauaaauagagcuuuaaauguuucagggauuucaauuuauuuuugaaaguccuauugacuauuuaagagaguucagugccaaagugaaaugcaagaguuagaaaaauuagguuuggguuuaaacuuuuuaacuucaauuaaacaaccuaauaaccaggaacuuuuauacaggucuauaucguuuguguacucuagggccuuucuugaacaucaaaauacucauacagauagauacaagaaaggcccaccuuggacuccaucccaaagggcuuaauuacuaaaauaccaagaaagucuuguacuggcaugccucacgguuaagacagauucauuucacagauuaugaagacagccuaauggcuagacuccauuacugccuaaaauguucugagauuaagggauguucauaucagacuuugcugauuacuauuaaauucacugaugagaguauguugggugaauguuauacuuacuguuaaaagaauauuuuagaagcuucuacacagcaaagaaaacaaucaacaaagugaagagacaacccacagcaagggagaaaauauuugcaaaaagggauuaauuaccagaauauauaaggagcccaaacaacucuauaggaaaaaauguaauaauccgauuuaaaaaugggcaaaagauuugaacaggcauuucucaaaagacggcaacaaauggcaaacaagcguaggaaaaagugcucaacaucacugaucaucagagaaaugcaaaucaaaacuacagugagagaucaucucaccccaguuaaaauggcuuauauccaaaagaaaggcaauaacaaaugccggcaacaauguggagaaaugggaacccucacacauuguuggcaggaauguaaauuaggcaacuacuaugaagaaaaguuuggaaguuccucaaaaaaacuaaaaauagagcuaccauaugaucuagccaucccacuguuggacauauacccaaaugaaaggaaaucagucuacugaagagguaucugcacucccauauuuguugcagcacuguucacaauagccaagaucugaaagcaaccuaaguguccaucaauggaugaauggauaaagaaaaugugguacuuauacccaauggaauacuauucagucauaaaaaauaaugagauuuagucauuugcaacaacaugguuggagcuagaggucauuauguuaagugaaauaagccaggcacggaaagacaaacaucacauguucucacuuauuugugugaucuaaaaaucaaaacaauuaaacucauggacacagagaguagaaggaugguuaccagaggcugggaaggguggugggggcauagugggaggcugguggggauaguuaauggguccaaaaaguaguuagaauaaaugaauaaggccuaguauuugauagcacaauagggugacuauagucaauaauaauuuaauuguacacugaaaaauaauuaaaagaguauaauuggauuguuuauaaaacaaaggguaaaugcuugaggggauggauaucccaucaugaggggaugguuaccccaucuuccaugauaugauuauuacacauugugugccuauaucaaaacaucucauguaccccauaaaaauauauacccacuaugaacccccuaaaauuaaaaauaauuuuuuaaaauaauauuuuaggggcuaaacuaaaucccagauguuucuucaagguuacaaaacaauauaaguuguagcuuuuugggcaaaauauacaucuuuuuugacaucauaaguaauagguuauuaaagauguggugccuuugaaaagccacacaguauaaaaugggccugggugugauaugguauuuauggacauacaguuaauuggguuuuuuuguuuugguuuuuuugugugguuuuuuuguuuguugagguuuguuuguuuuugagauggagucucauuuugucacccaggcuggaaugcagugccguaaucucagcucacugcaaucucuaccucccagguucaagcaauucuccugccucagccucccaaauagcugggauuacaggaacccgccaccacacccagcuaauuuuuguauuuuuaguagagacaggguuucaccauguuggccaggcugaucucaaacuccugaccucaggugaucugccugccucagccucccaaagugcugggauuacaggugugagccaccaugcccagccucaguuaauuguuaauacuaccucucuguacuuccaggaucauuaaaacuggcugggaagccugaaaucaagaauuucugcagaagauaaaagaacaggcagaguaauaaaaacagaaaaucuugaaauuguuuuaugggcuuccaggggaaaugagccauuaaaagaaaucaucuagaucugaucugaucgccugggccugggaguucaaagcuguuuugagccuagaagauguacaauaccacagucaagacccuuacuaccuacuuagacugccacaauagcuucuaacuuguggcauccuuccaaauaagauaacugguccacgguccagggguugggaaccccugagguagaggaugaauaaugcaaccaaccaacgagucaagugcaugaaguaucauuaguucuauaaugcuauaaaucaauaaaggcauugucccccccaauuaaaauauguucaccaaaucauccaguuuaacuaaagucagaacuuucucgucacuuaaaaugaauugccuuaauaauggagauauacgugaagaucagcgaucugggcaucuacagaucgugaucaaaaauaugguucaauuaagcacuauaucaucucuguagcugcuucaaauuauaugucauauuugccaggcugucuaucagcccauaacgugguauuagggaagucuaaacaaaaucauaugauaaacauuucuaccuucaaaugccaaagaacuagaaccuuucaugauuccuagguguccuagaggucacauuuuuuaaaagucacauuauuguguucauuacuucauuuuuaugauggucacauaaucuauaugucauugaugcucauaaccuccucaaaaaaaaggaauuucaaaacuugagauaucagcuguagccucuuauaaguuaucacuuagcagaaaauagcauuuagcagaagauagccccaaaaaucuuucauuaaagucuucacuuucaaagucaguuacaucuggguucaaauuuuugugcuaccacuugcaaaauuuugcuccaccaugacaaaugugggcugugugacucucugagccauaaauuccucaccgaggaaauaggaaaaaugauaccugcuuuauaggagugauaagcaguuaacugauacacuguauaaagcauauauauggccuaguacauuacauauaacaauuucuaaguaaaguuuuucuuucuugauagaauuaaaacauuuauguuuuuccuuuucugccuuauauuccuccuucuuauccagggauggauuuuucuaaucaucucuaggaacuauuuuauucuaaggacuaaauauucuagucuaauaacuauuuuaccacagugacaagguagguaauaauaccgacuacaaauaagaaaucagaaaaugaaagaucugugagucaauggcagacaaauuuaaacuaccaccaugaaggagaccggcaacuucccauagugaaagaguguuaauaaaaaggauccuuuccuccaacugaguccaaaaauaaaugcuauuucaaaagcuacuggacaaacauuaacuugucucugagacuacuuccuccuaaagcagauggcaccuggaagcaccagaagccuacauucuaggugugguaugacuuuacucucuuagccauggugccuuaaguuacacaagagcaggcuuuuaagagugcauuuaaaauguaguuuacaagcuauucagggaaaaagaaaagugcacaaucuuuugcccucaucucagcuauguguguguaugugaauggaaauguaaccaauacgacagcuugaugucacauguauuugcagagauuuuuauaaaaacacaguaagacauuuuuaaaauuauuacauugauuuuacaaaaacaacugucauaccacacugagucuacuauuugguccucccaagguuacagcugcaacuccuauccgacccuuccccuuccacacccaugccuccauuuuccuguagggcaucucggcaggaacaccaccacgagguugugaaaccacucugcugccacauuuccucaugccucacugcugaaugcgugagagacacuacaugaaauugggccuugcccagaccucuuuguuacauuuguaaauaaaaucagaucaaaucacaaagauauaauugauuuaggagagccauggugcuauucagauaggaaauauaaacagaagagaaaugcccuaugguaucauaguuuccuuaaacaacacaucacuagcucaguuucucagagugaaaaugcugucacauacucccaaggaaaagaagagcucauccuuacacaaauuugcuuuuaacugucaaaagaaaaucccagagagacgcccacugccuuacaaguaaaucuaggauuacaguaccaaaucuguuauaaaaacaacaaugaaauaaguuccaaguuguuucuuccuuugacaaauacccaaauaacuuccauaauuugaauaccaggucaaaaaguuuuauuacaagcaaaacaaauacuucaguccuacucauuguuagcaagacacaaaccauauuaaaaagcagaacaugugacuaacaauuagcauaccuuggaagggaagggacuuacucaaauuugaaaggcuagauaaaauuaugggaaaaugagacaaaaguucagacaaaaaauaaucauaugcuaauaauucauuuuuauacucugaaaauuauucuuuuaaaauuuuaaauauacuucucauuuauuugaaccccagaguaaaaaauuuagugaggguuaucaagaguucccaauauucaaucccuuccaucauuuaaccuagacuuuaaaaaauaaaauuuguggauaaagaaauccuuugacucgagaaaaggagaaacucuuuuucagcauuaaacacaaagacaguaucugaugaaaacaguauauucaccuauccaaguucucauagguaaacuuauaaaagauguuuaauugcacaugugaguggcagugauaauaugcagcaacaaacuucaaacuucaucaagagauuuuugugauacucaaagguauuacaucgcuaacucugaaagaaaaagaaaagccagaauaaagcccccuaaaauuugcaacaguacaacagaaugaaugaaacauugguucuguuuucacaaacugguuaagacaucuuucuucaccacagacacuaaacugagagcugcuucaucaggaggcauccucuaaaaacuucaauuaugaaguuacuaauacuaccagagauucaaaaaccaagagagauuugggggaaagggggcaugagauacaagaucagagacaaggguaaagaucaaagccacaaaauaaccaaucuguacuuaaucggaauuuuucauacccaugcauaaggcaaacaaagcaggcaggcaggcaggcacgcacacacacacacacacacacacacacaccacauuccaagaaaaagaggaagaaaaaucuauuagauacaaauucagaucaaaucuauuugauacaaaucagauacaggaagggguaguaguucauuaugagugucuacuugaaauuccugaaaggcuacuacaaaaccugucuaacaccuucuccuccuggcguucuaacaaguccuuuaaaaugcauuuuacaaguucagggcaaguuguggaaugaggagugcuauauacaacucaaaaccugcucccuugagcuccaaaccuucccccagaaaacagaaagucuuauuggaaaaaagaccgaaaugcagagaagaaaaaggggugcggguggggguagggaguggacaggacaaaggaacugugaauuccauaaucaccugaacuucucuucccuuucuuccucuucacagucagucaccuggauuauaacuucagacuccaaccagaagacacugucauccccuaaagugcuacucucacuuucagucuccau

SEQ ID NO: 192953 - RNA, 28542 nt, Homo sapiens
gaacagagacauaguagcccagaaaggcacucuucuagcacucuucuggucccacauuuauucauucaauaaaaauuuauugagccacgcuguuuccaaggaauuguacuaggugcugcaaugcaaaggguuaugacaaaacugucuguaaauguaggaucugaauuggucuuugauaguuuuccugauuugagaaagaagucucuauuuggcuaauuuagggagcuaagagaauggacaaggucugcuuauguccuucuggcagccuagcauagcuuuugccucccucaaaucaguuauaagucaaaacaaauaaggcacauuuuuuaaaaaaauuccccccuuuaauugaccaaaguaaagccaugacauuucauuugguaaccuguuuagaauuauaaaaaucauuucauuuggcccagcccauacugcccaagacaaaacuuccagacaauucugaugccauccaguuuuguucuuacaaacugcauauuaaaaaaaaaaaaaaaaaaaaaucuucaacguccuaaaugugaugugcucagugcgaagcauaucagagcuggacgugacauuuauguccuugacaagccucgauuauccagguccuuuaccugcaacauaaagaugucaguuuaauauuuacaaucagaucaacuuuggagaaauuuucuacuaaaauggauucacccagagugggcaggauuauguuggguucugcagccugguuuagggcugugaauacacaagcacugacuagagacuagauucucucugcuuagccuuuuggaauaccucugugaggaccaauauuacugaucuacccuccacauagaucaaggguucucaaucuuuucuuauaugagagauauacuccuaugugguucuauaugacucuauauaccuuaaguucuucagagagagaagaaaauguagcuaaauauaaacaugugaacuuuuucucuauuuccugcacucuccccacccgugagccugauaaucacagaaacugguuuagucaagccccagcuggaaaaguaucacugcaacaaccgccaaaaugauggcagacugggaucaucuacucucuaagaacaaucuaaaauaaguaaaauuuucagugaguuugcaagcuacuuuucaagcacaggugucaugagaaauuucccuauuugagaaauauaugucccauuuuauaagcauugaaaccaaucuccaaaaauaaaaguugcuuucugagacguauagcaucugcuuaccuuguauauccugaccagccaauguucugugguauaugcuuccuccaggacaucaagcucaaagucuuuauucccaaucucagcauuucggacacggucaaagccuggaggacgcucuagagagggaugaaaaagaacacacuucuuucuacagugcuaauuuccuagagagacaguauauggauucaggaaaccaucuacuaauugaugauuauuccucagccugcaauuuguugagaguagagccugcaaaaaagggcaugagguaguaagggcaaaucaaguguuacccuagcuuaaguucuaugcaagaugaugcuugccagucaaugucuuaucucugauaagacagacauagggagccgacuuccaaggcccucuauuccugaggauugucauuuagagccucuaauacacuagcaacccuugcauggaucagagaaaaaagccuaccagaagucaaagaccugcauucaugucagaaauucucccuaguacagaaucaagaaauugaagucagaaggagagacuuaaccuaaucaaauaacucucaauguagucaucagaagauacgaaaagucacuuucuuucccuuuuguuccugucuucacuguaauacccuuaaggacaauaaaaaguaacggucaaaagcacagaauuuggagccacucuuugucaguuugaauccugacucugccauuaguuaugugacacuaggcaguuaaauaaccuauuuguaccucaauuuccucauauauaaaauaacaggcugggugcgguggcucaugccuguaaucccagcacuuugggaggccgagguggguggauuacuugaggucaggaguucgagaccagccuggccaacauagugaaacaaugucucuacuaaaaauacaaaaaaaaaaaaaaauuagcuggggaugguagagcacaccuguaauucuagcuacucgggaggcugaggcaggagaaucgcuugaaccggggagguggagguugcagugagccaagaucgugccacugcacuccagccuggguaacagaacaagacuucaucucaaaaaacaaaacaaaacaaaacaaaaauaacaauagcuaggugcaguagcucaggucuguaaucccaguacuucaggaggccaugacaagaagauugcuugagcucaggaguuccagaccagcccagacaacauagugagaccucaucucuacaaaaaguuuuaaaaacagccaggcauuguggugugcaccuuagucccagcuacucaagaggcugaagcaggaggacuccuucagcccaggaaaucaaggcugcagugagccaugauuguaccacugcacuccagccugggugucagagcaaaaacccugucucaaaaaaauaugcaaacaacaaaaauaaagguaauaugacaauaauaucaguauaugccuuugggguugcugugaggauuaaaugaguuaacagacacaaagcacuuacuagugcuuggcauauggaaaauacuguguauuaguaaucacuauuauuacuacuguuauuaauauuauuaugagucacucacuggcuucuguguaaaccuguccaaagcgauaguaacacaucuuguacaugaggcaguugagcagcacuggagaaccuucacgguccacacggaacuccccaguuggaguauaauagucauucuccuugauauguuugccuguaucugugcucccuccaauccggaccauccaaagaaacuuguugauaucuaggagaaaaaaaaaaaaagaacugcugcaucacaaaaguugcuggaguuaaagcagguuaguauuucuaagaaaauuccucaacauuuuuuuaauggggauugguaucauuuaacucuaauuuguaaaaauagugaggacaacauacgggcaaagcauuuuucgucaaaauauacaacuuuucugagaaauuauuauacuccugaaauccuacgcuacuaguccagacuuaagccacaacugagauugguccuauagauuagcuagggcuaggcuaucaaauauagcagcaauuagcuacauauagcugcugagcagcugaaauguggcuaguccaaauuaagauguacuguaaguauaaaauacacacuagguaaguaugaaauacacauuagauuuugaaaaguuaguaaaaaaaacaaaccccaaaaggggguauacugguuacauguuaaauuaaauaauaauguuuugauaugacuauucaguuaaaauuauuaaaauuacuuucaccuguuucuuuauacuuaguuugaugugacuaauauaaagcuuaaaaugauaaugugguucccauuauuucuauuagacagugggcacgacugaucuaaagaguaguagcuuuaccaaaaagguagacaagacaugagucuucucauucuugaccaacagcugcaaaauuauagaccuccaaagcagguauaugagaagucaacauuucugugucaaacacacucccaugcuuaauaaauauugacacuaucaucaacucaugauaucucuuuuaggguucaucauuuacuguauugcuugcacaggcuuuagggaaaucaguugcuacauguuucacuggaugguuaguauuaaaaauauuucuaaugcauaaaaaaagauaagauuccuauugcacuacugcaaagaguucgaggggauaucacggugguuaagaacagacucuggauccaaacugccuaaguuugaauuccagcacugccaauucuagcugggugaccuugggcaaguuauuuaaccucucugugcuucaguuuucucaucugucaaauuagaaaaauaagaguaucuacaacaauagggcuguuauuaugaguaacaacauguaaagcauuuaguaaguuguuugucacaugguaaacauccaaugaauaauauuacuaucuucguucagugucugcauucuuaucuucauauuacaaauggagaaacugaggcacagagacuugccuagaucauagcgccagaaacaggaacaaaaauaaacccccagaacaucagcucggcuaugauagaacaauaguauuguagcugccuggcagguaugucugaagcaaaaaccucauaagcucuaugaauggaagagugaaaauaauaggaauggcugggugugauggcucacaccuauaauccuagcauuuugggaggcugagaugggcggaucacuugagcacaggaguucaagaacagccugggcaauguggcgaaacccaaucucuacaaaaaguauaaaaauuggccgggcaugguggugugugccuguagucccagcuacucaggaggcugaggugggaagaucacuugagcaugggaagcagaggcugcagugagcagacaucgugccacugaacuccagccugggugacaaagugaaacucugucucaaaaacaauaaugaugaugaugauaggaacugcaucaaggagagcccauuguucaaaagauaugguugucuacaaaaaaagaagcugggccaggcccaacuuuuuuuauuuuuauuaugccucucaaauguuacagaacuccuauuaguaaagcccaaugaauaauuugaccuugaaaaauaaauucaguguaacaaauuaaccaaaacaguuggccuuccauaucuguggguuugacauccauaaauucaacaaaccucuaaucaaaaauauucacaaaacaaaaaaacagaugacugcaucuguaaugaagauggauagacuuuuuucuugucauuguuaccuaaacaauacaguauuaacaaccauuuaccuaguauuagggauuaguauuaucaucuagagaugauuuaaaguauauaagagaauguguguauauuauauacaaauacuaaaccauuuuauauaagggaccugagcauccacaaauucugguauccuggugaggggugaggauagggguggggguguccuggaaacaauccuccauggauacagagggacaacuacacuaucuucuuuuaugaucuucacauacauguuuucauggaucuagacaguaacaguguuuugcauuuuucuuuuuucuuuuuuuuugagauggagucucgcucugucacccaggcuggggugcaguggcgcaaucucaacucacugcaaccucugcugccuggguucaagugauuaucuggccucagccucccaaguagcugagauuacaaguaugugccaccacauguggcuaauuuuuguauuuuuuuaguagagacgggguuucaucauguugggcaggcuggucucaaacuccugaccucaagagucuucccaaagugcucagauuacaggcaugagccaucgcacccggccucugcauuguuuuuuaaugguuaucguauuaucuucuuuaaaaaauaaaaagucuaacuuauauauccccucccaccagaauaucaaaauucacaaaugcucaagucccuuauauaaaaugguauaguauuuguauauaaccuaugcacaucugucuauauacuuuaaaucaugucuagauuaccuauaauacuuaauacaguguagaugcuauguaaauaguuguuauacuguauuuuuuauuuguaugauuuuuauuguuguauuaugauuuuuuuucacaaauauuuuccauuugugguugguugaacccacagaugcagaacccacggauauggaggggaaacuguauacacaguauuuagaaauaugcauguaaguacuagaagaaauagcugcaggaaucauugcuucuggggacugauguuaagggggcuuagauuuuugggcagugaacuaucacuuuuuauuauaaaccuucagaacuguuuaacuuuuuuuuuugaaacaguuucacucugcugcccagacuggaguccaauggcgcaaugucagcccacugcaaccucucccucccgaguucaagcgauucuccugccucagccuccugaguagcuaagacuacaggcaugugccacuacgccuggcuaauuuuuguagagacaagguuucacuauguugcccaggcuggucaugaacuccugaccucaagugauccgcccgccuuggccucccaaagugcugggauuacaggugugagccaccacacccggcugugaacugcuuaacuuuuuaaaguguaaacaggcauuacauuaacuuuuaaggcagauaacuauauuuggauguuucuucuaaaaaucuuugugccaauaaucauagggcacaugguaaccuccauuuuacacacacuuuuauuuauauauauuuuauauauauauaaaauguucucuuuuuuuacacgcugucaggccauauaaaacauuucuaagcuggucaaugauuauauggcuuaaaaccacuaaaaaaaugcuaauucuuaaguucauugucaugagccuuauauucagcuugguuuuauuacugguuguggaacuacuucuaugccuuagacaaucauauagcaugcuguaccuacacaagaauuguuuacauuuauguccucuuguuacaaaaagaaaaaaaucaaaauacccaaaccucaaguugcaaauacuuaggaacuucccaugaaagaaaaauaucuuaguaaaauauuaguaaaaguacagaaaacuaggauauucaucuaguuuucuuagaaucuauguccugcagcuagaaacagaaucaaguauauuaccaucagaggaauacccagugaggccuccaaaaaugaccagcacauagcugacaucgagcucccucaugaucucauaggcuuuuuccucuguggacgccauugccuggaaaaacaaauguacaauucucagagcaaaaucccaagucauaugauccccucaugcagacacauuucccauuagaccuuguacaccaaacacucaaagaucaucccuuuaucuuaccugcccuacucgagaaauauggguauuauuccauguguuauuguccacuaaaauuguucgguuugccauagcuguaaucugauagccauaaucccaccaggacaugaccuucgcauccugaaaguagaaugggaaauggaaauaacaagcuucucacugucucuaaaaaucaaaugcaacagagaaggcaucuuuggucugacagaagugacaccuggcuaacuaaucaauuucuucacaaaguaaugcaugucaaaccagaaaauaaauccuggcaccuggucuuccauuuauauacaauuauaaaaucucagcacaaauaacaaaccaacauucccaacacuucaucccaggucacuuuauacuaacauaauggggugggaggugugggagacugugcaauguagccacaucaauagccuagugucauuagacaauuuucuuaaauaaccuuuuaacagaauugcaaaaaucacuuacuauaaagaugggguggaaacucaaaucacaugauacgauggacaagaauuaagagacucuuaaaaguuuuuauuccuaacaaauugucucagaaaugauauuccuaauaguuauuguaaaggaaaucacuucagauucucaaaagauauaaauuaaaauguuaaaagcaguuaucauaaggugaucacuuuacacaagauuuauaucuuucuucuugauucaauuuucugauuuuucuaaagugaacauguauuauuuaucuauaacuuuuuucuucuuuuauaacugggauguucuaccucauguuaaaaucaucauaucaauaaaagugugcaugcaaagucuagauaauuacuaguaagaguaacuacaaaagaucccagaauugaauggagguucaccuuuaaggcucauucaagacuagaguugcaaaguuccaguuucacccagcuuuccacccaucuaaaagcuguaugauucacuguaacaucaaaugucuuccccuuugccccuaacccacaauucccaccccucccaaaucuucaccucuggaguauuaugacgaagccaauaauaugcuucucggaagucaucaaauaugauccuacugccauccccaccacgggcagauaguacaauggacggagaagaguaggccucacuggucacccagguugaaugaaagguguaggugaugagaaagaaagccaugaccaguaucaucccacuugccaccuaaacaaggaaaaagaauuaauuguguaguuaaccaaacuaaauucacacaacacaggacaacuucuuagacacauucauauagaugagauugaucaaaauaagucagaggcuauaugaguuaauucugaccaccuaggacagugcucuacuuuacuccucccaccccccgcugcccacauacacacauacacacacacacacagaguuucccaagucuacucuuaacauugcuucucacuucauucuuaauaggguagguggaauccuguugcuucuugcucuucuugucuggacgacuuauguccagauucuucauguauguggacagcaccugggagacuccaaugccagagagaaugcacauaacaggugccaacacuagcauuagacgcaccuaacagagacaggaagcaugaucagucuaaucaguguuccacaauuuacagauuucagccuauuaguagaucaagacaucaauuuagggguuuucaucaaacaugaccuccacaaaaagugaaagagaaaauacuugaaacaguugcaguauuaguauguauuucuuaaacuuuguuucaauuauaugcauguacauaugcaugugugucuugaauaaugauauaaaguauauuucauaacugugguuugagaccaaaaaaauaugagaaacacuauuuuacuacaauauauaaaaucucuccucucuuuuuucuugucauuguucccuaaacaauacaguauuaacaaccauuuaccuaguauuaguuauuaguauuacaaucuagagaugauuuaaaguauauaagagaauguguguauucucaguggcucacgccuguaaucccagcacuuugggaggccaaggcggguggaucaccugaggucgggaguucaagaucagccugacgaacauggaaaaccccaucucuacuaaaaauacaaaauuagcuggguaugguggugcaugccaguaaucccagcuauuugggaggcugaggcaggagaaucgcuugaacccagcaggcggcaguuguggugagccgggaccacgccacugcucuccagccugggcaacaagagugaaacucugucucaaaaaaaaaaaaaaaaaaaaaaaaaaaaaaauucaaaucccuccucuaacaaucuagcacuggguaauacucccaagccuucaagaaaaaaauaucaucucccguuuuaagacacccagggucauauuauccaacaaagugcaaaaaugcuucuauaauacaaaguuacgaauccaagaaaguuggaccccacaaccagaauguaugagugucccauacguuccuggaaaggaucaacaacuuacaacucauucccucaaaugcucagagggaagcaugugcacaaucaucaguacuuucugaauucugccagacagauaaaaaagcaccucagaguuagagugaaaaagucuaccagacugagggcauccucaccauuacagcugaaaaguacaugcuggucacaccauacaugaugauaaaaauccgggcaucagacagguugcuaaagcaguaauagaggccaacuacaaaagagggaaggagaaauaagcagcugaguccuguagguugaaaccuacaagguaaaguaucuucauuauaugacuggaugauuccacacauuuaacccagcaauuccacuuccaggaauuuauccuaaaaaaacaaucauagaaacaugcaaagauguuuacuacagcacacuuuaaaguagcaaaaaaaucagaaacaacccaaauguccaaaaacaaggagcuaauuauacuauauuuauaaaauggaauauauuaaaauauugcugcaugagauuauguacuacuugccuucuuacacaucuugacacaucucuguacuuuaaaaaacuaauaaaugauacauuuuaaguauuucuauaaaauaauacuaaguaacagagaaauuugauucuuuaugaagugaaaaaaaucagggaaaaaacuaugaucucauucuuauuugauaaauauacaucaaaauguuaacaguggcuagagauggguagugagaacuccugaauauguaccuuuuuugagaugggggucuugcuguauaaccgaggcuggucucaaacucccgggcucaaguaauccuuccaccucagccuuccaaguagcugggacuaaaggugcacacuaccaugcccagcuaauuuuauuuauuuuauauguguguauguguguguguguggguauggguguguguggguaugggugugugcgcgcauuauuauuauuauuuuuuuuuaaguagagacaggggucucacuauauugcccagccuggucuugaacuccucgccucaagcaauccucccaccucauccuuccaaagugcuggcauuacugaugugaacuacaauuccaggccuguuguuguuuuuuuuaagacgugggucccacuguguugcccagguugaucucaaauuccugaccuuaagugaucuucucaccucagccuccuaacuggcuaggauuauaggcaugagccauugugcccagcaucuuuuucuauuuauuuacauauauuuuuacaauacacaaauuacuuucacaguaagaaaaaaguaaaaguuggccaggcacaguggcucacgccuguaaucccagcacuaugggaggccaaggugagcagacugcuugagcccaugaguucaagaccagccugggcaacauggcaaaaccccaucucuacaaaaaaaauacaaaaauuagcugggcaugguggugugcaccuguagucccagcuacucaggagggugagguggaaggauggcuugagcccaggaggcagaggccgcaguaagcugagauuguaccacugcccugaagccuaggcaacagagcaagacucuaucucaaaaaaaaaaaaaaaaaaaaaaagguaaaaguuauuuuuuaagagaaaaagaccacuaacaccgguaaauucuaaaacacaucuggauuggccagaagauaagagauugaugaggcuuuacaaucagcaguacucauuaugggacuucaauacuuccaagaggaaaaacaaggguaaaggggaaggaguacgacagaaguacucaaacaaaacaaaacaaaaccggaguaaaaauuaccguuaaauuuuaacuuauaacacaaaugacaaaugaacagaaaacugugaggcugaacuugccaauaucuacaacuguugaacuucugacuucugcucagcuucauacaugagaaaauuugcuuagccguccucuguauuacacaacauaaacaggcaaagaaaaacaaaacacgaaugaggguagcuugcaaauuuggaaucaaauugugauucuuaugaacaaggccauuucagaacacgaggccacauaccuggaaacaugaagacgaggagcugcaggucaaaauaguaugaggaccagguugugggcugaugcucagacacagaagcaaugauggggauguuguucuuagcauaagagggauccagcagcgaguagaaacgccccguccagggagauauuuuuccuagcagcaaagaggcaauaaauauuccacacacacucuucaaacaaacaucugauccaaaugaaucacaacuucccauuuuaauaagauucucagugacagagaaggauuagguuuuugcuuaauugccaccaauacuuagagaguuucacuccuuccuuucuuucaaaccugagaguacuuuugucagcacugccagcagaauaaagccaggcuguauauaaacuuggagagaagaacagaggcagaaaugcuaccugaaaggguuuuaggccaaauuuggucaaaccaaggccaacuguagagauuaaaucaacuauauccucaaguccugcucugaauuagucaauagauagacuugagcaaaaucaaauucaucucugagaaagcaaaguagagaaaaagaaggaaaauuuggcuuuccaaccaacuaaacagcuaugauuuaguuuccaugggauuagaugagugccacuuuggaggguaugguaagcaauauaaugacuucucccacccaaucaauaggaaagaaaaaaaaagaaagaaaaaggagaaagauucgcaagguaagauauaguccuuucaccaggugugauuaagagcagcuccaacaagauauuuucugcuaugcugaauccaaacacugggcugaaaaguggauugaauguaaaauugugggauuguacaugcuuccgaugaaaaaagaaauaagaaaaaaauaaucuuuuguguucagaaaauacccugucuuuuggaguuuauucuaugucuguacccaucugcauuuaauaguaaaagcucuaagccugaccgggugcaguggcucacgccuguaaucccagcaauuugggaggccgaggcgggcggaucaccugaggucgggaguuugagaccagccugacaaacauggagaaaccccgucucuacuaaaaauacaaaauuggcugggcgugguggcgggcgcgguggcaggcgccuguaaucccagcuacucaggaggcugaggcaggagaaucgcuugaaccugggagguggagguugcagugagccgagaucgcaccacugcacuccggccugggcaacaagagcgaaacuccaucuuaaaaaaaaagaaaaaaggaaaaaagcugugagccuucccuaccugucagcaugaggagagcucccacggugagaaggacaaagccuaccagagagaugacgcuccggaaaagaacuucaaauuguuguggauucaacuugcugcgcagguaauccacaaaggcauggaucuggcagagaccaaagaccccaaaggcugccaugugcucugaugaaaggacaggcuguagguaaaaggauauguauguuaauacuaaggaaaaaaaaugaguaaguccagugcaggccugcauuauucuuaucuaguucaaaccaaauggucaaaugaguucugaggccccgaaggaaucagggccaaucuagggaaggguuuaauucaccagccauauuuucuacagaauauuugcagcccccuaaagcauaagauacacuaucauuaucacaucucuggcuuuugcucagguuauuuccuuagccuagacuguaauuuuccccaaauucccauccacuaaaauucucaucauucaagguccaacucaaauaucaucucuucccaaucugccaaacugaaaucaaucacuccucucuauguuccauaucacauuaguucucuucuagcacuuaaucauucuuugccuuagaucggugguucucaaaugcuagugggcaucguagucaccaaggagguaggagugucgaagcacagaucgcugagccccaccuccagaguuucugauucaguaggucuguguuggggcucuagaauuugcauuuauuucuaacaaguuucuagcugcugcugcuagugaugaugauucaagaaccacacuuccagaacuguagccuaucggauauagacagcugccuguauuucuuucccuguaagaagaccaaaacuuccuuaaggacuaugaccgcauuuuuauucuuuuuacauuuucaagugauuagcaaacugcauauacaaaugcuuuucaacuuaugauuggguuauauccccauaaacccauuuuaaguugaaaauaucuuaaguagaaaaugcauuuaauacgccuagccuauggaacaucacagcuuagcguagacuaccuuaaacaugcucagaacauuuaacauuagccuacaguugggcaaaaucaucuagcacaaagccuauuuuacaauaaaguguugagaaucucauguaauuuauugacuaccguacuguaagugaaaaacagaaugcuuguauggguacuggaaguacgguuucuacucaaugcagaucacuuucacaccauucuaaagccaaaaaauccuaagucacgcuucauaaguuggggacaaucugcaguagguaaucaguaaagaaauacuuguugaccucuagauaagguuugcauuuucaugauaauuucacaagagaaaucaaacauaccacauuauucuuugauuuaacaguugucuguuaacccuguggagcaaugugguuaaagguuugugcuuuacuuccugaagcacuuacaauuagaugccauuaagaucaggaaucucugcuacuacauggggucaucugcauuaagaagacuggaaauuuuaacucugaucacucaucuaaacucaacucaacuaaauaucccuccccuucccacaaacuuaaagccaaaguaagagccauggaauucaaacuccacggagcaaauauuagcagacuccuggaugcaaacuuuaaugaccaguaauucuguugcuucaacuaacacaaguaguucaauauaaaggcugugaauaagucguacucuucuuaacagaaucuaagauaaaucagucuaguuggggcugcauagaaaaaguagaagcugaaaacccuacucagucaagggcucaccuggaaacccacaaaggagaucugcauagaaaguauagugcccaggcaguaaacaguacaguaggccacauagauccggugagagaaacggccugugagcaucagcacgaggacguggagaggaauuaaguugaucaggaacacauaaccuccccaugacgagaccuaugauggaauagaaaaaaacaguuccucugaguaugccuccucagaccaccaccacuauauuguaggauaucaccugugacucuuuaaagaacacuuauaguaacuauaacuuuauuuaugccaaauggcuuaaagaguucaaauaacugauuuuuuuuuuuaaacaggaaaaucaaguccuuacauguacaggucacacaaaauaaaauaaauuuuaaaaaagaaaauauaaaaucaaguucaaacccaucacuguaacucaauccccugcucccuugugguugcugaugucaugaucacauaacgagagggacucaagccucagaauuaaucuaaaugcaaucuacuguaaggucacacagaggauuuagggauaugugagcaaguggaagcaauuaaggaagucuacauguauacguaaguaugaacagaaaaaauauacuggaaaagaaaaaaauuuaggggaaccuaccagaaaagaaaguuggucaaacaauaaguacccauaggaaauacaguauuuagagaacuuuaaaaauugaaaacauguagaaaaaguuaccauguagaaauaagcaagggcacacuuagcugcccaacagauggaaccagucuuuacugccuugauccacauguaguaggugaguagcaugcaaaagauggcaaucccugcagaaaggacacaccaaaaauucaacaagaggccaggcuaguauagucauuaagaauacuguucuggaacagacugccuggaucuacuaccaaguaauaguguaauuuuaggcaaauuauuuacuuccuuuuguuucaguuucauguaagaagaaguaauaguaucuacuucauaaaaguguucugaaaacaaauauaauuaaugccuguaaagcacuuagaagaguaccuagcauauaauaaacauuaaguaaauauuggccauuauuaucauucuuuccaagcacuaaacauccugcuaguauaguucuaaagacaucuuauacuaucauucaucauccugccucuaugucuuaacauauaauacucaugccccaauugccccuuuccuugauaucugccuaaugaagucccaacuucaggacccaguugacccucaaccacuucuaaaaagccuuccuugauucuccagucugcuuuuuuuuuuucuuaaaaaaauaaaaauaaaaacaacaacaacaacaacaaaaacagggucuugcucuauuacuaggcugaagugcaguggcaaucacagcucaccgcagccucaaccucccaggcucaagcgauccucccacuucagucuccagaguagcugggacuauaggcgcacacuaccaugcccagcuaauuuuuguauuucuuauagugacaggguugcccaggcuggucucaaacuccugagcucaaaugauccacacaccucagccucugaaaguacuggauaacagggcgugagccaccaagcucagccccaaaucucuccuuccacuacauuccugaaguacucuguucaaauuuuuaucauggcacauaguacuaucuccugucacuggaguuauauuuacauguccauuuuaaucuuccuuaauagaugaugggccaauauaaccuuauucauuaccuaucucuuuaauuucuuauaauuaugcacaaaguaaucuuagucauuaccuaacacuuaauacuauguuuucccaauaacauucaacaaauguauguugaauugagaauaagucaaucagucauuaaaauuuuaaggacauccacucccuuuauguaggaaaauaaagcaaaugauuauaauguuaaaacaauaguuaacuauuuuaugagugcagagaugaaccaaagacuuguaagaaaaguuaccaacuaccuuucuggaaaggaugaugggaagagaacaugagcuuguccaagauccguuccugcccauuucuaauauucucacccaguuaccauuuuuauuauugcuaaaccauagacugcacuuugugaagcucuguuggauaaugaggugagaugaucuucuucagcauuuuaaaagucuuaccuucauuaucauaggagccagccacagaucgggagauauauccaggaacuacagcaaucauggcagcagcaagaagcccagccccugcauccuguaagaaaaaaaggguaauaagacauuaacaccaauacaaugcugagaaagaacagaggauccacuaguccauucuguuuauaaugagcccagaaaacaguccaacaauuucgaagguagaugugagauguuagaaaugcuagaaaugcucacagcacaagcaagcuaaaaacuucaugaccaauuccccaugaugacaccaaaccugacacugagaacacauaugcugaggacagacaaaucaagugagaugucaaacaucaauacugucccagaaugggcuguuuggcuaccaaucuccccaagcucguaagucucuaccccuaacaauaucuguacaucauuggaacaccagucacaccucuaaaagccaugcaaggacaaucaaaggaagaaaauuauuauuucaguuaaaaagccaagaaagcuaagugauaaucuaccuaaacugaagaugccaggagcuuaggcaauaaagcuuaaauaucaccaggcacccuuugagcucaggagaaaggagcaacagauauaagccacauuccaaaaaaguaaagacuugucuguugaaagagucaaauuugggaaagggcagcaaggagaaggaucaaaaaguuuuccaaacuaaauucaggcuucccaaacccccuacuaguuuaucaccucucagguaucucucuaacaccgcagcacaaacuaagaauagcacccagggagccaaggucagcaaugcugaaaccuggaaaaacagagucagcauuauggagucuacuacggaagccaaauggcuuaagaauuuuaaaauaaaaaaaaauuuuuuuuaaaucaacaaauaauugcugaguacauuccugguaggaaaaacuaaccguuuuggaauguuucauguaguuuuuuuuuccucucccuuacauugugaggacuucaaaauccaaaccucacauuuugcauuuuaaauguuuuuuucuuuauguugcaauuuacauuucacuuucaacuguacucucauaaggacaaacaguugcuaaugauaaaaaacacauauugcagaaagggguuggagugaagccaauuaauuuggcccaguaaaagcugucuucaccuucuggcucccugccuuucuaaggcucugucccccacccuccagcaucgauuagagaggcucaauaacauucauucccaagccuccugucaccccaaauccuucaccuugagcucuuugguaaggugguacgugacgaugguggugaaggaggagaagagaggggccaggaacacacagacauuccgaaugucgauggugauguggaaaaaauggaguacaugguagauugcagcagaggugaucauuaaaccuguaacaggaagaagaaacuccauuagguugucuuaccagaacuuaagggaaaaagaaagggaaaaucccagauacaauaaagugacuauguaagucuugacaaaucaccagaaauacuaacauagcaacugcaguaagccuauaaauuucuccccuaaggauucaaucagaagucuagaauguauaaaaaccacccaucuccacucuacuacaaauguacuccuguuuauguaagaugcacuuuuaggaaccuguaaucaggaugaaauuacaagugucacaagacaaagcuauuagaaauaaaagaaacugguucucuagcauacaaauauuucuguuuuuuuuuuaaaaaaaaaaacacaucuggucuccucaccuggguaaauuguuccuccaaugauucgucccaaaggguaccaggcucggucaucaaaccaguuauggaauuuauaaaaccccuccucagccaggaaccugguaguccgauaauuaaaguaccuauagcaagaaauaaacuuuguuguaaauuuguggugaauuuugcuccucaggauacaccauugagaaauucagcauuacucaaugaaaaaucaguuuaacaucagauauuaugccaugaaaaucauuuuacacuaccauaagucuguuuacuucuaucuccaugcuugucucaacuaaagcacugcuuuucucauaaggaaaugagccgggugcaguggcucaugccuauaaucucagcacuuuaggaguccgaggcagguggaucacaaggucaggaguucgagacuggccugacgaacauguugaaaccccaucucuacuaaaaauacaaaaauuagcugggcacgguggcaugugccuguaaucccagcuacucaggaggcugaggcaggagaaucgcuagaaccuuggaggcagagguuacagugagccgagauugccacugcacuccagccugggcaacagagcaagacuccaucucagaaaaaaaaauaaauaaauaaaaaggaaaugaaacuggagccuaacauuguaacaaagcaaucaaaugggauacuucaacaagcugacaugugguaggcauuaggaccagucagagaauucaagcaccaugaagacaaagccacugagaugugggcaccaauagauuuuggcuuucuuauuuauuuuuuuuuuugagacagaguuucgcucuuguugcccaggcuggagcacaauggcacgaucucggcucacugcaaccucugccuacggaguucaagccauucuccugccucagccuucugaaaguaacugggauuacaggcgcucgccacaaugcccagcuaauuuuuguauuuuuaguagaggcaggguuucaccauauuggccaggcuggucucaaacuccugaccucaggugauccaccugccccagccucacaaagugcuuggauuacaggugugagccaccaugccuggccagauucuggcuuuuaagugacaggaacauauuuuuaaaaaucuauacugcacacaaagacacaugaauaauuuccagugaugagaaucuuuaaagauguugguauaccaucauaugcaggaugaaaaaauuuuaaccuacuucauaacacaacuuucuuaaucaguguuuaaacuuuuaacaaggucuacucaugugguuaucuaaaaugcuucuuaugucaccuauauagaagcauaaaaauauagauuacagccaggcauggcagcucaugccuguaagcccggcacuuuggaagacugaggcaagaggaucgcuuaagcccaguucaagaccagccugggcaacacagugagacucugucucuacaaaacauuuuuuaaaaauuagccaggcaugguggcacacaccuauagucucagccacucaggagguugaagugggaugacugcuugaguccaggaggucaaggcuacagugagccaugaucacaacacugugcuccagacugggcaacagagcaagacccuuucucaaaaaaaauauagaaagauacacagauacauagacaacaugaaaaauauuugacauaaaaugcuuaagagcuuuaaauggaaagauaguucuuuaggcccaaaauauguaaguccuuaaguuucuuauuuaaaaagaaauaaggcugggugagguagauaacaccuguaaucccaauacuuuaguaggccaaggcagguggaucacuugagcucaggaguucaagaucagccugggcaacauagagagacccuguuucuaaaaaaaaauacaacaaucagcaggacuuaguggcacacgccuguagucccagcuacucaggaggcugaaauaagaggaucaccugagcccagggagguugaagcuucagugagcccugaucaugccauugcacuccagccuggugacagagcaagacccugucucaaaaaauaaaauaaauaauaauaauaauaaggccaggcgcaguggcucacuccuguaaucucagcacuuugggaggccgacgcagguggaucaccugaggucgggaguucgagaccagccugaccaacauggagaaacccugucucuacuaaaaauacaaaauuagccaggcgugguggcgcaugccuguaauccuagcuacuuaggaggcugaggcaggagaaucgcuugaacccgggaggcagagguuguggugagcugagauugugccauugcacuccagccugggcaacaagagcaaaacuccaucucaaaaaaaauuaauaauaauaacaaauaaaaauaaauaagaggccggcguaguaguuaaugccuguuaucccagcacuuugggaggcagagguggauggaucgcuugagcacagaaguuugagaccagccuguguaacaugacaagacccaaucuacaaaaaauacaaaaauuagccaggcgugguggcgcgugccuguaaucccagcuacuuaggaggcugaggcaggagaaucgcuugaacccgggaggcagagguuguggugagcugagauugugccauugcacuccagccugggcaacaagagcgaaacuccaucucaaaaaauaauaauaauaauaauaaauaaaaauaaagaagaggccgguguaguaguucaugccuguuaucccagcacuuugggaggcagagguggauggaucgcuugagcacagaaguuugagaccagccuguguaacauaacaagacccaaucuacaaaaaacacaaaaauuagccaggcaugguggcgcgugccuguaaucccagcuacucgggaggcugaggugggaggaucacuugagcccaggaaguugaggcugcaugagccauaacugagccacugaacuucagccugggugacacagcaagacccuguuuccaaaaaaaaggaagacagacaaaaauaaacaaagagucucaaacuagagacaguuuaauuacuauggauaaucaugacuaaccguccucucugcccaccucucuaacccuauuuccuccuuggucagucaaguuuugaaagcugaaguaaacagaagcaacagauggcagaaaucucuauccuucuguuugucacugauguuauuuuggugacugucagaaacagaagagaugaggguugcagacaucaguaugugucagaauuguguccuuuagcuaccaguaggagaggcagagugagagaggaaguauaaguuaguaggaauaggucuggacugcauucaccacucugggaaucaguuuccuccucugcaaaaggaagugucaagucccuuauggucccuaacagcucuugacgacaaagcagaugcucuugcauuccuugauuaucuaacaucaauauuugcucauucagagggucugagaaagaagccuaacagauugggaucaagaaacaaaaguaggcugggcauggaagcccauaccuguaaugccaguacuuugggaggcugaggagggaggauugcuugagcccaggaguuugagaccagccugggcaacauagugagacuccaucucuacaaaaaauuuuuaaaaaauuagcuagguaugguggcacaugccuguggucccagcuacuugggaaacugagguggggggaucacuuaggccccacaagucaaggcugcaguaagccgugaucacuccacugcacuucagcuugggugacagucagacccaaucucaaacaaaaaaagaaaaaacaaaaggacaugucuccucauucaugagaaaaaauauaaacugaauuugggaggccccaaacagaauuauuuguaaugccuccaaaaugcuuucaaauaucuacacaaaacaaaauuauaaauuugcaaauagaugcaggcauuuucaaucaauacuccacaagauugaauauacuauuuuuaagauaccaauaauauuucaagaaccuaugauuuuggcccuccaaauuuguuauaagccuuaacuuuaggcaauauaacacagugacuacagucucuggagucagacaaaccaacauucaaaucacgguuccuccacguacugaauaaucaaccuuagauaaccacucccagccugagucuccucauuucuuuuuucuuuuucuuuuuuuuuugagauggagccuugcucuguagcccaggcaggagugcaguggcaugaucuuggcucacugcaaccuccaccuccugcguucaagcgauucuccugccucagucucuagaguagcugggauuacgggcacaugccaccaugcccagcuaauuuuuguauuuuuaguagagaugggguuuuacuauguuggccaggcuggucucgaacuccugaccuugugaucugcccgccuuggccucccccagugcugggauuacaggcgugagccaccgugcccaguggagucuccucauuucuaagaagggaauaauaguaccuacaucucaaaggguugcugaaaggauuuagagauaaucuguaaauuagugcuuggaacaaaaugaaugcuuaguaaauacuaguuauuaauaccacuaaggaauuccacuauaucuuuuucaucuaaugaacaaaauuccuuaucaaacugauaacuuugaguuuuuucauugcccuagaauuuaacuaagaagcccaauuucuaucacauaaauugcuaaacaaacaaacaaacagcaaaaugucaugaaucucaaguccauuguuugugauucucuucugagccuggaauacacaccaggacccuuuccuucaaucugcaucacaaacuuuuaccaaacugggcagccagaauucucuuagccuagccagaucuuaagugauaggcagacauacuagcaaugccucucacauuuuuugaguuucagagacuuacuuggucaauuccaacacauacuuuuuuuuuuuuuuuuguagagaugggguuucaccauguugcccaggcuggucuugaacuccugagcucaagugaucccuccaccucagccucccaaagugcugggauuacaggugugagccacugugcuggacuccaacacauacgucuuaaaaggagauaauuaucuccuuuggaagaauuuaaggguuuuuuuuucccuuaaauguacugaaagcacaucucuaucacugagagcugacugaaauuugaaucugaaacccaugaaccugaaugccucccaaaggaaauaauaccagaucaagcaaagguacucacggaucaaacucauggauaacacuuucaaaucucaggacagcaaacagacgaguggagaaggcugcaaaaaccagagaguuaauauuuuauugguaaugugccaugaaagaacagcagauauaguauuauaaugaagacaguauuauccaguagagaggucacagaaaauauaaaauaaucccugaauaaagucuuuauccaucuuuccccacauaaaggaaacaagagaaguuuacuuuccccugacaauggcaucuacauuuuccacuuucauaggucacaguuaacuaauuauaaaagccuauaacauuacauucaccuacuaauaccaaacucaacuuacauggucaucuuuuauauacgcugacucccccaccauacacacauaacuaaccuuaaccuuggagcaaaguaauagguauggcaagcaaaauuacaccuaggacucaugaagagccagaaaaucuaaaauacagaguaaacucucaagagacuuucaaaaauacuauaggagacaucuaaauugaagauaauugucuuuuacaaaaaucaguuauccaaggguccccaauaucacuuucaacccuaugagaaaacagaauuggcacagcaugcuucccauucuuucaaagaugaucacagcccucuuuuuuuugagacagagucuugcucuguugcccaggcuagagugcaguggugcaaucucggcuuacugcaaccucugccucccagguucgagcgauucucgugccucagccucccaaguagcugggaauacaggcauccaccaccacacucaacuaguuuuuguauuuuuaguagagacaggguuucaucauguuggccaggcuggucucaaacucccagccucaagugauccacccaccccagccucccaaagugcugggauuacaggcgugaaccacugcauguggcccauagcccugacuuuuauauuccuuuuauuuugccuucauaaaauuauacuaaugaggaauggaaaaauguaacaaucugcuaaaaagaacaaggcauuuuaagauagcgauuuucaauuuuuuucuagacuuucuucuuucuauccccaaagaaagagagguucacaugcacacucacauaauacagcagccauugacagaaugagaagcuucaaaaguguguccugcuucucauaggacaaucgcaaaaauccaaacuuagucaucuugacaugaauggguggcaacacacgacgaucagcuaaaaugaaaaagucaagaccacaagauauugaacaccuucaauuuacuuaauuuucauauuuuaugaugagagggaaucauaaaggacguaggagcuagcaaaaacaccagacagggucaaggcuaauacuaguauccaagccuggccuaaaguaugaucaacuugcaaggaaguaggcacaagucaggucuaugugucaagacuaaaauggaguggucagaauaaaccauccauaauucuauuucccacuccuucacagcuaacaaguacauaagcacaauuagcaauaguauagcacaaggaagagaugaaaaaauaaacaggaaagauuggaaauacugaaaaauaauaaaauggagaaagagagcacucaagaaaaggcaggacuauaugggguggcaggggcggagggggggaagcaggaaauaaacauugagaccagaagugcaagccccagcaauuucagaggcuaaggagggaggaucgcuugaagccaggaguucaagaccaaucugagcaauacagcaaaaccccaucuccacaaaaaacuguuuaaaauuaugcaggcuugguggucugcaccugcagucccagcuacucaggaggcugaggcaggaguuggaggcugcagugagcuaggaucacaccacugcacuccagccuggacaauagagccagaccuccucucuuuaaaaaggaaaaaaaaaaaaaaagaagaagugaaaggcauuaagaggaaaaauagaagucacgacugaaucaacacaauuucgagcccuaaauuuaaacuucaacugaauggcuauaaacuuuuuucuuuuccaaaucccaauggggcugucgggucaacuaacagcauaccugauaacuaaugcagguacaaucaugcacucaaaaagagguggagguacccaaacacagauccacuguguucucaucccauauaucagacuguaacgacugcucagaucuauacccgcuuccaaucaucugucucaaggcuucucuguaacugacaaugcugauuuaagagacugauuaaauuacacagacaguuugauggcaucagaugauaaucuagagggaaagaaaacgaauuuuuccuacugaagcagaagagucgggggauuaaaaaaaguagauuaaaauguugagggacacuaucuguaggcaguucaaaauggaaaucacaugacagauaugaauuauuuauauagcaauauagcacuaaucuaccauagguuaguuauucuuguauaagacaguacuacuaucuuuuuuuuuuuuuuuuuuuugagacggagucuugcucugucgccaggcuagagugcaguggugccaucucggcucacugcaaccuccauccaccuccuggguucaagcgauucuucugccucagccucaugagaagcugggacuacaggugugcgccaccacgcccagcuaauuuuuguauuuuuaguagagacgggguuucaccauguuggccaggguggucuggaucucuugaccucaugaucugcccaccucagccucccaaagugcugggauuacaggcgugagcuaccacgcccagaccuacuuuuuuaaauuacaaggugaucaagagcuaaguuauaacgacuauaacaaaggauaugcaacaccauucaagauguuuugcuuuuauucuuuuugacugacacauaauuguacauauuuauggaguacagugugacauuuugguacauguauauaauguguaaugaucaagucgggaaauaauuaguagauucaucaccuuauuuuuuuugucuuaggaauauucaaaauccacucuucuagcuaucugaaaauauacaacaaauuguguauuuuuguuguuaauuauacuccuaauaauaguuauccuauagaacacuagaauuuauuccuaucuaguuguacuuguguaucccuuaacaaacguuugucuauccuccuccaugaaucuuuuuucccacuauuauuggaauaaaggagaaaaacaaaacaacaacaacacuggacuagguggaaggcauauagaaugcuagccccaacacugagaagucaagcauguucuccauaauuaacugucccagaagagcaguuuagaaauguguuuaaguauagucccaaagggaaagcuuacuuugcaacuaaaaauaaaggccuaacuacuccaggaggucaacaauccagccauaucucucaggguuugcagcuguuuucuggaaugccugaaauaggaacaaacuuaacaccacugcguugauacgagccacacaccaaaaugagacugcuaggaucucuacuugaaaacuugaguaaacgagcuagucauugagggcagggccguaagggagauuucaucucgugcucuuuggucacuuucgcacaccgccaagcaaauaagagcaaagacaccuuucuuaaaacacuuaccaaccugcucuccucaacugugcccugcaagcuguggcaucuccugccacccugccucuaguuucccagacugcaauuuccccagccccguuuuccuacacacguuuccacacccucucacgaucuuuuacucucuucucccuuccggucguuccagcgggucccaccucccucuucuucccacccucaaagaacugaccaccucugauaccccucagcgcgggacacucaucaccccagcauccuacgcgccuuccccuccauaacuagucccaggacccagucuuucccacgcucuguucucaagacccaccuuacccucccucccuagaccuucgcauccuuccauccaggaagcccccacaccacgccccacgcccccuccucugcaaggcccuaagcucugcucuccacccccauuuagaguuuugccuccugcacuucguucagccccaucaacgccauggacugcaccugccgcugauuuucaaguuacguucuacggccuucucaccuggccggcuuuccuaaacgauccgcggggcucccucagccauccguucagcggcgcacccaacccuggcaggag

SEQ ID NO: 192954 - RNA, 86850 nt, Homo sapiens
gcggaaaauacccgccaacgacccaaaaaaggccggcggcggguggacgcggcgcgcgaggacccgagccaggcggggacaggacggcggggcgagccaggugagggggccugaggagcgggaggcgcgcggcggguccggucccuccgggagggccgagcgaggcgucccccuggggccguccuagggcugggguccgagugcgccgcccuuccuccccgccuccaggcgcccgagcccgccugaagaguggcuucucucccaggcccucagcgcagaccccagugaugacaacugccuggugcuggccaggugcggucccagguccggccagggucucagaucgccuccggguugcauccaggugggaggaugcccaucagggguaggaaacuuuccaggagggaaaggaggaaaguccccgaccucccgcacgccccccgguucauuccucccucuuuugcuuucaguuuaacuguuuaaccugguugcccuccgguuggugagggucuggacugcagacuagcugcgagggaggggcucucucuucuccugucaguuagacugaaaacuaccuggcagccaggcccuccggucgggacuggugguggugcagauaugaugacaggcuuugguaacuauugccaaagccugucucugucccaauagaucaccaguucagcaaagucaggccugaagcgaagggagucuugugagcccuggacugaggagccuucccagccuuuccgcuccugcuggccaccugggcccacauggccucagggucuucugccacaggguccuuaccccuacagcuuaacagcuguucuuuccuucuggauggauucucacauuuuaugguugguugaucagucagauguuggaauuggggguagagggauuauagaguugugugugcuauuuaaguuuucuguaaucauugcuaauuaaauuuguugauucuccacucacuguucuuguucuuuuuuuuuuuucggccuuaaaaacuugcuuuagagggaaaauacaaucuggaaaacaguuucugcagaugguuagaagugaagaaagguuaauauaaugcugaaggaacuugacugaggaucauuauuuucuguauuuuauguugguuuauguuguuuuauguuuucauuccuacuuuuuucuuccuuccuuucuaccauucucucuuccucccucccucccuuuuuucuuccuuccuuaauuucugugacgugccuugauuuuuaauuucguugaaguauauuuaaucuauuuuuccuuuuuuuucuuuugagacagagucucacucugucgcccagguaggaaugcgguggcaugaucuuggcucacagcaaccuccgcuuccuggguugaagugauucuuuugcuucagacuccagaguagcuggaauuacaggugugugcuaccaugcuuggcuaauuuuuguauuuuuaguagaggcgggguuuugcuauguuggccaggcuggucuugaacuccugaccucaagugaucaaccugcgucagccucccaaagugcugggauuauaggcuugagccacugcaccgagccuauuuuuccuuuuguuguuugugcuuuugaugucaaaguuaagaaaacauugucaaauucaagaucaugaagauuuauacuuauguuuucuucuaaaaguuuuauaguuuuuagcucuuacauuucauucuuugacccauuuuaaguuaauuuuuaaauauggugugaggcagggggucugacuucaacuuuuugcauguggauauccaguucuuucagcaccauuuguuuaaaagacuguuccucuuugaauaguuuuggcaccucuguugagauaaauugaccaugaauguaaagguuuauuucuggacugucaguucuauuccauugaucuguaugucuguccucaggcuaguaucauacuaccuugauuauuguagcuacauaguguuuugaaaucaggauaugugaguccuccaaccuuguucuuuuucaagauuguuuugacuauccagucccuugaauuuccauaugaauuuuuuuuuuuuuucgagauggaguuuugcucuuauuuaccaggcuggagugcaauggcacgaucucagcucacugcaaccuccgccucccugguucaagugauucuccugccucauccuccugaguagcugggauuacgggcaugugccaccaugccuggcuaauuuuauauuuuuaguagagacaggguuucuccauguuggucaggcuggucucggacucccgaucucaggugaucugucugccucagccucccaaagugcugugaucauaggcaugagccaccaugccuggccuuccacaugaaauuuaaagucagcuucucaauuucuauuguuuugguucuaaaauagauguaaggguuuuaaagugagcaacaaucucuaggagccagauuuuugaguuuucucucccaaagcugcuuuuccccuagucuucuccaucuuagugaauggcaacuucacucuuccagaugcucacaccaaacacccugaaaucacucuugauucuuucucuuauaccccacauuaaauuccucagcaggccgggugcgguggcucacgccuguaaucgcagcacuuugggaggccgagacagguggaucacgugaggucaggaguucaagaccaggcuggccaacauggugaagcccuguaucuacuaaaaauacaaaaauuagcggggcgugguggugggugccuguaaucacagcuacucaggaggcugaggcaggagaaucgcuugaacccaggaggcggagguugcagugagcuaagaucgugccauugcacuccagccugggcgacagagugugaguccgucucaaaaaaaaaaaaaaaaaaaaaaaaagaauacaucuaggaugauaaccauuucucaccacuucugcugcuuccaccaaguucuaucaucucugucaccuggauuacugcaaaagccuucugaagggcuucccugcuuccacccuuacugcuccacacucuauucuuaacacagcagccagagucuauuaugucacucugcuugaaacucuccaguggcuuuuuaucucagaagugacagaguccucaccauggucuauacaacccuugcauggagugcggcuucaucugcuaucacucuugccuuugcugacucugcuccagccauaccucaggaccuuugcacuuguuuccucugccuggaaugcucuuccccucagaugucugcauggcuuucuuauuuauuucauucaggugaaaagucauuuuucuggagaggccuucuuagaccacuccaucuagaauaguaucccucaccuaucccaucauuuucugcccccuuaccuugccuuguuuucuuucgaguauuuauagaacugucauacacagaccagcacacacacacaacauuugucuuucacugguagaagacaagcuccaggauggccaguaaucugccuuguucacugugauguccauagcacauagaaugguuucugacauauauuaagcacucaaagagauauguguugaacuaaugaaaaagggaacagaagacagagcaauagggaucauucugccauuucucccauccaaguacuaaccaggcccaacccugcuuggcuuccaagaucagaggagaucgggcacauccaggaugguaugucuguagaguguucugcuauuucuuucccacuauuccauccauuuuuuucuaagagaagcaaugucuauagauacaccaacaucuccuaagucucucgucuucuguccuacuuucccaaaaauaauagucuuaucuuccuuaaaaagggaaaggucaaauaaguagaaaggugaggauuuuggucccucccacaguggcagaccggagcccucugucuauauccugggcaaacugggcagggccauucagugccuaucuccaggguguuggccucuugugcuaauuuaagaagagugaaguuuuuuggaaauuugagaaaauggaaauucauuucuuauuuauuuauucaauagaaacgggguuucaccauguuggccaggccccugagaagggaaauugucuugccaucgcuaaaacaagauugguucuugaagagaguaauuuuucccuucuauagccuucacuuuuuaugccacuugcagauuuucuuggacuguauuuguucuucugccucuuggucaggaaguuugaguuuaugauuugguuucccuuaagcuaggugcagacaugagcccugaacuggaggcagagauaaaggguuuguaauuuacuuauguucguaggguaagguguguggaguagagagcauucagcucuguuuggacucucugguuuugcagguacuuguaugauugaggucuaguaauacucauauuuuauuuauugucaaguaaaauuagaugccucucuuacgaggaaugcugaaaguuuuguuccuccuuuccuguuuuuuuuuuuuuuuugguuguuuguuuuucgucuguauauguugcccuuaaacagaaguuuaccauguagugcuuuagucagccaaccucccguguguggagugagaguuuugauucuaauguggggauggagguggggugccagauuuagcaaacuaaaaaaaaguuaaauuugcauugcagaaaaacacuaaauaauuguuuccuauaucuuauacauuauuugggacauacuuuuacuaaaaaauuguucuuuauccaaaaugcacauuuaacuggaugucuuguuuugugucuggcagcccuagcuggaguuuauguuuaugcauaggaaaugcaucgauggugaaaauguccaaagaaugauugagccauggcugauuuuuggugauugugcauguauccaaaagagaagauuuguaaacccaaggaguauuagaauuagaaggaaguuagagaacauuucauuuuacucuagucuuuuauaguuaauggaauuuacuccagagagguuaagucacuuugucaaagucacauagaguuaguggcagagcuggaagugggacucuggaaccagcaguuguucugcugcauaaucccuucccuuaagaggucaugaagaaguugcuuauguuuucauguugaccuuuaaucacaucucuagccauccacucaagaucaccucauuaucauacuguccuucaguccccagauccaacauguggcagccaaagccauucucaugagacacuuugacuuuucucugagagccgcauaacuguugaaagccccaugugguucuugucccugcuguuaugccagaaagccuguaauucaaugugguuuuauuuuuuuuuaugguuuuguuaacacuuuugacccucuggaguauuuauuauaaggugcuuugauuaagguggucuuacugaguauaauuccacaacaacuaaguguugucuuauggaaagccugcuugcuuugaguggccuauucccacaaaauuccucaccccuuuuuauuuugguacaauaaauauggaagauauacauaugacaaggaccaagguagauagacagguguaugugacuugcucacuagagaucuguucuuuuuaaacaagauuuuauuauuuuuuauuguaauuauuuguaccuauuuaaaagaaagcagccuugaaaaugaacugcuuucucuaacugcuauuugaauaccauauuucagaaccacuaaucuuguuuuuucauaguuucauugguuaauucauauaaagucuuaccagcugccaggucaaagcauaauaauaaaauugguugccacgagacugaaaagucuguucauucuuauuugcuauaguuuaucuaccuuggccugaucccaccaccugggaggcuggucaaguccuaucaggguauggcuaaauacuaaucugcuguguauuuguaucguuaaaagcaaagucaaggucuaaaucagcuaguuaaacacaauaauaugauacuuuuguucuugcuguacuagcccuaauaaggggagaaaugaaacauacagaaauaggucaugacuuaaauguucauuuacaaaacuaaagaauuuuaaaauauaaccuaugauuguggucaggauuucuuuguuucuugcuaagaaaucauuaugaaaauagugauuuucauaauaaaucgcaucauuucaaggaaacaacuccaagaaugagugaagagguguaacaguccuugaaaagauaagucauuguccucacagucaaauacuggagaccuaauguggcuuuucucauuagggacaaggucagcugucccaggucccacgucugcccuaggcuguguauugaaguggguuguguagugaaguggguugugguauuuccucagguggcggcucauuccuguguuccggacuuccugcuugaauguggaagaaucaacacagucaggaaucagucggucgguuuuuagucuccauauuccugauuauuaacuaugugauaucacaccaguguaugucaguugggggugauuuucuccccugccccaccccacaugggacauuuagcaaugccuggagacauuuuugacugucacagcuggggaguuacuccuggcauuuagugggugggggccagggaugcugcaaaacauucucaguacacaggagagcccccaacaaaggauuauccugccuaaaaugucaacagugccgacgcuaagaaacccugcauuagacaacucauucaaccucuuuggcuuacaguuucccaaguuacacguucuguccaucauguaaaacuaacuaagccuaacuaccgcuguugucuuucuaaccucucccucaccccaauucuaagucaguaaaugugggguagggcucaggcuguuuguuuguuuauuuauuuauuuauugucuccacacgggauucugaugggcaguugcaguugagacugagaaccacugcccccagggaucaugcgaaaugggguucucguggaggugccagguuggccauaggagaggaguggacccuuugggaacagccuaccagcaggaggaagugagaggcuggucuucagugccugucuauugugugcuuccacaugagcgaaagccacaugagcaggggaccccagagaucguguaccugaaggguuacacagggacuuggguucucagucuuugcacgauaagcucgcagcugccaggaaugucuacuucccagauuuccagcugaccaccauacccuggaaaggaaauaauaaaacuggacaguuucuuuauuaacacccugauucuagcuucacuagagcuucucugggagguugaaaaucuguaacaaaaaaccucacccugagucaucaucccauuuugccacccagauaaggaaaccacauuuguuacacuuacagaauuguguaauuuaagagcuaguagggaccuuggaaauuguagcccaggcuccccucccagaaauccagagcugugccucaggucacauagcuaauugauggcagggaugguuccagaagccuggucugaugguuuccugguguguucuuuuuauguucuuauucuaauacuucuugauuggaaccaguuguacuguggacaauccaaaauucuauguguuguucaaaagaagugacaucuagauggaacuuugcuaacacccagagucucuuccuugaacuccucugaaauacauuaggaggugaaacaaguauauuaugauuucccuauguuaaagcagugcagaaauauccaagugccugcucugugccagcugcugguuaaaggccuguacugcuacuuuucuguuccaauucuugccccucccugccauagcccauucuucacacaaagccagugaugucccaaaaaaggaacucacacucuugaggagcaugagacaaaauuuuaaaaaauuaaaggaauucaauucauauccuucugcuuaaaaucccuuaguugcuuucauuguaauagguauaagauccaaauauguaccuguggucuguaagggccucugguuucuuuuuuuuuccuucucuuuuccuuuccuaccuuccuuccucccuuccauucccccuucccuucucccuuccuucccuuccuuucucuucuuccuucccuucccuucuuucuugucuuugucacccagcucacugcaaccucaacauccugggcucaaguggauccuccugcuucagccuccuaaguaacuaggaccacaggagcaugucaccaugcugggcuaauuuuuguauuuuuaauagagaugggguuuuacuauguuggccaggcuggucucgaacuccugaccucaagugaucugccugccuuggccucccaaagugcugagauuacaggcaugaaccacugugccuauccuggacuuuauuuuuuaaaugaaaccagaaugccaguuuauugauauaugagaaauggaacugcuaagcagaguagauuccuuuuuuugaggacaguguaugcuuccuuucggaagaauagccaggugaagcaaauauaaaaggagaaggcuacuuauacuggcuaaguauagacucaggacccagugaauuggaaaucaaaaagacccaagagcuuuaaugcuggagaaagauuaccauguuaaugcuuccucaaaacuggcuauacaugaaaauggcacagggagcuuuuguuuaaaacaugcucacaaaagaguguaaauugauucaaccauuguggaagacaguguggcgauuccucaaggaucuagaacuagaauuaccauuugacccagcaaucccauuacuggguauaugcccaaaggauuauaaaucaugcuacuauagagacacaugcacacguauguuuauugcagcacuauucacaauagcaaagacuuggaacuaacacaaauguccaucaaugauagacuggauuaagaaaauguggcacauauacaccauggaauacuaugcagccauaaaaaaggaugaguucauguccuuugcaaggacauggaugaagcuggaaaccaucauucucagcaaacuaucucaaggacagaaaaccaaacaccacauguucugacucauaggugggaacugaacaaugagaucacuuggauacaggaaggggaacaucacacaccggggccucucaggggguggggacugggggagggauagcauuaggagaaauaccuaauguaaauuaugaguugaugggugcagcaaaccaacauggcaccuguauaccuauguaucaagccugcacauugugcacauguacccuagaacuuaaaguauauauauauauauauauauauaaaccauacccacaagaaacaacaacacauuuuucagucucuccuuuggugauucuaauuuauuagguuuguggcuagggcuugggaaucuauguuuuauuuuaaauacugcucuagugauuguugguggacaaccugguuugggaaccagugucuagcucaccuuuacucccagccugaguaaacucaggcuggaagagaucauaugucucaugcagagucacacagcaagugagugggaagauagaacucaaaucucccuguccucucuaugcauuguucaaacaacauaguaagauucucagggacagaggcagcacagccucggaaauuguugguuucuuaguuuuuuucucuauuuacaugaaacuaaccagucuagugucaaacaggaaauauacacagcauaguuuuucuuuuuuuauugcaaagugucagauuaggaccaguaacaucagcaccaccugggaacauagaaaugcagauuuucagccccacuccagaccuacugaaucugaaacucugguggggccuagagucuguguuuuaaaaccaucuaggugacucugaugcaccccgaagcuugagaaccacugucuacaaguacauuucaugacucaaucgcugguuaaggcugcugaccucggccuuuguaguugaugagucauuaacauugaggccuuaacuuuccuggccaucugcuuuccuuggugauauuuauucaaaacaggugacauuuauucaaaaacuauuguuguaagucuucauuagaaugccauacacaagcgagggaauggacuuuuauugagcaccugcuguaugugagacacugugugugaggcuauuacuuauuucauuugauucucacaaccaccuugcuaggucaguauuauuaucccuauuuuacagauuugguaucugaggcuaguagaaguuaaauaugaucuugauguacaggcuauuugccuaacuguaguuguacauuuuugccaucuguugucucccuagaacaguggcuuacaaacuugauuguguauaaccagaaagccccugggaagcuugauauaaaugcagauucccuaggccucccuugcagagauccuaauucagaggccugaaugggacccagaauuuuggauuuucaucacauauccuaggugauucugcugccaguccuggauccauuuucaccugcccuaauugguugaccaguugccccucaaggcuucucugagguucuguguuguccuguguuuuguggucacaggccucggacacuggguggagaagaaauagaagaguaugggaggacaggccaugggggccuuuauuaagagucuuaucugccuggcucuuucugcugucucuacugcuucuuagaggguuccuaggccauauuuuggcuuugaguaacuugugauucuuuccauuaucuaucccaaaguuuggaacuguucuuuuagcaacugugcccuuuugucuguggggugcauagaugugagcaauuuccuucaggcuguaauuaauaaauguggaguagggaguugcuucagcuuuugaguucagaaaugguauuucauccguuuggugauacaagcccuuauuuuucagggauagaauugacauaauuagugaaugacuuggcuuagaacuuagaacuuagaaaugcagauuuuucagccccaugucaacguacugaauucacuaaauaauuagaagacugggccaggugcgguggcucacgccuguaaucccagcacuuugggaggcugaggcgggcagaucacgaggucaggagaucgagaccauccuggcuaacauggugaaacccugucucuacuaaaaauacaaaaaauuagccagacgugguggcgggcgccuauagucccagcuacuugggaggcugaggcaggcgaauggcgugaacccaggagguggagcuugcagugagcugagaucgugccacugcacuccagccuggguggcagagugagacucccucucaaaaaaaaaaaaaaaaaauaauaaugauuagaagacugaauaaucuggugcuauuaugaaggaaaaaagugaaauggaaauuaaaaacaaauuucagauaugaugccucuucuuugugagguggcaggcugauuucuguucacaaguuuagaagcggcuacugacauaaauaccccagggcucccauaguguaaaagagucauuucuaugaaaauauaguggaaaccugccaggcuuuuguccaguagagaaaucagaaauguugaacuauuaaauuucuuuaauauguuuuagucccugaaacaaaauguguguuacaaaaugggaaggaaauucacaaaagcaaacauugcagcuuccugaaguccacuauauauaaagcaaauuacagguuauguuucuaagaauacuuucuuuuucuaccugauacuaggguugauaauaacaauaugcaagugaguauaauagcuacagcuaccauaugugucaagaguuauacaaacauuuucucauuuaauccucaacaaucuuucaaagcagauauuaucuuucauuuuacagaugaugaaacagguugaagaagaugaaguaacuugcccaaugcugggauaugguuucccgggaugcaugacuuucagugcuauaacucaguccccacuaaacugggaugguuggucccacugagugucacccagccuacugacccauaguugauaguaaggccaaacgguucugaguuggacaaaugguuaauguauugaaaauugccaaccugcaucacagagcaacuuucagaacauuuuuuggugcccauuuuucuucauuuuacacacaguucuaauaagcuugguuauuugguuuccaggugccuugucaauuaaaaacagugcaucggaagggguagggguugucccaggaaggcacacugauuacuguggugagggauagcugccugacagcaaaggugaggggagggagaaggaaauauaaauuaacaaaagacacgaaauaaauacagcagucaggagccauuuauuauggagacaaacaggcuggucucgaacuccuggccucaagugaccugcccgccucugccucccaaaguucugggauuacaaguaugagccaucgugcccugccaaauuuaccaaaguuauacguggacguuguuuuacaagggcuguuacaaaaaaccaguagacgccucucccccagcccauuuccugcucuccagaguuaaccacugaagucuugcaguaguuuauacaucuagucucuaaaugacacauuuauauuucuguggucaguuuuucaguuuuagucauuaucuauugauacuuuauuacagaaguagagaauuuagcucauugcuccauccaccccugccacaaguauaccauuuucaucuccucuuucuuaccugaguuuguucauuuguuccuacguuuguuuguucauucuuuccuuccccuacuuaacaauuuauuuuuaaaaaaacuacuuuaugggagguauuauugacagauaaaaagucuguacauauuuaauguauacaucuugaugaauuuggggauaauuauucacccaugaaaccaucgccaccaucaaggccauaaauguauccaucaccucccaagguuuuauccugccuguuuuauuauuauugcauuuuugugugugugugguaagaacaauuaacacuggaucuaucuucuuagcagauuuucaguauauaauacaguauuauuagcuauagacacuauacuguauaauagcuuuucagaacuuauuuauuuugcauaacugaaacuuguucucuuuaacuaugaccuucccauuucccccuccucccagucccuggcaaccaucauucugcucucugcuucugggaguuugaguuacuuuuuuuuaaauuaaaauuuuuucuuuuagaaacaagaucuuacuccgcugcccgggcuggagugcagugacgugaucauagcucacugcagccuugaagucauaggcucaagcaauugucgcgccucagccucuugaguagcuggggcuacaggaguggccaccaugcuuggagaguuugacauuuuagauucuauauauuaaauauaugggagaucacauaguauuuuucuuuaugugucuggcuuauuuaacuuaguauaauaucuuccaccuaucuguauugucacagguggcaggauuuauuucuuuuuuaaggcugaauacuuuuucauuguauguauagaccacauuuucuucauucauucauugucaguggacauugagguuguuucuaagucuuggcuauugugaauaaugcugcagugaacaugggaguacagauaucacuuagaaauccugauuucaauucuuucagauguauuauacccagaaguaggauugccaaauccuaugguauucuauuuaaaaaauuuuugaaaacauuuuuuuaaagaagcuccauaauguuuuccauaguggcuguaccaauuuguauucccaccaacagcguacaagguucccuuuucuccacauccuugccaacacuuaucucuuguuuuuuuuuuuuuuuuuuuuuuaauuagccauccuagcagaugugagguaaucaaaaucauugugguuuugauuugcauuucucugcugauuagugaugucgagcacuuuuucauauacuuguugaccauuuuuaauguauucuuugaaaaaaugucuauucaggucuuucgcccauuaaauuuuuuuuucuuuuggggguuguuuuuuugguauucaguaguaugagguucuuguauauuuuggauauuaaccccugaucagauuuaccuuuuuuucccuucuauagguugccuuuucuuucuuucuuuuuuuuugagguggagugucauucugucaccuggcuggaguucaauggcacaaccucugcucacugcaaccucugccuccaggcucaagugauucucgugccucagccucccgaguagccaggauuacaggugcccaccaccgugcccagcuaauuuuuguauuuuuaguagagaugggguuuugccauguuggucaggcugguuucaaacuccugcccucaagugaucugcccucuuuggguucccaaacugcugggauuauaggugugagccaccaugcccggccaguugccuuuccauuuuguuguuuccuuugcugugcagcagcuuuaguuugauguaaucccacuuuuuuuugucuuuuuuuuuuuguuguuguuagauggagucucacucugucacccaggcuggagugcaauggagcaaucucgacucacugcaaccucugccuccuggguucaagugauucuccugccucauccucccaaguagcugggauuacaggugugcaccaccaugccccaguuaauguuuguauuuuuaguggagacgggcuuuuaccauguuggccaggcuggucuugaacucgugaccucaagugauccaccuacuuuggccuuccaaaguccugggauuacaggcgugagccacugcgcccgacuggauuauuuagaguaucucuuauuauucuuuguaccucugugguaucaguuguaacaccucuuauuucauuuauaauuuuauuuauuugaguuuuuacucuuuuuuuuagacuagcuaaaguuuugucugucucucucuauacauauauauauauauauauauauauauauauaauuuauuuauuuuuuuaaggacggauucuugcugugucacccaggcuggagugcaguggugcaaucucagcucacugcaacuucugcuucccagguucaagugauucuccugcuucagccucccaagcagcugggauuacaggcaccugccaccacgccuggcuaauuuuuguguuuuuaauagaaacgggguuuugccauguuggucaggcuggucucaaacuccugaccucagguuauacgcacgccuuggccucccaaagugcugggauuacaggcaugaaccaccgcacccagccaguuuugucaauuuuguuuauuuuuucaaaaaacagucuuaguuuuauucaucuuuucuuucuuuucuguuuuuuuggucucuauuucauuuuggcuccaauuuuuauuauuucauucuuucuucuaauuuugggcuuaguuuguuaccuuuuuucuaguuuguugcaguauaaacuuagguuguuuacuggagaucuuucuuuuuucuuaauggaggcauuuaucgcuguaaacuucccucuuaaaacugcuucuccugaauccccuaaaauuuugauguguuguauucuauuuucauguaucucaagauuuaaaaaaaauuccuuuugauuuuauuuggcccauuggcuguucaggauuauguuacuaaauuuccacagauuugugaauuuuucaguuuucuuccuguuauugauuucuaguuacauaucgguguggucagaaaagauaauuaauaugauuucgaucgucuuaaauuuguugagacuuguuuuguggccuacuguauguucuauccggaagaauauuccacgugcgcuugagaagaauguauauucuccucuaguuggauagaaaguucuguaugugccuguuaauuccauuuguucuauaauguuguucagaucugccauuuccuuauugauuuucuaucuggaugaucuguucauuguugaaaacaggguauucaaaucccuuacuauuauuguaugguuaucuauuucucuuuucaguuugguuaauauuugcuuuauauauuuaggugcuuugauguugggugccuacauguuuacaacuguuauaucugcuugaugaauucaccuccuugucaccacauaacuaccuucuuagucucuugggacuguuuuuuacuugaagucuauucugauauaaguauagucaccccugcuuucuuuugguuuccauuugcaugaaauauuuuuuuccaucccuuuacuuccagucugucugcccuuaaaucuaaagcaacucucuuucaggcagcaaauaauuguaucuuauuuuuuauauauauucugucauucuaugucuuuuauuuuuuauuuuuauuuuuauuuuuuuuuuuuugagauggagucucgcucugucgcccaggcuggagugcaguggcgcgaucuuggcucacugcaaccuccgccucccggguucaagcaauucucaugccucagccucccuaguagcugggaucacaggugcccuccaccaugccuggcuaauuuuuuuguauuuuuaguagagauggaguuucaccacauuggcuaggcugguuuugaacuucugaccucaagugaucugcccgccuuggccucccaaagugcuaggauuacaggcuugagccaccgugcccaaccucuaugucuuucaguuggagaauguaauacauuuacauuuaaaguaauuaucgauagauagggacuuacuaugccauuuuguucauuauuuucuauuugguaguucguucuuucuuuucuucuucucuuggugugcugagcugcuuuuuaagcagaugaccaccauucugucuguuuugagucccuauguuacugucccccaaauuccagaaguuuugggguucugaaucccugagacuuucuggagauucugugaugaguuccuucuuggauuucccuacuggcagauaaagagucagcuuuccgaggucugcuaaucaguuaccucuaguccaucuacucuguagcuucuaccauuuuguugcuuccacuaccugaucuuuguccuugugaguuuaugucuaaaagaaauaaaacauucuuuauugcuauauuagugagauuuugggaggcagcagaaccacauguacauguugagcaugccaucuuuauucugaagucugaaagauauuuuagaaagcuuucaauacaaaagcauccaaaaaagguuuuguugcuuuaagcagacuaugaaaauugguauugucauaauuuuacuugcuauucaaauuauaguuccagaguuaggaauguuaguauuaccugggcaucaccugggugcuuacuaggagaaauacagacuccugagcccccuacaggauuuuuuuuguuuguuuuuguuuuuuugagacggagucucacucugucacccaagcuggagugcauuggugcgaucucggcccacugcaagcuccgccucccggguucacggcauucuccugccucagccucccggguagcugggacuacaggcgcccgccaccacaccuggcuaauuuuuuuguauuuuuaguagagacgggguuucaccguguuagccaggauggucucgaucucccccuacaggaauauugaaucagaauuagcauuuugaaagaucccuaggagauuccuauauauccugaugguugagaagugcuaauaugaacuuguaauuaaaggaagcuaacucuaaugaauuuuaaucugggauuuaaaaaucuggauacauuuucuuacuaaauuguucucaaaauucucgagguugcugugugauauaaaaaagaaagaggugcauuuucaugagauuuucgucaggugugaaacgaaaauuccauuucauuuaccaugagaagagaugucagacugguugugcucagacuuuucuuaguugcccacaguucuugaggccgguggugguuuuuuuagauuggacagauugagucuucagucacacguugagcugccauaaugaaagcguagcuucuccuagaggcaagggauagauugauuaguucuauguccgacauuucacccaauaauucauaagugcucaauaagugauuguggggugaaugaacaaaaaacaagauacaaccccugucuucaagauugucacaaagcaacagcaaagaccaagaaauaaauugaauaauuagcauacaggggugaccauuucuagaaacaguaagcacagggaagguguauccagcucagcauugcuggcacaaggagccaaggagcugauucucuuagugaacagaacuugguggauuuacagcagcagcucucacacuuuaguguguaucagaaucaccuggagugcuuguugaaccacagacaccugugcccuauccucagaauuucugauucagcugggugggcccaagaaugugcaaaucuaauaaguuccuagaagaugcuauaauacuggucuuggaaccacaguuugagaaccacuuaacuuagcgaauuauaaaacguacugauggcuggacucuagcagcuuauaggaaggaggcggugauacugaaggcagaagcuuaaggagcagggauuuuauuguggagauuguggggagccauuaacaggagagugauggacucucauuugccuuuuggaaagaucacuuugggugugguguggaggauggaucagagucaagaauacguggggaccagaaaaccaaauaagugguuuauuauagccaucuaagaaauaauaaaaacuuggaguaggagcaagaagaugaauauccuuaggacuugguggccaauuggaagugggaggggcagagagggaggaguuaaugagagccaucagauuucuggcuguguugggauugugugauucaagacacaggaagagaaguggguuugaagcaagguuguggagaaaagcaaaggaggugaguacgggacaugcuggauuugagaugccagcaagauaucuggguggacucccuuguaggcaguuuuacuuaugaaauuggaggccagcugcaaggucugguaaguaaucuagccccaucccuccugccacuuccauuugaucccccauauuguuuguuuggaucaggcauuguauuuguaagcaacaauaugaauauaaccuuuaagggccuugagaauacaaggcacuuucucaagaaaacaaauguucuacuguuuugauucacgggguaggugggcggaagaaagagcugaagugcagagucuucuaacaccagaagagguuaauaaagccgcccucugaguggccagucgaacuggaacuugguaagcuugaaaggggcaaaaaucacuugacuggucugcagugccauaugacaaacagcugagacuaauuagcuggauuguggguuuuuacagcgaugccuguuuugaaaguugauggagcgaacugcuuuuccaaagacucuuuugaaaaacuuuuuaaguaggccauucugacuuuaacauuucucuuugucuuaacauuagacaaaaaguaaccuuccugaagaggacaugugauuggaaguugucaauuguugaagcauugguaacuccagucucuaacguuuuagaaaaucauaacaagcgguucucuacccuguaaagguaugguuuuguauuuaucuuuuuuuuuuuugguagugguuuugagcucugucaugucaauuuucaugcgcuuaaauuaugugcaauauaacauacaauaccauugcacguacuguuuuuaaacuaaagacuuaaugaugucuacuaaauuucuugggauuaguuugaaaagugcauuuucagugaccacggaguggguaugaauacugaccgcauucuuccuuucuuuucuguacuugaauaaagaaacauagguuuuuacuuucaggaaauuguugaauaugagagcugauuaggaaauugaauuauucugagagucuugcuuauccucugaggguuguuugacaaaaauucaagcuuauugguguuuuguuuuugauaguauuaauagcuuuuguuuuguuuuguuuuguuuuuuaaauuugagacagagucuugcucugucgcccaggcuugagugcagugguacaaucucgggucacugcaaccucugccucccaggaucaagugauucuccugccucagcauccugaguagcugggaccccacgcuaccaugccuggcuaauuuuuguauuuuuaguagagaugggguuucaccauguuggccagccugcuuucuaacuccugaccucaagugaucuucccaccugggccucccaaagugcugggauuacaggcaugagccaccgugcccggccuaaaaguguuaauaguuuuaauggaggaauguaaguguguguuuuaguauaagguuuauuucuucugggaauuaaaucugcuuuuaaauuaguguuaauucuguuagguuugauaaggguauuguuauguaaggaaauguccauauauuuuagaaauacgaaaugaaguaugccggagugaaagaucugaguggugagugugaugggagauuucauuauauaauucuacuucuggauauuguauuaguuuacuagagcugccauaacaaaguaccauaaacuggguggcuuuaaaacugugugauuucaaaaacagaaauuuauugccucacaguucuggagccugaaagucuaagaucaagaugucagcgggguuggucccuuuugaggacugugagggagaauccguuccaggccuuucugcuuagcuguggauggcugucuucucccuaugucucuucaugccauccucccuguguucaugucugugaucccaguuccuuucuugugaagagaccaugaggguggauuaggacccacccuaaugaccucuuuuuaacuugauucccucuauaaagguccuagcuccaaaaaacauuguauucugagguacugggaguuagggcuucaacaugugaauuuuagggggacacaauucaauccauaaccgacaugucugaaaagcuucuuaauaugacauuuuaaagauuugccucaaaaugcaugcaguaaacauuuguuaagcccagugccuggacugggcuggauuuugagugugugaagaugcauaagacaugguuccugucuacuaacccaugguuuaaucaaauauagggaucuagcuuugugaguguguacguguuuacuuauugcuuccauugaguuguagccacucucacacuugugugucccugggagcacaaucaggguccugacacauggacagccuaaccacaagagacaccuggaaggguucccgugcucugagcacccauaagcauagauuaagagaguggaaggacuucauauucacccaguccauucuucucauuuuacagaugaagaaauugaggcucagaagugcuaaagucauuugcuaauuuguauuagugccaaggcauccuucagaauauccuggcuuccauuccaguguggugaccaaacaauacuguuuucuuugccacaaacucaugcuuuucaccugggaaugaaccccaacccccauuaucagaagucauugugggaaagagccuugauaaaaagcugacauucucugucaagguucuuggauuauaaauaccaaaaaaaaaaaaaagauguuuuggggaugaguguuuauucaugagggcauuuuauccauagaaugaaguuggauuuaauacauuccaaaggaguuuacccccaucuuggcugcucucucugucucuuaccacuuucuccuugucacuuguugaaauaguuaagucacagagguaugacccugcagccauaagaauacaaacaaccauuuuucuucuuucuuggugcuucugcugcccacaagacaggaacuguggcagaaagggaacggucuggugaaaucuugcuggcuggcaggauggcgucacggcaacuaggcugccucucucugcggcuguuucagcuuccgcccucucuggacccucgguaccugagugcucauaggggaaacugucuucuuccugccuccauuucuguuuuuccucaguaggauuaaggcuucuugagauaucugcucaucuuuugcuauuauuccuuucuucucccuuugaacuuguuugauuuagagccagagcucaggcuauagcauacgugauagcugaugagucaugugaagcccauuaaaagcaaaagcugauuaucacaagaaccauuauuuauuugcgcugucuaugcaacagcacauuuucuuuugcgcuucugguguugcugcagcguggcuggggcccugcccucuuggcagagcagagguccugugguguaggcuggggggcagguaggggaagugggugauggaugagauggggugcugcuugagaaaugagcuaucuuugcugcugcuucucugaaggcagaaucugcuuugcucaaacacggguauaaaucauccuuucaagagcugagagcauccauuuuuguuuguuuuucuuguuuuccccguuucauacccuaucaggccuccuuucuugaugacauagucuaagcuggaaucuuuuagcuaucuuuuagcuagaugguaaauccagcaaauagcucaaugauaaguccauucauccagcaaacagugaauggauuugccauuuucacacggagaaggcccagaccacuucaaguuuguaccucugugguguggcaacugagccagccuguggacaaucacugcuugaaaaaucuccuuccuaguguccuucuuguaucugucuugcugcuccuuacauuuuuguucucucuucacucuaaauguccaucucauuuuucccauggccuaaggaaauacuauuauguugaugacacuaaaauucauagccauauucuucuugugagcccuaggucuguuuuccaaaugcaaauuaaacacaacucccuugaugucccucagacaugagagauguuuaacugguuguguaccguacaguguaaugugguaguugagagugugucugagaucacaucuugguucugccauuucuggcugugugaccuugggcaacuuuauuaaccuuucugugcauugguauuuuucaucuguagauuuagggaccuuauacgguuguugugaagacuaaaugaguuagugcuuuaaaggauuuagaauagugcuuaguguuaguuauaauaauuaucaucuucucaaaccaucuuuuccuuuuucaguuaauguuauaccauuuauuuaccaaacuaaaaguuuugguuaucuuuaauuucuauacuagucuguuaagaaguuauauugauuucuaccuccuaaauauaucucaaauuaaucacuucuucuucaucccuacugucaccaacacaauucaaacccucaaaaucucucuccauaugucuuaaccaguucaaacuguuauaacaaaguaccauagacuggauagcuugcaaacaacggaaauuuauuccucauuguucuagaggcugaaagucugagaucaggguaucagcaugcucagauuuuggugagagcucucuuccagguugcagacacuugacuuuucacuguauucucacaaggcagaaagguagcucucuggccucuucuuauaggggcacuaauccccuucaugaaggaucuauccucaaaaccuaauuacuucccaaagaccugccuccuuauaccaucacauuggggauuagauuucaacauacaaauuuuggggagacacaaacauucagucgguaacauuagagccuucugaugcucuguguauuuccagucuccauguggcugccauagagaucuuucuaaggcacacaucucaugguccucuccugcauaaagagcccgugguggccuucuguugcccagaggauaacacacaaacuuuuuagugccaugucacaguccuuuuagacccaggucucaaacacuuucccauguuuucagccucuguucuggauacauucuccccuaccuccaugcaucccuucagccacauccacugcugaaguccuuuaaugcauccuaaguaaccuuagccucuuacaccuuugcaagcgcaaacccucaaacccuuaccugcccgcaucagucagcccaagauguguucccuccugacgguucgaaaccuggucuuuuuuuuuuuuuuaauuuugagcaucaggcauuccuuaccaaauuccaucaaaacucaguuacauguuuuggauuggcaucaagaauuauuugcuuauaguuucuguuaucuugaaaggauaaugcuuauuuggcugacaugugagguaaagucguuccccacauuaucuagugcacuguguaauuuuuguccauucacaucugucacuuguccuuaugugugccuguacacucacauucugacuuuaguccuuagcucagaugccccugugugaaguuuuucugauucccuccuuagacauugugggcuccuucuucucccucuugugcuaucuccccagcccucccaucuccccaacggcuugugcauacuucuguuacaguucuucuucuucuucuuuuuuucuuugagacagaguuuuacucuugucgcccaggcuggagugcaaugugcgaucucggcuggcugcaaccuccgccuccuggguucaaauguuucuccugccucagccucccaaguagcugggauuacaggcaugcgccgccacgcccggcuaauuuuguauuuuuaguagagaugggguuucaccauguuggucaggcuggucuugaacucucaaccccaggugauccgcccaccucggccucccaaagugcuaggauuacaggcaugagccaccaugccgggcccuauaguucuuguuuccaugcauuuuccuugggcauuuccacaaacagcuuaccuauuagacuguugcucuucuagagccacauucuuggugcuuaacauaguggcacauccacaauucuuguuuguuagauguuuaauugaugugcucaugagcuacugcuuaaaugacugaaugaauuucagucauuuaaaccaggcucucucccuccucaguggcaucaagcuuuacuaguauaucuuuggaucauugguggaggccaauuuacuuaucaaaccucauuuaaaauuauuaacagauuuuggagagguauauguaugcuauucugcauuuaacuucuguuauauuugaaguacauuuaauauauauuuuuugggaaauacuuuccuauguguugugaacacuacaacccuuucccacauccuccuaugcuucguaauuuugauaauuucacauuugucauuugagccaaguuuauuuuucucuaaaacagcuuaaaauuucuguuaaaaaacagauccccaucuauucuagcuuauagagguuggaaaaauguuuaaaaucuaaacgugauuaaagguuuguagaaaucacaaaauaaagauuuuggcugggcacaguggcucacacccaaaguaaucccaguacuuugggaggccgaggccggcugaucaccuaaggucaagaguuugagaccagccugggcaacauggcgaaacccugucuauacuaaaaauagaaaaauuaaccggaugugguggugcaugccuguacucccaacuacuugggaggcugaggcaugagaaucaccugaauccagaggcagagguugcaaugagccaagaucggaccacugcacuccaacuccagccugggugacagagugagacucuugucucaaaaaacaaaaacaaacaaacaaacagaaaaaauaacccuggcuauaguugagagacucuuuggagucagguguggacuaaauguuguauucucuuacgauguuuaaugugguuuuuuguaagacuaaagacuccagaauucuguuacagaguuguuugcugauuuguuucuuuuguguaagugcccuuuucauuucuagaucaugguuacucuaacaucguuccucaaauauaugcauuucauggaguuaaaugaaauacagacuuuaggacaauuaaacagacuaauggaaaaacuuggcaaaguuuuuuuaaguggguccuaaauuauuagcuagaauucagaaauuuggguucggcuucuuuaauuuuaaaauuaagaagagacaugggcuggccucuuuaacauacaguguugaauuacagaaugcauaaacguuauuccuugucucucuucagauacuuggcauuuuuauaaucuagugcccuacuuucuagguauuaaaugggggaacccaagugcuaguaguuaaaauuaaauauaguacuguguucaaaagaaaauucggaugauagcuaaugcauuuucgauguuucucuagagggugaaacaccauuucuguuuaaagcauucuacuauaauucuuccucuagugacugcaucucaaguaacuuuuuuuuuuaagcccaagacgggagcgacuuauauaaauguaauauggcacauuugaagacugguuuuggguaaggucaccucaaggaccuggcaccuauuagguauuucacuuuuuagccauucaaauauuuauuaauuacccugagaacuaccucccuuugcucuccccuacccccuggcgaaugcaaaaggaagaaacagaauuacuuugaaagagaaauucuagguagaaaguaugagaaaagagcagaaaccaggaaagugagagaagaagcuagaagaaaggaaagaaaaauaucaaaggcggaauaaauauaaaagcugguaaauuaacagauuaagggaaaaaaguagcagucuccuugauacaugcugaaacaaaaugugauaaaguugacacccauucauaauacucguacuuagcaaacuaggauagaugaacuuccuugaccugauaaaaauauguaccaaaaaucuacagcaaaugucauucuuaacagugaaauguuagaaucaagacaugacgagacugggcugggcgugguggcucacaccuauaaucccagcacuuuagaaggcugaggcagguggguggcuugagcccaggaguuccagaccagccuggacaagggaggcuggggcgggacagucaccugagccugggaggccgaggcugcagugagcugugauugugccauugcacuccagccuggacaacagagugagaucuugucucaaaaaaaaacaaaaaaaaagaaaaaaaagagauaagacuaccuguaucaccaugucuauucacuguuuuuuuguuuuguuuuguucuuaccuauuuuuuuuuuuucuuugagucagagucucacucuguugcccaggcuggagugcaguggcgugaucucggcucacugcaagcucugccucccggguucacgccauucuccugccucagccucccgaguaccugagacuacaggugccuaccaccacgcccggcuaauuuuuuuguauuuugaguagagacgagguuucacuguguuagccaggauggucuggaucuccugacauugugauucgcccaccuuggccucccaaauugcuaggauuacaugcaugagccaccgcgccuggccgacuuuuuauaauuagacuaaaagguaagauuagaaaggaagaaguaauuuauuuuuaccuaauauguuuaacagauugcuggaauuaguauggcuauguaagaaauagaagauacauguuuaaaaguuaucacaguagugacaaaaacaaaguaucaauaaguugaaagauguacaauaucuucaugaaaagaguuuauugaaaacuuuuuuuuuuuuuuuugggauggagucucgcccugucacccaggccagagugcaauugugccauuuuggcucacugcaaccucugucuccugaguucaagcaauucuucugccucagccucccgaguagcugggauuacaggugcaugccaccaugcccagcuaauuuuguaucuuuaguagagaugggauugcaccauguuggccaggcugguuuugaacuccugaccucaugauccacccaccucggccuuccaaagugcugggauuacaggcaugagccacugugccuggcccgaaaacuuuucaaaaagaugcuuuuuuuuuuuuuuuuuuuuuuuuuugagaugcagugagugaucucggcucacugcaaccuccgccuccuggguucaagcuauucuucuaccuuagccucccaaguagcugggacuacgggcacacgcccccaagccuagcuaacuuuuuuuuuuuuuuuugguauuuuuaggagagaugggguuucaccguguuggccaggcuggucuugaacuccugaucucauaaucuggcugccuuggcuucccaaagugcugggauuacagguguaagccacaguacccagccaaaaauauucuuuucuuagaguuuauuuauuuauuauuuuuauuuuuuuuugagacagagucuaacucugucacccaggcuggagugcaguggcacgaucauggcucacugaaaccucugcugcccggguuccagcaauucucccaccucagccuccugaguagcugggauuacaggugccugccaccgcgccuggcuaauuuuuauauuuuaguagagauggggguuucaccaucuuggccaggcugguuuugaacuccugaccucgugauccacccgccucggccucccaaagugcugggauuacaggccaccaugagccaccaugccuggccgaguuuuaguuuuuagagcaguuuuagguucacaguaauacugaguagaaaguacaguuuccauauauucccuucccucccaaaccccccaacaugcauagccucccccacuaucaacaucccauaccagagugguacguuuguuacacaugaugaaccucuauugacacauuaucauccaaaguccauaguuuagauuggaguucacucuugguguuguacauucuauggguauguauacaaauguauaaugacaucuaucuauguuauagugucacacaaaauaguuucacugcccuaaaaaucgucuguucucugccuauucaucucuuucacuucccccacuccaaccccuaauaaccacugaucuuuguacuaucuccacaguuuagccuuuccuagaaugccacauaguuggaaucauacagauuggcuucuuucaguuaguaauaugcauuuaagguucuuccauguuuuuucauggcuugauagcucauuucuuuuuagugcugaauaauuuuccauugucugaauguaccacaguuuauuuauccauucaucuacugacgaacaucuuguugcuucugaguucuggcaauuaugaauaaagcugcuauaauaaauaucagugugcagguuuuuguguggacaugaguucucccuucauuuggguaaauaccaaagaaugugauuggauuguacgguaagaguaaguuuagcuuuguaaacaacugccaaacugucuauaacaaagggcuuguaccauuuugcauuccuaccagcaaugaaggagaguucuggguuuccacauccucaccagcauuugauguugucaguguuuuggauuuuggucauucugauagguguauagugauaucucauucuuguuuuaauuugcaauucucuaauaacauaugauauugagcaucuucucauaugcauauuugccauuuguauaucuucuuuugugagauuugagaauauuuuuaaaggcacuaaaaauacguaaauagauggagaaauaugcauguacuuagguagguaaauuaaacaucaugaacaugucaaucuucuuaauuugaucuauagauuuaugugaucccaaugcaaugcaaugcaauuccaauaagaauccccauaugguuuuugaggaacucagauggaaaugugaaggguucauguccuugguaagguggguaccagucguaacagguaugaaguuauauuuuagggucauagugauuaaggcauuguggcacuggcccagggauggucaaaaugaccagcgaaaccaaauguaaagcccugaaacagauccauucauuuauugcauaucacugggcaaaagauaauuuuaugcaauaaauggugcuaugacgauuguauauacuuaagggaaaaauaaugaaauuggaucccuacauauaccuugaauucucaguguauuaaagacuuaaauaaaaaggcaguaucuuuauaaacauaauauaaaagaauaucuuuauugcuuuagauaagaauuucuuggcugggcaugguggcucacaccuguaauccuagcacuuugggaggcugaggugggaggaucacuugagacuaggaguucaagacuagcuugggcaacauagugagaccccaucucuacaaaaaagaaaagaaaauuagcugggcguggcgacucaugcuuguagucccaguuauugggaggcugaggugggaggaucacuugagccugagaaguugaggcuguagugagcuaugauugugccauugcacuggagugagaccgugucuccauuaaaaaaaaaagagacuuucuugauaugauauaaaauaaauaacuauaaaaaagaauaaauuugacuauuuuaagauuaagagccacuaaaaaagugaaaagacaaaccaaaaacaguaagaauauauuugcaacauacauaacuuauaaauaguauccagaauauaugaagaacugcacauccauagaaaaagaaccuggcugggcaugguggcuuaugucuauaaucucagcacuuuggacggccaaggugggcggaucacuugccgcuaggaguucgagaccagccuggcuaacaugggaaaaccccaucucuacaaaaauuagccagguaugguggugcgugcuuguagccccagcuacuugggaggcugagggaugagaaucacuugaaugcaggaggcagagguugcagugagaugagauugugccauugcacaccagccugggcaacggagcgagacucugucuuaaagaaaaagaacccaauagaaaaauaggagaaagauacaaaugugcauuuuaauaagaggaaacuagauggccaagaaacuaauaaaagaugcucacacucauuagcacucagagaaaugugaauuuagaucacaauguguuaccauuuugagaagucugacaacaagcaccaaauguuggugaagauaugaaguugggaguguaaaacaacuauauuggacagcaauuugacauuaucuuguauuacugaacaugugugcauagguauagcccaggaauuucacgcuuugacgccuacccuagaggaggugacucccccuggugugcacugaauugguucagauguguugagauguugaacccuuugucccucaggguggcuggacagggccuggccuuucuggggcccuaaaaccuauugccuuugaucaagagcauaugcccugguaggucauacaaauaucaugaacaagguuggaaagcaauuuucuagagaaacucuugcuggugugcauuaggagacaggcacauacauauagcaguguuaagugagaccaaaaacaggauagaccugguauagguagugaauucuucuucuaggaaaacacagagacauuaaguaauuagauaaggguaauaagagaaggguucuaaccucuuauuucuuagugucagugguuucaaggagagugagaggugcagagaaggagcuggaggaaagugauacuacaacuccuccucacuguguguuuccuuuuuuuuuuuuuuuuuuuugagacugagucucgcuguaucgcccaggcuggagugcaguggugcgaucucagcucacugcaaccugcgccucccagguucaagcaauucucgugccucagccuggagugcaguggcaugaucucagcucacuguaaccuuugccucccagguucaagcaauucucaugccuuagccuccugaguagccgggauuauaggugcccaccugcacgccuggcuaauuuuuguauuuuuaguagagacaggguuuuaccacguuggccaggcuggucucgaucucuugaccucaggugauccgccagcuuuggccugccaaagugcugggauuacaggcgugagccaccaugcccagccaguguguguuuucauugagauacauucagaugggugguggaugaugaugggcaaggccuaaguuuggaaucugaggaggugccuauugcaggcuccuaagaggagugaaugcugugcaggacaucuagcugucuucccugacauuuccuuuuuacucacugccagauaaagaacuuuacaacagggagauaguaucuggaaacugaguuuaaucagagcagcagggacugcccaucauguccuguguaauugaguuuggcugagagcacccugcuguuauccuuggucuuguucauccugaacuaacagcauguucccucuucuguggcuuguacagucauggcccucuuuuuggagcuuucacuguuggcuacucugccucugucucaagggcagagguaaaugugggccacagggacuggggaugauuuucaagcauuucuuggucauguggcuuugaugaucucucaugcugaaccugccccgauccaaucucaucauccuucccuuccaaaaaucugauaccacccacaaacaccuuaugcccauuccaacucuuucccuuccccacuucaaauguccugcuucuguuggcaacauuauuuuggccuccuggcccccuaggcuuuauucuuugguguucucuuugcuguguccuuuuccaccugauguggaacucuguucuauuauuuuaaaauuaguguaucuuggauccccuucuucccauucccaugcggcugcccucaucuaggcucucaucuucaaggagugagaggugauagaagggacaacugucaccaugaccccacuuaaauuucucaugacuaagcuuugaacuuugaaccuggaaucauacagcauagaaugucuguguuggaaagagaccauuguggucaaaccucuuauuucauauuugauaaaacaaggccugcagagggauggugaccuauccugggucuaaacagaugguggcagaggaaccccauauaccaauggauuagucguccugcucuccucaauuugucacauuaccucauaagcauuccuuugaguuuacagccaguuuuguacuuagaggauuauaucugaggcacauuuguauccuuugaaaugauuagcaagccuccucaauacuuguuaaauugaagucaaaacaugcccuugcaugaaacaugcuguguauccuauucuucacuaucuagcuaaaucuugccuggcuuugaagaaggugcucagcucagguccuggcucuugcuuugagucacggucagauugcucccucuuucuuucuuuuuuugagacagggucucacucugucacccaggcuggaguguggugacauagucauggcucacugcagccuugaacucuugggcucaagugauccucccaccucagccuucugaguagccgggacuacuggcacaggccaccucaccuugcuaauuaaaaaaauuuuuguacaacagcaucucauuauguugcccagguugguuuugaucucuugggcucaagugauccuccuaccucagucucuugaauaggugggauuacagguaugagccuccaugcccgacagauugcuccccuuuucugaccucccagccucuacuugacuuguaaaacaacgaucuuacauguacccaguaguuuacaguuuauaaaaugcauuucacauaauguacccuuuaauccuuccaauaaucuugcuagauaaauauucccauauugaggaaacaguguggggaagcugucuggcucaccacaggacacauagcuaggaaggaaguagcagaguucaggucuuuugacuugaagccccuuucacuuuugauuucuugugcuggcuggugcacaugguguaccagacguuuuucucccugauaauauugucuuauccguccuuuuucguaaaugaguacaucauuccaccucacccuaauuaccaacuucuugaagggagcaguuggauccuguguuucuuucaugccauucguaguugcuagcaccguacuggaaagguaguaauugcuuaccaaauacuguugaauuggauguaaauaugguuuaauuaucaaaaaagcacagcuaucaguggaguccccaaacacuuuuugagucacuucuaaauaaaauuggcagggaauggagggaaccagcggaaggaaaaggcuauuagagaaagcagaugauagacacaauuagcauuugagugacagcuggccaguugucuguccaguggugagggguaguggagaagcaauacacaaaaugagacucuucaggaaauaugcaacuguaccaaagagaugaaacacacccaugaggugggaauggaguacuuaaaaguggcagaugaccuguacaaguuagccaaagcauucauucauauuaauaaacauugauuaaaggaauaccccgaggaggauggauuuaugagaacaggcuuccagggugagaguggaagggauagaguugcaguuugguuucaguuugugaucauucuguuaauuacuggaaccaggagaaaagagacauaaguaggugaggauguugccguugaaacaacuuucucuucccuuucuuauacuaugugcagucaauaggaccucagcccugagcccuggcagucagaagugaaggaaagacaaauaauugcucaugucaucugugcauagagguguguagugaugagcaacuugcuggauuuucugguacugccuccuuuaacguauuuuugugcauuuucuucauaaaucaaagagaugcuuuaaaaguucuaauacuuggacaacuaaauuguguuuccaacucugccuuuucccaaaagggucacaaaaauccauagacauaagccgcagauuuugguuuggaaagucaugcugcauuuuaucuuuauguuugggcugcucccgaguucauaaauauuuugugccugaaagaaauguaaaaccccuuccacuguaauauaugugaaaaauguccaauuucuuaauaguagaagccaaacauuuucuuuugugaguuucugucuccuacagagaacauaagauggagggcuuuuagauuagaaguaauagaauuuuaauaucuguuccuuccugucucagaauuuuucacaguuuauaaguauauuauaagagcuaaaggaauguauaucuaaaaugcuuacaagcaucagaaauuaauggaaauuauuucaaauuaauuaaaaauuauaauuuuuauacaaaauaauuuuaucauguuguaugcuguagauucuaaaagaaaaauaaaaaacuuuuauuucuuagacauucauaugugguuuuaaagugauauaucuaggaaaauagauuaguaccauugaggccuauuguuagauguguugguuuauuuuuaaugcuugauggcuauauagcaauuauauuuuuuaugugauaagcaaguauguauaggaaaguaauaacuuaaaaggaaugucauuauaauauuucuuucuuuaaaaaauaggaagguauuucucgaggucaaaacucaacuuacaaaccuugcagccaaauuuguugguauauaaagucuaacuuuauacuuuaaaauguggacauacuaaaaugugauuguagaauuaugagauugauuuucaugugugacuucugaaaccuuuuuuacuacuuuacaguuaucucucaugcagaaucucauuucaaccucauuuaaaaaauuaaguguacuguuacuuguuuuugugauuuccccugaacacucaaacauaguuucugaagacuuacuuauuacuuaucaauuauccauguuauaaacacguggauacuuacaucuucaugguuuaugcugcucuugucuacaauuuccuuuauccucuugcguuguucucuugcugauucauagucucuuugcuaacacaaagucuuuauuucuguguuaguaaaucuguauugagguuuauuccccgacucuuuuuuuuuuuuaaacaaggcucuuguucuuucugagucacccucuugccugcuuauuuuagcccuuauguucuuaaccucuaggcuucaaauaucuuucucagaggcauguuaagaaaauaggagcuuuguuuccauagauggccuuauccugggcuuagcugaggacagagacaagguauggccuugggggacuaaguucuaaccuggaugcuuggcuuuccaucugccuagguaggaaaacgaaacuuagugaaggaaccuaguuggaauacuuagggagccuuucuuuuuuuuuuuccuuugagacggagucucgcucugucacccaggcuggagugcgguggcacgaucuuggcucacugcaaccucugccucccugguucaagcgauucuccugccuuagccucugggguagcuggaauuauaggcacccgccaccgugcccggcuaauuuuuguauuuuuaguagagauggguuucaccauguuggccaggcuggucucgaauaccugaccucaggugaucugucagccuuggcuuuccaaagugcugggauuauaggcaugagccaccacgccuggccauuagggagccuuucuuucuuuuuuuuuuuuucagagacagagucuugcucugucacccaggcuggagugcaguggcacgaucuuggcucacugcaaccuccgccuccuggguucaagugauucuacugccucagccuccugaguagcugggauuacaggcacaugccaccaugcccaacuaauuuuuguaauuuuaguagggcugggguuucaccauguuggccagcuggucucgaucucuugaccucgugauccacccgccuuggccucccaaagugcugggauuacaggugugagccaccgcgcccggccagggagccuuucaaacugguuggcagaguagaggaaagcaaguugauugaauaaauugcuguaacuuagaagguuagaacauuucucuggcuuuugauaaagcaacaacuacuaugggucuuuuuuuuuguauauagauagauagauacguauaucuguaucuaucugucugucugucugucuaucaaucaauagcuuuugggguuuuuggcugcauggaugaauuauuauuuuauucuguacguuuuuuugagauggaaucucacucugucgcccaggcuggaguacaguagugcgaucuuggcucacugcagcuuccgccucccagguucaagccauucucgugccucagccuucagaguagcuaggauuacaggcacguguccccacgccuagcuaauuuuuguauuuuuuaguagagaugggguuuccccauguuggccaggcuguugaacuccuggccucaagugauccaccugccuuggccugccaaagugcugggauuacaagugugagccacuguauccagccacuuggaugaauaauauagugguaaauuccgagauuuuagugcacccaucaccugaauaguguacauuguacccaauauguaguuuuuauaucccucaccacccucccccggucuuuucuagcuacuguugcugugggcucuaaugaacuguguugucugcccagauguccucuugaauucuuggaaugcugaccuccaagacucccagauccauaaacuacucuuccccuuuguugaccugcuccuuagucucuugguguuugaccuugguaugacuuugaacaccugucugaaaacucccuuuguacuuaaucccuguggguuggaguugauuuugugcugccuugacaugaagccagguagggagugcuagggguuucucuguccccucuaccucaugccgcuuucuccuucccuggaacuuuguaaugguuucaagcaaggguacuuucauguaaaacacuccucaugacacagacauuagcugagccuaauacuagaaauuucuucugaauucauagaaagaaaaugaaguuaguagagaaaaucugaacuuuuacuuugaucaguauuuuaaaaaauuuuuguaccucuuuauucccuucugugcuauaauuuaguauaaaguggcuucugauacagcacaaaauaauauauucucaguuaucuuaaaguugcuauaccaacauuucauuguguucuucaaaccacaucuugacuuuugaggguucauccauauauagauuuuugagcccaucaggacuaaucuggucauauuuucugauggccucaaaguguccauuuagauacaagaaaggaucaccaauguagcugguuacagacauccucccugcaguuuucucucuugccccuuuaaggacaccaguuuccuaucccauggucgaugcugcuucuuugguugccuuuugggcaguuuggccucgauuuuuccaggacucauuuccaggacccuuuccccaggaaugacgcaaugaugguuguucucaagacucuuccuauggucuucuuucauucucuuaagcuuuaaauagcuccucuugcaguucucaccagggacacccaaagcauuucaaaucccucccagauaagaaguguguuaaggugauaucugagagguggcaucuuuaggagacgcugaauaaaagaguguggcagaucuuacaaaugagcugucaacugaagugguuaggcagagaggaaguguuuagggacaaagccaaaggcaaaugagacgauucagagcugcauuguagguagaccuuucugcaaugauuuucuaaauguguacagugagauucuucuuauguccuuguugggucuaugggcguuggugucuugaccuucacuccuuucauuagaauaucacucugcugccaucuguuuuauauguuggggugccauguaagauuuuauuugaagaaacaguuuuauugcuaaagaaaguuugcaaccagcugggccagagcaguuuucugaggcaaugaaagguuuguugcaaugacauuauguagguuuccuaugcaggaacugacugugaagacacucaucugcuaugaaaaagaaguagcccaaacccagaauagcccuuucaugcuucuagaagucagacaacaaacuucccaaagaauaaucucuauagugaucuguaauaaaauguugugaugcaacauguuguguucauucuuuauugcucaauugacuguuguaacaggaugaaagcaaacaucugcugaaacaugugccugagcuuugacugccguuuacugaauguaguucacauguacuuccuuaaauaauuucacaauagacaaauuaauccauucugauuaagcaaaggagagaagucuagugcaaaguacagucuucucaacuaauaauuauaggaauuccaaauaacauguauacguuaaagguagccauaaauagcuuaacaaaguagcauaaguaaauaacuuggaggucucuaaauuugguauguaacuuauuugacuauauacuuuuuuuuauuccaguuuuuaaaaaacauaauagaaggaguccaggcgcaguggcucaagucuguaaucccagcaccuuggaaggcugagguaggcagaucacuugagaucaggaguuugagaccagccuggccaacauagugaaacgccaucucuacuaaaaaauacaaaaauuagcugggcgugguugcgcaggccuuuagucgcagccacuagggaggcugaggcaugagaauugcuuaaacccgggagguggugguuucagugagcccgagaucaggccacugcacuccggccugggugacagagugagauucugucucaaaaaaacaaaaaacaaacauagaaaaaaaaaucuuaauaaguuuacagaacucuuaaaguauuuucaugaaucccagcguuucauagaaaacagacugaaaagcacaaauuuaaugcuucucugaauaaggacugcaaugcuuguucuuuuauuaugcuuuauauucauccucuuuaagacaugaccuugggcuuauuuucuaaaaaugaauaugaucuaggaguuucaacacaccuuucuuagaaacagaugaaguagcaaaaagauaaauaaggauauaucagaucaaaaaccacaacuaacuagcuugacuagaauguauguaauuuugcauccaacuaacaggguguacagauuguuuucacauaaucguggaacauuuauaaaacuuaauucagcccgggcaugguggcucaugccuguaauuucaccacuuugggaggcugagauaggaggaucacuugagcccaggaguucaggaccagccugggcagcaacauagugacaccuugucuuccaaaaagaauuaaaaagaauuauccauuuuugguggugcauaccugugaucccagcuacuuaggaggcugaggugagaggauugcuuaagcuggggaggucaaggcugcggugagacauaauugcgccagugcacuccagccugggugacagagugagacccugccucuaaauaaauacacuuaauuccucuuaaauuccaccaaauuuguuguuaagcagaccacauuuagugaucacaaugcaauaaaauuagagauggacaacaauaauagcaaaaaagccaacuguaaucugacaggcugaguuagaaacuggcuggauggcugugcauuguuguuccucagucauuuugcauaagcaaacgcaagucacaccccauucuauaaacagcugcugauagaaaugcaaacagucaguucugagacucugcauacugaauaauaggugaaauaaggaaagacuuugagaagcaauaagaaauauaucugauuugaccuuguccauuaggugaguuuccuuuuuuuuugguucaguuaaagaauaugauauuuagggaaacauuuaaacauguguuguaaauauauauuaauggagacaguagacuugacaaauaccaaaaagaccuauauauagcuggcugucuacagcuuauugacaacaaauggaagaagcuaagaauccuggcaucauugauuuagugguauuaaaacaucaggaaaagccuugauuuuucugagccuaguuuaauguuuuuaaaagaacuaaguuggcauauaauaaacauauuuauagauacuaauauuuuaaacacgugaucuauuuguaucagaaugcuaccuuuucauuaacauuauggugaaaccaaaacuggcauaguauuagaaacacuugguuuuccagaauggcucuuuucccauacuuugcaggggaaaaacucuuccugauuggaaaagugggaguaccugaagacacagcagcauuaugaauuuauugaggaggguugaacaccuugaaguugauauagcaacucaguguguuacaagaaaagcacuaauauuguuaguuucaugucacuuuuugcacaugcaaaccggaguuuggcaauaguaccuggagaugagggacaggaaagccaggagaggaagaagacuguagagagguuauggcacccagaugaugguuggaagugaggcuguuggaacacagcauggggugugguaggguggauguuugacuauggaaaugaaaaucagcugugaagagauggaaguccugugugcuuuagcaugccaccauguaccugaagaacauauuccugugggcagagaauguaucugcuuaaaugugauuagugccuguagucugggugaggugaugggcgccuggagucccagcugcuugggaggcugaggcaggagaauggcgugaaccccugaggcagagcuugcagugagcagagauugcgccacugcacucacgccugggccacagagugagagucucaaaaaaaaaaaaaaaaaagugguuagugaggaagaggguguuggguaggcaggacaagggaggcaugaagccauaccuggugccucuuaguagucuuuguaaguaucuaugugucaaauugaugguacucauauucucauuuuguacaaagucaaugauaaaugcgcccgucucuuccccaguuacugccaacucauggauguuugucuaauuguuuuuauuauuuggacagucauguuuaacacgucuggcugcuucuaauucaucauguuucuuggaaggaaagaaguaucauugcuccuucagaaagcaaaggguuugcuuuuugaguuggugcauuucccuaacagauuaacaucuuuccuguguugcagcaaacagaaaacuugaggaaguugagaugcaauaggagagucagucuguguuggucaaaagcuuuccaugcauguuucauguucuaggaagaugagucuugacagauuccuugacacuguuuuuaggucuguguuuugcaacuuggaaauucucuuugcaaugugaaguccuuugagugcuaucugauuuuuuuuuuuucuuuugagugcuaucugauuuguaauucucucaguccuggcugggguagcagugcuaucauuucuauuuuuuucugccuuugagccuugggcccacaaguuugguggcacucugagauaaccaaagcuuuucauuuuaccucuucagagcuuguuaauaccagaauucccuguacuuaccaguuggacuugcagauguucuaccuuccagguagcuuaaguuguuccuccuuuuucauuuucaggaaauauuuccacuccauucuuugauagcuuuaugaagucucagugucauccugaagguagacuggaaaaagccccaggaucagugcucaagccugguuuaagccuuaaucugucauaaucauaagaauagcuaugauucauugaucuucaucaggcauuuugcuguucaguuuguacagguaggaggugguauacuauuauuugaauuuaggagaacuugacuccgaagucuguguuucacugucuucuaugugcucacaaaaagcaaccacucagugggagcauacuuuguagauuuugcacucauuccaaauucuuggagacugcuugcuucuugguggugguaagaggcauguuuagcuauggguugagcagacuuuuggagugucgaguggcuguguccauucugagacugccgucacauuauuugagauauuacuaagcaaaucaaacagccacaccuguuuccacuguacugccuauguuuuaccaaugacauauauucuaugugugcuuuuuuuuuuucuauuacccuauaucuauggagcaagggguacuugucacaaacuauaaguacuauaagacccaguguuuuggugaauuuacuuuccauaaaucucuauaaacauucauauucugauccuggaagagccuugggcaacaaauaaugucuuuuggguaaaugaagucaaugguuucaauaaauuaaaaaaaaaagccgauaucucauuugaguuauugacauuggucuuccagaacguuuucugcuuucaggaaucauuucaacgccucuuguuuccuaacauacaguuguuuguguuauuugccuacuggguuauguuggucacccacugaggugaugguaacauuucagaaauaguugauggauuucugggcuaugacugcuuauuuuuuucuucauccuggucuuucucuuuaagaaaaauuaugaacaucuggaagaugcuguuaaaaaugauguauguuuugguguuuuggaagcauuuauaaauguguauauauauuuauauguauuauauauauaucuauaucauauauauaucuuagacgaagucucacucugucgcccaggcuggagugcaguggcauuaucgcccgugaaccuaccggauucaaguaauucuccugccucacccuccugaguagcugggacuacaggcuaauuguuuuguauuguuaguaaaguaaggguuuugccauguugguuuugaacuccugaccucaagugaucugccugccuuggccucccaaagugcuggaguuacuggcaugagccaccaugcccggcccagaaauguauauuuaauucaacaguauuuacagauaauuuuauuuuuugucugaagaacuugcuauaguggaauaucaccaucugcuagaaguuggucuagcaguuuucuagcaguuggugagggaaauggaauauuccuauguagcaagugcauuuauaaauauuaagccaaaugcuauagaacuuaagaucucaacaguuucuagccaugaacuucucugcugccucaacaucacuguuaaggauggacuuauguuauuauuauaaaauacuguacugauaggaaugcacuuaugaaucuuagguuauaggugaauauaaaaugcaguuaucuaauauucugaauuuagauaaaaucaaacucaucuuuuaauaagaaacaagaaagaaucauauuccuguuuccuucuacuuuucaaagguguuagauuuccacuucucuccgccugagauuuugcacaaacaagaugagcucuuuguuuauaacaucauuuuuuccacucuugacauauuagggagggcgcaaccauaucuacgcacaucuagaccagaaguugagaugaguaaacugcacggaagacauaggcugucuccacuuauggaaaugggguuccugcuauugggcaguaugcaucuugcuuuugaaguggaaguagcuguguuccaccucaggguguaggaauuguaauggucugugagaguuguggccagggcucauuugguaaauacaagugucccuacucauauaucuugguacauuauaaaaugccucuucuagccugccucaugccaugugacuucucuuccuugcuuuuggugucucuguuauguguuuccuuccagaaugccggguauggguccacaauggcauuauuaaaacaaaaacaaaauaaaacaaaaaaagcaagaaaagccuacugcuuuuuaacguuaaacauaaaaguacugauaagguuuauauuucuaugccagucauuuguauaugaacauuuucuccaaaucaaucacugaacaaggggauguuaaauuauaugaaagaacaugugguguuauaauucacauaaaugcugauguucugugcuauuugaaaaguaauaguuauauucaucugcuccuguuucucugcaaaaauaauuuugcacugcaauaagugaaguccauaagcuacauaggaacacucaaauauugaaccauucuaaaaaauucaaaauauuuucagauaaaaaauucuuuauaauauaccuuauguuucucuuuauaaaaauuucuccucuugagcucgggaguuugagaccagccugggcaacauagggagacgucaucuccccccaacaacaacaacaacaaaaagcugggcaugguguaugguguugugcacugcugugaucccagcugcuugggaggcugagacuggaggaucacaugagcccaggagguugaggcugucucuuucuucucuacugagcuuuauguguuuuuuuguuuuguuuuguuuguuuguuuguuuuuuugagauggagucucccucugucucccaggccggaaugcaguggugcuaucucugcucacugcaaccuccaccucccagguucaagugauucuccugccucaaccccgcugaguagcugggauuacaggcacccaucaccacgccuagccauuuguauuuuuguauuuuuguauuuuuagcagagaugggguuucaccauaucagccaggcuggucucgaacucgugaccucaagugauccaucugccucagccucccaaagugcugggauuacaggugugagccacugugcccgcccaagcuucacacuuuuauuccuuuuccauguuuauuccuuuugcaucuuugucaaacaugugacuuaggauaugaauuuugaugucauauuguguuauguuuaugagagaagcuuaaaauguucagaaagauggacuuauuugaaaacccaaaggcagguauaguuguugggagaaguuagacugggacauggcuaaaacuauaaggucuaagguaggcaagaguaagagauuuuccacauugaauauaacugaguuggauccccauuguacccuggcaccuagcauauaauaaguauucaaucaauauuuauugaaugaaggaaaaagagagagggccagaaguguccuuacagagacaugaugucagagaaaauaauguuuuuuuuuuuuugagauagagucucgcugugucgcccaggcuguagugcaguggugugaucucgauguuauucucuugccucagccucccaagaagcugggauuacaggugccugccaccaugcccagccaauuuuuuguauuuuuaguagagacagcguuucaccauguuggccaggcuggucuugaacuccuuacuucaggugauccacccuccucggccucccaaagugcugggauuacaggugugagccacugcaccuggccuaaaauaaucuuauucgagaggaaaauacuuauuugagagaaaacggggccgagcaauucuacagguaaaugaaaaauuucaugauugcucugcuugcuuuucauuuugaaaccauaggaaagaaagaugauuuaugggauaugguacaaguauuaagaagaguuauuuuuuuuucuuggauuugcaaugaccagcaagaagcagacaagcucccaauuuaugacuucuguccuuggcagagcccaucaggaugaagggcuucuugauagagggacucugagcacagaaguacagaucccucaacccaaccucucugagagcacaagccuuaauuauaaagcauuuuaucacugcuauaacugcuggcacugaagaaaacuuuugauucuugaauucaagcagcuguaacugagguuucucacucugaaggaaggaauacagacagaagaaaaauaugcauacaugacuagaauuuaggagacaugagaucuagauuagccccaugucuaacuagcugguuuauuucagacuauucauuuaccuucucugaguuucaguuuccucuucuggaaauuagagcauucaacugauggguacuccuaggucugaaauuaccaaaaaucacccagauacaacucauucuuagauuggaaugccaagguagauuuugugauggauagggcgccccaaaaucauuguacuuaacuuaaauuucuuucugugauuuuucugaagguucagguacugguuacauuaagaauagguuauaaaauuacaugccuugcuaaugaagaacguggugaaacuauuaauaauaguauuuuuaauaagucucaauuauugaacacuuagcacagggcaaacaaugugcuaaaagcuuucuguggguuaucucacuuaguccuuaaaacaacccaaugagauuaguacuguuauuaucuccauuuuacaguuuaaagaauaaggcuuaguauaaaaaacuuggaucagaucauacaaaguagaaaagucagaauuugaacucaagccuauuugccaucacacugagaaaacaucagucucuauaugguaugagucuuguccagacaugaaguucuuuuuaaggaugaugagcagauaaaauaaaaucaaguauauuuauuacauguugcuguucaguuaauauuauuccuccccuuucuuuugcucuguacuaaauaugaguaauagagggaaaauuuggcuuucggaaaauggcugaccuaucuagaguaguuuuagaaugauucugccuaauagugggggauccuaagguuggagucuaugauucacuuuaauaugacacuucauggaaaaucugggcugugauaugucuguguguguguagcagagagagagagagggagaaauagaacuagaucuuucccuuuccucuuaacuaaaucuacucucuucuaucuuauuuccuaaaaaacacuuaaaaaguauuuuuaaaaacauuuaaaaaucuuuaaguguuuuuuccuucaacuuaaguucagggguacaugugcaguuauuuuuauuuauuaaauaaauuuauuuaaagaugggauguuaaucuguugcccaggcuacaauguagugaugugagcauaucuuacugcagccuugaacuccugggcuuaagcaauccuccugccucagccucccaaguagcuaggacuacaggcuaaugccaccacaccugccuaauuuauaaaaaaaaaaacaaauauauauacacacauauauauauauauauauauauauaaauaggucuugcuaguugccugggcuagucuugaacuccugacgucaagccauccuucugccucagccuccucagucacugguauuacaggugaaaauauguuuuauuuuaaaaauaaggaagaugauagacuuucucucaccaggcaauuaacaccacauaguacauguugaggaaauggguguuccuugcuuucuauuguuaaucugaugauagugaggguggagagcacuuugaaaaaauauuuguauaaggaggagagagagaagugagcugaauaagaaagucuuuugcauaucccaaauuaaggucauucuugacuuuuuagaagauauuuccuugagguagacagcacuuuucucaaggcaguacagaguuuaaauauauaaccuuggcuucaaauacucuuagcagauccuuauuuuuaaaaauuaauuuuugguuuaggggcucaauguacuuucuuauacuucuaggaaagaaaagaacauugccugcauauugacccuuggaagccagauugcuggaugcugcugcuaauaacagcuaauacuuacauagaacuuacuauguccugugcacuguuccaaacuuuguguguauacacuagcucaguccucacaacagcccucagaaauagcuuuauuauugugcuucauugagucuaaaauauauugaugaugcauucuugaccuugcuagaagaugcuaacaaaaagcuuucacacaguuguaucucuauugcaauugcaauaauagcaauugcaagaugucuuggauuguaagacugaaauguaagaugcaccccaauuuuaaagaaguuaaaauaagaaagcauguuagaauugauaaaauagaaucucuuccuguuuuacaggugaggagcccaaggcaaaagagacuaaauaaauuuuccaaaguuacaugacuggacucaaauacagguggcuugguuguagaguuucugccuuuaaccuccauuuuuuuuuccugucucucaacaauagauuggaauugugcccaugcuaauauguggguagacuggccaagacucaguuacuuaugcccucacugaagcacuuacgauagaacagcucuagaucuuucugagggagacaguguauaugcuauguauagggcagugaugaggauuguugugcuaauguguguaaagugcuugacaugugggcaucugaccuagguuucagacccauuuucagcaagagagugucagagggaagcccuugugaacuggcuucccaaaccucaguaggcuggaguacaagcaggaaauggugagcauacaacguuguuugggugccccaaaugucaaauucugguacuguguguucucacuguuuacuccuuccugaaaugaaaugccaacacaaaaaucauuuacguuauuagauuucuguauuugaggaguggaguauuuucuuucuggaaaacaggcccuaggaauacuacucaggacuugaauaauaaauaagagaacaaaaauuguuuauaugaaaauauaccaucaauugagacuuaacauuaaauugucuucaccuaguagugauaaguagugaugagaaagccacguauggacuugcaggauggaggugggaguauagucugguauagacuagaaugauuuucugcugaaagaugggguaauuccacuaacuccaggcuuucacuaacuggacugcaagcucagauaagaaggcugucgcccucaacaccaugcccaaaccuugaaagaucuguuauuuugaaaaccugccugcccccaacucccuuuauuucucugaaauuuucuuauucuuuggaauucuggucucuuuuaacccagaccagccuggucagcgugaucaguuuugaacaaacucuagacagccuccaaauuugcuaaagguuuuccccaaucagaaucuucauuguugggucaugggugaauauuuugcugccaggucuuucagguaaaaugggaggugaauucucaacccaggaagccugugucacucaucacauauuucccuguuaucugucaucuucuccuaugccagugcuccuuucucccaauccuuuacuguacucgaacacauacaugcuguucgagugugauuauacaguauauaaugguggagauaaauuuuuggauacagaauaucuacaaaugagguaauuuaaaaauaaaauuuuaaguuuguugguuuggcacaaguuuuaaacaccaaacuguuguuuuuguugcuucugauugucauuuuacauuucuaguuuugaacuguuugaacaucugaaauuaauuugaaacauuucagacuguuuugaaccagucuauauuggucuaaaccaguaaaaacaauuuuacagauaacuauaguuaucaaacuaguuuccagcaguucgauagagguagaaccagugugacucaauugaaaguggauuuaauuugucagcacaguuugauuuaguaaaauauacucagaaccaacuaaaacuuuuagaagccugucagaaccugcauguccaagucagagccuauuggaacuagcuaaaaccagucugaagcaauuaaagcuaauuacaaugagacuccaauaauuuugguuagauauaucagguuuuagccaaagucagaaaguuuuguaggagaaccucuuuuaacucaccguaaaauaauaugaaccagauucuuuugaacaacuaugaacuugcuaaaauggaugguguauuuuauauggauuugaaccucuuuuuaaguugaucagaacucuuuugaaguaaacauaucuguauuaaaugaauugcaaaugguuagaaccagccaaaaaggaucagaauuauuugaaagugaucuuuguugacucagccgaccacuuugagccaguuagcaaucguuugugcuagaaagacauguuuuaagcuggccagagucaaucugaaauuuguucuagaucuucagacccagucugaacguccacaauggggagaauaaagugagccaacaguuaaguacccaguauaugccaaccauugugcugggcacuccauaaacaguaucucauugaauccucagaauaauggugugagguaguguauauucuuuuuuauagaacagaaaccuggaaaucuaaggcucaaagacauccaaguaauugguaucugggagauuugggauucaaacccagcucugcuugacuuggugaguuuccuauuagguuaccuuguaagauaccauacuacuggucacuuuaaagcccaaugugcauuuauaacaaaaaugaauaauggauaugaagcuugggguagaauaggcauuggacuuggagcuaggagaucuagauucuagaucgugcaaaucagucuaccucucuggguucuguuuuacccuuuagaaaacugaacccagagaguggaaggucugaacauuuauuuucagaucaagaaagcagauaauugucuuaaagauacaaucugaaaagugcaaacuaugauuaauauugaugguggugucuauaccuucaauuuaugguauuugguuuguuaacagucccuuuaugauuacuuggucaguauugcuauugugaauagaaaacaaaacucacgaagaucauuuguagacuuacaugugugauuacccauggaaaugaaacacauuagagauaguuucauuuaagucuuugaauuccacuuaagugaguuuagagaauucuagaauaugaugccauuggugacagcauuuuuuccuguacccuaagugauguaaaaaacauaguuauaccaacuuuuuuuucaaauuaaaaauaaauaggaaauaagguagucacagugucuucuugcaucauucucacugcaggaucgguauuguuaucugcugcuccauucaguuugaggggaagcccucaaaugagucaacauuaucuggacuugcuuuucaauucuuagcucuuauuuccaauaacuuagagccaggugugaugcugugauaugacgugcuauaauguugauguccaaguugucguuuuuuggagaggaauucuguuauaugucauuaauacuggugaccuauacuugcaaauauccaagcuauaaagacagguaaggcaucaucugugaagugucacucuuuauagugugcaaauagaauuuugaauguuuguagaggcucugcccuuauccacgggcuagccauaccugaaacgugagguugcagaucugcacugaagcacucugaggaaacacacugcaguggcuuuuggggcucagcauucaggaguuuucagcauaaggugaguccccaaguugaggauggggugagggagguaacacugaaaaccaguaaauauucuugucugaguuuuuauuaauuuuauggauauauagaaauaguccuacaggaagcacugaauauggcagccaaguuucuggauauggugcuggguaaaaaggggauaacgccgggagucaguagcauccaauguaggacaucuggcauguguauagauggauaaauauguauguuugaauagucauguagagucgucaguguuaaugagauagcuaguuguuuuuaugauuuucaggagaguuuauuggcauuggcgggggaaacggagagagguugguuaauguguacaagcauaugguuagauggaaagaauaaguucuaauguucaacaguagacuagggugacuauaguuaacaaaaauguauuguguauuuuaaaauagcuagaagagaggacuugaaauguucucaaugcauagaaaugauaaauacucgaggaaauaaauacccuaaauaccuucaugugaucauuacauucuaugcauguaacaaaauauuacauguaccccauaaaaauauacaaauauuauguaucaauaaaauuuuaaugaaaaaguaaaccuccccuggagagagaucccauuucuaguuggacugauauuuuggguuugaaucuauuuagaagguaaauacaaaucaugaaaagugcugauugcaaagaaccaaaaauagccgugguuagguauugcugauauaaaugaauuuuucuucuuuaagguggacuuuuguuuuagucgguacugaagagcugaauuuuuagcaguucuugauagaguacccagguaaacauagguaagcgagcccuugguuguggcacuguggucucugagcagugacuguucaaaucuggaacucaguucccaagugagcagugauacucuagagaagucuggcuuaauauguaguacauauuaauaguaauauguaaggaagcagggacuaaauuuacuugugaaauaacagugucuuugaaggaaccguaauaacaugugaaaaugaauagaauaaaugaaauugccuagauguccauguaaaaagagagaaaaggcaagguucuagcacuaggagacuuucuuucuuucuuuuuuuuuuauuuccauagguuuuuggggaacaggugguguuuaguuacauggauaaguucuuuaguggugauuucugagauuuuggugcacccaucacccaagcaguguacacuguauucaaucuguagucuuuuaucccucacccgccucccacccuuuccacccgaguccccaaaguccauuguaucauucuuaugccuuugcuuccucauagcuucacuccuacauaugagugagaacauaugauguuugguuuuccauuccugacuuacuucacuuagaauaauugucuucaauuccauccagauugcugugaaugccauuauuucguuccuuuuuguggcugaguaguauuccgugguguguguauauauauacagauaaaaaaauugugguguaccacaauuucuuuaucuacucauugacuggugagcauuuggacugguuccuuauguuugcaauugcaaauuuuagcacuaggagacuuugaaaaaggaggggaaauuggaaccacuugcacucuaaugauuacuguuauuccuuauaacauucucuuuccucuguuuuucuuguauuaguuuuuguucuauauggucuacagauaagacuuagugacuguuaccuucuuguugauuaucauucccacuugaaauuuuuguccuaaugguacuauaauauguauguuuuuauuuuuauuuuuauuuuuauuuauuuuuuuauuuugagacagaguuuugcucuuguugcccaggcuggagugcaauggcgcaaucuuggcucacugcaaccuccaccucccagguucaagugauucuccugccucagccuccugaguagcugggauuauaggcaugcaccaccaugccuggcuaauuuuuguauuuucaguagagaugggguuucuccauguuggucaggcuggucucgaauucccaaccuuaggugaucugcccaccuuggccucccaaagugcugggauuaccuguguguuaaauuaaaacuacacuguuaauuacuauuucaauagcuucucaucuagcuaguuauuaggucuucaaggauggugaacaauauguauguaacucucuuuucauacaacccguagacauacagguuaacauuagguguuaaacugaauauuguugucacuuuuuaaauggauaauuaauguuuucuaauggauuuuaauuaaaaaauuuuguguguauuuuacaggugaacuacugaguucuucauuaugucugauggagauuaugauuaccucaucaaguuuuuagcuuugggagacucugguguagggaagaccaguguacuuuaccaauauacagaugguaaauuuaacuccaaauuuaucacaacagugggcauugauuucagggaaaaaagagugguaaguucuauauccuucuauguaaaaauguaaucguuaagucaacauuugcuggucuguuuaguuuacuuuguaggaauuaggaggacaaagguugggaucugaaauuaaagguacauaugaaagugaguuauguucaauccaggcaacaugauugaaaaggcugugcugacagcacuucauauaaaaccaggcagacaaaguggaaguggacaguucuuuaaaaugucaccuugguacucuuuuggcuuguaucuucccucugaacuccgaaaguuauuugucuaccuuugucuugaagccugccaaccaccuugccccucauacucuuguuuuaugggcugugucuuccaccuuugguaucuuauuauuuuuaauggcauuucuccuaauaaagucucagcaguuccacauggaacacuaacuggcagaacuuaucacugcugccaggagggugagguuggaguaggaguggggaaugccaguagugaaugugauguucugcagaauguugaagggagaaacuuuuauuuauuuauuuuuuaaggacuuugagacugaaaguuauucuaguguuggaggggaaggcagaaggucauggugucacaguugcagaugaggaaagauggcuuucuccuuagacuacauuucuuguugaaaaauccauuguuggccugaagcagguaaaccaguugucaggaaauuaaugacaaagguccuuuaauggaucauauucugucagggggaaaggucccuggcuuuuaagacagaagaacauucccuuuugcccauucuaguauuuuauucuacuaccagagaggcuuauagagauuaagacccacugaauaacaguagggcccuaaugaaauuuuuaguauugacguguaguugauagaaucuacauauauguaugugauuauuuuuguugguuacuuauuguauaacuuaaaaaauagauuuguugagauauaauucacaaaaaaaggaaauccauccaucuaaaguauaaaauucggugguuuuuaauauauucggaguuguguggccaucacagccauucaauuuuagaauaguuucaucacuuuaaaaagaaaccucauaccuauuagcaggcauuccucuuucuaccuccccuuagccaccaugaauuuucuaucaauggcuucugcacacaccauauaaauggaauaauauauggccuuuugugucuggcuucuuacauucagccugauguuuucaaggaucuuccauguuguagcauguaucaggacuucauuacuuauuauagcuacauaauauucuauuguauugauacaccauuuuguuuauccauuugucuguugauagauacuguuguuucuuuuucuauuuucuagugcaucauuuuaauucccuuuuuuguuauauguuuuugaguucuuuuuuaaaaauucccuuggggauuacaauuaucuuaauuuuucacaaucuaauuuugauuaauagcaacuuaauuuuaauacuguguaaaacuuugcucuuauguggcucuguuuucucccauauuuuugugccauuauugcuauacgaaugacaucuuucuacauugugugccaucaucaauacagcuuuacaauuauugcuguaugcaguuaauuuuuuuuucuuuuuucuuuuugagacagggucucucucuguugcucagacuggagugcaguggugagaucucagcucaccgcaaccucugucucccagguucaagugauucuccugccucagucucccaaguagcuaggauuacaggcacccgccaccacacccggcuaauuguuuauauuuuuaguaguaaugggguuuugccauguuggccaggcuggucucgaacuccuggccucaagugauccacccaucuuagccucccaaagugcugagggauuacaggcaugagcuaucacucccagccugcaguuaaauuuuaaucuaguggaggaaaagggcuacaaagaaaaaccacguuuauacuguuuuuuauauuuacuaugcaguuacauuuuuacuggugcuuauuauuucuuuguguggauuuaaguuacugucuaguuuccuuucagcuuagucuugagaguugucuguaguauuucuuguaggauaggucugcuagagaugacuuuucucaguuuugucuuaauuuauccuuuaauuuuagaggaccgcuauguuacugauuuuuaaguucuuugaauauauuuauaauuccugauguaaagucuuugucuaauaaguuuaacaucugggccuccucaggaauaauuucuauucguuguuuuuuuccugcgcaugagccauacuuuccuguuucuuugugugucuuauacguuuugcugaaaacuggacauuuaaaauaaugugucuauucuagaaacucagauucuuuccccuaccuggguuucuuguuuuuacugcauauuuauuuauuuuugucguugcuguuuguuuaauuauguuucugggauaauucugcaaaaucuguauucuuuguaugcagcuacugaagucucugcucagucaacuuaguggacagcuaaugaguggagagaguuuauuaaauuccuugaacuaauaagucucuuagcuuuuucugagagucucuguguguuuguugggguauguguuuaauacuacugcaggcaguuuacaacucugccuuagcuuuuauuuucugccugagaagaaccucaaagucagucagaagugagagauuaggaccuuuuuagaucuuuccugggcauuuguagagcccugcccaugaacauggccuuuuagguuccaaggaauauuugggagcauuauagaaaucucauuuccuauuuuuuucuuuaaauuuuuuuuuuguuguuguuguuagacuuuuguuagcccuaacugguauugcuaccucugguagcugugauguuaaauaauuacugcugauaguuuucaacaaaugcccuugggauagggcuguucucaaagagcaagcuuugagugaggucaaagaaagacaaagcuggggcauggagcuuuccaaggggcuuccugacaauuuuucucaguaugggacuuuuagggagcuccaaaccuguuguuccucugcuguccacagugguggcuaggcugauguuuucacaacaaccacauuugugcacaugguuuuuaagucuucuaaaagcuugagugagggggaugggaauagggcaagguaaaaaacaccucaaagcuuacuguuuuuacugauauucggcuguuuuucuugaauaaaugcuccuuggaauguugcaagucuuuguuaauuccuagaguacugaaaaaguugauuuggacaauuuuuaccacuguuuuuguugcuauuguggaggaagaaauuuuugaugguccguucucugcuguucuaggaguguugucuauaaaauucuuuuaagagcacuuuuaaaauuugggaugggacaagggaaaauuguucuaccaaaaauacaucugcacucaaauguuuauugcagcacuauucacaauagcaaagucauggaacuaacccuaggugcuuaucagugguggauuggauagagaaaaugugguacauauacaucauagaauacuaugcagccauaaaaaagugaaauuaugucuuuugcagcaacauggauagagcuggggaccauuauccucagugaauuaaugcagaaacagaaaaucaaaugccacaugcauucucacuuauaagugggaacuaaacaauggguacgcauggacauaaagacagaaacaguagacacuagggacuccaaaagggggaagggagugggagaggggcugaaaaacuacuuauuggguacuacauucacuguuugggugaugaauucaauagaugcucaaaccccagcauuaugcaaucuaucuacguaacaagccugcacauguacccccugguuaaacaaacaaaaaagaugagauugggaaaagccauagaaaaguaauauuuccugaaacuagugacccaagagaacuuugaggaaagguaaacuaauuauuauauuuuauacaaguuguuuuguauucauauuuuacaauauauuuauaagauauauauguauauauuucaauauaacuuauuacauuaccuggauauaauuauuugacauaaauacaaacaugguuguauuccagauggcauucucuuuggaauuuuagaugccuuugggauuuguacugaacaaaaaggugagaagguucgcugguguuagaaguucucuuuuguuuucucuuucacuuugcuguuuuagguguacagagccagugggccggauggagccacuggcagaggccagagaauccaccugcaguuaugggacacagcagggcaggagagguaugagaucuucaguuaugugcuccuuacugaaggaaagggaaaaauaguuacauucuucaaacagugaccugagcaggaaaaagccagccaauucguugguuugcacuugaaugcugccaaauuagcaggaaauuugucaagucugagaugagaaugguggccuuauuucauacaaggucaagggagagguuaugacucuuacuuguggacuuuuuucuuuuccuucuuuuaauuuuuuuuugcuuagauacuuugcuccauuuccuuuugcuauuuacucaaccacaagaaaguggccaaguuacaugcauuauucuuaccugacuguugaaaucuagugggauaucugguuggaauuaauucaugugaccagggguuacuugaccaaaauaagccacaugaaaucuugauauaaaguugcuuucaguuagcuagaacuucuguuuucuuucacagccaccuugaaggauuuuguuuuuuaacuuuuuauuauggaaaacuucaaggauauucaaaaguggaaggauuauaugauaaaccuauguacccauuacucagcuucaacaauuaugaaauuguggccaacagaauuucauuuauaccccuuaccucuucucaccccacccccuuaccauauaauuuagaagcaaauuccagacacuauauuauuucauuuuuaauacuugugguaauguagcucuaaaagauaagagcucuuuuuuguuuuuuuuuugggcggaguuucauucuuguugcccaggcugacgugaucucagcucaccgcaaccucuaccuugcugguucaagugauucuccugccucagccucccgauuagcugggauuacagaugugcaccacuacacacagcuaauuuuguauuuuuaguagaguugggguuucuccauguuggucaggcuggucucuaacuccugacuucaggugaucugccugccuugaccucccaaagugcugggauuacaggugugagccauggccccuggccaagaacucuuuuuaauaaaaacauugauuaaaaguauuugagaaaaaccuaauauugcugauuagaugacaaauucauaccaauauuuucuucccuggagccugccugucaguuacagguuuuacauauaggcaaagacgagaggaaacugacuggugauagggugggguuggggguggggagagagagagagaagacagggaagacagaaggauaaagccuuggaaggcagaguaccaagacagaauaaggucugagucaagagauucuuaccuucaagccaaacaaauggcuaucagagauaagagaucucugcauauucugaaauuaaaagaucauggaacacauuguaaugucaagucaagcuuucacaauaggaaaacauacacuauauugcuuuuggccaaauuaacucauaauuguacauaaauucuugggugagacuaagaucacaagcugguucuugucaucccucuccagcagccucgguuuucaaaucacauggucuguuaacacuuaaacugauauaagugauaaauaacuauccuauauacuuuugaaauaucaccauguagcuuguuauugguaaacuuuuguaagaggcugaaggcauugcuuguaguuuuauauuucaggaguggggccgugguuuaacugaccauucugcuuuuauguuccuagguuucguagcuuaacgacagcguucuucagagaugcuauggguuuucuucuacuuuuugaucugacaaaugagcaaaguuuccucaaugucagaaacuggauaaguaaguguuauuguuccccaguguccugcuacacaguccccucuuauuuauagaaugcccucuuaugcucuacuucugugacaaaucguuuuggaggagaucuuagugcaaauacuauuuuaaggagcaagguuuuuaguuuagggacaaagauaauugaaauacucugcuucucccugguacugauaacuuugauuuguugaguacuuccugugcuccaggugcaaggcagcacuuuaugugugcucuccucuucagucuaucccacagaagagacucuuauucccauuucguagaugaggaaguagaagccuagagaaguuaaaucucuaaguaucugcuugucuauuguaugcuaucaauucuucuaucaucucuggacauuaaauggguauuacauagaugcagauagcuuuuaaagacuuaauggaucauaccccuggcuucaugucuuuucugugcuuagaguccccuucuagcuuuuaggguuagagcaucuuucaggaggauucugccauggaaaacucuacaacugcauugguaaaaguggucaccagugcaauauaugucaaccuuuauuuuggagagauuuuaaccuccuaaaugauugguucauagccauuucgaauucugccacuugacugcauaacagcuuucaaauguauauuuucccuguuuggucauguuaguguaacccuagagaaucuauuagggaaggcuguaauauuaaauucuuaacaucuaaaucuuuaaaacacugauuuaaaaagaucugcuacuuaaacauuacuguuuugggauuaugaaaggguaauuggcuguaguuuugauaguagaaaagcuuagauuaaaaaugaguuuaaaaauaauuuagugcacugugguuuucacauacuuuguaucugauccucacaaucacccugggcaaagauucgggucaguguuguguccuuauuucaggagaaggacauugagccuuaaaaaguaauagacuuauccaaggauaugaagcuuuggcuuuccuuuuuaauggccuuuuuuuugcccguucucaagucaguuggccacuaagaguugaagagcuauuaauuacuuuaaauaugaguuccccaaauauaguaaugcuuacuggggcuucacuucgcuagaugccuggcuaaguugccucauuauuucccuuguagcugaaugacaguggcuguuuauggucucuuacucucagcccguguucaucaucccuccuuugcaucaucagaacaaguucuggggcuuuuuaaaaucaacuauuuuauaaggaucacuagagagugcgcauagaaucuuagcaucaaaaaauaacgcaccuguuuuucauagguagacacuaaaacucugagacauuagauaaauauugccuauccuggcuaacuaguuggauaaagaacaaaauuaugugaaaauauguauacauauguauguauuuuguuuuguuuuccuuagagaguaaaagaauccuuauugcucaguuagguaaagaacacuuauacguauugaagauuuuauauauuuaauagaaaguauucuccacccccuaccauuuaaacaaaaagguguaauguucagugucagaagugguaauaucaaaucuuaauuaggaauaaacauuuguuaauuaucuguacuuuuauuuuuuucuucuuccugucagccuuuugaguauuacaaugaucauucauuucuuaucuuuuuuuuuuuuuuuugagauggaguuucuacucuuguugcccuugcuggagugcaauggugcagucucggcucacugcaaccucugccuccuggguucaagcaauucuccugccucagccucccgaguagcugggauuacaggcgcacaccaacacccccagcuaauuuuuguauuuuuguagagaugggguuucacccaucucccgggguuucauccaacuccugaccucaggugauccacgcgccucagccucccaaagugcugggauuacaggcgugagccacagugcccggcccauuucuuauuuuuuaauaaaaauaauagcuuaauacacacaaauacacacucacacacacacacacacacacacacaaauacauaaaaaucaguggugagugccagaacacaguguugcauuaaagaaguagcugacucgugggcccugauuggccugggagaggagagcaggucuauauacccuccccuuucccuuugcuccuugcagaccccucccucucacucaaucucuccaugcccucuugagaagggugauaaaagucuaaaguaagccccacucagaugaggagacagaacagaggcugaguccucugggccuggauugaaaucugaaaggaauuugguagugugguagucacuguccugucuuccuggaguucagaggaguaagcacgucaugcccagagucacucuucauccagugcuaguguguuuccuaaggaaacuuuaaaguagccuacauuucuaaacuuucuucuguagagucccauaaguggugcaaaaacccaacaguauauauuuuacauauuuuuacuucuuuauuuuuuauucccauuauucucucugucugaaaaacccuuuccacaccugcccccauuuuuuaaccaacuggaguucugcuuauucuuuaaaaccuagcaaagauggccucugugagauucucuguaauaaacuuaguuguguuagauguuuucccuccuuuuaaccccuguuacauuuuauacuguguauaggguccuuauuacauccauuaucagacuguaguuguuuauguaggugacuuuuuucuuagugaaguuuuuaaaauaacugauuaauuugcuuuuuagauaagcacaaucuuaguagaaaaauuaggaaaaaugagacaaaaagaagaaaucaccaauaaucacacuuccuagacuacccaaaauaaauacuguuaaccauaauuacuggugauacuuacaugcucuucuaaaugcuuuaauauauuaacuuaguaguucucaaaugugaaugugcaucucagucaccuggaggacuuuuuaaaacacagauuucuagccccauuuccagcauuccugauucaguagagcuggagugggaccugagacuugcaugucaacaaauucuuagguuaugcuaaggcugguggcucacagucuuuaccugcagaaucacuggauuaauucauuuuaauccuuaccuugacuguauaaaguaaguaguaucauuaucaccauuuacagauggggaaauugaggcagucaaauaacuucaucagggucacacagcuaguaaauggcagagccaggauucaucccuagguacacuggauccugagucugugcucauagcaugacacugggcauggaccuauaacaccuuauaaggcauuaacagagcacagagccacucuggagaccagaaagauaaugagguaaccaugaagcaagucuugaaggaagguugugguuaaguauucagugaugugggaacagcauguguaacaaccuggaggaaagaaagggcauggcuuuucaugaaaugguacacaguuuagucuguccucuguaggucuuauuaccccaguugccccaugagggcaaagaacuguugugaaauuccaugcagaguaucaggccugugcuaaugcucaguaaacaccugccuacuugacuuucucaugauaagauaugaugaacacuacuucauaaugaggaacuaaaauguccacacuuuucugguuaaccaugaugaaaaaauaaauuaggccauaaacucugaaguaugucuuacugugaacguuuaggccuuaauuuuauucuggggugugauggguaagaaaugagguguuauuuuccuacuuugaaagauuaaacuauuuagcuuagugaagcucuuugguuugagucaauugcuuuuuauaauugugccuauuugcagguuuucaggugaaauaaaagcugcggaauaagaauuauaguccucugcuuccacuuggcucuggugacagaaucacuuacuguuuauucugggucuuuucuucucauugaagccuguaucuuguuuguuuuaaaugaguugauucugcccuaggauaauagaaaaaugugaaaaacauuuuggauagaaauagauuaguuuggagaaaaacaauucuuuuagaaaugucauugcuauggagaaaaaaacacauaaaaacaguuuuaagauuagcaguaaacccuaggaacuccugcaacuuucuuuucaaauagccuucauaaaaaagaaagguguuuuguaugugugugugugcauaugugugcgugugcacaugugggcccucacacuugagagguagcacauucuccuauaaacucuccgauaucaauaaacugggguaugugcuuaagaaugguuuuauauuucugccccaacuauucagcuuuacagauaagauuacugaugcuuugaaagcauuaugucaauucccaauaucuauauauacauuauagucuucaaagcacuuuugcauguauuguucacugaucauacacuuacauuauuauuuacauauauaauaaacuuucuuauauuaauaggccagcuacagaugcaugcauauugugaaaacccagauauagugcuguguggaaacaagagugaucuggaggaccagagaguagugaaagaggaggaagccauagcacucgcagagaaauaugggugaguauuuuuguggagaagucuagagaaaacauuuucaauauaaacauuagcaggugaaugguaaugaaaaagauaaaaguggacaauuaaagcaaaaccucagccauaggccuuggggcauguugaauguguccuuuuuauaugauaugauaguaggauccauugacaaugcauguggcaagggccuccuucagugcuuuggucccauuuucucaaacucuuggcauuugcagagagacaacuuugaguugucucagaggcgccuuaaguauguaaggccuucuuuccaagaugcaaauaggagacuccugggguaaagaaauccuccauguugagcgaggaaauuucuuuuuucauuucuuuucuuuuuuuuuuuugagacagagucucacacugucacccaggcuggagugcaguggcacaaucucggcucacugcaaccuccaccucccggguucaagcgauucuccuaccucagccucccaaguagcugggacuacaggaguccaccaucaugcccggcuaauuuuuguauuuuuaguagagaugggguuucugguaccauauuggccaggcuggucuccaacuccugaccuugugacccacccgccucagccucccaaagugcugggauuacagguaugagccaccacacccagccucagcaaggaaauuucaaagccacuucauguacuauuguagagaaugcuagcauauaagaagggcuuauugguuauugcagauuaggugcugguuuugaaauuucuauucugggagaggagugugagaucuccuuuggcuuagucuauggucuugugguggagggucagcaaaauacugucguucuccuugaguucugggaauaggaucauagcagcagcagcagcagcagcagcaugaacuggacaugaaagaaguggucagcugcugcuuauuaaaguauuaaaguguuaagggugccucuaaaaggaauuuuuacuuuacuuucuuucugccucucacacaaugagaacccauauguaaauucaaacccuuaauagcauuaaaagaggaaggaagcaaguggguugagaagggaggggagggaaauagagaugguguagaugguguaggggauguuaccuaguuuguggcuuuggugguuagcagaauccaagaaggccaagagaaaaccuuucccuuuuuauugugugaucacugcuuuauucuuucuuugguugauggagguucagaaagcugguaggguuuauagugggaagggagggggaggauagguuggccagguaggaagaagccagacucuggagggguuugaauaccagguaaggagauuagauuugaucccuggaggacagggaguugcugaaagccuuugagcauggagggauguuauguuuacauuuccagaucagucuauaggcuauagguggggagggaggaaagacuagagauugauagauugcaguggucugugaggugggcagaggcuagcuuugugaaaaaggaaaaggaagaauaaaucaggaaaaacacauagaguagggcaggauuuuagguuuuucucaaggcuagcucagcugaaggauucccauccacuauaggcuuacucuggcaaggauuugcaauugcauguagagguuuuuacccuagggcagaugguguuuaaccauguuagaaacauccagagaacuuuuaacacauucucaugucugggcuucaccucugaccaucagacauaauugguuuggaggaguuucucaggcaggguucacuugaagaagcauaccuauacaugaagggaucuguuacaggaauuugagcauaugcaauugugggagcuggguaaguagucucuguaagguguugucuuugugucugaugcugaagccugaaggacaggacagucagacaggaaggggagaaggaugugaaaugggggauggauggaaaaagugagaaccagcuggugcccauaaugagggacuaaaacccaugucacuuccuguugccucugaccuggcugguguggguguccugcagaaacuggggcccuuugucacagggcuaacaacaucaccuggcccaggugcaggucuaguugcagguuuaugacaauaagaugagccagcagauaagcgacaauauaugagggcuaugaaauggagguugcuucacuuccuacccccaaaauugcccccaaaucucuuuuguggcccacccuaaccagaaagggcauucugggaaauguuguuuagccuagccaagcugacucauuacaaagccugggcauugguaucuuuuaaaaucuccccacgugaucuucaugugcaaugguugagaaccagugacuuaggugauucugagggggaggcugacagagucuuaccggccagucugaaaugucccccugcuccccugagaggcacucauguaacguaguggaaaagaaacagggagagaacgauuaccacagagaaugcuguaguguugaagcugugagguauguugcaauggguaaggaggaaguaagugaugaagcaauggaaaccauggauccuagagcauucuuuugagaguaugucaguaaaugcaaagaaaaaaaagaaaaaggcaguuagaggaguuagcuagaucaaacaagcacauucaaguauauucucaaguacugggggagggucaggcuugacuucuugccccugugggcuuuuucagcccuuugcuuguuuccugugcccucggucuuaggauuccacagccugucugguuucacagagccuaacccugccuucugucauaugggguaucugaggggugugggggacugucuuugaccugugcccaggucacgaugguuauggaguauuucauagagaggagcucaaucuauaguuuuugaauuggguuaaaaugagaaaagaggauuuagcagauaaugauugaaacccuugaagaaaggaaagggcuagaaacagagucccuuaggauacagaaagcauaccauguaguuugguaggcuguuuggcacuuuuagaggaaaauaugauggaaaaauuugguucacaugcauuucacaaauauggcauauaacuuuaaugauuauuuucacagauguuuuguuucauucuuagaacauuuacacugguuacacaugcacuaaaggacuauauuguuuaguuuauccaugugcuaacagucagaaaacaggauaaaguuuauggcauaucuucauauaauuuguauguuguuugauaaauuuacauuuuuuguuacuauuaugcugucuucuauucucaauucauaaaaacagaucacuggggccaggugugguggcucauaccugcaaugccagcacuuugggaggccaaggcagguggaucaccggaggucaggaguucuagaccagccuggccaacauggugaaaccccaucucuacuaaaaauacaaaaaauuagccaggugugguggcgggcaccuguaauuccagcuacuugggaggcugaggcaggagaaucgcuugaacccugguaaggcagagguugcagugagccaagaucgcaccauugcacuccagccugggcaacaagagcaaaacucugucucaaaacaaaacaaacaaacaaacaaaaacaaacaaacaaacaaaaaaaccccagaucauugguuuacaauugguucucuggaauagacauaucaaagaaucaaacaccaugucucagaagaacuuuguaagccuaauaaagaacacuacagugcgaaaauggaauguuaaucugugugugcugggacaaguaaauuugagaaugaggacuucauacaacagacaaaaauguaaagggcaaauuguaugcaugauaaugaauaucagaaaaaaaauuuguaguggccuaagagucuaccgcuaauuuuccauguuuuuuuuuuuguuguuguuuguuuguuuuugcugugaaacuugguuaaauuguaauaugaagcucuuaggucacuuccuaacaaaucaaagugaucucugugguaaaccaauugaauuuuccuggaacaaaugcaacauaaugguuuccaauguauuauauugagugauauugucaaugaaguuggagaagagaacaaaacagaaaguuguucaaauuugcacuccugccagccaagugauuacaguucacaugguuacugaaacacuuuaaaaagauagcuacgaagucagugacaaguagaagagaaagcugaaugaaauauuggcaacauuccucuuuuggaagacacuauuagaucucaagcuucagugugcaucagaaucaaucaccugaacacugggucccgcaguuucugauucaguaggucuggguuggagcccacaaauguauacugaugaucaguuucuagauguugcugcugcugguucaagacaacacuuugaguuccuaucaaagacgcaugcuagcaaacauuuugcuugacaggugagcaugcuagcagauauuuucuuuggacaaagucauucuuguacaggauaugaaccaauugucuacuugugccaugcaugagugagugaaauaugcucaaugacuucucauuggaaaauccaugcuaaagagaggaagauuuuuuuucucacccaguuaauuacaucaccuaugauauaggcugggaagggaccuuggcauugguagugagggagcaccaaccacaagugagcagacaagggcuucacucugugacuaaauaugguugcguugaaaugucuguccauacuuuauucacagaggauaguugguggucauaauaagccuuuguucuugauucagaguugaggaaaauagagaaaaaugugaauaugaucuaaagcugggcaugguggcucaugccuguaaucccagcacuuugggagguugagguggguggaucaccugagcucaggaguucgagaccagccuggccaacauggugaaaccccgucucuacaaaaauauaaaaauuaccuggguaugauggugggugccuguaaucccagcuacuugggaggcugaggcaggagaauugcuugaacccaggaggcagagguugcagugagccaagaucacaccauugcacuccagccugagcaaaagagcgaggcucugccucuaaaaaaaaaaaaaaaaagaaugugaacuaagaaugacaacugaauguacauauuuuguguacugugcaaagaaaugggcagcaaauuuaagaugauguucucccugcugaaggcugcugguuauugcugaggaagaugcucaagaguucuggaaugaaagaggaauuaaaaauauuuauuuacaacauuaauaauaucaguauggaucauuucagggauuucaaguagcuuaauucaacagcaugcucacuguuuucucuaguuugaacuagaugaaaugcgguacaaauagcuugaucucuaauaguuuagucuuuuaaaacuugauuacaucuuuucuugauuugagaaauaacuuagcgauguagcauugggcauguuugaaaaguacacaaauaagucaaacauacaagacugauucacagagcuccauuuaacucagcagaggaucuggauuucauuugcugcaauaucccagguucaaacagucagcacaccagccauuuccuggaaauguuguucaauuagcauccaacagacugugaaaaguagugugaaacucacuucucacuuuagugagacguuuguucauaauuucuagaucuacaugugagccaaauaucuacagccauuugacagaaccaccaaacauacuugcuguuauuccuggcaaccucuaacugagauuuaggaucuuuuaguuuugugagaauaaauaauggaaaagaaaucaggaugcugaccuacgccacaagcaagaucuuggugaaaaacugcaaaugcuuaugccccucucauugauuugaaucuguuuacuuaaauuuuuuauuuuaaaauuugugauuaaucuauuuuuggaaaugcauuauaauuaauggucuccauguacuccaaauggccuuuaaguggccacuuacagacugguaauaacgaugagcagugcugaauuuuuucgucuuuggcaauacggcuccaugguggugcuacauuagcaccaccauguggagaaaaggaacaauagcacucuuucuaugguuaaaaugggaacaauacauccucuugaauuuuuuuuuuuuuuuuuuuuuuuuuuuuuuuugagauggaguguagcucugucacccagcuggagugcagugacacgaucuuggcucacuguaaccucugccucccagguucaagcgauucuccugccucacccucccgaguagcuggggcuacaggugugcaccacugugcccagcuaauuuuuauauauuuuuuuuaguaaagacgagguuucaccauguuggccagguugauccugaacuuuuggccucaagugaugcacaagucucggccucccaaagugcugggauuacaggugagccaccgccuccagccuggaacaucauuuucuuauggaaagaaagucuuaauucagggucuuuucuauggcucucaucuaguuugcuagaugagauuacagcccaauuacuggcacagagcugagaguggagugaacucuauucacuuauuccuguagaaaugaaaaucuuacugccucaaauugcucagaaaacucugagugauuagucuaaggauuuuuaaaguuguuaaccugacuccuggucccaugaccuagagguuuacaaauggcaagaaaguauacuuuuaauugaaagaaguuuguuacuugaauuuggaguuacaaaucuaaaguaugucuuguuaauauugugugucuuuuagcaugaguaacuugaaaaguuagagcucuuauaccuugaaauuauaccaauuaaauauuugcuuaaguuaauaaacauuggacaguagcucacagcucugcuagaagcaucauuuauacgucaguauuaaucaguagaguaagauccauugucuuccagcauuucaugaagauugcuuggaaagugaggaguuuaaugaggaguaagggaggcaaaugcuuuggaggcacaaagcacuuuggccaggacaggucugagugcagcaucucugguguagggaggcguggucccagguaccagaauuagagcaguauuguagauuuuauagaucagcuacauuguggauuaaaccaauguucauggguuaguuugcaaauuuauuuuuauuuuuuauucuuuuuuuuucacacaacacacagauugagaauuuaauguuuaccauguugcuagugacauugcuuuuuugggaugauguauucugaguuuuuguuuuucuuuucugagacagagucucccucuguugcucaggcuggagugcaguagcaccgccucggcucacugcaaccucugccuccuguguucaagagaucucccgucucagccucccuaguagcugggacuacaggcacgugccaccaugcccagcuaauuuuuguguuuuuaguagagacaggguuucaccauguuggccaggcugaucuugaacuccugaccucaacuccgacccugccuuggccucucaaagugcugggauuacaggugugagccacggugccuggcuguguucugaguuuuaaauaacaucauuacaaauaagcuuuuaucaccuaacccaauucuguguuggaaauaagaaacauuuauuguuuguacaugugucagguucugaucuaagugcuuuaaauauuaacucauuuaaucauuacaagaagauacugauguuauuugguauuacagaugaagcagcggaggcacagagguuaaacuuuugucagaaucacaguugguaagauguacuacuaggauuugaagccaggcagcaugacuccagagguuaugacuucuuuuuuuuuuuuuuuuuuuuuuugagacggcgucucccucuguugcccagccuugagugccguagcacgaucucggcucacugcaaccuccgccucccagguuaaagugauucuccugccucagccuccugaguagcugggauuauaggcgccugccaccacgccuggcuaauuuuuguauuuuuaguagagacgggguuucuggucuugaacuccugaccucaggugauccacccgucucagccucccaaagugcugggauuacaggcgugagcuaccgcgcccgaccugagguuaugacucuuuuuuuuuuuuuugagacggagucucgcucugucgcccaggcuggagugcaguggcgcgaucucggcucacugcaagcuccgcuucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccuccucggccucccaaagugcugggaugacaggcgugagccaccgcgcccggccgguuaugacucuuaaccauugauccauguuguugauaacuuccaugcacagguuuuauaguuuucaaaguacuuucacuauguuuucucauuuauuccucaaaaaugauggugaaguaauuuucaggagcuguggaggaaaauuaaggaaucaaaugaggcuggagacucuggaguuggaaagauauuuguaacugauuuugagagaauuuuuaaaaugaaguauacauuauugugauuuagcauuuuaaaaaagcuuacuguucaacuacuuuuuaagaaauuuccaauuuauucuguugcgggagaucugaguuuuucaacugcuuuuucauguaauguauuucugaaaggugauagaauggucaaacccucuccuuaaguauaagaaauguucuguggacauuaacugauuuuuaauggauauaauugagaaagaucauaaugaagaaaauguaacaauuuacauuuugaaaaaucucauucuaaaauucuauucuuguaacaauggcaucacaagcuauccccaggauuuuagcucaauaauauuauagauucuugauaaauaaacacauauugacuccagucacaaaggauugccucuucaaguuguuaaucaaauauuacaugugacuagugagggacagagaugcauuaucuucauuuugugugcaaggugauagauggaggaaaaaagauugacaguaacuaagaggcaagcaggagguuuaaaaacugcgaagaccaugucauuuuucccaacaaacuuuuuucugauuaagauauuuuagagucaggaaauaaaaggaugauagaauaugagcaugguggaguuaggggagcaacucugccuugcagaacucacagguggguggauaaacacucaaaugaggugauaguuucucaaccaguuuuuguuguuguuguuguuguuuugagacggagucucgcucugucgcccaggcuggagugcaguggcgugaucuuggcucacagcaagcuccaccuccuggguucaugccauccuccugccucagccucccgaguagcugggacuacaggcguccaccaccaugccuggcuaauuuuuuguauuuuuaguagagacgggguuucaccauguuagccaggauggucucgaucucccgacuucgugauccgcccgccuuggccucccaaagugcugggauuacaggcaucagccaucgcgcccggccucaaccaguuuuuaauagcugugcuaaaacagagaauugcagagauucaguugcaaggccuuaucaccuccuggaggaaguuaucaaauaauaagacagcauuacugaggaaucauacuggaaaaauagccuuaugucccuacacauauauccucuaaaucagugguccccaaccuuuuuggcacugggaacugguuucauggaagacaaucuuuccauggaccaguggaggugugggugguuuuggaaugauucaaacauauuacauuuauugugcacuuuauuucuauuaucauuacauugccauauauaaugaaauaauuauacggcucaccauaauguagaaucagugggagcccugagcuuguuuuccugcaacuggacagucccaucugggggugauaggagacagugacagaucaucaggcauuagauucucauaggagagugcaaccuagaucccucacaugggcaguucacaauauggcuugugcuccuaugagaaucuaaugaugcugcuaaucugacaggagacagagcucaggugguaaugugagugauggggagcagcuguaaauacagaugaaacuuggcuugcucgcuggcccccugcuuaccuccuguuguguggccugguugcuaacaggccauggauugguaccagucuguggccuggggauugggaacccuugaucuaaauaugcuucuuaguaacaucagaagugaaagaguucugaaaagaucuguaaaagcauuaacaaguuaaaaaagaaaacuuuaccaagcucucauauagaagcuguuacuagccaagaaagaauaaaagaguaagguaaauuguaaucagaguaacugauguaguuguuaacaugcuaugagaauacagaaaaacaaaaacauucuucaagaacaguaaucguggaggacuuuaaaguucuaauaaauuuaagaaauacuuuacugaauucaauugcaggacucccugagauaauaaaauaacuuugcuuuguuguuuugauaucuaagaacauuuugguuagauuccucacaagugguggcaaugaagucaacaguugaaggaaauacaauguuaucacgacuuucauggcuuuauugaaaagcaaggugaauuugucacuugauuaauccuguugcaaagaccaucucaaauguauaaaggaugacuucgacaagaagucugauuucucaagauuaugugaaaaacagcuauacaguuuugaagcaaugcuuugugaguuauuuaaaaauuacaccuguaccacaggucuuuggauaacaaaacaaauguauacuuaagauuugaugggcugggugcgguggcucaugccuguaaucccagcacuuugggaggccgaggcggguggaucacgaggucaggagaucgagaccauccugucuaacauggugaaacaccgucuguacuaaaaauacaaaaaauuaaacgggcgugguggcagccgccuguaaucccagcuacuugggaggcugaggcaggagaauggcgugagcccgggaggcggagcuugcagugagccaggauggcgccacugcacuccaggcugggcaacagagugagacugucucaaaaaaaaaaaaaaaaagauuuguugcucuugagcaacuugaugcuguaaaauucagaaugucuucaaguguaugguccagaaauauagucuggaguugguaaguggcaaagccuuugauaaacauggccagugaccucugaauacuccccaaagccagcguuuucuucuuguacagugcauaagauuuauuuauuuugaaaauccucauacuaguuuggaaccaguagaaccuaugguuaaacuggcugcauuggaauuagcuguggacccaaauccuaacucugcuacuuucuagcauugugaauugggcaaguuccuuucaucuuucucagccuuaguuuaaucauuugugaaaugggaauauuguguaccugaauacaguagugguuauauuuagugaaucauguauguaagacacauaguauuggguagcucaagaaauaauuuuaguuauuuuuuccuucaaucuuaaaugacucauauauaucagcuaguuucaauucaggcaaaccagaacacucugaagagcauauacaagaaaucccugaagcaaaaaagggggaaaagcuaaaaaaaaaaaaaaaaaaaagguuauaguccaggaaacucauuuaauaaaauagcauguugcaaaauuugaauuuacccaguuuuuuucuucuaguuaguaguuuuggaaaucaguauucuuugaacuaaacacugagaagacauuuccuauuuuguuuuacaagacauaguauaguauaugaggaccuguauaagaaaacaggaagagccuacuugcuucucugucauuuauuagcugaauaacauugaucagaccgcuuaacuuuucugggccuucuugccacaggccugcuuuaagaguuuuuuucuaaccuaaagauuacaccaaaaaacauuuagaacugaucaacgaauucaguaaaguuuuaggauacaaaaucaacauacaaaaaucauuagcauuuauauacaccaacagggaacaaucugaaaaagaaaucaagaaagcaaucucauuuacaauagcugcaaagaauauaaaauaccuagaaaucaauuuaaccaaagaagugaagcaucuauacaaggaaaacuauaaaacacaggugagagaaauugaagaggacaccaaaaauggaaaaauauuccauacuuuuggacuggaauaauuaauauuguuaaaaugauaacacuucccaaagcaauuuacugacucaaugcaaucccuaucaaaauaccaauaauauucuucacaaauaucgaaaaaaauccuaaaauuuauauggaaccacaaaagacccucaauaacugacaaaauccugaggaaaaaagcccaaagcuggagaccucacacugacuucaaaguuuacuacaaagcuauaggaaccaaaucagcaugguacuggcauaaaacagacacauaggccaauggaacagaacagagaacccagauauaaauccaugcauuuacagacaacucaucuuggacaaaaguaccaagaacagaggggaaaggacauucucuucaauaaaugaugcugggaaaacuacauagccacaugcagaacaauguaacuagaccccuaucucucaccauauauaaaaaucaacucaaaaugaauuaaaacuuaaauaucggacuugaaacuaugaaacuacuagaagaaaacauuugggaaacacuccaggucauucgucuggacaaaaacuuuuuguguaagaccacaaaacacaggcaaccaacacaagaauagaaauaugggauuuauaucaagcuaaaaagcuucuacacagcaaaggaaacaacaaaaugaagagauaacccauagaaugggauaaaauauuugcaaacuacccaucugaucagggauuaauaacgagaauauauaaggggcucaaauaacucaauagcaaaaacaaauaaucuguuuuaaaaauaggcaaaagaucugaauagacauuucucaaaagaucugcaaauggcaaacagguguaugaaaaaaugcucaauaucacuacucagagaaaggcaaaucaaaacugcaaugagauaacuucucauccaguuaacaugacuuuuauccaaaauauaggcaguaauucccccccccucaaaaaaaaaaaaaccacaccuaaauacaggcaauaguggaugcuggugaggaugcagagaaaggugaacccguacauuguuggugggaaaguaaauuagcauaagcacuguggagaaaaguauggauguucuuaaaaaaaaaaacuaaaaauagaacuaccauaugauccagcaacuccacuaauauauauguguguauauauacauacacauacauguguguauguauacacacauacauauguguguacguauauauguauguguauguauacauacacauacauauauacacuauauauacauauguguauguguguauauauacacacauauauguguauauauguauauguacacacacauauguguauauauguacauguacacacacauauauaugcguauauauguacauguacacacauauaugcguauauauguacauguacacacauacgcacauauaugcguauguguguacauguacauacauauauguguguauauacauacacacacauauguguauauauguauacacacacauauauguauauauguauauacacacauauauguguacacacauauauguauauauacacacauguguguauauauguauacauacacacauauguguguauauauguauauguacacacauacacauauauauguguauauauauguguauauauauuaguggaaguuuucuuaaaaguuuuauguaaguuuucuuaggagagagauauauauauaucccaaaagauauauagagauguauaucagauauaucaaaaggguauuugcucucuguacucccauguuuauugcagcacuauccacaagagauaagauaugcaaucaaucuacccaucaauggaugaauggauaaauaaaauaugguuuauauauacaauggaauguuauuccaccauaaaaagaaugaaaucccaucauuugcagcagcuuggauggaacuggagaucauuauguuaugugaaauagccaaacacagaaagacaaauguugcauguucuuacucauaugugggagcuacaaagguggaucucaugaagauagagaguagauuggagaauaccagaggccaggaaggguaggagggaguggaggaugaagagagauugauuaauagguacaaacauaugguuugauagaagaaauaagauguaguguuagaaggaucaguagggugacuauaguuuacaacaaucuauuguauaucuugaaauagcuaggagggaaaaauuccaaucguucuaguauaaagaaaagacaaauauuuaagauuauggcaaucccaaguauacuuaucuuuacacauuauaucaguguauuaaaugaucauauuuacucugaaacuauauuaugcauaaauaaaaaauaaaauuuucuuacagauacaauugaagucccuuuuaaaauuccuugcugauuccauucuccuuccuaccuccucagagggaaccacacuauaucuacuuccuauagcagauguuguugguugccuagacaauauucaugccuuuauuuauagaaucucaauuuucuuuagcuaucuacucugcuucuagaggacaugcuacuuaagagaggcaggugccagccaccagcccaggaagacugauugguuuaagccagugauggugguguaccauuccucuugccagaguuugguuuaggcauuggcaugugauacaguuuugaccaaugagacacgagggaaagucuuccagggacuugugggaaagauuuccucucuccugagggaggcacacagaggaagaguccuuucuuccuuggaacuucgguguguugagaugugaugccuggaauguuuuaacuucuggggucaugaagggagucagauuguggagaaagcugacauguggaggauggcagaacagaaggaugauaugaaucuaggcucuuuguuucuaccguuuggcaaccgaauuaacacuggaaacucucuaguucuguguucauuaugcauuacaauaaauuccuacuugugauucaugccaauuugagccacaauuuucgguuacuuuuagcuaaaagcagucaaaauuauauauuucuaguccaagaaguuguacuuuuacuacauagauguuuuuauaaugauguguaauuguugucuucacacaaaugaucuuguaucauacaaguugguuuuuuaauucaauguuuaauuuuugccauguugauacaguuuaagcauuguauaauucauuguauaaaaauaucacuauucaugcgcuuauugauggacguuuagguaaauuuuuucccuauuacaaauaguucugcaauaucuauuccauuagacgaugccacgugcacauaugugagagcuucucuagggcugcacuauccagugugauagccacuggucacauguagcuauuuaaguuaaaauuaaaaguucagguuuuuuggccaggugugguggcucaugccuguuaucccagcacuuugggaguggaggcagacagaucacuugaggucaggaguuugagaccagccuggccaacaugauaaaauuagcugggagugguggccuguuccuguagucccagcuacuugggaggcugagggacgagaaucgcuugaacuugggaggcagagguugcaaugagccaauaucacaccauuacacuccagccugggcaacaaagugagacuccaucucuaaaaaacaaaacaaaacaaaaacaaaaacaaaaaagucgcauuuuugguugcauuagccacauuuuaagugcucaauagcuacauguggcuaguaguuauuguacuggaugauauacauauggaaaguuccugucacugugggaaguucuauuggauagugcugcuccagcacaggguuucugaauauuuuucauaggauggcaccugcagaaaaugauaauauuuguacagcucacugggauaaauagauaaggcugcucaaguuuggaggagacugguucagggacucuggcugcccuaagaccuucucaguugcccuaaggacugagggauugcugaugucucauguaucccuguaacucacuuccugcccaucaacaugccuuggcucugcuuuagauguauacccaggagugcuguugcugggucauagugcaugcauguuucaauuuuaucagauauuaccgucuuauuuuccaaaguaguuauuaacaguuuauacuuacauaagcaguaagugcaaguuccucuuuucuucuccuuggcaauacuuaauauugggagauuucuauauuuuugccaaucugaugggugugaguuaauauaccauuauuuuaacuugcauuucccuuauuuugggugagguugaacauuuuuucacaaauguaauuucuuagaauuucccgugcauauccuuagucuguuuuguauuaucuuguuuauuacuuuaauucauuugaggaauuauuuuuucggaugcuaacccguuugcaaguuauaugaaaugccauguauuucggccugucgcucaucuuuuaacuuugcuuaugauauauguuguggcaccaaaguuuuaaacuuuaacauugucaagauuaucaaacuuauucucugugguuugagcuuuuauagcuauauuaagaaauccuuucuuauuccaaugucaaaaagauaagacuguuguauguucuucuaaaaguuuucaaguuuuacuuuucacuuagaggaauuuaaacggcuuucauaccaauaaucaaguuuuaaauucuuaaaacuaggcugggugcagcagcucacaccuguagucccagcacuuuggaggccaaggcggguggguagcuugagcucaggaguucgaaaccagccugggcaacaugguaaaacccugucucuacaaaaaaauacaauaauuagccaggugugguggugugcgccuguggucccagcuacuuggaaagcugagguaggaggaucgaugccugggaagucgccugggaacugagaucgugccacugcacuccagccugggugauagagacucugucucaaaacaaaaaacccuccaaaaacuuaaacgaaaaaagauuuaauucugucucugucuuccagaauccccuacuuauaucuuuuuauaaauuuuuuacaguaaaucaguauguauugccaaaauauauauaugguccuuuaaaaaaugaaaauugauuuuuuuugagacagucuaacucuauugcccaggcuggagugcgguggcacaauauuggcucacugcaaccucugccucccagguucaagugauucuugagccucagccuccccaguagcugggauuacagguguaugccaccauuccuggcuaauuuuuguauuuuuuguagagaugggguuuccgcauguuggccaggcuggucuuaaacuccugaccucaggugaucugcccaccugagccucccagagugcugggaggugugagccacugcgcccagccaaaaauugauauuuugaagagucuaaaauuuccaguuuugcauaucuacuggaaaugcagugugaguauuuuauugucuuuuuaacuuuuuaauguacucuggggugguaaaauguuugucaucuuguauauuuguauucuaucgauucucuaauuugaauuaucaagagcaaaggucacucuccuuucccuccacauguuguuaccucaguugucucugucuuccagaauccccuacuuugaaacuagugcugccaaugggacaaacauaagccaagcaauugagaugcuucuggaccugauaaugaagcgaauggaacgguguguggacaaguccuggauuccugaaggaguggugcgaucaaauggucaugccucuacggaucaguuaagugaagaaaaggagaaaggggcauguggcuguugagaagucaaguaagcgacauaguaguucagguggcccaugccugggaucuucucuaugauugauacauggcacagugagagauuaaugggcauuguguacaaauugcuucucaccauccccauuagaccuacgaauaaagcauccgguucuaaaauuaauuuguugcagcuuuguaaauauuucuuuaagauucagccugagaguuaggagaaauauuucagagccaaaagugccuuauacaaccuuagccuauuauaguaaaucauucaaggauucagaauuuugcagucacagaagaguguauuuauuauguagaaugaaugaggguacugucaccugccuuaauguagguaggcccagagucuuacauuuaagaucuuacaugcaguuauaaaaccgccacagucuucaauccagauuugaagacucaugccauaggugacauucuaaaauaccauuaaagccacuuaaauguuaaauaagaauauacaugcacaucagcucaaugucuuugaguauuaauuuuauguaagcauucuauuuaacaugaauauaggacaaaucauggcuauaucuauagaccuuggauaaacuggauugaccaauuauacacucacggugacuuuuuuauuggugggaaggggauugggguggggcaggcuggcuuaauguaauaugagcaaccaaagugggacuucugucuccccgcuauauucccauugcucugaaugguugauugaagggucagggaacuagauuuuauggcuuuaguucacugugauuguacauuuauacuuggccuaugugcuggccgcaccugaacauagcuggugcuuaugccgaguuauuugcgaugaguaaauauuuaguuucuuuuucuucauauuuauaauguugaucuggcauccucaggcugcagcuuuauuagcuuauaacuuacucaucucuaucuuuaccagcaggcucuguauuguugauauuugcaacuuguuuugcuuuuccauugguggaauugaaauaauuaguuuuuaauuacauaagaugccuguuugcuauuugguggaagauagauguucauauugaagcagucacauuuguacuguaguucaauaaaagaaaaaugaaguauucuguagccuauauuuuucauagagcucaugagcauuuacuguacuugcugggucuugccaagaucauuuauuccgcugcauugccaaagugucuucauaccaaauuaaaggugguuuuaauauauguuucauggaaguuguuuauaaaauucaaagguauuucauuuaggugaaaagucuuauuuauuaaagugguuugaauaaaguagaucaaaacuuccagagaucuuaauggcuauauaggaagaaauaucacucaccauaauuuaaauaaagaauaaaaauacuuguauuuugugguggcaaauguuugguagaacuguaauuagaaaaauacaaguauauuugcgugaugguuacacuagaagcccagacuuuacgacuacacaauauauucauguaucuaaacuguacuuguacccccuaaauuuauuuuuaaaaaaggaaaaauaaaaguaucaugaaaaaaccuauuuuuuuuuccacuguccuuccacuacucccauaacaaacuuauccaugguugguaaaauuuuacauauuucuauccuugaaaugaaggcuucuuuuaaauuccaaagaagucauggaggccugugcauuugaauuguauaugcuagugaggaaaagauuuagacauuucaagagcaggguuggccaggcgcgguggcucacaccuguaaucccagcacuuugggaggccgaggagggcggaucacgaggucaggagaucgagaccauccuggcuaacacagugaaaccccaucucuacuaaaaaaaaaaaaaaaaaaaaaaugggcugggcgugguggugggcaccuguagucccagcuacucaggaggcugaggcaggagaauggcgugaaccugggaggcggagcuugcagugagccgagauugcgccacugcacuccagccugggcgacagaggagacucugucucaaaaaaaaaaaaaaaaaaaaagagcagggucauaaucacacagcagugccuuauauaguugccauaagacuucagugcaguacaacauaauuuuacagcuacauaucagggcauauucuauaugguguauuuguguuagaauaacacauuaaaugucuuuaaacauaaaaauaagaauguuugcauguuucaguuuucaagaaccaaaugaguaauuagcuauagauuccacuggccuuaaacauacaauuaaguguauacaugauauagugcacacacaaaagccaccuuuaauuauugaaauaaccuguauucuuuuuggaaaucauuuaaguuugguauugaaguacuauauuuuuugugcaucaauguauuuuucuauuuacaagccuauguaaaagugaaguguaucuucagugaaccaugugccaauuaagcuguaauaaaaaaguggucuagucugucaaa

SEQ ID NO: 192955 - RNA, 86850 nt, Homo sapiens
uuugacagacuagaccacuuuuuuauuacagcuuaauuggcacaugguucacugaagauacacuucacuuuuacauaggcuuguaaauagaaaaauacauugaugcacaaaaaauauaguacuucaauaccaaacuuaaaugauuuccaaaaagaauacagguuauuucaauaauuaaagguggcuuuugugugugcacuauaucauguauacacuuaauuguauguuuaaggccaguggaaucuauagcuaauuacucauuugguucuugaaaacugaaacaugcaaacauucuuauuuuuauguuuaaagacauuuaauguguuauucuaacacaaauacaccauauagaauaugcccugauauguagcuguaaaauuauguuguacugcacugaagucuuauggcaacuauauaaggcacugcugugugauuaugacccugcucuuuuuuuuuuuuuuuuuuuuugagacagagucuccucugucgcccaggcuggagugcaguggcgcaaucucggcucacugcaagcuccgccucccagguucacgccauucuccugccucagccuccugaguagcugggacuacaggugcccaccaccacgcccagcccauuuuuuuuuuuuuuuuuuuuuuaguagagaugggguuucacuguguuagccaggauggucucgaucuccugaccucgugauccgcccuccucggccucccaaagugcugggauuacaggugugagccaccgcgccuggccaacccugcucuugaaaugucuaaaucuuuuccucacuagcauauacaauucaaaugcacaggccuccaugacuucuuuggaauuuaaaagaagccuucauuucaaggauagaaauauguaaaauuuuaccaaccauggauaaguuuguuaugggaguaguggaaggacaguggaaaaaaaaauagguuuuuucaugauacuuuuauuuuuccuuuuuuaaaaauaaauuuaggggguacaaguacaguuuagauacaugaauauauuguguagucguaaagucugggcuucuaguguaaccaucacgcaaauauacuuguauuuuucuaauuacaguucuaccaaacauuugccaccacaaaauacaaguauuuuuauucuuuauuuaaauuauggugagugauauuucuuccuauauagccauuaagaucucuggaaguuuugaucuacuuuauucaaaccacuuuaauaaauaagacuuuucaccuaaaugaaauaccuuugaauuuuauaaacaacuuccaugaaacauauauuaaaaccaccuuuaauuugguaugaagacacuuuggcaaugcagcggaauaaaugaucuuggcaagacccagcaaguacaguaaaugcucaugagcucuaugaaaaauauaggcuacagaauacuucauuuuucuuuuauugaacuacaguacaaaugugacugcuucaauaugaacaucuaucuuccaccaaauagcaaacaggcaucuuauguaauuaaaaacuaauuauuucaauuccaccaauggaaaagcaaaacaaguugcaaauaucaacaauacagagccugcugguaaagauagagaugaguaaguuauaagcuaauaaagcugcagccugaggaugccagaucaacauuauaaauaugaagaaaaagaaacuaaauauuuacucaucgcaaauaacucggcauaagcaccagcuauguucaggugcggccagcacauaggccaaguauaaauguacaaucacagugaacuaaagccauaaaaucuaguucccugacccuucaaucaaccauucagagcaaugggaauauagcggggagacagaagucccacuuugguugcucauauuacauuaagccagccugccccaccccaauccccuucccaccaauaaaaaagucaccgugaguguauaauuggucaauccaguuuauccaaggucuauagauauagccaugauuuguccuauauucauguuaaauagaaugcuuacauaaaauuaauacucaaagacauugagcugaugugcauguauauucuuauuuaacauuuaaguggcuuuaaugguauuuuagaaugucaccuauggcaugagucuucaaaucuggauugaagacuguggcgguuuuauaacugcauguaagaucuuaaauguaagacucugggccuaccuacauuaaggcaggugacaguacccucauucauucuacauaauaaauacacucuucugugacugcaaaauucugaauccuugaaugauuuacuauaauaggcuaagguuguauaaggcacuuuuggcucugaaauauuucuccuaacucucaggcugaaucuuaaagaaauauuuacaaagcugcaacaaauuaauuuuagaaccggaugcuuuauucguaggucuaauggggauggugagaagcaauuuguacacaaugcccauuaaucucucacugugccauguaucaaucauagagaagaucccaggcaugggccaccugaacuacuaugucgcuuacuugacuucucaacagccacaugccccuuucuccuuuucuucacuuaacugauccguagaggcaugaccauuugaucgcaccacuccuucaggaauccaggacuuguccacacaccguuccauucgcuucauuaucagguccagaagcaucucaauugcuuggcuuauguuugucccauuggcagcacuaguuucaaaguaggggauucuggaagacagagacaacugagguaacaacauguggagggaaaggagagugaccuuugcucuugauaauucaaauuagagaaucgauagaauacaaauauacaagaugacaaacauuuuaccaccccagaguacauuaaaaaguuaaaaagacaauaaaauacucacacugcauuuccaguagauaugcaaaacuggaaauuuuagacucuucaaaauaucaauuuuuggcugggcgcaguggcucacaccucccagcacucugggaggcucaggugggcagaucaccugaggucaggaguuuaagaccagccuggccaacaugcggaaaccccaucucuacaaaaaauacaaaaauuagccaggaaugguggcauacaccuguaaucccagcuacuggggaggcugaggcucaagaaucacuugaaccugggaggcagagguugcagugagccaauauugugccaccgcacuccagccugggcaauagaguuagacugucucaaaaaaaaucaauuuucauuuuuuaaaggaccauauauauauuuuggcaauacauacugauuuacuguaaaaaauuuauaaaaagauauaaguaggggauucuggaagacagagacagaauuaaaucuuuuuucguuuaaguuuuuggaggguuuuuuguuuugagacagagucucuaucacccaggcuggagugcaguggcacgaucucaguucccaggcgacuucccaggcaucgauccuccuaccucagcuuuccaaguagcugggaccacaggcgcacaccaccacaccuggcuaauuauuguauuuuuuuguagagacaggguuuuaccauguugcccaggcugguuucgaacuccugagcucaagcuacccacccgccuuggccuccaaagugcugggacuacaggugugagcugcugcacccagccuaguuuuaagaauuuaaaacuugauuauugguaugaaagccguuuaaauuccucuaagugaaaaguaaaacuugaaaacuuuuagaagaacauacaacagucuuaucuuuuugacauuggaauaagaaaggauuucuuaauauagcuauaaaagcucaaaccacagagaauaaguuugauaaucuugacaauguuaaaguuuaaaacuuuggugccacaacauauaucauaagcaaaguuaaaagaugagcgacaggccgaaauacauggcauuucauauaacuugcaaacggguuagcauccgaaaaaauaauuccucaaaugaauuaaaguaauaaacaagauaauacaaaacagacuaaggauaugcacgggaaauucuaagaaauuacauuugugaaaaaauguucaaccucacccaaaauaagggaaaugcaaguuaaaauaaugguauauuaacucacacccaucagauuggcaaaaauauagaaaucucccaauauuaaguauugccaaggagaagaaaagaggaacuugcacuuacugcuuauguaaguauaaacuguuaauaacuacuuuggaaaauaagacgguaauaucugauaaaauugaaacaugcaugcacuaugacccagcaacagcacuccuggguauacaucuaaagcagagccaaggcauguugaugggcaggaagugaguuacagggauacaugagacaucagcaaucccucaguccuuagggcaacugagaaggucuuagggcagccagagucccugaaccagucuccuccaaacuugagcagccuuaucuauuuaucccagugagcuguacaaauauuaucauuuucugcaggugccauccuaugaaaaauauucagaaacccugugcuggagcagcacuauccaauagaacuucccacagugacaggaacuuuccauauguauaucauccaguacaauaacuacuagccacauguagcuauugagcacuuaaaauguggcuaaugcaaccaaaaaugcgacuuuuuuguuuuuguuuuuguuuuguuuuguuuuuuagagauggagucucacuuuguugcccaggcuggaguguaauggugugauauuggcucauugcaaccucugccucccaaguucaagcgauucucgucccucagccucccaaguagcugggacuacaggaacaggccaccacucccagcuaauuuuaucauguuggccaggcuggucucaaacuccugaccucaagugaucugucugccuccacucccaaagugcugggauaacaggcaugagccaccacaccuggccaaaaaaccugaacuuuuaauuuuaacuuaaauagcuacaugugaccaguggcuaucacacuggauagugcagcccuagagaagcucucacauaugugcacguggcaucgucuaauggaauagauauugcagaacuauuuguaauagggaaaaaauuuaccuaaacguccaucaauaagcgcaugaauagugauauuuuuauacaaugaauuauacaaugcuuaaacuguaucaacauggcaaaaauuaaacauugaauuaaaaaaccaacuuguaugauacaagaucauuugugugaagacaacaauuacacaucauuauaaaaacaucuauguaguaaaaguacaacuucuuggacuagaaauauauaauuuugacugcuuuuagcuaaaaguaaccgaaaauuguggcucaaauuggcaugaaucacaaguaggaauuuauuguaaugcauaaugaacacagaacuagagaguuuccaguguuaauucgguugccaaacgguagaaacaaagagccuagauucauaucauccuucuguucugccauccuccacaugucagcuuucuccacaaucugacucccuucaugaccccagaaguuaaaacauuccaggcaucacaucucaacacaccgaaguuccaaggaagaaaggacucuuccucugugugccucccucaggagagaggaaaucuuucccacaagucccuggaagacuuucccucgugucucauuggucaaaacuguaucacaugccaaugccuaaaccaaacucuggcaagaggaaugguacaccaccaucacuggcuuaaaccaaucagucuuccugggcugguggcuggcaccugccucucuuaaguagcauguccucuagaagcagaguagauagcuaaagaaaauugagauucuauaaauaaaggcaugaauauugucuaggcaaccaacaacaucugcuauaggaaguagauauagugugguucccucugaggagguaggaaggagaauggaaucagcaaggaauuuuaaaagggacuucaauuguaucuguaagaaaauuuuauuuuuuauuuaugcauaauauaguuucagaguaaauaugaucauuuaauacacugauauaauguguaaagauaaguauacuugggauugccauaaucuuaaauauuugucuuuucuuuauacuagaacgauuggaauuuuucccuccuagcuauuucaagauauacaauagauuguuguaaacuauagucacccuacugauccuucuaacacuacaucuuauuucuucuaucaaaccauauguuuguaccuauuaaucaaucucucuucauccuccacucccuccuacccuuccuggccucugguauucuccaaucuacucucuaucuucaugagauccaccuuuguagcucccacauaugaguaagaacaugcaacauuugucuuucuguguuuggcuauuucacauaacauaaugaucuccaguuccauccaagcugcugcaaaugaugggauuucauucuuuuuaugguggaauaacauuccauuguauauauaaaccauauuuuauuuauccauucauccauugauggguagauugauugcauaucuuaucucuuguggauagugcugcaauaaacaugggaguacagagagcaaauacccuuuugauauaucugauauacaucucuauauaucuuuugggauauauauauaucucucuccuaagaaaacuuacauaaaacuuuuaagaaaacuuccacuaauauauauacacauauauauacacauauauauguguauguguguacauauacauauauacacacauauguguguauguauacauauauacacacauguguguauauauacauauauguguguacacauauauguguguauauacauauauacauauauguguguguauacauauauacacauauguguguguauguauauacacacauauauguauguacauguacacacauacgcauauaugugcguauguguguacauguacauauauacgcauauauguguguacauguacauauauacgcauauauauguguguguacauguacauauauacacauauguguguguacauauacauauauacacauauauguguguauauauacacacauacacauauguauauauaguguauauauguauguguauguauacauacacauacauauauacguacacacauauguauguguguauacauacacacauguauguguauguauauauacacacauauauauuaguggaguugcuggaucauaugguaguucuauuuuuaguuuuuuuuuuuaagaacauccauacuuuucuccacagugcuuaugcuaauuuacuuucccaccaacaauguacggguucaccuuucucugcauccucaccagcauccacuauugccuguauuuaggugugguuuuuuuuuuuuugagggggggggaauuacugccuauauuuuggauaaaagucauguuaacuggaugagaaguuaucucauugcaguuuugauuugccuuucucugaguagugauauugagcauuuuuucauacaccuguuugccauuugcagaucuuuugagaaaugucuauucagaucuuuugccuauuuuuaaaacagauuauuuguuuuugcuauugaguuauuugagccccuuauauauucucguuauuaaucccugaucagauggguaguuugcaaauauuuuaucccauucuauggguuaucucuucauuuuguuguuuccuuugcuguguagaagcuuuuuagcuugauauaaaucccauauuucuauucuuguguugguugccuguguuuuguggucuuacacaaaaaguuuuuguccagacgaaugaccuggaguguuucccaaauguuuucuucuaguaguuucauaguuucaaguccgauauuuaaguuuuaauucauuuugaguugauuuuuauauauggugagagauaggggucuaguuacauuguucugcauguggcuauguaguuuucccagcaucauuuauugaagagaauguccuuuccccucuguucuugguacuuuuguccaagaugaguugucuguaaaugcauggauuuauaucuggguucucuguucuguuccauuggccuaugugucuguuuuaugccaguaccaugcugauuugguuccuauagcuuuguaguaaacuuugaagucagugugaggucuccagcuuugggcuuuuuuccucaggauuuugucaguuauugagggucuuuugugguuccauauaaauuuuaggauuuuuuucgauauuugugaagaauauuauugguauuuugauagggauugcauugagucaguaaauugcuuugggaaguguuaucauuuuaacaauauuaauuauuccaguccaaaaguauggaauauuuuuccauuuuugguguccucuucaauuucucucaccuguguuuuauaguuuuccuuguauagaugcuucacuucuuugguuaaauugauuucuagguauuuuauauucuuugcagcuauuguaaaugagauugcuuucuugauuucuuuuucagauuguucccuguugguguauauaaaugcuaaugauuuuuguauguugauuuuguauccuaaaacuuuacugaauucguugaucaguucuaaauguuuuuugguguaaucuuuagguuagaaaaaaacucuuaaagcaggccuguggcaagaaggcccagaaaaguuaagcggucugaucaauguuauucagcuaauaaaugacagagaagcaaguaggcucuuccuguuuucuuauacagguccucauauacuauacuaugucuuguaaaacaaaauaggaaaugucuucucaguguuuaguucaaagaauacugauuuccaaaacuacuaacuagaagaaaaaaacuggguaaauucaaauuuugcaacaugcuauuuuauuaaaugaguuuccuggacuauaaccuuuuuuuuuuuuuuuuuuuuagcuuuucccccuuuuuugcuucagggauuucuuguauaugcucuucagaguguucugguuugccugaauugaaacuagcugauauauaugagucauuuaagauugaaggaaaaaauaacuaaaauuauuucuugagcuacccaauacuaugugucuuacauacaugauucacuaaauauaaccacuacuguauucagguacacaauauucccauuucacaaaugauuaaacuaaggcugagaaagaugaaaggaacuugcccaauucacaaugcuagaaaguagcagaguuaggauuuggguccacagcuaauuccaaugcagccaguuuaaccauagguucuacugguuccaaacuaguaugaggauuuucaaaauaaauaaaucuuaugcacuguacaagaagaaaacgcuggcuuuggggaguauucagaggucacuggccauguuuaucaaaggcuuugccacuuaccaacuccagacuauauuucuggaccauacacuugaagacauucugaauuuuacagcaucaaguugcucaagagcaacaaaucuuuuuuuuuuuuuuuuugagacagucucacucuguugcccagccuggagugcaguggcgccauccuggcucacugcaagcuccgccucccgggcucacgccauucuccugccucagccucccaaguagcugggauuacaggcggcugccaccacgcccguuuaauuuuuuguauuuuuaguacagacgguguuucaccauguuagacaggauggucucgaucuccugaccucgugauccacccgccucggccucccaaagugcugggauuacaggcaugagccaccgcacccagcccaucaaaucuuaaguauacauuuguuuuguuauccaaagaccugugguacagguguaauuuuuaaauaacucacaaagcauugcuucaaaacuguauagcuguuuuucacauaaucuugagaaaucagacuucuugucgaagucauccuuuauacauuugagauggucuuugcaacaggauuaaucaagugacaaauucaccuugcuuuucaauaaagccaugaaagucgugauaacauuguauuuccuucaacuguugacuucauugccaccacuugugaggaaucuaaccaaaauguucuuagauaucaaaacaacaaagcaaaguuauuuuauuaucucagggaguccugcaauugaauucaguaaaguauuucuuaaauuuauuagaacuuuaaaguccuccacgauuacuguucuugaagaauguuuuuguuuuucuguauucucauagcauguuaacaacuacaucaguuacucugauuacaauuuaccuuacucuuuuauucuuucuuggcuaguaacagcuucuauaugagagcuugguaaaguuuucuuuuuuaacuuguuaaugcuuuuacagaucuuuucagaacucuuucacuucugauguuacuaagaagcauauuuagaucaaggguucccaauccccaggccacagacugguaccaauccauggccuguuagcaaccaggccacacaacaggagguaagcagggggccagcgagcaagccaaguuucaucuguauuuacagcugcuccccaucacucacauuaccaccugagcucugucuccugucagauuagcagcaucauuagauucucauaggagcacaagccauauugugaacugcccaugugagggaucuagguugcacucuccuaugagaaucuaaugccugaugaucugucacugucuccuaucacccccagaugggacuguccaguugcaggaaaacaagcucagggcucccacugauucuacauuauggugagccguauaauuauuucauuauauauggcaauguaaugauaauagaaauaaagugcacaauaaauguaauauguuugaaucauuccaaaaccacccacaccuccacugguccauggaaagauugucuuccaugaaaccaguucccagugccaaaaagguuggggaccacugauuuagaggauauauguguagggacauaaggcuauuuuuccaguaugauuccucaguaaugcugucuuauuauuugauaacuuccuccaggaggugauaaggccuugcaacugaaucucugcaauucucuguuuuagcacagcuauuaaaaacugguugaggccgggcgcgauggcugaugccuguaaucccagcacuuugggaggccaaggcgggcggaucacgaagucgggagaucgagaccauccuggcuaacauggugaaaccccgucucuacuaaaaauacaaaaaauuagccaggcauggugguggacgccuguagucccagcuacucgggaggcugaggcaggaggauggcaugaacccaggagguggagcuugcugugagccaagaucacgccacugcacuccagccugggcgacagagcgagacuccgucucaaaacaacaacaacaacaacaaaaacugguugagaaacuaucaccucauuugaguguuuauccacccaccugugaguucugcaaggcagaguugcuccccuaacuccaccaugcucauauucuaucauccuuuuauuuccugacucuaaaauaucuuaaucagaaaaaaguuuguugggaaaaaugacauggucuucgcaguuuuuaaaccuccugcuugccucuuaguuacugucaaucuuuuuuccuccaucuaucaccuugcacacaaaaugaagauaaugcaucucugucccucacuagucacauguaauauuugauuaacaacuugaagaggcaauccuuugugacuggagucaauauguguuuauuuaucaagaaucuauaauauuauugagcuaaaauccuggggauagcuugugaugccauuguuacaagaauagaauuuuagaaugagauuuuucaaaauguaaauuguuacauuuucuucauuaugaucuuucucaauuauauccauuaaaaaucaguuaauguccacagaacauuucuuauacuuaaggagaggguuugaccauucuaucaccuuucagaaauacauuacaugaaaaagcaguugaaaaacucagaucucccgcaacagaauaaauuggaaauuucuuaaaaaguaguugaacaguaagcuuuuuuaaaaugcuaaaucacaauaauguauacuucauuuuaaaaauucucucaaaaucaguuacaaauaucuuuccaacuccagagucuccagccucauuugauuccuuaauuuuccuccacagcuccugaaaauuacuucaccaucauuuuugaggaauaaaugagaaaacauagugaaaguacuuugaaaacuauaaaaccugugcauggaaguuaucaacaacauggaucaaugguuaagagucauaaccggccgggcgcgguggcucacgccugucaucccagcacuuugggaggccgaggagggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaagcggagcuugcagugagccgagaucgcgccacugcacuccagccugggcgacagagcgagacuccgucucaaaaaaaaaaaaaagagucauaaccucaggucgggcgcgguagcucacgccuguaaucccagcacuuugggaggcugagacggguggaucaccugaggucaggaguucaagaccagaaaccccgucucuacuaaaaauacaaaaauuagccaggcgugguggcaggcgccuauaaucccagcuacucaggaggcugaggcaggagaaucacuuuaaccugggaggcggagguugcagugagccgagaucgugcuacggcacucaaggcugggcaacagagggagacgccgucucaaaaaaaaaaaaaaaaaaaaaaagaagucauaaccucuggagucaugcugccuggcuucaaauccuaguaguacaucuuaccaacugugauucugacaaaaguuuaaccucugugccuccgcugcuucaucuguaauaccaaauaacaucaguaucuucuuguaaugauuaaaugaguuaauauuuaaagcacuuagaucagaaccugacacauguacaaacaauaaauguuucuuauuuccaacacagaauuggguuaggugauaaaagcuuauuuguaaugauguuauuuaaaacucagaacacagccaggcaccguggcucacaccuguaaucccagcacuuugagaggccaaggcagggucggaguugaggucaggaguucaagaucagccuggccaacauggugaaacccugucucuacuaaaaacacaaaaauuagcugggcaugguggcacgugccuguagucccagcuacuagggaggcugagacgggagaucucuugaacacaggaggcagagguugcagugagccgaggcggugcuacugcacuccagccugagcaacagagggagacucugucucagaaaagaaaaacaaaaacucagaauacaucaucccaaaaaagcaaugucacuagcaacaugguaaacauuaaauucucaaucuguguguugugugaaaaaaaaagaauaaaaaauaaaaauaaauuugcaaacuaacccaugaacauugguuuaauccacaauguagcugaucuauaaaaucuacaauacugcucuaauucugguaccugggaccacgccucccuacaccagagaugcugcacucagaccuguccuggccaaagugcuuugugccuccaaagcauuugccucccuuacuccucauuaaacuccucacuuuccaagcaaucuucaugaaaugcuggaagacaauggaucuuacucuacugauuaauacugacguauaaaugaugcuucuagcagagcugugagcuacuguccaauguuuauuaacuuaagcaaauauuuaauugguauaauuucaagguauaagagcucuaacuuuucaaguuacucaugcuaaaagacacacaauauuaacaagacauacuuuagauuuguaacuccaaauucaaguaacaaacuucuuucaauuaaaaguauacuuucuugccauuuguaaaccucuaggucaugggaccaggagucagguuaacaacuuuaaaaauccuuagacuaaucacucagaguuuucugagcaauuugaggcaguaagauuuucauuucuacaggaauaagugaauagaguucacuccacucucagcucugugccaguaauugggcuguaaucucaucuagcaaacuagaugagagccauagaaaagacccugaauuaagacuuucuuuccauaagaaaaugauguuccaggcuggaggcgguggcucaccuguaaucccagcacuuugggaggccgagacuugugcaucacuugaggccaaaaguucaggaucaaccuggccaacauggugaaaccucgucuuuacuaaaaaaaauauauaaaaauuagcugggcacaguggugcacaccuguagccccagcuacucgggagggugaggcaggagaaucgcuugaaccugggaggcagagguuacagugagccaagaucgugucacugcacuccagcugggugacagagcuacacuccaucucaaaaaaaaaaaaaaaaaaaaaaaaaaaaaaaauucaagaggauguauuguucccauuuuaaccauagaaagagugcuauuguuccuuuucuccacaugguggugcuaauguagcaccaccauggagccguauugccaaagacgaaaaaauucagcacugcucaucguuauuaccagucuguaaguggccacuuaaaggccauuuggaguacauggagaccauuaauuauaaugcauuuccaaaaauagauuaaucacaaauuuuaaaauaaaaaauuuaaguaaacagauucaaaucaaugagaggggcauaagcauuugcaguuuuucaccaagaucuugcuuguggcguaggucagcauccugauuucuuuuccauuauuuauucucacaaaacuaaaagauccuaaaucucaguuagagguugccaggaauaacagcaaguauguuuggugguucugucaaauggcuguagauauuuggcucacauguagaucuagaaauuaugaacaaacgucucacuaaagugagaagugaguuucacacuacuuuucacagucuguuggaugcuaauugaacaacauuuccaggaaauggcuggugugcugacuguuugaaccugggauauugcagcaaaugaaauccagauccucugcugaguuaaauggagcucugugaaucagucuuguauguuugacuuauuuguguacuuuucaaacaugcccaaugcuacaucgcuaaguuauuucucaaaucaagaaaagauguaaucaaguuuuaaaagacuaaacuauuagagaucaagcuauuuguaccgcauuucaucuaguucaaacuagagaaaacagugagcaugcuguugaauuaagcuacuugaaaucccugaaaugauccauacugauauuauuaauguuguaaauaaauauuuuuaauuccucuuucauuccagaacucuugagcaucuuccucagcaauaaccagcagccuucagcagggagaacaucaucuuaaauuugcugcccauuucuuugcacaguacacaaaauauguacauucaguugucauucuuaguucacauucuuuuuuuuuuuuuuuuuagaggcagagccucgcucuuuugcucaggcuggagugcaauggugugaucuuggcucacugcaaccucugccuccuggguucaagcaauucuccugccucagccucccaaguagcugggauuacaggcacccaccaucauacccagguaauuuuuauauuuuuguagagacgggguuucaccauguuggccaggcuggucucgaacuccugagcucaggugauccacccaccucaaccucccaaagugcugggauuacaggcaugagccaccaugcccagcuuuagaucauauucacauuuuucucuauuuuccucaacucugaaucaagaacaaaggcuuauuaugaccaccaacuauccucugugaauaaaguauggacagacauuucaacgcaaccauauuuagucacagagugaagcccuugucugcucacuugugguuggugcucccucacuaccaaugccaaggucccuucccagccuauaucauaggugauguaauuaacugggugagaaaaaaaaucuuccucucuuuagcauggauuuuccaaugagaagucauugagcauauuucacucacucaugcauggcacaaguagacaauugguucauauccuguacaagaaugacuuuguccaaagaaaauaucugcuagcaugcucaccugucaagcaaaauguuugcuagcaugcgucuuugauaggaacucaaaguguugucuugaaccagcagcagcaacaucuagaaacugaucaucaguauacauuugugggcuccaacccagaccuacugaaucagaaacugcgggacccaguguucaggugauugauucugaugcacacugaagcuugagaucuaauagugucuuccaaaagaggaauguugccaauauuucauucagcuuucucuucuacuugucacugacuucguagcuaucuuuuuaaaguguuucaguaaccaugugaacuguaaucacuuggcuggcaggagugcaaauuugaacaacuuucuguuuuguucucuucuccaacuucauugacaauaucacucaauauaauacauuggaaaccauuauguugcauuuguuccaggaaaauucaauugguuuaccacagagaucacuuugauuuguuaggaagugaccuaagagcuucauauuacaauuuaaccaaguuucacagcaaaaacaaacaaacaacaacaaaaaaaaaaacauggaaaauuagcgguagacucuuaggccacuacaaauuuuuuuucugauauucauuaucaugcauacaauuugcccuuuacauuuuugucuguuguaugaaguccucauucucaaauuuacuugucccagcacacacagauuaacauuccauuuucgcacuguaguguucuuuauuaggcuuacaaaguucuucugagacaugguguuugauucuuugauaugucuauuccagagaaccaauuguaaaccaaugaucugggguuuuuuuguuuguuuguuuguuuuuguuuguuuguuuguuuuguuuugagacagaguuuugcucuuguugcccaggcuggagugcaauggugcgaucuuggcucacugcaaccucugccuuaccaggguucaagcgauucuccugccucagccucccaaguagcuggaauuacaggugcccgccaccacaccuggcuaauuuuuuguauuuuuaguagagaugggguuucaccauguuggccaggcuggucuagaacuccugaccuccggugauccaccugccuuggccucccaaagugcuggcauugcagguaugagccaccacaccuggccccagugaucuguuuuuaugaauugagaauagaagacagcauaauaguaacaaaaaauguaaauuuaucaaacaacauacaaauuauaugaagauaugccauaaacuuuauccuguuuucugacuguuagcacauggauaaacuaaacaauauaguccuuuagugcauguguaaccaguguaaauguucuaagaaugaaacaaaacaucugugaaaauaaucauuaaaguuauaugccauauuugugaaaugcaugugaaccaaauuuuuccaucauauuuuccucuaaaagugccaaacagccuaccaaacuacaugguaugcuuucuguauccuaagggacucuguuucuagcccuuuccuuucuucaaggguuucaaucauuaucugcuaaauccucuuuucucauuuuaacccaauucaaaaacuauagauugagcuccucucuaugaaauacuccauaaccaucgugaccugggcacaggucaaagacagucccccacaccccucagauaccccauaugacagaaggcaggguuaggcucugugaaaccagacaggcuguggaauccuaagaccgagggcacaggaaacaagcaaagggcugaaaaagcccacaggggcaagaagucaagccugacccucccccaguacuugagaauauacuugaaugugcuuguuugaucuagcuaacuccucuaacugccuuuuucuuuuuuuucuuugcauuuacugacauacucucaaaagaaugcucuaggauccaugguuuccauugcuucaucacuuacuuccuccuuacccauugcaacauaccucacagcuucaacacuacagcauucucugugguaaucguucucucccuguuucuuuuccacuacguuacaugagugccucucaggggagcagggggacauuucagacuggccgguaagacucugucagccucccccucagaaucaccuaagucacugguucucaaccauugcacaugaagaucacguggggagauuuuaaaagauaccaaugcccaggcuuuguaaugagucagcuuggcuaggcuaaacaacauuucccagaaugcccuuucugguuagggugggccacaaaagagauuugggggcaauuuuggggguaggaagugaagcaaccuccauuucauagcccucauauauugucgcuuaucugcuggcucaucuuauugucauaaaccugcaacuagaccugcaccugggccaggugauguuguuagcccugugacaaagggccccaguuucugcaggacacccacaccagccaggucagaggcaacaggaagugacauggguuuuagucccucauuaugggcaccagcugguucucacuuuuuccauccaucccccauuucacauccuucuccccuuccugucugacuguccuguccuucaggcuucagcaucagacacaaagacaacaccuuacagagacuacuuacccagcucccacaauugcauaugcucaaauuccuguaacagaucccuucauguauagguaugcuucuucaagugaacccugccugagaaacuccuccaaaccaauuaugucugauggucagaggugaagcccagacaugagaauguguuaaaaguucucuggauguuucuaacaugguuaaacaccaucugcccuaggguaaaaaccucuacaugcaauugcaaauccuugccagaguaagccuauaguggaugggaauccuucagcugagcuagccuugagaaaaaccuaaaauccugcccuacucuauguguuuuuccugauuuauucuuccuuuuccuuuuucacaaagcuagccucugcccaccucacagaccacugcaaucuaucaaucucuagucuuuccucccuccccaccuauagccuauagacugaucuggaaauguaaacauaacaucccuccaugcucaaaggcuuucagcaacucccuguccuccagggaucaaaucuaaucuccuuaccugguauucaaaccccuccagagucuggcuucuuccuaccuggccaaccuauccucccccucccuucccacuauaaacccuaccagcuuucugaaccuccaucaaccaaagaaagaauaaagcagugaucacacaauaaaaagggaaagguuuucucuuggccuucuuggauucugcuaaccaccaaagccacaaacuagguaacauccccuacaccaucuacaccaucucuauuucccuccccucccuucucaacccacuugcuuccuuccucuuuuaaugcuauuaaggguuugaauuuacauauggguucucauugugugagaggcagaaagaaaguaaaguaaaaauuccuuuuagaggcacccuuaacacuuuaauacuuuaauaagcagcagcugaccacuucuuucauguccaguucaugcugcugcugcugcugcugcugcuaugauccuauucccagaacucaaggagaacgacaguauuuugcugacccuccaccacaagaccauagacuaagccaaaggagaucucacacuccucucccagaauagaaauuucaaaaccagcaccuaaucugcaauaaccaauaagcccuucuuauaugcuagcauucucuacaauaguacaugaaguggcuuugaaauuuccuugcugaggcugggugugguggcucauaccuguaaucccagcacuuugggaggcugaggcgggugggucacaaggucaggaguuggagaccagccuggccaauaugguaccagaaaccccaucucuacuaaaaauacaaaaauuagccgggcaugaugguggacuccuguagucccagcuacuugggaggcugagguaggagaaucgcuugaacccgggagguggagguugcagugagccgagauugugccacugcacuccagccugggugacagugugagacucugucucaaaaaaaaaaaagaaaagaaaugaaaaaagaaauuuccucgcucaacauggaggauuucuuuaccccaggagucuccuauuugcaucuuggaaagaaggccuuacauacuuaaggcgccucugagacaacucaaaguugucucucugcaaaugccaagaguuugagaaaaugggaccaaagcacugaaggaggcccuugccacaugcauugucaauggauccuacuaucauaucauauaaaaaggacacauucaacaugccccaaggccuauggcugagguuuugcuuuaauuguccacuuuuaucuuuuucauuaccauucaccugcuaauguuuauauugaaaauguuuucucuagacuucuccacaaaaauacucacccauauuucucugcgagugcuauggcuuccuccucuuucacuacucucugguccuccagaucacucuuguuuccacacagcacuauaucuggguuuucacaauaugcaugcaucuguagcuggccuauuaauauaagaaaguuuauuauauauguaaauaauaauguaaguguaugaucagugaacaauacaugcaaaagugcuuugaagacuauaauguauauauagauauugggaauugacauaaugcuuucaaagcaucaguaaucuuaucuguaaagcugaauaguuggggcagaaauauaaaaccauucuuaagcacauaccccaguuuauugauaucggagaguuuauaggagaaugugcuaccucucaagugugagggcccacaugugcacacgcacacauaugcacacacacacauacaaaacaccuuucuuuuuuaugaaggcuauuugaaaagaaaguugcaggaguuccuaggguuuacugcuaaucuuaaaacuguuuuuauguguuuuuuucuccauagcaaugacauuucuaaaagaauuguuuuucuccaaacuaaucuauuucuauccaaaauguuuuucacauuuuucuauuauccuagggcagaaucaacucauuuaaaacaaacaagauacaggcuucaaugagaagaaaagacccagaauaaacaguaagugauucugucaccagagccaaguggaagcagaggacuauaauucuuauuccgcagcuuuuauuucaccugaaaaccugcaaauaggcacaauuauaaaaagcaauugacucaaaccaaagagcuucacuaagcuaaauaguuuaaucuuucaaaguaggaaaauaacaccucauuucuuacccaucacaccccagaauaaaauuaaggccuaaacguucacaguaagacauacuucagaguuuauggccuaauuuauuuuuucaucaugguuaaccagaaaaguguggacauuuuaguuccucauuaugaaguaguguucaucauaucuuaucaugagaaagucaaguaggcagguguuuacugagcauuagcacaggccugauacucugcauggaauuucacaacaguucuuugcccucauggggcaacugggguaauaagaccuacagaggacagacuaaacuguguaccauuucaugaaaagccaugcccuuucuuuccuccagguuguuacacaugcuguucccacaucacugaauacuuaaccacaaccuuccuucaagacuugcuucaugguuaccucauuaucuuucuggucuccagaguggcucugugcucuguuaaugccuuauaagguguuauagguccaugcccagugucaugcuaugagcacagacucaggauccaguguaccuagggaugaauccuggcucugccauuuacuagcugugugacccugaugaaguuauuugacugccucaauuuccccaucuguaaauggugauaaugauacuacuuacuuuauacagucaagguaaggauuaaaaugaauuaauccagugauucugcagguaaagacugugagccaccagccuuagcauaaccuaagaauuuguugacaugcaagucucaggucccacuccagcucuacugaaucaggaaugcuggaaauggggcuagaaaucuguguuuuaaaaaguccuccaggugacugagaugcacauucacauuugagaacuacuaaguuaauauauuaaagcauuuagaagagcauguaaguaucaccaguaauuaugguuaacaguauuuauuuuggguagucuaggaagugugauuauuggugauuucuucuuuuugucucauuuuuccuaauuuuucuacuaagauugugcuuaucuaaaaagcaaauuaaucaguuauuuuaaaaacuucacuaagaaaaaagucaccuacauaaacaacuacagucugauaauggauguaauaaggacccuauacacaguauaaaauguaacagggguuaaaaggagggaaaacaucuaacacaacuaaguuuauuacagagaaucucacagaggccaucuuugcuagguuuuaaagaauaagcagaacuccaguugguuaaaaaaugggggcagguguggaaaggguuuuucagacagagagaauaaugggaauaaaaaauaaagaaguaaaaauauguaaaauauauacuguuggguuuuugcaccacuuaugggacucuacagaagaaaguuuagaaauguaggcuacuuuaaaguuuccuuaggaaacacacuagcacuggaugaagagugacucugggcaugacgugcuuacuccucugaacuccaggaagacaggacagugacuaccacacuaccaaauuccuuucagauuucaauccaggcccagaggacucagccucuguucugucuccucaucugaguggggcuuacuuuagacuuuuaucacccuucucaagagggcauggagagauugagugagagggaggggucugcaaggagcaaagggaaaggggaggguauauagaccugcucuccucucccaggccaaucagggcccacgagucagcuacuucuuuaaugcaacacuguguucuggcacucaccacugauuuuuauguauuugugugugugugugugugugugugugaguguguauuuguguguauuaagcuauuauuuuuauuaaaaaauaagaaaugggccgggcacuguggcucacgccuguaaucccagcacuuugggaggcugaggcgcguggaucaccugaggucaggaguuggaugaaaccccgggagaugggugaaaccccaucucuacaaaaauacaaaaauuagcuggggguguuggugugcgccuguaaucccagcuacucgggaggcugaggcaggagaauugcuugaacccaggaggcagagguugcagugagccgagacugcaccauugcacuccagcaagggcaacaagaguagaaacuccaucucaaaaaaaaaaaaaaaagauaagaaaugaaugaucauuguaauacucaaaaggcugacaggaagaagaaaaaaauaaaaguacagauaauuaacaaauguuuauuccuaauuaagauuugauauuaccacuucugacacugaacauuacaccuuuuuguuuaaaugguaggggguggagaauacuuucuauuaaauauauaaaaucuucaauacguauaaguguucuuuaccuaacugagcaauaaggauucuuuuacucucuaaggaaaacaaaacaaaauacauacauauguauacauauuuucacauaauuuuguucuuuauccaacuaguuagccaggauaggcaauauuuaucuaaugucucagaguuuuagugucuaccuaugaaaaacaggugcguuauuuuuugaugcuaagauucuaugcgcacucucuagugauccuuauaaaauaguugauuuuaaaaagccccagaacuuguucugaugaugcaaaggagggaugaugaacacgggcugagaguaagagaccauaaacagccacugucauucagcuacaagggaaauaaugaggcaacuuagccaggcaucuagcgaagugaagccccaguaagcauuacuauauuuggggaacucauauuuaaaguaauuaauagcucuucaacucuuaguggccaacugacuugagaacgggcaaaaaaaaggccauuaaaaaggaaagccaaagcuucauauccuuggauaagucuauuacuuuuuaaggcucaauguccuucuccugaaauaaggacacaacacugacccgaaucuuugcccagggugauugugaggaucagauacaaaguaugugaaaaccacagugcacuaaauuauuuuuaaacucauuuuuaaucuaagcuuuucuacuaucaaaacuacagccaauuacccuuucauaaucccaaaacaguaauguuuaaguagcagaucuuuuuaaaucaguguuuuaaagauuuagauguuaagaauuuaauauuacagccuucccuaauagauucucuaggguuacacuaacaugaccaaacagggaaaauauacauuugaaagcuguuaugcagucaaguggcagaauucgaaauggcuaugaaccaaucauuuaggagguuaaaaucucuccaaaauaaagguugacauauauugcacuggugaccacuuuuaccaaugcaguuguagaguuuuccauggcagaauccuccugaaagaugcucuaacccuaaaagcuagaaggggacucuaagcacagaaaagacaugaagccagggguaugauccauuaagucuuuaaaagcuaucugcaucuauguaauacccauuuaauguccagagaugauagaagaauugauagcauacaauagacaagcagauacuuagagauuuaacuucucuaggcuucuacuuccucaucuacgaaaugggaauaagagucucuucugugggauagacugaagaggagagcacacauaaagugcugccuugcaccuggagcacaggaaguacucaacaaaucaaaguuaucaguaccagggagaagcagaguauuucaauuaucuuugucccuaaacuaaaaaccuugcuccuuaaaauaguauuugcacuaagaucuccuccaaaacgauuugucacagaaguagagcauaagagggcauucuauaaauaagaggggacuguguagcaggacacuggggaacaauaacacuuacuuauccaguuucugacauugaggaaacuuugcucauuugucagaucaaaaaguagaagaaaacccauagcaucucugaagaacgcugucguuaagcuacgaaaccuaggaacauaaaagcagaauggucaguuaaaccacggccccacuccugaaauauaaaacuacaagcaaugccuucagccucuuacaaaaguuuaccaauaacaagcuacauggugauauuucaaaaguauauaggauaguuauuuaucacuuauaucaguuuaaguguuaacagaccaugugauuugaaaaccgaggcugcuggagagggaugacaagaaccagcuugugaucuuagucucacccaagaauuuauguacaauuaugaguuaauuuggccaaaagcaauauaguguauguuuuccuauugugaaagcuugacuugacauuacaauguguuccaugaucuuuuaauuucagaauaugcagagaucucuuaucucugauagccauuuguuuggcuugaagguaagaaucucuugacucagaccuuauucugucuugguacucugccuuccaaggcuuuauccuucugucuucccugucuucucucucucucuccccacccccaaccccacccuaucaccagucaguuuccucucgucuuugccuauauguaaaaccuguaacugacaggcaggcuccagggaagaaaauauugguaugaauuugucaucuaaucagcaauauuagguuuuucucaaauacuuuuaaucaauguuuuuauuaaaaagaguucuuggccaggggccauggcucacaccuguaaucccagcacuuugggaggucaaggcaggcagaucaccugaagucaggaguuagagaccagccugaccaacauggagaaaccccaacucuacuaaaaauacaaaauuagcuguguguaguggugcacaucuguaaucccagcuaaucgggaggcugaggcaggagaaucacuugaaccagcaagguagagguugcggugagcugagaucacgucagccugggcaacaagaaugaaacuccgcccaaaaaaaaaacaaaaaagagcucuuaucuuuuagagcuacauuaccacaaguauuaaaaaugaaauaauauagugucuggaauuugcuucuaaauuauaugguaaggggguggggugagaagagguaagggguauaaaugaaauucuguuggccacaauuucauaauuguugaagcugaguaauggguacauagguuuaucauauaauccuuccacuuuugaauauccuugaaguuuuccauaauaaaaaguuaaaaaacaaaauccuucaagguggcugugaaagaaaacagaaguucuagcuaacugaaagcaacuuuauaucaagauuucauguggcuuauuuuggucaaguaaccccuggucacaugaauuaauuccaaccagauaucccacuagauuucaacagucagguaagaauaaugcauguaacuuggccacuuucuugugguugaguaaauagcaaaaggaaauggagcaaaguaucuaagcaaaaaaaaauuaaaagaaggaaaagaaaaaaguccacaaguaagagucauaaccucucccuugaccuuguaugaaauaaggccaccauucucaucucagacuugacaaauuuccugcuaauuuggcagcauucaagugcaaaccaacgaauuggcuggcuuuuuccugcucaggucacuguuugaagaauguaacuauuuuucccuuuccuucaguaaggagcacauaacugaagaucucauaccucuccugcccugcugugucccauaacugcagguggauucucuggccucugccaguggcuccauccggcccacuggcucuguacaccuaaaacagcaaagugaaagagaaaacaaaagagaacuucuaacaccagcgaaccuucucaccuuuuuguucaguacaaaucccaaaggcaucuaaaauuccaaagagaaugccaucuggaauacaaccauguuuguauuuaugucaaauaauuauauccagguaauguaauaaguuauauugaaauauauacauauauaucuuauaaauauauuguaaaauaugaauacaaaacaacuuguauaaaauauaauaauuaguuuaccuuuccucaaaguucucuugggucacuaguuucaggaaauauuacuuuucuauggcuuuucccaaucucaucuuuuuuguuuguuuaaccaggggguacaugugcaggcuuguuacguagauagauugcauaaugcugggguuugagcaucuauugaauucaucacccaaacagugaauguaguacccaauaaguaguuuuucagccccucucccacucccuucccccuuuuggagucccuagugucuacuguuucugucuuuauguccaugcguacccauuguuuaguucccacuuauaagugagaaugcauguggcauuugauuuucuguuucugcauuaauucacugaggauaaugguccccagcucuauccauguugcugcaaaagacauaauuucacuuuuuuauggcugcauaguauucuaugauguauauguaccacauuuucucuauccaauccaccacugauaagcaccuaggguuaguuccaugacuuugcuauugugaauagugcugcaauaaacauuugagugcagauguauuuuugguagaacaauuuucccuugucccaucccaaauuuuaaaagugcucuuaaaagaauuuuauagacaacacuccuagaacagcagagaacggaccaucaaaaauuucuuccuccacaauagcaacaaaaacagugguaaaaauuguccaaaucaacuuuuucaguacucuaggaauuaacaaagacuugcaacauuccaaggagcauuuauucaagaaaaacagccgaauaucaguaaaaacaguaagcuuugagguguuuuuuaccuugcccuauucccaucccccucacucaagcuuuuagaagacuuaaaaaccaugugcacaaaugugguuguugugaaaacaucagccuagccaccacuguggacagcagaggaacaacagguuuggagcucccuaaaagucccauacugagaaaaauugucaggaagccccuuggaaagcuccaugccccagcuuugucuuucuuugaccucacucaaagcuugcucuuugagaacagcccuaucccaagggcauuuguugaaaacuaucagcaguaauuauuuaacaucacagcuaccagagguagcaauaccaguuagggcuaacaaaagucuaacaacaacaacaaaaaaaaaauuuaaagaaaaaaauaggaaaugagauuucuauaaugcucccaaauauuccuuggaaccuaaaaggccauguucaugggcagggcucuacaaaugcccaggaaagaucuaaaaagguccuaaucucucacuucugacugacuuugagguucuucucaggcagaaaauaaaagcuaaggcagaguuguaaacugccugcaguaguauuaaacacauaccccaacaaacacacagagacucucagaaaaagcuaagagacuuauuaguucaaggaauuuaauaaacucucuccacucauuagcuguccacuaaguugacugagcagagacuucaguagcugcauacaaagaauacagauuuugcagaauuaucccagaaacauaauuaaacaaacagcaacgacaaaaauaaauaaauaugcaguaaaaacaagaaacccagguaggggaaagaaucugaguuucuagaauagacacauuauuuuaaauguccaguuuucagcaaaacguauaagacacacaaagaaacaggaaaguauggcucaugcgcaggaaaaaaacaacgaauagaaauuauuccugaggaggcccagauguuaaacuuauuagacaaagacuuuacaucaggaauuauaaauauauucaaagaacuuaaaaaucaguaacauagcgguccucuaaaauuaaaggauaaauuaagacaaaacugagaaaagucaucucuagcagaccuauccuacaagaaauacuacagacaacucucaagacuaagcugaaaggaaacuagacaguaacuuaaauccacacaaagaaauaauaagcaccaguaaaaauguaacugcauaguaaauauaaaaaacaguauaaacgugguuuuucuuuguagcccuuuuccuccacuagauuaaaauuuaacugcaggcugggagugauagcucaugccuguaaucccucagcacuuugggaggcuaagauggguggaucacuugaggccaggaguucgagaccagccuggccaacauggcaaaaccccauuacuacuaaaaauauaaacaauuagccgggugugguggcgggugccuguaauccuagcuacuugggagacugaggcaggagaaucacuugaaccugggagacagagguugcggugagcugagaucucaccacugcacuccagucugagcaacagagagagacccugucucaaaaagaaaaaagaaaaaaaaauuaacugcauacagcaauaauuguaaagcuguauugaugauggcacacaauguagaaagaugucauucguauagcaauaauggcacaaaaauaugggagaaaacagagccacauaagagcaaaguuuuacacaguauuaaaauuaaguugcuauuaaucaaaauuagauugugaaaaauuaagauaauuguaauccccaagggaauuuuuaaaaaagaacucaaaaacauauaacaaaaaagggaauuaaaaugaugcacuagaaaauagaaaaagaaacaacaguaucuaucaacagacaaauggauaaacaaaaugguguaucaauacaauagaauauuauguagcuauaauaaguaaugaaguccugauacaugcuacaacauggaagauccuugaaaacaucaggcugaauguaagaagccagacacaaaaggccauauauuauuccauuuauauggugugugcagaagccauugauagaaaauucaugguggcuaaggggagguagaaagaggaaugccugcuaauagguaugagguuucuuuuuaaagugaugaaacuauucuaaaauugaauggcugugauggccacacaacuccgaauauauuaaaaaccaccgaauuuuauacuuuagauggauggauuuccuuuuuuugugaauuauaucucaacaaaucuauuuuuuaaguuauacaauaaguaaccaacaaaaauaaucacauacauauauguagauucuaucaacuacacgucaauacuaaaaauuucauuagggcccuacuguuauucagugggucuuaaucucuauaagccucucugguaguagaauaaaauacuagaaugggcaaaagggaauguucuucugucuuaaaagccagggaccuuucccccugacagaauaugauccauuaaaggaccuuugucauuaauuuccugacaacugguuuaccugcuucaggccaacaauggauuuuucaacaagaaauguagucuaaggagaaagccaucuuuccucaucugcaacugugacaccaugaccuucugccuuccccuccaacacuagaauaacuuucagucucaaaguccuuaaaaaauaaauaaauaaaaguuucucccuucaacauucugcagaacaucacauucacuacuggcauuccccacuccuacuccaaccucacccuccuggcagcagugauaaguucugccaguuaguguuccauguggaacugcugagacuuuauuaggagaaaugccauuaaaaauaauaagauaccaaagguggaagacacagcccauaaaacaagaguaugaggggcaaggugguuggcaggcuucaagacaaagguagacaaauaacuuucggaguucagagggaagauacaagccaaaagaguaccaaggugacauuuuaaagaacuguccacuuccacuuugucugccugguuuuauaugaagugcugucagcacagccuuuucaaucauguugccuggauugaacauaacucacuuucauauguaccuuuaauuucagaucccaaccuuuguccuccuaauuccuacaaaguaaacuaaacagaccagcaaauguugacuuaacgauuacauuuuuacauagaaggauauagaacuuaccacucuuuuuucccugaaaucaaugcccacuguugugauaaauuuggaguuaaauuuaccaucuguauauugguaaaguacacuggucuucccuacaccagagucucccaaagcuaaaaacuugaugagguaaucauaaucuccaucagacauaaugaagaacucaguaguucaccuguaaaauacacacaaaauuuuuuaauuaaaauccauuagaaaacauuaauuauccauuuaaaaagugacaacaauauucaguuuaacaccuaauguuaaccuguaugucuacggguuguaugaaaagagaguuacauacauauuguucaccauccuugaagaccuaauaacuagcuagaugagaagcuauugaaauaguaauuaacaguguaguuuuaauuuaacacacagguaaucccagcacuuugggaggccaaggugggcagaucaccuaagguugggaauucgagaccagccugaccaacauggagaaaccccaucucuacugaaaauacaaaaauuagccaggcaugguggugcaugccuauaaucccagcuacucaggaggcugaggcaggagaaucacuugaaccugggagguggagguugcagugagccaagauugcgccauugcacuccagccugggcaacaagagcaaaacucugucucaaaauaaaaaaauaaauaaaaauaaaaauaaaaauaaaaacauacauauuauaguaccauuaggacaaaaauuucaagugggaaugauaaucaacaagaagguaacagucacuaagucuuaucuguagaccauauagaacaaaaacuaauacaagaaaaacagaggaaagagaauguuauaaggaauaacaguaaucauuagagugcaagugguuccaauuuccccuccuuuuucaaagucuccuagugcuaaaauuugcaauugcaaacauaaggaaccaguccaaaugcucaccagucaaugaguagauaaagaaauugugguacaccacaauuuuuuuaucuguauauauauacacacaccacggaauacuacucagccacaaaaaggaacgaaauaauggcauucacagcaaucuggauggaauugaagacaauuauucuaagugaaguaagucaggaauggaaaaccaaacaucauauguucucacucauauguaggagugaagcuaugaggaagcaaaggcauaagaaugauacaauggacuuuggggacucggguggaaagggugggaggcgggugagggauaaaagacuacagauugaauacaguguacacugcuugggugaugggugcaccaaaaucucagaaaucaccacuaaagaacuuauccauguaacuaaacaccaccuguuccccaaaaaccuauggaaauaaaaaaaaaagaaagaaagaaagucuccuagugcuagaaccuugccuuuucucucuuuuuacauggacaucuaggcaauuucauuuauucuauucauuuucacauguuauuacgguuccuucaaagacacuguuauuucacaaguaaauuuagucccugcuuccuuacauauuacuauuaauauguacuacauauuaagccagacuucucuagaguaucacugcucacuugggaacugaguuccagauuugaacagucacugcucagagaccacagugccacaaccaagggcucgcuuaccuauguuuaccuggguacucuaucaagaacugcuaaaaauucagcucuucaguaccgacuaaaacaaaaguccaccuuaaagaagaaaaauucauuuauaucagcaauaccuaaccacggcuauuuuugguucuuugcaaucagcacuuuucaugauuuguauuuaccuucuaaauagauucaaacccaaaauaucaguccaacuagaaaugggaucucucuccaggggagguuuacuuuuucauuaaaauuuuauugauacauaauauuuguauauuuuuaugggguacauguaauauuuuguuacaugcauagaauguaaugaucacaugaagguauuuaggguauuuauuuccucgaguauuuaucauuucuaugcauugagaacauuucaaguccucucuucuagcuauuuuaaaauacacaauacauuuuuguuaacuauagucacccuagucuacuguugaacauuagaacuuauucuuuccaucuaaccauaugcuuguacacauuaaccaaccucucuccguuucccccgccaaugccaauaaacucuccugaaaaucauaaaaacaacuagcuaucucauuaacacugacgacucuacaugacuauucaaacauacauauuuauccaucuauacacaugccagauguccuacauuggaugcuacugacucccggcguuauccccuuuuuacccagcaccauauccagaaacuuggcugccauauucagugcuuccuguaggacuauuucuauauauccauaaaauuaauaaaaacucagacaagaauauuuacugguuuucaguguuaccucccucaccccauccucaacuuggggacucaccuuaugcugaaaacuccugaaugcugagccccaaaagccacugcaguguguuuccucagagugcuucagugcagaucugcaaccucacguuucagguauggcuagcccguggauaagggcagagccucuacaaacauucaaaauucuauuugcacacuauaaagagugacacuucacagaugaugccuuaccugucuuuauagcuuggauauuugcaaguauaggucaccaguauuaaugacauauaacagaauuccucuccaaaaaacgacaacuuggacaucaacauuauagcacgucauaucacagcaucacaccuggcucuaaguuauuggaaauaagagcuaagaauugaaaagcaaguccagauaauguugacucauuugagggcuuccccucaaacugaauggagcagcagauaacaauaccgauccugcagugagaaugaugcaagaagacacugugacuaccuuauuuccuauuuauuuuuaauuugaaaaaaaaguugguauaacuauguuuuuuacaucacuuaggguacaggaaaaaaugcugucaccaauggcaucauauucuagaauucucuaaacucacuuaaguggaauucaaagacuuaaaugaaacuaucucuaauguguuucauuuccauggguaaucacacauguaagucuacaaaugaucuucgugaguuuuguuuucuauucacaauagcaauacugaccaaguaaucauaaagggacuguuaacaaaccaaauaccauaaauugaagguauagacaccaccaucaauauuaaucauaguuugcacuuuucagauuguaucuuuaagacaauuaucugcuuucuugaucugaaaauaaauguucagaccuuccacucucuggguucaguuuucuaaaggguaaaacagaacccagagagguagacugauuugcacgaucuagaaucuagaucuccuagcuccaaguccaaugccuauucuaccccaagcuucauauccauuauucauuuuuguuauaaaugcacauugggcuuuaaagugaccaguaguaugguaucuuacaagguaaccuaauaggaaacucaccaagucaagcagagcuggguuugaaucccaaaucucccagauaccaauuacuuggaugucuuugagccuuagauuuccagguuucuguucuauaaaaaagaauauacacuaccucacaccauuauucugaggauucaaugagauacuguuuauggagugcccagcacaaugguuggcauauacuggguacuuaacuguuggcucacuuuauucuccccauuguggacguucagacugggucugaagaucuagaacaaauuucagauugacucuggccagcuuaaaacaugucuuucuagcacaaacgauugcuaacuggcucaaaguggucggcugagucaacaaagaucacuuucaaauaauucugauccuuuuuggcugguucuaaccauuugcaauucauuuaauacagauauguuuacuucaaaagaguucugaucaacuuaaaaagagguucaaauccauauaaaauacaccauccauuuuagcaaguucauaguuguucaaaagaaucugguucauauuauuuuacggugaguuaaaagagguucuccuacaaaacuuucugacuuuggcuaaaaccugauauaucuaaccaaaauuauuggagucucauuguaauuagcuuuaauugcuucagacugguuuuagcuaguuccaauaggcucugacuuggacaugcagguucugacaggcuucuaaaaguuuuaguugguucugaguauauuuuacuaaaucaaacugugcugacaaauuaaauccacuuucaauugagucacacugguucuaccucuaucgaacugcuggaaacuaguuugauaacuauaguuaucuguaaaauuguuuuuacugguuuagaccaauauagacugguucaaaacagucugaaauguuucaaauuaauuucagauguucaaacaguucaaaacuagaaauguaaaaugacaaucagaagcaacaaaaacaacaguuugguguuuaaaacuugugccaaaccaacaaacuuaaaauuuuauuuuuaaauuaccucauuuguagauauucuguauccaaaaauuuaucuccaccauuauauacuguauaaucacacucgaacagcauguauguguucgaguacaguaaaggauugggagaaaggagcacuggcauaggagaagaugacagauaacagggaaauaugugaugagugacacaggcuuccuggguugagaauucaccucccauuuuaccugaaagaccuggcagcaaaauauucacccaugacccaacaaugaagauucugauuggggaaaaccuuuagcaaauuuggaggcugucuagaguuuguucaaaacugaucacgcugaccaggcuggucuggguuaaaagagaccagaauuccaaagaauaagaaaauuucagagaaauaaagggaguugggggcaggcagguuuucaaaauaacagaucuuucaagguuugggcaugguguugagggcgacagccuucuuaucugagcuugcaguccaguuagugaaagccuggaguuaguggaauuaccccaucuuucagcagaaaaucauucuagucuauaccagacuauacucccaccuccauccugcaaguccauacguggcuuucucaucacuacuuaucacuacuaggugaagacaauuuaauguuaagucucaauugaugguauauuuucauauaaacaauuuuuguucucuuauuuauuauucaaguccugaguaguauuccuagggccuguuuuccagaaagaaaauacuccacuccucaaauacagaaaucuaauaacguaaaugauuuuuguguuggcauuucauuucaggaaggaguaaacagugagaacacacaguaccagaauuugacauuuggggcacccaaacaacguuguaugcucaccauuuccugcuuguacuccagccuacugagguuugggaagccaguucacaagggcuucccucugacacucucuugcugaaaaugggucugaaaccuaggucagaugcccacaugucaagcacuuuacacacauuagcacaacaauccucaucacugcccuauacauagcauauacacugucucccucagaaagaucuagagcuguucuaucguaagugcuucagugagggcauaaguaacugagucuuggccagucuacccacauauuagcaugggcacaauuccaaucuauuguugagagacaggaaaaaaaaauggagguuaaaggcagaaacucuacaaccaagccaccuguauuugaguccagucauguaacuuuggaaaauuuauuuagucucuuuugccuugggcuccucaccuguaaaacaggaagagauucuauuuuaucaauucuaacaugcuuucuuauuuuaacuucuuuaaaauuggggugcaucuuacauuucagucuuacaauccaagacaucuugcaauugcuauuauugcaauugcaauagagauacaacugugugaaagcuuuuuguuagcaucuucuagcaaggucaagaaugcaucaucaauauauuuuagacucaaugaagcacaauaauaaagcuauuucugagggcuguugugaggacugagcuaguguauacacacaaaguuuggaacagugcacaggacauaguaaguucuauguaaguauuagcuguuauuagcagcagcauccagcaaucuggcuuccaagggucaauaugcaggcaauguucuuuucuuuccuagaaguauaagaaaguacauugagccccuaaaccaaaaauuaauuuuuaaaaauaaggaucugcuaagaguauuugaagccaagguuauauauuuaaacucuguacugccuugagaaaagugcugucuaccucaaggaaauaucuucuaaaaagucaagaaugaccuuaauuugggauaugcaaaagacuuucuuauucagcucacuucucucucuccuccuuauacaaauauuuuuucaaagugcucuccacccucacuaucaucagauuaacaauagaaagcaaggaacacccauuuccucaacauguacuaugugguguuaauugccuggugagagaaagucuaucaucuuccuuauuuuuaaaauaaaacauauuuucaccuguaauaccagugacugaggaggcugaggcagaaggauggcuugacgucaggaguucaagacuagcccaggcaacuagcaagaccuauuuauauauauauauauauauauauauguguguauauauauuuguuuuuuuuuuuauaaauuaggcaggugugguggcauuagccuguaguccuagcuacuugggaggcugaggcaggaggauugcuuaagcccaggaguucaaggcugcaguaagauaugcucacaucacuacauuguagccugggcaacagauuaacaucccaucuuuaaauaaauuuauuuaauaaauaaaaauaacugcacauguaccccugaacuuaaguugaaggaaaaaacacuuaaagauuuuuaaauguuuuuaaaaauacuuuuuaaguguuuuuuaggaaauaagauagaagagaguagauuuaguuaagaggaaagggaaagaucuaguucuauuucucccucucucucucucugcuacacacacacagacauaucacagcccagauuuuccaugaagugucauauuaaagugaaucauagacuccaaccuuaggaucccccacuauuaggcagaaucauucuaaaacuacucuagauaggucagccauuuuccgaaagccaaauuuucccucuauuacucauauuuaguacagagcaaaagaaaggggaggaauaauauuaacugaacagcaacauguaauaaauauacuugauuuuauuuuaucugcucaucauccuuaaaaagaacuucaugucuggacaagacucauaccauauagagacugauguuuucucagugugauggcaaauaggcuugaguucaaauucugacuuuucuacuuuguaugaucugauccaaguuuuuuauacuaagccuuauucuuuaaacuguaaaauggagauaauaacaguacuaaucucauuggguuguuuuaaggacuaagugagauaacccacagaaagcuuuuagcacauuguuugcccugugcuaaguguucaauaauugagacuuauuaaaaauacuauuauuaauaguuucaccacguucuucauuagcaaggcauguaauuuuauaaccuauucuuaauguaaccaguaccugaaccuucagaaaaaucacagaaagaaauuuaaguuaaguacaaugauuuuggggcgcccuauccaucacaaaaucuaccuuggcauuccaaucuaagaaugaguuguaucugggugauuuuugguaauuucagaccuaggaguacccaucaguugaaugcucuaauuuccagaagaggaaacugaaacucagagaagguaaaugaauagucugaaauaaaccagcuaguuagacauggggcuaaucuagaucucaugucuccuaaauucuagucauguaugcauauuuuucuucugucuguauuccuuccuucagagugagaaaccucaguuacagcugcuugaauucaagaaucaaaaguuuucuucagugccagcaguuauagcagugauaaaaugcuuuauaauuaaggcuugugcucucagagagguuggguugagggaucuguacuucugugcucagagucccucuaucaagaagcccuucauccugaugggcucugccaaggacagaagucauaaauugggagcuugucugcuucuugcuggucauugcaaauccaagaaaaaaaaauaacucuucuuaauacuuguaccauaucccauaaaucaucuuucuuuccuaugguuucaaaaugaaaagcaagcagagcaaucaugaaauuuuucauuuaccuguagaauugcucggccccguuuucucucaaauaaguauuuuccucucgaauaagauuauuuuaggccaggugcaguggcucacaccuguaaucccagcacuuugggaggccgaggaggguggaucaccugaaguaaggaguucaagaccagccuggccaacauggugaaacgcugucucuacuaaaaauacaaaaaauuggcugggcaugguggcaggcaccuguaaucccagcuucuugggaggcugaggcaagagaauaacaucgagaucacaccacugcacuacagccugggcgacacagcgagacucuaucucaaaaaaaaaaaaacauuauuuucucugacaucaugucucuguaaggacacuucuggcccucucucuuuuuccuucauucaauaaauauugauugaauacuuauuauaugcuaggugccaggguacaauggggauccaacucaguuauauucaauguggaaaaucucuuacucuugccuaccuuagaccuuauaguuuuagccaugucccagucuaacuucucccaacaacuauaccugccuuuggguuuucaaauaaguccaucuuucugaacauuuuaagcuucucucauaaacauaacacaauaugacaucaaaauucauauccuaagucacauguuugacaaagaugcaaaaggaauaaacauggaaaaggaauaaaagugugaagcuugggcgggcacaguggcucacaccuguaaucccagcacuuugggaggcugaggcagauggaucacuugaggucacgaguucgagaccagccuggcugauauggugaaaccccaucucugcuaaaaauacaaaaauacaaaaauacaaauggcuaggcguggugaugggugccuguaaucccagcuacucagcgggguugaggcaggagaaucacuugaaccugggagguggagguugcagugagcagagauagcaccacugcauuccggccugggagacagagggagacuccaucucaaaaaaacaaacaaacaaacaaaacaaaacaaaaaaacacauaaagcucaguagagaagaaagagacagccucaaccuccugggcucaugugauccuccagucucagccucccaagcagcugggaucacagcagugcacaacaccauacaccaugcccagcuuuuuguuguuguuguuguuggggggagaugacgucucccuauguugcccaggcuggucucaaacucccgagcucaagaggagaaauuuuuauaaagagaaacauaagguauauuauaaagaauuuuuuaucugaaaauauuuugaauuuuuuagaaugguucaauauuugaguguuccuauguagcuuauggacuucacuuauugcagugcaaaauuauuuuugcagagaaacaggagcagaugaauauaacuauuacuuuucaaauagcacagaacaucagcauuuaugugaauuauaacaccacauguucuuucauauaauuuaacauccccuuguucagugauugauuuggagaaaauguucauauacaaaugacuggcauagaaauauaaaccuuaucaguacuuuuauguuuaacguuaaaaagcaguaggcuuuucuugcuuuuuuuguuuuauuuuguuuuuguuuuaauaaugccauuguggacccauacccggcauucuggaaggaaacacauaacagagacaccaaaagcaaggaagagaagucacauggcaugaggcaggcuagaagaggcauuuuauaauguaccaagauauaugaguagggacacuuguauuuaccaaaugagcccuggccacaacucucacagaccauuacaauuccuacacccugagguggaacacagcuacuuccacuucaaaagcaagaugcauacugcccaauagcaggaaccccauuuccauaaguggagacagccuaugucuuccgugcaguuuacucaucucaacuucuggucuagaugugcguagauaugguugcgcccucccuaauaugucaagaguggaaaaaaugauguuauaaacaaagagcucaucuuguuugugcaaaaucucaggcggagagaaguggaaaucuaacaccuuugaaaaguagaaggaaacaggaauaugauucuuucuuguuucuuauuaaaagaugaguuugauuuuaucuaaauucagaauauuagauaacugcauuuuauauucaccuauaaccuaagauucauaagugcauuccuaucaguacaguauuuuauaauaauaacauaaguccauccuuaacagugauguugaggcagcagagaaguucauggcuagaaacuguugagaucuuaaguucuauagcauuuggcuuaauauuuauaaaugcacuugcuacauaggaauauuccauuucccucaccaacugcuagaaaacugcuagaccaacuucuagcagauggugauauuccacuauagcaaguucuucagacaaaaaauaaaauuaucuguaaauacuguugaauuaaauauacauuucugggccgggcaugguggcucaugccaguaacuccagcacuuugggaggccaaggcaggcagaucacuugaggucaggaguucaaaaccaacauggcaaaacccuuacuuuacuaacaauacaaaacaauuagccuguagucccagcuacucaggagggugaggcaggagaauuacuugaauccgguagguucacgggcgauaaugccacugcacuccagccugggcgacagagugagacuucgucuaagauauauauaugauauagauauauauauaauacauauaaauauauauacacauuuauaaaugcuuccaaaacaccaaaacauacaucauuuuuaacagcaucuuccagauguucauaauuuuucuuaaagagaaagaccaggaugaagaaaaaaauaagcagucauagcccagaaauccaucaacuauuucugaaauguuaccaucaccucagugggugaccaacauaacccaguaggcaaauaacacaaacaacuguauguuaggaaacaagaggcguugaaaugauuccugaaagcagaaaacguucuggaagaccaaugucaauaacucaaaugagauaucggcuuuuuuuuuuaauuuauugaaaccauugacuucauuuacccaaaagacauuauuuguugcccaaggcucuuccaggaucagaauaugaauguuuauagagauuuauggaaaguaaauucaccaaaacacugggucuuauaguacuuauaguuugugacaaguaccccuugcuccauagauauaggguaauagaaaaaaaaaaagcacacauagaauauaugucauugguaaaacauaggcaguacaguggaaacagguguggcuguuugauuugcuuaguaauaucucaaauaaugugacggcagucucagaauggacacagccacucgacacuccaaaagucugcucaacccauagcuaaacaugccucuuaccaccaccaagaagcaagcagucuccaagaauuuggaaugagugcaaaaucuacaaaguaugcucccacugagugguugcuuuuugugagcacauagaagacagugaaacacagacuucggagucaaguucuccuaaauucaaauaauaguauaccaccuccuaccuguacaaacugaacagcaaaaugccugaugaagaucaaugaaucauagcuauucuuaugauuaugacagauuaaggcuuaaaccaggcuugagcacugauccuggggcuuuuuccagucuaccuucaggaugacacugagacuucauaaagcuaucaaagaauggaguggaaauauuuccugaaaaugaaaaaggaggaacaacuuaagcuaccuggaagguagaacaucugcaaguccaacugguaaguacagggaauucugguauuaacaagcucugaagagguaaaaugaaaagcuuugguuaucucagagugccaccaaacuugugggcccaaggcucaaaggcagaaaaaaauagaaaugauagcacugcuaccccagccaggacugagagaauuacaaaucagauagcacucaaaagaaaaaaaaaaaaucagauagcacucaaaggacuucacauugcaaagagaauuuccaaguugcaaaacacagaccuaaaaacagugucaaggaaucugucaagacucaucuuccuagaacaugaaacaugcauggaaagcuuuugaccaacacagacugacucuccuauugcaucucaacuuccucaaguuuucuguuugcugcaacacaggaaagauguuaaucuguuagggaaaugcaccaacucaaaaagcaaacccuuugcuuucugaaggagcaaugauacuucuuuccuuccaagaaacaugaugaauuagaagcagccagacguguuaaacaugacuguccaaauaauaaaaacaauuagacaaacauccaugaguuggcaguaacuggggaagagacgggcgcauuuaucauugacuuuguacaaaaugagaauaugaguaccaucaauuugacacauagauacuuacaaagacuacuaagaggcaccagguauggcuucaugccucccuuguccugccuacccaacacccucuuccucacuaaccacuuuuuuuuuuuuuuuuuugagacucucacucuguggcccaggcgugagugcaguggcgcaaucucugcucacugcaagcucugccucagggguucacgccauucuccugccucagccucccaagcagcugggacuccaggcgcccaucaccucacccagacuacaggcacuaaucacauuuaagcagauacauucucugcccacaggaauauguucuucagguacaugguggcaugcuaaagcacacaggacuuccaucucuucacagcugauuuucauuuccauagucaaacauccacccuaccacaccccaugcuguguuccaacagccucacuuccaaccaucaucugggugccauaaccucucuacagucuucuuccucuccuggcuuuccugucccucaucuccagguacuauugccaaacuccgguuugcaugugcaaaaagugacaugaaacuaacaauauuagugcuuuucuuguaacacacugaguugcuauaucaacuucaagguguucaacccuccucaauaaauucauaaugcugcugugucuucagguacucccacuuuuccaaucaggaagaguuuuuccccugcaaaguaugggaaaagagccauucuggaaaaccaaguguuucuaauacuaugccaguuuugguuucaccauaauguuaaugaaaagguagcauucugauacaaauagaucacguguuuaaaauauuaguaucuauaaauauguuuauuauaugccaacuuaguucuuuuaaaaacauuaaacuaggcucagaaaaaucaaggcuuuuccugauguuuuaauaccacuaaaucaaugaugccaggauucuuagcuucuuccauuuguugucaauaagcuguagacagccagcuauauauaggucuuuuugguauuugucaagucuacugucuccauuaauauauauuuacaacacauguuuaaauguuucccuaaauaucauauucuuuaacugaaccaaaaaaaaaggaaacucaccuaauggacaaggucaaaucagauauauuucuuauugcuucucaaagucuuuccuuauuucaccuauuauucaguaugcagagucucagaacugacuguuugcauuucuaucagcagcuguuuauagaauggggugugacuugcguuugcuuaugcaaaaugacugaggaacaacaaugcacagccauccagccaguuucuaacucagccugucagauuacaguuggcuuuuuugcuauuauuguuguccaucucuaauuuuauugcauugugaucacuaaauguggucugcuuaacaacaaauuugguggaauuuaagaggaauuaaguguauuuauuuagaggcagggucucacucugucacccaggcuggagugcacuggcgcaauuaugucucaccgcagccuugaccuccccagcuuaagcaauccucucaccucagccuccuaaguagcugggaucacagguaugcaccaccaaaaauggauaauucuuuuuaauucuuuuuggaagacaaggugucacuauguugcugcccaggcugguccugaacuccugggcucaagugauccuccuaucucagccucccaaaguggugaaauuacaggcaugagccaccaugcccgggcugaauuaaguuuuauaaauguuccacgauuaugugaaaacaaucuguacacccuguuaguuggaugcaaaauuacauacauucuagucaagcuaguuaguugugguuuuugaucugauauauccuuauuuaucuuuuugcuacuucaucuguuucuaagaaagguguguugaaacuccuagaucauauucauuuuuagaaaauaagcccaaggucaugucuuaaagaggaugaauauaaagcauaauaaaagaacaagcauugcaguccuuauucagagaagcauuaaauuugugcuuuucagucuguuuucuaugaaacgcugggauucaugaaaauacuuuaagaguucuguaaacuuauuaagauuuuuuuuucuauguuuguuuuuuguuuuuuugagacagaaucucacucugucacccaggccggagugcaguggccugaucucgggcucacugaaaccaccaccucccggguuuaagcaauucucaugccucagccucccuaguggcugcgacuaaaggccugcgcaaccacgcccagcuaauuuuuguauuuuuuaguagagauggcguuucacuauguuggccaggcuggucucaaacuccugaucucaagugaucugccuaccucagccuuccaaggugcugggauuacagacuugagccacugcgccuggacuccuucuauuauguuuuuuaaaaacuggaauaaaaaaaaguauauagucaaauaaguuacauaccaaauuuagagaccuccaaguuauuuacuuaugcuacuuuguuaagcuauuuauggcuaccuuuaacguauacauguuauuuggaauuccuauaauuauuaguugagaagacuguacuuugcacuagacuucucuccuuugcuuaaucagaauggauuaauuugucuauugugaaauuauuuaaggaaguacaugugaacuacauucaguaaacggcagucaaagcucaggcacauguuucagcagauguuugcuuucauccuguuacaacagucaauugagcaauaaagaaugaacacaacauguugcaucacaacauuuuauuacagaucacuauagagauuauucuuugggaaguuuguugucugacuucuagaagcaugaaagggcuauucuggguuugggcuacuucuuuuucauagcagaugagugucuucacagucaguuccugcauaggaaaccuacauaaugucauugcaacaaaccuuucauugccucagaaaacugcucuggcccagcugguugcaaacuuucuuuagcaauaaaacuguuucuucaaauaaaaucuuacauggcaccccaacauauaaaacagauggcagcagagugauauucuaaugaaaggagugaaggucaagacaccaacgcccauagacccaacaaggacauaagaagaaucucacuguacacauuuagaaaaucauugcagaaaggucuaccuacaaugcagcucugaaucgucucauuugccuuuggcuuugucccuaaacacuuccucucugccuaaccacuucaguugacagcucauuuguaagaucugccacacucuuuuauucagcgucuccuaaagaugccaccucucagauaucaccuuaacacacuucuuaucugggagggauuugaaaugcuuugggugucccuggugagaacugcaagaggagcuauuuaaagcuuaagagaaugaaagaagaccauaggaagagucuugagaacaaccaucauugcgucauuccuggggaaaggguccuggaaaugaguccuggaaaaaucgaggccaaacugcccaaaaggcaaccaaagaagcagcaucgaccaugggauaggaaacugguguccuuaaaggggcaagagagaaaacugcagggaggaugucuguaaccagcuacauuggugauccuuucuuguaucuaaauggacacuuugaggccaucagaaaauaugaccagauuaguccugaugggcucaaaaaucuauauauggaugaacccucaaaagucaagaugugguuugaagaacacaaugaaauguugguauagcaacuuuaagauaacugagaauauauuauuuugugcuguaucagaagccacuuuauacuaaauuauagcacagaagggaauaaagagguacaaaaauuuuuuaaaauacugaucaaaguaaaaguucagauuuucucuacuaacuucauuuucuuucuaugaauucagaagaaauuucuaguauuaggcucagcuaaugucugugucaugaggaguguuuuacaugaaaguacccuugcuugaaaccauuacaaaguuccagggaaggagaaagcggcaugagguagaggggacagagaaaccccuagcacucccuaccuggcuucaugucaaggcagcacaaaaucaacuccaacccacagggauuaaguacaaagggaguuuucagacagguguucaaagucauaccaaggucaaacaccaagagacuaaggagcaggucaacaaaggggaagaguaguuuauggaucugggagucuuggaggucagcauuccaagaauucaagaggacaucugggcagacaacacaguucauuagagcccacagcaacaguagcuagaaaagaccgggggaggguggugagggauauaaaaacuacauauuggguacaauguacacuauucaggugaugggugcacuaaaaucucggaauuuaccacuauauuauucauccaaguggcuggauacaguggcucacacuuguaaucccagcacuuuggcaggccaaggcagguggaucacuugaggccaggaguucaacagccuggccaacauggggaaaccccaucucuacuaaaaaauacaaaaauuagcuaggcguggggacacgugccuguaauccuagcuacucugaaggcugaggcacgagaauggcuugaaccugggaggcggaagcugcagugagccaagaucgcacuacuguacuccagccugggcgacagagugagauuccaucucaaaaaaacguacagaauaaaauaauaauucauccaugcagccaaaaaccccaaaagcuauugauugauagacagacagacagacagauagauacagauauacguaucuaucuaucuauauacaaaaaaaaagacccauaguaguuguugcuuuaucaaaagccagagaaauguucuaaccuucuaaguuacagcaauuuauucaaucaacuugcuuuccucuacucugccaaccaguuugaaaggcucccuggccgggcgcgguggcucacaccuguaaucccagcacuuugggaggccaaggcggguggaucacgaggucaagagaucgagaccagcuggccaacauggugaaaccccagcccuacuaaaauuacaaaaauuaguugggcaugguggcaugugccuguaaucccagcuacucaggaggcugaggcaguagaaucacuugaacccaggaggcggagguugcagugagccaagaucgugccacugcacuccagccugggugacagagcaagacucugucucugaaaaaaaaaaaaagaaagaaaggcucccuaauggccaggcgugguggcucaugccuauaaucccagcacuuuggaaagccaaggcugacagaucaccugaggucagguauucgagaccagccuggccaacauggugaaacccaucucuacuaaaaauacaaaaauuagccgggcacgguggcgggugccuauaauuccagcuaccccagaggcuaaggcaggagaaucgcuugaaccagggaggcagagguugcagugagccaagaucgugccaccgcacuccagccugggugacagagcgagacuccgucucaaaggaaaaaaaaaaagaaaggcucccuaaguauuccaacuagguuccuucacuaaguuucguuuuccuaccuaggcagauggaaagccaagcauccagguuagaacuuagucccccaaggccauaccuugucucuguccucagcuaagcccaggauaaggccaucuauggaaacaaagcuccuauuuucuuaacaugccucugagaaagauauuugaagccuagagguuaagaacauaagggcuaaaauaagcaggcaagagggugacucagaaagaacaagagccuuguuuaaaaaaaaaaaagagucggggaauaaaccucaauacagauuuacuaacacagaaauaaagacuuuguguuagcaaagagacuaugaaucagcaagagaacaacgcaagaggauaaaggaaauuguagacaagagcagcauaaaccaugaagauguaaguauccacguguuuauaacauggauaauugauaaguaauaaguaagucuucagaaacuauguuugaguguucaggggaaaucacaaaaacaaguaacaguacacuuaauuuuuuaaaugagguugaaaugagauucugcaugagagauaacuguaaaguaguaaaaaagguuucagaagucacacaugaaaaucaaucucauaauucuacaaucacauuuuaguauguccacauuuuaaaguauaaaguuagacuuuauauaccaacaaauuuggcugcaagguuuguaaguugaguuuugaccucgagaaauaccuuccuauuuuuuaaagaaagaaauauuauaaugacauuccuuuuaaguuauuacuuuccuauacauacuugcuuaucacauaaaaaauauaauugcuauauagccaucaagcauuaaaaauaaaccaacacaucuaacaauaggccucaaugguacuaaucuauuuuccuagauauaucacuuuaaaaccacauaugaaugucuaagaaauaaaaguuuuuuauuuuucuuuuagaaucuacagcauacaacaugauaaaauuauuuuguauaaaaauuauaauuuuuaauuaauuugaaauaauuuccauuaauuucugaugcuuguaagcauuuuagauauacauuccuuuagcucuuauaauauacuuauaaacugugaaaaauucugagacaggaaggaacagauauuaaaauucuauuacuucuaaucuaaaagcccuccaucuuauguucucuguaggagacagaaacucacaaaagaaaauguuuggcuucuacuauuaagaaauuggacauuuuucacauauauuacaguggaagggguuuuacauuucuuucaggcacaaaauauuuaugaacucgggagcagcccaaacauaaagauaaaaugcagcaugacuuuccaaaccaaaaucugcggcuuaugucuauggauuuuugugacccuuuugggaaaaggcagaguuggaaacacaauuuaguuguccaaguauuagaacuuuuaaagcaucucuuugauuuaugaagaaaaugcacaaaaauacguuaaaggaggcaguaccagaaaauccagcaaguugcucaucacuacacaccucuaugcacagaugacaugagcaauuauuugucuuuccuucacuucugacugccagggcucagggcugagguccuauugacugcacauaguauaagaaagggaagagaaaguuguuucaacggcaacauccucaccuacuuaugucucuuuucuccugguuccaguaauuaacagaaugaucacaaacugaaaccaaacugcaacucuaucccuuccacucucacccuggaagccuguucucauaaauccauccuccucgggguauuccuuuaaucaauguuuauuaauaugaaugaaugcuuuggcuaacuuguacaggucaucugccacuuuuaaguacuccauucccaccucauggguguguuucaucucuuugguacaguugcauauuuccugaagagucucauuuuguguauugcuucuccacuaccccucaccacuggacagacaacuggccagcugucacucaaaugcuaauugugucuaucaucugcuuucucuaauagccuuuuccuuccgcugguucccuccauucccugccaauuuuauuuagaagugacucaaaaaguguuuggggacuccacugauagcugugcuuuuuugauaauuaaaccauauuuacauccaauucaacaguauuugguaagcaauuacuaccuuuccaguacggugcuagcaacuacgaauggcaugaaagaaacacaggauccaacugcucccuucaagaaguugguaauuagggugagguggaaugauguacucauuuacgaaaaaggacggauaagacaauauuaucagggagaaaaacgucugguacaccaugugcaccagccagcacaagaaaucaaaagugaaaggggcuucaagucaaaagaccugaacucugcuacuuccuuccuagcuauguguccuguggugagccagacagcuuccccacacuguuuccucaauaugggaauauuuaucuagcaagauuauuggaaggauuaaaggguacauuaugugaaaugcauuuuauaaacuguaaacuacuggguacauguaagaucguuguuuuacaagucaaguagaggcugggaggucagaaaaggggagcaaucugucgggcauggaggcucauaccuguaaucccaccuauucaagagacugagguaggaggaucacuugagcccaagagaucaaaaccaaccugggcaacauaaugagaugcuguuguacaaaaauuuuuuuaauuagcaaggugagguggccugugccaguagucccggcuacucagaaggcugaggugggaggaucacuugagcccaagaguucaaggcugcagugagccaugacuaugucaccacacuccagccugggugacagagugagacccugucucaaaaaaagaaagaaagagggagcaaucugaccgugacucaaagcaagagccaggaccugagcugagcaccuucuucaaagccaggcaagauuuagcuagauagugaagaauaggauacacagcauguuucaugcaagggcauguuuugacuucaauuuaacaaguauugaggaggcuugcuaaucauuucaaaggauacaaaugugccucagauauaauccucuaaguacaaaacuggcuguaaacucaaaggaaugcuuaugagguaaugugacaaauugaggagagcaggacgacuaauccauugguauaugggguuccucugccaccaucuguuuagacccaggauaggucaccaucccucugcaggccuuguuuuaucaaauaugaaauaagagguuugaccacaauggucucuuuccaacacagacauucuaugcuguaugauuccagguucaaaguucaaagcuuagucaugagaaauuuaaguggggucauggugacaguugucccuucuaucaccucucacuccuugaagaugagagccuagaugagggcagccgcaugggaaugggaagaaggggauccaagauacacuaauuuuaaaauaauagaacagaguuccacaucagguggaaaaggacacagcaaagagaacaccaaagaauaaagccuagggggccaggaggccaaaauaauguugccaacagaagcaggacauuugaaguggggaagggaaagaguuggaaugggcauaagguguuugugggugguaucagauuuuuggaagggaaggaugaugagauuggaucggggcagguucagcaugagagaucaucaaagccacaugaccaagaaaugcuugaaaaucauccccagucccuguggcccacauuuaccucugcccuugagacagaggcagaguagccaacagugaaagcuccaaaaagagggccaugacuguacaagccacagaagagggaacaugcuguuaguucaggaugaacaagaccaaggauaacagcagggugcucucagccaaacucaauuacacaggacaugaugggcagucccugcugcucugauuaaacucaguuuccagauacuaucucccuguuguaaaguucuuuaucuggcagugaguaaaaaggaaaugucagggaagacagcuagauguccugcacagcauucacuccucuuaggagccugcaauaggcaccuccucagauuccaaacuuaggccuugcccaucaucauccaccacccaucugaauguaucucaaugaaaacacacacuggcugggcaugguggcucacgccuguaaucccagcacuuuggcaggccaaagcuggcggaucaccugaggucaagagaucgagaccagccuggccaacgugguaaaacccugucucuacuaaaaauacaaaaauuagccaggcgugcaggugggcaccuauaaucccggcuacucaggaggcuaaggcaugagaauugcuugaaccugggaggcaaagguuacagugagcugagaucaugccacugcacuccaggcugaggcacgagaauugcuugaaccugggaggcgcagguugcagugagcugagaucgcaccacugcacuccagccugggcgauacagcgagacucagucucaaaaaaaaaaaaaaaaaaaaggaaacacacagugaggaggaguuguaguaucacuuuccuccagcuccuucucugcaccucucacucuccuugaaaccacugacacuaagaaauaagagguuagaacccuucucuuauuacccuuaucuaauuacuuaaugucucuguguuuuccuagaagaagaauucacuaccuauaccaggucuauccuguuuuuggucucacuuaacacugcuauauguaugugccugucuccuaaugcacaccagcaagaguuucucuagaaaauugcuuuccaaccuuguucaugauauuuguaugaccuaccagggcauaugcucuugaucaaaggcaauagguuuuagggccccagaaaggccaggcccuguccagccacccugagggacaaaggguucaacaucucaacacaucugaaccaauucagugcacaccagggggagucaccuccucuaggguaggcgucaaagcgugaaauuccugggcuauaccuaugcacacauguucaguaauacaagauaaugucaaauugcuguccaauauaguuguuuuacacucccaacuucauaucuucaccaacauuuggugcuuguugucagacuucucaaaaugguaacacauugugaucuaaauucacauuucucugagugcuaaugagugugagcaucuuuuauuaguuucuuggccaucuaguuuccucuuauuaaaaugcacauuuguaucuuucuccuauuuuucuauuggguucuuuuucuuuaagacagagucucgcuccguugcccaggcuggugugcaauggcacaaucucaucucacugcaaccucugccuccugcauucaagugauucucaucccucagccucccaaguagcuggggcuacaagcacgcaccaccauaccuggcuaauuuuuguagagaugggguuuucccauguuagccaggcuggucucgaacuccuagcggcaagugauccgcccaccuuggccguccaaagugcugagauuauagacauaagccaccaugcccagccagguucuuuuucuauggaugugcaguucuucauauauucuggauacuauuuauaaguuauguauguugcaaauauauucuuacuguuuuugguuugucuuuucacuuuuuuaguggcucuuaaucuuaaaauagucaaauuuauucuuuuuuauaguuauuuauuuuauaucauaucaagaaagucucuuuuuuuuuuaauggagacacggucucacuccagugcaauggcacaaucauagcucacuacagccucaacuucucaggcucaagugauccucccaccucagccucccaauaacugggacuacaagcaugagucgccacgcccagcuaauuuucuuuucuuuuuuguagagauggggucucacuauguugcccaagcuagucuugaacuccuagucucaagugauccucccaccucagccucccaaagugcuaggauuacaggugugagccaccaugcccagccaagaaauucuuaucuaaagcaauaaagauauucuuuuauauuauguuuauaaagauacugccuuuuuauuuaagucuuuaauacacugagaauucaagguauauguagggauccaauuucauuauuuuucccuuaaguauauacaaucgucauagcaccauuuauugcauaaaauuaucuuuugcccagugauaugcaauaaaugaauggaucuguuucagggcuuuacauuugguuucgcuggucauuuugaccaucccugggccagugccacaaugccuuaaucacuaugacccuaaaauauaacuucauaccuguuacgacugguacccaccuuaccaaggacaugaacccuucacauuuccaucugaguuccucaaaaaccauauggggauucuuauuggaauugcauugcauugcauugggaucacauaaaucuauagaucaaauuaagaagauugacauguucaugauguuuaauuuaccuaccuaaguacaugcauauuucuccaucuauuuacguauuuuuagugccuuuaaaaauauucucaaaucucacaaaagaagauauacaaauggcaaauaugcauaugagaagaugcucaauaucauauguuauuagagaauugcaaauuaaaacaagaaugagauaucacuauacaccuaucagaaugaccaaaauccaaaacacugacaacaucaaaugcuggugaggauguggaaacccagaacucuccuucauugcugguaggaaugcaaaaugguacaagcccuuuguuauagacaguuuggcaguuguuuacaaagcuaaacuuacucuuaccguacaauccaaucacauucuuugguauuuacccaaaugaagggagaacucauguccacacaaaaaccugcacacugauauuuauuauagcagcuuuauucauaauugccagaacucagaagcaacaagauguucgucaguagaugaauggauaaauaaacugugguacauucagacaauggaaaauuauucagcacuaaaaagaaaugagcuaucaagccaugaaaaaacauggaagaaccuuaaaugcauauuacuaacugaaagaagccaaucuguaugauuccaacuauguggcauucuaggaaaggcuaaacuguggagauaguacaaagaucagugguuauuagggguuggagugggggaagugaaagagaugaauaggcagagaacagacgauuuuuagggcagugaaacuauuuugugugacacuauaacauagauagaugucauuauacauuuguauacauacccauagaauguacaacaccaagagugaacuccaaucuaaacuauggacuuuggaugauaaugugucaauagagguucaucauguguaacaaacguaccacucugguaugggauguugauagugggggaggcuaugcauguugggggguuugggagggaagggaauauauggaaacuguacuuucuacucaguauuacugugaaccuaaaacugcucuaaaaacuaaaacucggccaggcaugguggcucaugguggccuguaaucccagcacuuugggaggccgaggcggguggaucacgaggucaggaguucaaaaccagccuggccaagauggugaaacccccaucucuacuaaaauauaaaaauuagccaggcgcgguggcaggcaccuguaaucccagcuacucaggaggcugaggugggagaauugcuggaacccgggcagcagagguuucagugagccaugaucgugccacugcacuccagccugggugacagaguuagacucugucucaaaaaaaaauaaaaauaauaaauaaauaaacucuaagaaaagaauauuuuuggcuggguacuguggcuuacaccuguaaucccagcacuuugggaagccaaggcagccagauuaugagaucaggaguucaagaccagccuggccaacacggugaaaccccaucucuccuaaaaauaccaaaaaaaaaaaaaaaaguuagcuaggcuugggggcgugugcccguagucccagcuacuugggaggcuaagguagaagaauagcuugaacccaggaggcggagguugcagugagccgagaucacucacugcaucucaaaaaaaaaaaaaaaaaaaaaaaaaagcaucuuuuugaaaaguuuucgggccaggcacaguggcucaugccuguaaucccagcacuuuggaaggccgagguggguggaucaugaggucaggaguucaaaaccagccuggccaacauggugcaaucccaucucuacuaaagauacaaaauuagcugggcaugguggcaugcaccuguaaucccagcuacucgggaggcugaggcagaagaauugcuugaacucaggagacagagguugcagugagccaaaauggcacaauugcacucuggccugggugacagggcgagacuccaucccaaaaaaaaaaaaaaaaguuuucaauaaacucuuuucaugaagauauuguacaucuuucaacuuauugauacuuuguuuuugucacuacugugauaacuuuuaaacauguaucuucuauuucuuacauagccauacuaauuccagcaaucuguuaaacauauuagguaaaaauaaauuacuucuuccuuucuaaucuuaccuuuuagucuaauuauaaaaagucggccaggcgcgguggcucaugcauguaauccuagcaauuugggaggccaaggugggcgaaucacaaugucaggagauccagaccauccuggcuaacacagugaaaccucgucucuacucaaaauacaaaaaaauuagccgggcguggugguaggcaccuguagucucagguacucgggaggcugaggcaggagaauggcgugaacccgggaggcagagcuugcagugagccgagaucacgccacugcacuccagccugggcaacagagugagacucugacucaaagaaaaaaaaaaaauagguaagaacaaaacaaaacaaaaaaacagugaauagacauggugauacagguagucuuaucucuuuuuuuucuuuuuuuuuguuuuuuuuugagacaagaucucacucuguuguccaggcuggagugcaauggcacaaucacagcucacugcagccucggccucccaggcucaggugacugucccgccccagccucccuuguccaggcuggucuggaacuccugggcucaagccacccaccugccucagccuucuaaagugcugggauuauaggugugagccaccacgcccagcccagucucgucaugucuugauucuaacauuucacuguuaagaaugacauuugcuguagauuuuugguacauauuuuuaucaggucaaggaaguucaucuauccuaguuugcuaaguacgaguauuaugaaugggugucaacuuuaucacauuuuguuucagcauguaucaaggagacugcuacuuuuuucccuuaaucuguuaauuuaccagcuuuuauauuuauuccgccuuugauauuuuucuuuccuuucuucuagcuucuucucucacuuuccugguuucugcucuuuucucauacuuucuaccuagaauuucucuuucaaaguaauucuguuucuuccuuuugcauucgccaggggguaggggagagcaaagggagguaguucucaggguaauuaauaaauauuugaauggcuaaaaagugaaauaccuaauaggugccagguccuugaggugaccuuacccaaaaccagucuucaaaugugccauauuacauuuauauaagucgcucccgucuugggcuuaaaaaaaaaaguuacuugagaugcagucacuagaggaagaauuauaguagaaugcuuuaaacagaaaugguguuucacccucuagagaaacaucgaaaaugcauuagcuaucauccgaauuuucuuuugaacacaguacuauauuuaauuuuaacuacuagcacuuggguucccccauuuaauaccuagaaaguagggcacuagauuauaaaaaugccaaguaucugaagagagacaaggaauaacguuuaugcauucuguaauucaacacuguauguuaaagaggccagcccaugucucuucuuaauuuuaaaauuaaagaagccgaacccaaauuucugaauucuagcuaauaauuuaggacccacuuaaaaaaacuuugccaaguuuuuccauuagucuguuuaauuguccuaaagucuguauuucauuuaacuccaugaaaugcauauauuugaggaacgauguuagaguaaccaugaucuagaaaugaaaagggcacuuacacaaaagaaacaaaucagcaaacaacucuguaacagaauucuggagucuuuagucuuacaaaaaaccacauuaaacaucguaagagaauacaacauuuaguccacaccugacuccaaagagucucucaacuauagccaggguuauuuuuucuguuuguuuguuuguuuuuguuuuuugagacaagagucucacucugucacccaggcuggaguuggagugcagugguccgaucuuggcucauugcaaccucugccucuggauucaggugauucucaugccucagccucccaaguaguugggaguacaggcaugcaccaccacauccgguuaauuuuucuauuuuuaguauagacaggguuucgccauguugcccaggcuggucucaaacucuugaccuuaggugaucagccggccucggccucccaaaguacugggauuacuuugggugugagccacugugcccagccaaaaucuuuauuuugugauuucuacaaaccuuuaaucacguuuagauuuuaaacauuuuuccaaccucuauaagcuagaauagauggggaucuguuuuuuaacagaaauuuuaagcuguuuuagagaaaaauaaacuuggcucaaaugacaaaugugaaauuaucaaaauuacgaagcauaggaggaugugggaaaggguuguaguguucacaacacauaggaaaguauuucccaaaaaauauauauuaaauguacuucaaauauaacagaaguuaaaugcagaauagcauacauauaccucuccaaaaucuguuaauaauuuuaaaugagguuugauaaguaaauuggccuccaccaaugauccaaagauauacuaguaaagcuugaugccacugaggagggagagagccugguuuaaaugacugaaauucauucagucauuuaagcaguagcucaugagcacaucaauuaaacaucuaacaaacaagaauuguggaugugccacuauguuaagcaccaagaauguggcucuagaagagcaacagucuaauagguaagcuguuuguggaaaugcccaaggaaaaugcauggaaacaagaacuauagggcccggcaugguggcucaugccuguaauccuagcacuuugggaggccgaggugggcggaucaccugggguugagaguucaagaccagccugaccaacauggugaaaccccaucucuacuaaaaauacaaaauuagccgggcguggcggcgcaugccuguaaucccagcuacuugggaggcugaggcaggagaaacauuugaacccaggaggcggagguugcagccagccgagaucgcacauugcacuccagccugggcgacaagaguaaaacucugucucaaagaaaaaaagaagaagaagaagaacuguaacagaaguaugcacaagccguuggggagaugggagggcuggggagauagcacaagagggagaagaaggagcccacaaugucuaaggagggaaucagaaaaacuucacacaggggcaucugagcuaaggacuaaagucagaaugugaguguacaggcacacauaaggacaagugacagaugugaauggacaaaaauuacacagugcacuagauaauguggggaacgacuuuaccucacaugucagccaaauaagcauuauccuuucaagauaacagaaacuauaagcaaauaauucuugaugccaauccaaaacauguaacugaguuuugauggaauuugguaaggaaugccugaugcucaaaauuaaaaaaaaaaaaaagaccagguuucgaaccgucaggagggaacacaucuugggcugacugaugcgggcagguaaggguuugaggguuugcgcuugcaaagguguaagaggcuaagguuacuuaggaugcauuaaaggacuucagcaguggauguggcugaagggaugcauggagguaggggagaauguauccagaacagaggcugaaaacaugggaaaguguuugagaccugggucuaaaaggacugugacauggcacuaaaaaguuuguguguuauccucugggcaacagaaggccaccacgggcucuuuaugcaggagaggaccaugagaugugugccuuagaaagaucucuauggcagccacauggagacuggaaauacacagagcaucagaaggcucuaauguuaccgacugaauguuugugucuccccaaaauuuguauguugaaaucuaauccccaaugugaugguauaaggaggcaggucuuugggaaguaauuagguuuugaggauagauccuucaugaaggggauuagugccccuauaagaagaggccagagagcuaccuuucugccuugugagaauacagugaaaagucaagugucugcaaccuggaagagagcucucaccaaaaucugagcaugcugauacccugaucucagacuuucagccucuagaacaaugaggaauaaauuuccguuguuugcaagcuauccagucuaugguacuuuguuauaacaguuugaacugguuaagacauauggagagagauuuugaggguuugaauuguguuggugacaguagggaugaagaagaagugauuaauuugagauauauuuaggagguagaaaucaauauaacuucuuaacagacuaguauagaaauuaaagauaaccaaaacuuuuaguuugguaaauaaaugguauaacauuaacugaaaaaggaaaagaugguuugagaagaugauaauuauuauaacuaacacuaagcacuauucuaaauccuuuaaagcacuaacucauuuagucuucacaacaaccguauaaggucccuaaaucuacagaugaaaaauaccaaugcacagaaagguuaauaaaguugcccaaggucacacagccagaaauggcagaaccaagaugugaucucagacacacucucaacuaccacauuacacuguacgguacacaaccaguuaaacaucucucaugucugagggacaucaagggaguuguguuuaauuugcauuuggaaaacagaccuagggcucacaagaagaauauggcuaugaauuuuagugucaucaacauaauaguauuuccuuaggccaugggaaaaaugagauggacauuuagagugaagagagaacaaaaauguaaggagcagcaagacagauacaagaaggacacuaggaaggagauuuuucaagcagugauuguccacaggcuggcucaguugccacaccacagagguacaaacuugaaguggucugggccuucuccgugugaaaauggcaaauccauucacuguuugcuggaugaauggacuuaucauugagcuauuugcuggauuuaccaucuagcuaaaagauagcuaaaagauuccagcuuagacuaugucaucaagaaaggaggccugauaggguaugaaacggggaaaacaagaaaaacaaacaaaaauggaugcucucagcucuugaaaggaugauuuauacccguguuugagcaaagcagauucugccuucagagaagcagcagcaaagauagcucauuucucaagcagcaccccaucucauccaucacccacuuccccuaccugccccccagccuacaccacaggaccucugcucugccaagagggcagggccccagccacgcugcagcaacaccagaagcgcaaaagaaaaugugcuguugcauagacagcgcaaauaaauaaugguucuugugauaaucagcuuuugcuuuuaaugggcuucacaugacucaucagcuaucacguaugcuauagccugagcucuggcucuaaaucaaacaaguucaaagggagaagaaaggaauaauagcaaaagaugagcagauaucucaagaagccuuaauccuacugaggaaaaacagaaauggaggcaggaagaagacaguuuccccuaugagcacucagguaccgaggguccagagagggcggaagcugaaacagccgcagagagaggcagccuaguugccgugacgccauccugccagccagcaagauuucaccagaccguucccuuucugccacaguuccugucuugugggcagcagaagcaccaagaaagaagaaaaaugguuguuuguauucuuauggcugcagggucauaccucugugacuuaacuauuucaacaagugacaaggagaaagugguaagagacagagagagcagccaagauggggguaaacuccuuuggaauguauuaaauccaacuucauucuauggauaaaaugcccucaugaauaaacacucauccccaaaacaucuuuuuuuuuuuuuugguauuuauaauccaagaaccuugacagagaaugucagcuuuuuaucaaggcucuuucccacaaugacuucugauaauggggguugggguucauucccaggugaaaagcaugaguuuguggcaaagaaaacaguauuguuuggucaccacacuggaauggaagccaggauauucugaaggaugccuuggcacuaauacaaauuagcaaaugacuuuagcacuucugagccucaauuucuucaucuguaaaaugagaagaauggacugggugaauaugaaguccuuccacucucuuaaucuaugcuuaugggugcucagagcacgggaacccuuccaggugucucuugugguuaggcuguccaugugucaggacccugauugugcucccagggacacacaagugugagaguggcuacaacucaauggaagcaauaaguaaacacguacacacucacaaagcuagaucccuauauuugauuaaaccauggguuaguagacaggaaccaugucuuaugcaucuucacacacucaaaauccagcccaguccaggcacugggcuuaacaaauguuuacugcaugcauuuugaggcaaaucuuuaaaaugucauauuaagaagcuuuucagacaugucgguuauggauugaauugugucccccuaaaauucacauguugaagcccuaacucccaguaccucagaauacaauguuuuuuggagcuaggaccuuuauagagggaaucaaguuaaaaagaggucauuaggguggguccuaauccacccucauggucucuucacaagaaaggaacugggaucacagacaugaacacagggaggauggcaugaagagacauagggagaagacagccauccacagcuaagcagaaaggccuggaacggauucucccucacaguccucaaaagggaccaaccccgcugacaucuugaucuuagacuuucaggcuccagaacugugaggcaauaaauuucuguuuuugaaaucacacaguuuuaaagccacccaguuuaugguacuuuguuauggcagcucuaguaaacuaauacaauauccagaaguagaauuauauaaugaaaucucccaucacacucaccacucagaucuuucacuccggcauacuucauuucguauuucuaaaauauauggacauuuccuuacauaacaauacccuuaucaaaccuaacagaauuaacacuaauuuaaaagcagauuuaauucccagaagaaauaaaccuuauacuaaaacacacacuuacauuccuccauuaaaacuauuaacacuuuuaggccgggcacgguggcucaugccuguaaucccagcacuuugggaggcccaggugggaagaucacuugaggucaggaguuagaaagcaggcuggccaacauggugaaaccccaucucuacuaaaaauacaaaaauuagccaggcaugguagcguggggucccagcuacucaggaugcugaggcaggagaaucacuugauccugggaggcagagguugcagugacccgagauuguaccacugcacucaagccugggcgacagagcaagacucugucucaaauuuaaaaaacaaaacaaaacaaaacaaaagcuauuaauacuaucaaaaacaaaacaccaauaagcuugaauuuuugucaaacaacccucagaggauaagcaagacucucagaauaauucaauuuccuaaucagcucucauauucaacaauuuccugaaaguaaaaaccuauguuucuuuauucaaguacagaaaagaaaggaagaaugcggucaguauucauacccacuccguggucacugaaaaugcacuuuucaaacuaaucccaagaaauuuaguagacaucauuaagucuuuaguuuaaaaacaguacgugcaaugguauuguauguuauauugcacauaauuuaagcgcaugaaaauugacaugacagagcucaaaaccacuaccaaaaaaaaaaaagauaaauacaaaaccauaccuuuacaggguagagaaccgcuuguuaugauuuucuaaaacguuagagacuggaguuaccaaugcuucaacaauugacaacuuccaaucacauguccucuucaggaagguuacuuuuugucuaauguuaagacaaagagaaauguuaaagucagaauggccuacuuaaaaaguuuuucaaaagagucuuuggaaaagcaguucgcuccaucaacuuucaaaacaggcaucgcuguaaaaacccacaauccagcuaauuagucucagcuguuugucauauggcacugcagaccagucaagugauuuuugccccuuucaagcuuaccaaguuccaguucgacuggccacucagagggcggcuuuauuaaccucuucugguguuagaagacucugcacuucagcucuuucuuccgcccaccuaccccgugaaucaaaacaguagaacauuuguuuucuugagaaagugccuuguauucucaaggcccuuaaagguuauauucauauuguugcuuacaaauacaaugccugauccaaacaaacaauaugggggaucaaauggaaguggcaggagggauggggcuagauuacuuaccagaccuugcagcuggccuccaauuucauaaguaaaacugccuacaagggaguccacccagauaucuugcuggcaucucaaauccagcaugucccguacucaccuccuuugcuuuucuccacaaccuugcuucaaacccacuucucuuccugugucuugaaucacacaaucccaacacagccagaaaucugauggcucucauuaacuccucccucucugccccucccacuuccaauuggccaccaaguccuaaggauauucaucuucuugcuccuacuccaaguuuuuauuauuucuuagauggcuauaauaaaccacuuauuugguuuucugguccccacguauucuugacucugauccauccuccacaccacacccaaagugaucuuuccaaaaggcaaaugagaguccaucacucuccuguuaauggcuccccacaaucuccacaauaaaaucccugcuccuuaagcuucugccuucaguaucaccgccuccuuccuauaagcugcuagaguccagccaucaguacguuuuauaauucgcuaaguuaagugguucucaaacugugguuccaagaccaguauuauagcaucuucuaggaacuuauuagauuugcacauucuugggcccacccagcugaaucagaaauucugaggauagggcacaggugucugugguucaacaagcacuccaggugauucugauacacacuaaagugugagagcugcugcuguaaauccaccaaguucuguucacuaagagaaucagcuccuuggcuccuugugccagcaaugcugagcuggauacaccuucccugugcuuacuguuucuagaaauggucaccccuguaugcuaauuauucaauuuauuucuuggucuuugcuguugcuuugugacaaucuugaagacagggguuguaucuuguuuuuuguucauucaccccacaaucacuuauugagcacuuaugaauuauugggugaaaugucggacauagaacuaaucaaucuaucccuugccucuaggagaagcuacgcuuucauuauggcagcucaacgugugacugaagacucaaucuguccaaucuaaaaaaaccaccaccggccucaagaacugugggcaacuaagaaaagucugagcacaaccagucugacaucucuucucaugguaaaugaaauggaauuuucguuucacaccugacgaaaaucucaugaaaaugcaccucuuucuuuuuuauaucacacagcaaccucgagaauuuugagaacaauuuaguaagaaaauguauccagauuuuuaaaucccagauuaaaauucauuagaguuagcuuccuuuaauuacaaguucauauuagcacuucucaaccaucaggauauauaggaaucuccuagggaucuuucaaaaugcuaauucugauucaauauuccuguagggggagaucgagaccauccuggcuaacacggugaaaccccgucucuacuaaaaauacaaaaaaauuagccaggugugguggcgggcgccuguagucccagcuacccgggaggcugaggcaggagaaugccgugaacccgggaggcggagcuugcagugggccgagaucgcaccaaugcacuccagcuugggugacagagugagacuccgucucaaaaaaacaaaaacaaacaaaaaaaauccuguagggggcucaggagucuguauuucuccuaguaagcacccaggugaugcccagguaauacuaacauuccuaacucuggaacuauaauuugaauagcaaguaaaauuaugacaauaccaauuuucauagucugcuuaaagcaacaaaaccuuuuuuggaugcuuuuguauugaaagcuuucuaaaauaucuuucagacuucagaauaaagauggcaugcucaacauguacaugugguucugcugccucccaaaaucucacuaauauagcaauaaagaauguuuuauuucuuuuagacauaaacucacaaggacaaagaucagguaguggaagcaacaaaaugguagaagcuacagaguagauggacuagagguaacugauuagcagaccucggaaagcugacucuuuaucugccaguagggaaauccaagaaggaacucaucacagaaucuccagaaagucucagggauucagaaccccaaaacuucuggaauuugggggacaguaacauagggacucaaaacagacagaaugguggucaucugcuuaaaaagcagcucagcacaccaagagaagaagaaaagaaagaacgaacuaccaaauagaaaauaaugaacaaaauggcauaguaagucccuaucuaucgauaauuacuuuaaauguaaauguauuacauucuccaacugaaagacauagagguugggcacgguggcucaagccuguaauccuagcacuuugggaggccaaggcgggcagaucacuugaggucagaaguucaaaaccagccuagccaauguggugaaacuccaucucuacuaaaaauacaaaaaaauuagccaggcaugguggagggcaccugugaucccagcuacuagggaggcugaggcaugagaauugcuugaacccgggaggcggagguugcagugagccaagaucgcgccacugcacuccagccugggcgacagagcgagacuccaucucaaaaaaaaaaaaauaaaaauaaaaauaaaaaauaaaagacauagaaugacagaauauauauaaaaaauaagauacaauuauuugcugccugaaagagaguugcuuuagauuuaagggcagacagacuggaaguaaagggauggaaaaaaauauuucaugcaaauggaaaccaaaagaaagcaggggugacuauacuuauaucagaauagacuucaaguaaaaaacagucccaagagacuaagaagguaguuauguggugacaaggaggugaauucaucaagcagauauaacaguuguaaacauguaggcacccaacaucaaagcaccuaaauauauaaagcaaauauuaaccaaacugaaaagagaaauagauaaccauacaauaauaguaagggauuugaauacccuguuuucaacaaugaacagaucauccagauagaaaaucaauaaggaaauggcagaucugaacaacauuauagaacaaauggaauuaacaggcacauacagaacuuucuauccaacuagaggagaauauacauucuucucaagcgcacguggaauauucuuccggauagaacauacaguaggccacaaaacaagucucaacaaauuuaagacgaucgaaaucauauuaauuaucuuuucugaccacaccgauauguaacuagaaaucaauaacaggaagaaaacugaaaaauucacaaaucuguggaaauuuaguaacauaauccugaacagccaaugggccaaauaaaaucaaaaggaauuuuuuuuaaaucuugagauacaugaaaauagaauacaacacaucaaaauuuuaggggauucaggagaagcaguuuuaagagggaaguuuacagcgauaaaugccuccauuaagaaaaaagaaagaucuccaguaaacaaccuaaguuuauacugcaacaaacuagaaaaaagguaacaaacuaagcccaaaauuagaagaaagaaugaaauaauaaaaauuggagccaaaaugaaauagagaccaaaaaaacagaaaagaaagaaaagaugaauaaaacuaagacuguuuuuugaaaaaauaaacaaaauugacaaaacuggcugggugcggugguucaugccuguaaucccagcacuuugggaggccaaggcgugcguauaaccugaggucaggaguuugagaccagccugaccaacauggcaaaaccccguuucuauuaaaaacacaaaaauuagccaggcgugguggcaggugccuguaaucccagcugcuugggaggcugaagcaggagaaucacuugaaccugggaagcagaaguugcagugagcugagauugcaccacugcacuccagccugggugacacagcaagaauccguccuuaaaaaaauaaauaaauuauauauauauauauauauauauauauauauguauagagagagacagacaaaacuuuagcuagucuaaaaaaaagaguaaaaacucaaauaaauaaaauuauaaaugaaauaagagguguuacaacugauaccacagagguacaaagaauaauaagagauacucuaaauaauccagucgggcgcaguggcucacgccuguaaucccaggacuuuggaaggccaaaguagguggaucacuugaggucacgaguucaagaccagccuggccaacaugguaaaagcccgucuccacuaaaaauacaaacauuaacuggggcaugguggugcacaccuguaaucccagcuacuugggaggaugaggcaggagaaucacuugaacccaggaggcagagguugcagugagucgagauugcuccauugcacuccagccugggugacagagugagacuccaucuaacaacaacaaaaaaaaaaagacaaaaaaaagugggauuacaucaaacuaaagcugcugcacagcaaaggaaacaacaaaauggaaaggcaacuggccgggcaugguggcucacaccuauaaucccagcaguuugggaacccaaagagggcagaucacuugagggcaggaguuugaaaccagccugaccaacauggcaaaaccccaucucuacuaaaaauacaaaaauuagcugggcacgguggugggcaccuguaauccuggcuacucgggaggcugaggcacgagaaucacuugagccuggaggcagagguugcagugagcagagguugugccauugaacuccagccaggugacagaaugacacuccaccucaaaaaaaaagaaagaaagaaaaggcaaccuauagaagggaaaaaaagguaaaucugaucagggguuaauauccaaaauauacaagaaccucauacuacugaauaccaaaaaaacaacccccaaaagaaaaaaaaauuuaaugggcgaaagaccugaauagacauuuuuucaaagaauacauuaaaaauggucaacaaguauaugaaaaagugcucgacaucacuaaucagcagagaaaugcaaaucaaaaccacaaugauuuugauuaccucacaucugcuaggauggcuaauuaaaaaaaaaaaaaaaaaaaaaacaagagauaaguguuggcaaggauguggagaaaagggaaccuuguacgcuguuggugggaauacaaauugguacagccacuauggaaaacauuauggagcuucuuuaaaaaaauguuuucaaaaauuuuuuaaauagaauaccauaggauuuggcaauccuacuucuggguauaauacaucugaaagaauugaaaucaggauuucuaagugauaucuguacucccauguucacugcagcauuauucacaauagccaagacuuagaaacaaccucaauguccacugacaaugaaugaaugaagaaaauguggucuauacauacaaugaaaaaguauucagccuuaaaaaagaaauaaauccugccaccugugacaauacagauagguggaagauauuauacuaaguuaaauaagccagacacauaaagaaaaauacuaugugaucucccauauauuuaauauauagaaucuaaaaugucaaacucuccaagcaugguggccacuccuguagccccagcuacucaagaggcugaggcgcgacaauugcuugagccuaugacuucaaggcugcagugagcuaugaucacgucacugcacuccagcccgggcagcggaguaagaucuuguuucuaaaagaaaaaauuuuaauuuaaaaaaaaguaacucaaacucccagaagcagagagcagaaugaugguugccagggacugggaggagggggaaaugggaaggucauaguuaaagagaacaaguuucaguuaugcaaaauaaauaaguucugaaaagcuauuauacaguauagugucuauagcuaauaauacuguauuauauacugaaaaucugcuaagaagauagauccaguguuaauuguucuuaccacacacacacaaaaaugcaauaauaauaaaacaggcaggauaaaaccuugggaggugauggauacauuuauggccuugaugguggcgaugguuucaugggugaauaauuauccccaaauucaucaagauguauacauuaaauauguacagacuuuuuaucugucaauaauaccucccauaaaguaguuuuuuuaaaaauaaauuguuaaguaggggaaggaaagaaugaacaaacaaacguaggaacaaaugaacaaacucagguaagaaagaggagaugaaaaugguauacuuguggcagggguggauggagcaaugagcuaaauucucuacuucuguaauaaaguaucaauagauaaugacuaaaacugaaaaacugaccacagaaauauaaaugugucauuuagagacuagauguauaaacuacugcaagacuucagugguuaacucuggagagcaggaaaugggcugggggagaggcgucuacugguuuuuuguaacagcccuuguaaaacaacguccacguauaacuuugguaaauuuggcagggcacgauggcucauacuuguaaucccagaacuuugggaggcagaggcgggcaggucacuugaggccaggaguucgagaccagccuguuugucuccauaauaaauggcuccugacugcuguauuuauuucgugucuuuuguuaauuuauauuuccuucucccuccccucaccuuugcugucaggcagcuaucccucaccacaguaaucagugugccuuccugggacaaccccuaccccuuccgaugcacuguuuuuaauugacaaggcaccuggaaaccaaauaaccaagcuuauuagaacuguguguaaaaugaagaaaaaugggcaccaaaaaauguucugaaaguugcucugugaugcagguuggcaauuuucaauacauuaaccauuuguccaacucagaaccguuuggccuuacuaucaacuaugggucaguaggcugggugacacucagugggaccaaccaucccaguuuaguggggacugaguuauagcacugaaagucaugcaucccgggaaaccauaucccagcauugggcaaguuacuucaucuucuucaaccuguuucaucaucuguaaaaugaaagauaauaucugcuuugaaagauuguugaggauuaaaugagaaaauguuuguauaacucuugacacauaugguagcuguagcuauuauacucacuugcauauuguuauuaucaacccuaguaucagguagaaaaagaaaguauucuuagaaacauaaccuguaauuugcuuuauauauaguggacuucaggaagcugcaauguuugcuuuugugaauuuccuucccauuuuguaacacacauuuuguuucagggacuaaaacauauuaaagaaauuuaauaguucaacauuucugauuucucuacuggacaaaagccuggcagguuuccacuauauuuucauagaaaugacucuuuuacacuaugggagcccugggguauuuaugucaguagccgcuucuaaacuugugaacagaaaucagccugccaccucacaaagaagaggcaucauaucugaaauuuguuuuuaauuuccauuucacuuuuuuccuucauaauagcaccagauuauucagucuucuaaucauuauuauuuuuuuuuuuuuuuuuugagagggagucucacucugccacccaggcuggagugcaguggcacgaucucagcucacugcaagcuccaccuccuggguucacgccauucgccugccucagccucccaaguagcugggacuauaggcgcccgccaccacgucuggcuaauuuuuuguauuuuuaguagagacaggguuucaccauguuagccaggauggucucgaucuccugaccucgugaucugcccgccucagccucccaaagugcugggauuacaggcgugagccaccgcaccuggcccagucuucuaauuauuuagugaauucaguacguugacauggggcugaaaaaucugcauuucuaaguucuaaguucuaagccaagucauucacuaauuaugucaauucuaucccugaaaaauaagggcuuguaucaccaaacggaugaaauaccauuucugaacucaaaagcugaagcaacucccuacuccacauuuauuaauuacagccugaaggaaauugcucacaucuaugcaccccacagacaaaagggcacaguugcuaaaagaacaguuccaaacuuugggauagauaauggaaagaaucacaaguuacucaaagccaaaauauggccuaggaacccucuaagaagcaguagagacagcagaaagagccaggcagauaagacucuuaauaaaggcccccauggccuguccucccauacucuucuauuucuucuccacccaguguccgaggccugugaccacaaaacacaggacaacacagaaccucagagaagccuugaggggcaacuggucaaccaauuagggcaggugaaaauggauccaggacuggcagcagaaucaccuaggauaugugaugaaaauccaaaauucugggucccauucaggccucugaauuaggaucucugcaagggaggccuagggaaucugcauuuauaucaagcuucccaggggcuuucugguuauacacaaucaaguuuguaagccacuguucuagggagacaacagauggcaaaaauguacaacuacaguuaggcaaauagccuguacaucaagaucauauuuaacuucuacuagccucagauaccaaaucuguaaaauagggauaauaauacugaccuagcaaggugguugugagaaucaaaugaaauaaguaauagccucacacacagugucucacauacagcaggugcucaauaaaaguccauucccucgcuuguguauggcauucuaaugaagacuuacaacaauaguuuuugaauaaaugucaccuguuuugaauaaauaucaccaaggaaagcagauggccaggaaaguuaaggccucaauguuaaugacucaucaacuacaaaggccgaggucagcagccuuaaccagcgauugagucaugaaauguacuuguagacagugguucucaagcuucggggugcaucagagucaccuagaugguuuuaaaacacagacucuaggccccaccagaguuucagauucaguaggucuggaguggggcugaaaaucugcauuucuauguucccagguggugcugauguuacugguccuaaucugacacuuugcaauaaaaaaagaaaaacuaugcuguguauauuuccuguuugacacuagacugguuaguuucauguaaauagagaaaaaaacuaagaaaccaacaauuuccgaggcugugcugccucugucccugagaaucuuacuauguuguuugaacaaugcauagagaggacagggagauuugaguucuaucuucccacucacuugcugugugacucugcaugagacauaugaucucuuccagccugaguuuacucaggcugggaguaaaggugagcuagacacugguucccaaaccagguuguccaccaacaaucacuagagcaguauuuaaaauaaaacauagauucccaagcccuagccacaaaccuaauaaauuagaaucaccaaaggagagacugaaaaauguguuguuguuucuuguggguaugguuuauauauauauauauauauauauacuuuaaguucuaggguacaugugcacaaugugcaggcuugauacauagguauacaggugccauguugguuugcugcacccaucaacucauaauuuacauuagguauuucuccuaaugcuaucccucccccaguccccacccccugagaggccccggugugugauguuccccuuccuguauccaagugaucucauuguucaguucccaccuaugagucagaacaugugguguuugguuuucuguccuugagauaguuugcugagaaugaugguuuccagcuucauccauguccuugcaaaggacaugaacucauccuuuuuuauggcugcauaguauuccaugguguauaugugccacauuuucuuaauccagucuaucauugauggacauuuguguuaguuccaagucuuugcuauugugaauagugcugcaauaaacauacgugugcaugugucucuauaguagcaugauuuauaauccuuugggcauauacccaguaaugggauugcugggucaaaugguaauucuaguucuagauccuugaggaaucgccacacugucuuccacaaugguugaaucaauuuacacucuuuugugagcauguuuuaaacaaaagcucccugugccauuuucauguauagccaguuuugaggaagcauuaacaugguaaucuuucuccagcauuaaagcucuugggucuuuuugauuuccaauucacuggguccugagucuauacuuagccaguauaaguagccuucuccuuuuauauuugcuucaccuggcuauucuuccgaaaggaagcauacacuguccucaaaaaaaggaaucuacucugcuuagcaguuccauuucucauauaucaauaaacuggcauucugguuucauuuaaaaaauaaaguccaggauaggcacagugguucaugccuguaaucucagcacuuugggaggccaaggcaggcagaucacuugaggucaggaguucgagaccagccuggccaacauaguaaaaccccaucucuauuaaaaauacaaaaauuagcccagcauggugacaugcuccugugguccuaguuacuuaggaggcugaagcaggaggauccacuugagcccaggauguugagguugcagugagcugggugacaaagacaagaaagaagggaagggaaggaagaagagaaaggaagggaaggaagggagaagggaagggggaauggaagggaggaaggaagguaggaaaggaaaagagaaggaaaaaaaaagaaaccagaggcccuuacagaccacagguacauauuuggaucuuauaccuauuacaaugaaagcaacuaagggauuuuaagcagaaggauaugaauugaauuccuuuaauuuuuuaaaauuuugucucaugcuccucaagagugugaguuccuuuuuugggacaucacuggcuuugugugaagaaugggcuauggcagggaggggcaagaauuggaacagaaaaguagcaguacaggccuuuaaccagcagcuggcacagagcaggcacuuggauauuucugcacugcuuuaacauagggaaaucauaauauacuuguuucaccuccuaauguauuucagaggaguucaaggaagagacucuggguguuagcaaaguuccaucuagaugucacuucuuuugaacaacacauagaauuuuggauuguccacaguacaacugguuccaaucaagaaguauuagaauaagaacauaaaaagaacacaccaggaaaccaucagaccaggcuucuggaaccaucccugccaucaauuagcuaugugaccugaggcacagcucuggauuucugggaggggagccugggcuacaauuuccaaggucccuacuagcucuuaaauuacacaauucuguaaguguaacaaaugugguuuccuuaucuggguggcaaaaugggaugaugacucagggugagguuuuuuguuacagauuuucaaccucccagagaagcucuagugaagcuagaaucaggguguuaauaaagaaacuguccaguuuuauuauuuccuuuccaggguaugguggucagcuggaaaucugggaaguagacauuccuggcagcugcgagcuuaucgugcaaagacugagaacccaagucccuguguaacccuucagguacacgaucucugggguccccugcucauguggcuuucgcucauguggaagcacacaauagacaggcacugaagaccagccucucacuuccuccugcugguaggcuguucccaaaggguccacuccucuccuauggccaaccuggcaccuccacgagaaccccauuucgcaugaucccugggggcagugguucucagucucaacugcaacugcccaucagaaucccguguggagacaauaaauaaauaaauaaacaaacaaacagccugagcccuaccccacauuuacugacuuagaauuggggugagggagagguuagaaagacaacagcgguaguuaggcuuaguuaguuuuacaugauggacagaacguguaacuugggaaacuguaagccaaagagguugaaugaguugucuaaugcaggguuucuuagcgucggcacuguugacauuuuaggcaggauaauccuuuguugggggcucuccuguguacugagaauguuuugcagcaucccuggcccccacccacuaaaugccaggaguaacuccccagcugugacagucaaaaaugucuccaggcauugcuaaaugucccaugugggguggggcaggggagaaaaucacccccaacugacauacacuggugugauaucacauaguuaauaaucaggaauauggagacuaaaaaccgaccgacugauuccugacuguguugauucuuccacauucaagcaggaaguccggaacacaggaaugagccgccaccugaggaaauaccacaacccacuucacuacacaacccacuucaauacacagccuagggcagacgugggaccugggacagcugaccuugucccuaaugagaaaagccacauuaggucuccaguauuugacugugaggacaaugacuuaucuuuucaaggacuguuacaccucuucacucauucuuggaguuguuuccuugaaaugaugcgauuuauuaugaaaaucacuauuuucauaaugauuucuuagcaagaaacaaagaaauccugaccacaaucauagguuauauuuuaaaauucuuuaguuuuguaaaugaacauuuaagucaugaccuauuucuguauguuucauuucuccccuuauuagggcuaguacagcaagaacaaaaguaucauauuauuguguuuaacuagcugauuuagaccuugacuuugcuuuuaacgauacaaauacacagcagauuaguauuuagccauacccugauaggacuugaccagccucccagguggugggaucaggccaagguagauaaacuauagcaaauaagaaugaacagacuuuucagucucguggcaaccaauuuuauuauuaugcuuugaccuggcagcugguaagacuuuauaugaauuaaccaaugaaacuaugaaaaaacaagauuagugguucugaaauaugguauucaaauagcaguuagagaaagcaguucauuuucaaggcugcuuucuuuuaaauagguacaaauaauuacaauaaaaaauaauaaaaucuuguuuaaaaagaacagaucucuagugagcaagucacauacaccugucuaucuaccuugguccuugucauauguauaucuuccauauuuauuguaccaaaauaaaaaggggugaggaauuuugugggaauaggccacucaaagcaagcaggcuuuccauaagacaacacuuaguuguuguggaauuauacucaguaagaccaccuuaaucaaagcaccuuauaauaaauacuccagagggucaaaaguguuaacaaaaccauaaaaaaaaauaaaaccacauugaauuacaggcuuucuggcauaacagcagggacaagaaccacauggggcuuucaacaguuaugcggcucucagagaaaagucaaagugucucaugagaauggcuuuggcugccacauguuggaucuggggacugaaggacaguaugauaaugaggugaucuugaguggauggcuagagaugugauuaaaggucaacaugaaaacauaagcaacuucuucaugaccucuuaagggaagggauuaugcagcagaacaacugcugguuccagagucccacuuccagcucugccacuaacucuaugugacuuugacaaagugacuuaaccucucuggaguaaauuccauuaacuauaaaagacuagaguaaaaugaaauguucucuaacuuccuucuaauucuaauacuccuuggguuuacaaaucuucucuuuuggauacaugcacaaucaccaaaaaucagccauggcucaaucauucuuuggacauuuucaccaucgaugcauuuccuaugcauaaacauaaacuccagcuagggcugccagacacaaaacaagacauccaguuaaaugugcauuuuggauaaagaacaauuuuuuaguaaaaguaugucccaaauaauguauaagauauaggaaacaauuauuuaguguuuuucugcaaugcaaauuuaacuuuuuuuuaguuugcuaaaucuggcaccccaccuccauccccacauuagaaucaaaacucucacuccacacacgggagguuggcugacuaaagcacuacaugguaaacuucuguuuaagggcaacauauacagacgaaaaacaaacaaccaaaaaaaaaaaaaaaacaggaaaggaggaacaaaacuuucagcauuccucguaagagaggcaucuaauuuuacuugacaauaaauaaaauaugaguauuacuagaccucaaucauacaaguaccugcaaaaccagagaguccaaacagagcugaaugcucucuacuccacacaccuuacccuacgaacauaaguaaauuacaaacccuuuaucucugccuccaguucagggcucaugucugcaccuagcuuaagggaaaccaaaucauaaacucaaacuuccugaccaagaggcagaagaacaaauacaguccaagaaaaucugcaaguggcauaaaaagugaaggcuauagaagggaaaaauuacucucuucaagaaccaaucuuguuuuagcgauggcaagacaauuucccuucucaggggccuggccaacauggugaaaccccguuucuauugaauaaauaaauaagaaaugaauuuccauuuucucaaauuuccaaaaaacuucacucuucuuaaauuagcacaagaggccaacacccuggagauaggcacugaauggcccugcccaguuugcccaggauauagacagagggcuccggucugccacugugggagggaccaaaauccucaccuuucuacuuauuugaccuuucccuuuuuaaggaagauaagacuauuauuuuugggaaaguaggacagaagacgagagacuuaggagauguugguguaucuauagacauugcuucucuuagaaaaaaauggauggaauagugggaaagaaauagcagaacacucuacagacauaccauccuggaugugcccgaucuccucugaucuuggaagccaagcaggguugggccugguuaguacuuggaugggagaaauggcagaaugaucccuauugcucugucuucuguucccuuuuucauuaguucaacacauaucucuuugagugcuuaauauaugucagaaaccauucuaugugcuauggacaucacagugaacaaggcagauuacuggccauccuggagcuugucuucuaccagugaaagacaaauguugugugugugugcuggucuguguaugacaguucuauaaauacucgaaagaaaacaaggcaagguaagggggcagaaaaugaugggauaggugagggauacuauucuagauggaguggucuaagaaggccucuccagaaaaaugacuuuucaccugaaugaaauaaauaagaaagccaugcagacaucugaggggaagagcauuccaggcagaggaaacaagugcaaagguccugagguauggcuggagcagagucagcaaaggcaagagugauagcagaugaagccgcacuccaugcaaggguuguauagaccauggugaggacucugucacuucugagauaaaaagccacuggagaguuucaagcagagugacauaauagacucuggcugcuguguuaagaauagaguguggagcaguaaggguggaagcagggaagcccuucagaaggcuuuugcaguaauccaggugacagagaugauagaacuugguggaagcagcagaaguggugagaaaugguuaucauccuagauguauucuuuuuuuuuuuuuuuuuuuuuuuuugagacggacucacacucugucgcccaggcuggagugcaauggcacgaucuuagcucacugcaaccuccgccuccuggguucaagcgauucuccugccucagccuccugaguagcugugauuacaggcacccaccaccacgccccgcuaauuuuuguauuuuuaguagauacagggcuucaccauguuggccagccuggucuugaacuccugaccucacgugauccaccugucucggccucccaaagugcugcgauuacaggcgugagccaccgcacccggccugcugaggaauuuaaugugggguauaagagaaagaaucaagagugauuucaggguguuuggugugagcaucuggaagagugaaguugccauucacuaagauggagaagacuaggggaaaagcagcuuugggagagaaaacucaaaaaucuggcuccuagagauuguugcucacuuuaaaacccuuacaucuauuuuagaaccaaaacaauagaaauugagaagcugacuuuaaauuucauguggaaggccaggcaugguggcucaugccuaugaucacagcacuuugggaggcugaggcagacagaucaccugagaucgggaguccgagaccagccugaccaacauggagaaacccugucucuacuaaaaauauaaaauuagccaggcaugguggcacaugcccguaaucccagcuacucaggaggaugaggcaggagaaucacuugaaccagggaggcggagguugcagugagcugagaucgugccauugcacuccagccugguaaauaagagcaaaacuccaucucgaaaaaaaaaaaaaauucauauggaaauucaagggacuggauagucaaaacaaucuugaaaaagaacaagguuggaggacucacauauccugauuucaaaacacuauguagcuacaauaaucaagguaguaugauacuagccugaggacagacauacagaucaauggaauagaacugacaguccagaaauaaaccuuuacauucauggucaauuuaucucaacagaggugccaaaacuauucaaagaggaacagucuuuuaaacaaauggugcugaaagaacuggauauccacaugcaaaaaguugaagucagacccccugccucacaccauauuuaaaaauuaacuuaaaaugggucaaagaaugaaauguaagagcuaaaaacuauaaaacuuuuagaagaaaacauaaguauaaaucuucaugaucuugaauuugacaauguuuucuuaacuuugacaucaaaagcacaaacaacaaaaggaaaaauaggcucggugcaguggcucaagccuauaaucccagcacuuugggaggcugacgcagguugaucacuugaggucaggaguucaagaccagccuggccaacauagcaaaaccccgccucuacuaaaaauacaaaaauuagccaagcaugguagcacacaccuguaauuccagcuacucuggagucugaagcaaaagaaucacuucaacccaggaagcggagguugcugugagccaagaucaugccaccgcauuccuaccugggcgacagagugagacucugucucaaaagaaaaaaaaggaaaaauagauuaaauauacuucaacgaaauuaaaaaucaaggcacgucacagaaauuaaggaaggaagaaaaaagggagggagggaggaagagagaaugguagaaaggaaggaagaaaaaaguaggaaugaaaacauaaaacaacauaaaccaacauaaaauacagaaaauaaugauccucagucaaguuccuucagcauuauauuaaccuuucuucacuucuaaccaucugcagaaacuguuuuccagauuguauuuucccucuaaagcaaguuuuuaaggccgaaaaaaaaaaaagaacaagaacagugaguggagaaucaacaaauuuaauuagcaaugauuacagaaaacuuaaauagcacacacaacucuauaaucccucuacccccaauuccaacaucugacugaucaaccaaccauaaaaugugagaauccauccagaaggaaagaacagcuguuaagcuguagggguaaggacccuguggcagaagacccugaggccaugugggcccagguggccagcaggagcggaaaggcugggaaggcuccucaguccagggcucacaagacucccuucgcuucaggccugacuuugcugaacuggugaucuauugggacagagacaggcuuuggcaauaguuaccaaagccugucaucauaucugcaccaccaccagucccgaccggagggccuggcugccagguaguuuucagucuaacugacaggagaagagagagccccucccucgcagcuagucugcaguccagacccucaccaaccggagggcaaccagguuaaacaguuaaacugaaagcaaaagagggaggaaugaaccggggggcgugcgggaggucggggacuuuccuccuuucccuccuggaaaguuuccuaccccugaugggcauccucccaccuggaugcaacccggaggcgaucugagacccuggccggaccugggaccgcaccuggccagcaccaggcaguugucaucacuggggucugcgcugagggccugggagagaagccacucuucaggcgggcucgggcgccuggaggcggggaggaagggcggcgcacucggaccccagcccuaggacggccccagggggacgccucgcucggcccucccggagggaccggacccgccgcgcgccucccgcuccucaggcccccucaccuggcucgccccgccguccuguccccgccuggcucggguccucgcgcgccgcguccacccgccgccggccuuuuuugggucguuggcggguauuuuccgc

SEQ ID NO: 192956 - RNA, 184181 nt, Homo sapiens
uauauuauuuuauauuuuauucaauuuuaauaugguuuccauuauuaacuuuuaaaacaaaaugauuuccaguuuaaaaaacaaugcacugaccacauaauuccuuuuuuauuuuacacaguuauacaaauauucuaaauacacauuuuguguucaagaugauggcaaauaagauuaacuguacaguacauaaggaaagaaaauauuuuaaguauauuuagaagcaauagaaaugucuauacaaaacaagcaaauggaauaaaauuuuuuauuuuuaaaguauugcaacaggcccacagguuuguaacaaaaaugucuuugcacaguuccucacaaugccccauuaauagcuaaagcaagacagcauuuuuuaaaaaaaaauaauguuucaaaaugcuacacgugguacuacuguuugcacaguuugaucaaaauaacgaucuacuuugagucaagcaaaaccuagaggaaauauaccaaacaacuugaaaaucauuuguauaaaaaucauugcacauuauuuugcucguuugaaaaguaaaaaaguguauuuacaaaauauuuugcagucaaaauuauaaagugaauggauaucucgaaguaacacgucuugauacagacaguucaaggaaaacacacaaaugcuuuuucuuuaagagguuuucagugcuccuuccacugggaaguaaacaugaucuacucaaaugaauuuacaagaugguacacauacuggagcaaauccaacaccugcauuauaaaacaauguuuaaaaggugacagaaugaggaauuuguacauuguaagaagugagcuauucagagaucaacaaguacauuuuaauucgguuagcauagaagucuucauagucuucagauaacagacagugaacauccuugacucgaugaaaguuaaaaagcaccaugcacaacaguuuagugguaagcacugaaaaaaauagcaccuguaauacugugauauugacaauuuaaaacuggucuaauaacugccggagauauggugccuuggacaauucucuauuuacucgggagaguuugaaaaguacugggcaguucagagaaacacaugggaugugucgaucaaagcaaccuguacaguucuugcauaucugaaagcauaagagaaauacaaaaaauaauaggaaaguuuuuaugcguguaugcaaacaacaaauuuuuauaaucccuacuuucuagacuaccacagauuacuggcagacauacauuacagaaacuuucauuaauuuuaaucucuuggaagccuagacuacccuauguugagacauuucuaaaggauauuauuuuguaaagauagaguacaaauuucccuaaggauucauuuaauuccuaagauuaacuuucauuuacaauggaauccuauuaaaaucuacauaagcuacccaauuaccaaagaaugucucuuacaugaacuauaaacacguuuucaaaguacuuagacuauauucucauaugccaaucauaaaaaaguuacucuuuuucguauuccagaagagaaaagcaaccugcugaagccacagcagaaaaacauaaauugugaagauuucauggacauuuguuaguuccccaaauuaauacuuucauaauuucuuaugccugucuuuacugcaaucucugaacaugaauugugaagauuucaugaacauuuaucacuuccccaaucaauacucuuauaauuuccuaugccugucuuuaaucuuuuaauuccgucaucuccguaagcugaggauguauaucgccucaggacccuguggugauugcguuaucugcacaaauuguuuguaaagcauguguguuugaacaauaugaaaucugagcaccuugaaaagaacaggauaacagcgauuugcagggaauaagggagauaaccauaaaaucugacugccugcagggccuggcagaacagagucauauuucucuucuuucagaaagcgaauaggagaaauaucgcugaauucuuuucucagcaaggaauaaccccgggaaaacgaaugcauucucagggguaggucucuaaaauggccacucugggagugucugucuuaugcaguuguagacacgggaugaaauaugcccuggccuccugcagcacccccaggcuugcuaggauuaggaaauuccagccuggcgaauucuagucagacugguugucugaucacgaacccuguuuccuguuaagauguuuaucaaugacaaugugugcccagcacgacauggaccuucaucaguaauucuaguuucacccuggccuugugaucucacucugccucuuugcuguugugauauuuuacugccuuugaagcaugugacccacucccuauucguacaccccuccccuuuugaaaccccuaauaaaaacuugcugguuuuguggcucaaggggcaucaaggaaccugccaacaugugaugucacccccagagacccagcuguaaaauuucaaaaaaaaaaaaaaucaaauaaugugaauuugaaaguaguggugcagaccagugguucuuaacccuggcuaacaaugagcuuaaaaauaaacaagugccccaucccagacccauaaugagucagaaucuccaggcaugaaagccuaagaaucuguacuucuuaaggcuucccagaugauuuggauguauaauaagaucugaucuuaaggaaaauaauaaaucauaaggcaauuuuuaaaaagagaagcacuauaauguuuuacacaaugaucaauuuuuaaaaauacuuuaaagucucaaguugcauauauaguuaaaaaaaagguuauaaaacaugaagaacauaaaaaaauuaaaaaggaugccaaugaagacuccaaagguuaagaaaaugcaggccgacuuucaccugaauaguguagacaagugauuuuaaaaaagccauaccaaauggcaacaacuacucuggauugucuuuuaagagaaaucaaauacgcucuagugaauucuuugaucuauauuuaucaaaggguuucaguuucagagauggcucacaggccagugaaguuuuguucuuugccccaguuaucuuccaguuaaccgaagggcacacuuuuucuaaguagacugguuacuguauccaauauuaugauauugucacaagcagacugcuuacaaacaugugcuucaguaugcuccaugaagacugaguaugcuguucuaugaugaagccuuugcuaauuagaucucugccaagagacucaaaucuauucccaaauauagaauuucuguauuacagcucuaugaauugcaguuacauucaggugccaggacaaacugauaaauauuuaagcucuuucugugcuugucugauaaauaagccaggauggaauuacuugacucacuaaauuuaacucaguguuuaguuucaagauccuuuacugguuuaaacccugagcauuauagcuugauucaggcuuacauuuaaaacuuuagugccccaacccggacaucuacuuuguagcacauagggaggcaggcacuuaaaaaauaucugcuuuaaucuuuauucuuuuuacuauccuuuggcuuucuuguucaaaaaaaauuuagucaaggcugggcacaguggcucaugccuguaauccuaguacucugggaggcagaggcagguggaucaccugaggucaggaguuugagaccaccuggccaacauggugaaacugucuccacuaaaaauacgaaaauuagcugggcgugguggugcaugccuguaaucccagcuacucgggaggcugaggcaggagaauugcuugaaccuggaaggcagagguugcagugagccaagauugcaccaacuacacuccagccugggcaacagugagacuccgucucaaaaaaaauuuuucagucagaugcuugcuucauuugcuuucauucuuucauguuuaugauuaacaguguuaaggugaugaauuuuucucugaggucugccaucuagaaucugauuugcaguguuuucauuuuguuuaacagaauuuacaaguggaaggaucacuuuuuuuuuuaguuuguaauuaauuaccauuuuauagcauuguauuacauucauuuguaauauuucuacuuuuugaaauguacugaggcuuucuuuucuuucuuuuuuuuuuuuuuuuugagaugagagagagcgucucauucuguugcccaggcuggagugcaguggcaugaucucaguucacugcaaccucugccuccuagguucaagugauucuccugccucagccuccuuaguagcugggauugcgggugcccgccaccaugccuggcuaauuuuaaauuuuaauuuuuauuauuuuauuuuuaauuuauuauuuuugaaauggagucucacucuguugcccaggcuggagugcaguggcacaaucucagcucacuguaaccucugccucccuggcucaagcgauuguccuaccucagccucccaaguagcugggauuauaggugccugccaccauacccugcuaauuuuuguauuuuuaguagagaugggguuuugccauguuggccaggcuggucucaaacuccugcccucaagugauccuccugccucagccucccaaagugcugggauuauaggcgugagccaugauccccagccgaggcuuuuuuuuuuuuuuuuuaacagacuaugacuuuuuuuuuuuuuuuuuuuuuuuuuuuuuuuuuuuuaagauggagucuugcucugucacccaggcuggaguucaguggugugaucucggcucacugcagccucugccuccuggguucaagugauuuuccugccucagccuccugaguaguugggaguacaaggcucaugccaccaugccuggcuaauuuuuguauuuuuuaguagagcugggguuucuccauguuggccaaacguuucaaacuccugaccccaggugaucuaccugccuuggccucccaaaguguugggauuacaggcaugagucaccacaccuggccagauauuuuuaaaacauucuagaaacacuuaagaaguauauuuuuugguacuggguuacagaguuugauauauaaucacaaggucugacuuauaauguuuacaauuuccauaauuucacuuauuucugaucacuugauuggucuuggauugagaaugauguaaaaucuccuguuuggauguguuucuaauucucauuacaucucuaguaauuucugcuucauuaaaaauuucuacaaauuagugcaugggagacauuuaaaacauucuagaaacacuuaagaaguacauuuuuugguacuggguuacagaguuugauauauaaucacaaggucugacuuauaauguuuacaauuuccauaauuucacuuauuucugaucacuugauuggucuuggauugagaaugauguaaaaucuccuguuuggauguguuucuaauucucauuacaucucuaguaauuucugcuucauuaaaaauuucuacaaauuaguguaugggagacauucauuugaacguucuugaaaaacaccucaaauuaaaauagcucuugaaagaugacaaaccaucauuauuuauaaauagcaucgcuuuuucuuuuuuuuuuuuuuuucgauccaaggguauacauguagguuuguuacauggguauacuguaugauguugagguuugagcuucuaaugauccuguugcccaugcaguaaauguaguaucugacaggugguuuuucaacuuuuccucuccucaccccccuuuuggaaucccuaguguucaucauucccaucuuuauguccaugaguacccaauguucauuauaugugagaacaugcaguauuugguuuucuguuucugcguuaauuugcuuaggauaauagccccagcugcauccauguuguuacaaaggacaugauuuuguucuuuguucuuuuuuuuuuuuuuuugagacagaguuucgcucuuguuccccaggcuggagugcaaugcugcaaucucagcucacugcaaccucugccucccagguucaagcgauucuccugccucagccuccugaguagcugggauuacaggcaugugccaccacgccuggcuaauuuuguauuuuuaguagagauggaauuucuccauauuggucaggcuggucucgaacucccgaccucacgugauccgcccgccucggccuccgaaagugcugggauuuguaggcaugagccaccacgcccggccgauuuuauucuuuuuuuauggcuguggcaucacuuucuuuuaaacuguauuuuuauaagaaauaagauggccgggcaucaugguucaugccuguaaucccagcccuuaggcagcugaagugggaggauugcuugaguccaacaguuugagaccagccugggcaacauagugagacccgaugucuaaaaaaaaauaauuaguaaaacauggugggauaugccuguagucccagcuacaugggaggcugagcugagaggaucacuugagcccaggagguugaggcugcaaugagcuguaaucaugccacugcauuucagucugggugacaaagugagacccuaccucaaaaauaaaauaaaauaaaaauaaauaaauaaaaagaaaaaaagaaugaacaccuaauguugaaggaggaugggcucuggguaaauugauggcaccaaguagugauguguuugucauugagugcagaaaaaacauaagaaagucuaggaaaggaccauuuaacagccugaccuuagcagagcccuggagguccugcucucauuuaggcgucauacuaggauccagcaagggaauuuucuaugagaguuggcugcugccaucaggacagaagucuauuaaauaaauagaagcugggagcacccagugacuucagugguuguacugacuagaaccacaaaacugguaaaaaauggcugaaaguugguugguaauaacuccagugauauauuccuucuuuaaucaugcauuaaccaggaacuuguucauuuauucaauaaauauuuacagaccagccccaugggcuuggcuauaugcuaggcauaacugacuugacagucaaagaacugggccucuguccucacugguucauuugcuauuuagugaggaagacagacaaaccccaaaucacaguaaagcagaggagauuauggcaggagccuacugcaaggaaggcuucacccaguccagagguuucagcugauuccucagaagaugggggguggggugggauagguagaggaaaguguuccuggcagaaggagcaggguguuuaaaggccaggaggaggcggcgaggggcauucacagaccuaagagaaguucaauaugguaugggucgagguagagugugacagagaagagcaagaaaucgugacagagggauagcagguagggacagaacggagaugacuuaucaacaauaaggaguaaugauuuuauuggggggugcgagguggcaaauuuuucuuuagauuucauucuucaacuuacuuugagauguuuguuguuuauuucugcuagaauucucauacuugaaaaaucauccuugcauuuuaugucuauaucccagcucggccacuuagcaguguaacaugcaaaucacuuaaacucucuguaucaguuuacucaccuguaaaggugccuagaacagucuguggcacacaguaugacucaaucaugccauuaaucaucuaccuggacucacagaauuauaaaccuuccaaguuuacuagcaagcaauucucuaagacaacuagguauuuuucuuuaaagaaugguaagcacuaguagagcaauugagacuuuuccuuucuucuuuuuaauacuguagauugaguaucccuuauuugaaacgcuuaagaccagaaguguuucagauuucaaauuuuuucagauuuuggaauaagugcauuauacuuacugguugaguaucauuaaucugaaaaucugaacucugaaaugcucucaugagcauucccuuugagagucacguuggugcucaaaaacuuucaguuuuggagcauuuugaauuuugauuuuucucaauuagggaugcucaaccuguauuauaaaagaaauuggauggauggccauucuuguuguagcuauuaagaaacacaacacacuauuccauaaaaaaaacaaaaaauaaauuauaaaacaaaccauuauuaauaguuuaugauauuuuugagauuuuuaggaaguuuaucauuuagacucuucauuucacuuuucacaccaguuuuguaucucacacuauaauucaagagugacuauaucuuccuguaagaucagacugcuugugauucugggcccauggaacaaaacuguaccuuuacaaguugcuccuguugacguuccaacucccggauuucuugguugaggaugacugcaacaugcugagguuggcuccgacauuuacuacagaugccaugcugaguuaggucaucacacacaggacaguguaagguaguaaaauauugugaaauagugccuuuccgcccuucagguucacuucgcgaggagcugguagcuuuauggaucuauaaaaacauccauucagaaguaagccugagucagcuucacagcaaagcugcuauuuucaugcuaauuacagguuuacucaggcauucauucauucguucauucacucauucaacaaauguugaguagcuacuaugugccaggcacuguuccagacacuggagcuacagaaaugaaugaaguccuugccuucauggaacuuacaucuuaauauuaucagauacauuuuuuuuuuauuauuauaauuuaaguucuaggguaugugcagguuuguuacauauguauacaugugccauguugguuugcugcacccaucaacucaucauuuacauuagguauuucuccuaaugcuaucccucccccagcuccccaccccccgacaggcccuggugugugauguuccccgcccuguguccaaguguucuuguuguucaauucccaccuaugagugagaacaggcgguguuugguuuucuguccuugugauaguuugcugagaaugaugguuuccagcuucauccaugucccugcaaaggacaugaacucauccuuuuuuauggcugcauaguauuccaugguguauaugugccacauuuucuuaauccagucuaucauugauggacauuuggguugguuccaagucuuugcuauugugaauagugccgcaauaaaucccuuuguaaaaaaguuauuagguuagccucuuacaaaugucauuggguuaacauucuugccgaugaugaaaugaacauuaguaauaaagaaucugaguuuccugccuuagagccaggauaugugcucagaacacuuaguaacauauaggugggcaagaucaucuaacacaaagccuauuuuauaauaaaguguugaauaucucauggaauuuauugaauacuguaccaaaaaugaaaaacagaaugguuguauggguacuugaacuacgguuucuacagaaggcauaucauuuucgcaccaucguuaaguagaaaaaucuuaaguugaaccaucauaaguuggggaacaacuauaaugcuauuuuaccauugcaguaauucuuuacucugguuucuucagggcugugucuagugugucuagauacuaaauccuacaccuuucuuagacauucauuucgaaggaauuuuugcuguacauuuauuuucuauuaacuggcuuauucuacguuauuugcggcuaccauugaaauuguugugggauuuauuuuaauauuucuauaauuuggccaacuugauagaagcuaggaauguguuuguagaauacuuaaaacguuuaucuuuuaggaaaccaggagagcauggcaucuuugccaguuuaggacagaggaucugcuuugcucucacagugaaacaggaaagguucccuuguuccccuugcagggugugcgagagggacaauggcucgcuucuucagugccccgcugcucaaaccucuaggggagcacacagacgggcagguuguggagcucuggccccauggcagugucuaggggugaauguuuacagcugaagccccaguggguguguguuacaggguauucuuuuaguuugcugucuauaggcggcuuguguuaaccagcucaauuagacccucuagcuugucucaaggauggagggcuuucuguauuccggguucuugccuugguguaccagaagaauccgaucacccgugggcuaggagaaugagugcaacguuuuauugaguggaaguagcucucaucugaugguggaaucagcagggagaugguuuuccccuggaguugggcuucuagguggccccgucucuucucugacugcccuggccaaacuccaccuuguccugccggucaauggccugccagcaugccagugccucucggugugcuguucugcuggcgugcuccucuugacgaccagcugcuugggucuuccaccgaaguguuccucacaauguccagccgcucgugugucugcccacuagggucucggguuuuuauaggcccaggauuggggcauggcaggccaagguggucuuggaaaaugguaacauuugggcaugaaagcaggagugccuauccucaccuagaucuguggggguggagcccuagccagggacccaccuuucucuacccagcacuuccccucccgcuuuccguaucauuuuacgggaccacacucuucccuucccagcacucccauaucaauagcacauaaaaccuuuaguucuacugaaaauuuggagugaaaucucuccauaguuagagcacauguacuauuugguaagcuuacccuugguaauucaugauaccagcugaagacaucaauaccaauaagugagaagauucuugccaaggguggaaggauuugcuugguaauauaguaaguagcauucagucucagaguuggguccugcaggacuuccacugggcgccuuacaagcuggauaagugguacuccgggggucccauaaaugaugacguauggcacucgcuccccaaccugaggcucagagcgccggucauaagucagcauuuuccuauucgaauucaaagaaaaaaaccacacccaaauacuguuauggaagccaucuuucucacaaauuaagucagaauuaaacaauaauaaaacaaugaaaaaacuacaaaagacaauuucaaaacagaauuacuauuucuuugagaauaauauauauacauuuugcuuaguugacaccaaguguagauauccuacaagaguuuaaaaauuacucuguaaaucacuguuaccuggaaaauaaugaguuggcagauaucaacuagcuuaagauguauuuuaggugggagugguggcucaugccuguaauuccagcacuuugggaggccaaggaucaccugagcccaggaguuugagaccagcuugggcaacauagcgagacccccaucuccacaaaaaaauuagccaccauaauggugcacaccuguuaucccagcuacuugggaggcugaugugggagguucgcuugagccugggaggucaaggcugcagugagcugugauugcaccacugcuuuccagucugggcgacagagugagacccugccuccaggggcaggaaaaagauguauuuuauccccuaagaaugagaacuaacuaucauuaaaucuaucaugaaagauaagagaaaauuuaccugguuaaacuaucugauuccagaaugauaccaucuaaaugcuuugguagaacaauauuaaggacuaccuagugauuuugaugugggaaaaacaaaugaaucaaggacugugucacaauuucuuugcauaaguuucugaaggaaagcccaaaagaggauuuccucuucacaucuuacgaaguaugagggaauauucacuaacuuucagugaggcuucaugugcgcagguaaagaaacaauuuugugucugugucuauggacugucuuuucauuugggucuucuagaccugugcagaaucucaggacuauccuggcaagguacugaggguaucauuaccuuguaaguucaagggcuggcacacaagcuccugguuuauaagaaaaacuuccucuguauuccuuggcaaagauaaagucuuguaugcuggccuuuccuuccagaagcuucauacauugucgcugaacauacuguuuaauuagacuuauaucucucguuucaaauagcagcuuuagagaacgcucaaguaucuuaaaacaaaaaagauaugcaaguaaagauaaaauaucuccuaguauguuucaccauuguuauuacacuuucaauuauguaacuacuggguaaccugcuaaccuaccuaaauaaucuguuacuuacaaugaugggauaauaaaauuauuaaaaauugaaaguuauuugagacuuuagagagcuugcuauuucuaaaaauagaauaucauguaguuuaaggaaaaccauguggaaugacaugcaaauuaacauuugucaugugauaagcaacauaaaacacguuaaguuuuuuuuuuuuaauagucaaagccucuagguacaagaaaccagacacgauuucauguauuguuuuuuuauuuaccaguauagaaaggguccugauucagucacaggaaacacagagaaguuuaaagaucaccaggcagucaaaucaaaaucagccuuuuugacuuuuuauaaaaauguugauaaauaacuaugacagaauuuucuguguuggaaauuucuacuaggaaauaaccagcaugcaguggauuuauguaagauuaauuuuuuuuuuuuuuuugagacggagucuugcucugucgcucaggcuggagugcaauggcgugaucucggcucacugcaaccucugccucccggguucaagcgacucuccugccucagccucccgaguagcugggacuacaggcgugugccaccacgcccggcuaauuuuuuguuuuaguagagaugggguuucaccguguuagccaggauggucucgaucuccugaccucaugauccgcccgccucggccucccaaagugcugggauuauaggcgugagccaccgugcccggccaaguagauuaaguuaguucuaggugaaagcucugugucuuauucugaauacuggaaccaauggauauuuauacaauaagcuuauuaauuuagcuugaguacaauucugccuacagagaaagaagguacuggauuauaucucuuccagaaauagugcugaaaaaaaucccaaauucacauaauauuauauauaugacauaauauauugauaauauucaauccacuaugcuuuuaaugcucucaucaaacaguauauagaaugcuauucccauuuauaccauuuauuuuuguuuugcuauagaaggagucuaggcccgaauaaagaaaaagccaaaaaauaucaggguuauuaugguugagaaauuugaguaauuuauagcuaauuguuuggaaaucuuccuaauuuguauuugauaauccaaauaaaugaaaguucaguuaaucuggaauggauuauguuucucucuuuuuauuuugauggagucucacucucuugcccaggcugagugcaguguugugaucuuggcugucugcagccuccuccucccggguucaagugauucucacaccucagucucccgaguagcugggauuacaggcaugcgccaccacacccagauaauuuuuguauuucuaguagagaugggguuucacuacguuggccaggcuggucucgaacuccugaucucaagugaucugccugccuuggccucccaaagugcugggauuacaggcgugagccaccacaccgggucuguuugucuuguuuauccugcucugcuuucaggaguuguuacacuaugacauauaugaucuccaggcaauaggcaggaaacucucauguauugcuuuuuaguaauuuuugauaaaacguaagguaugggaggaagucagaaacuuaaggacuaaaaucaaauaaauuguuuuuauuagaaauaaaauucuagcuacucaggaggcugaggcagaaagauugcuugagcucaggaggucaaggcugcagugagccaggauuggacuacugcacuccagccugggugacaaagugagacccugucucaaacaaacaaaaacaaaauaagacacuacaaauaaaauucucaaaauucauguaguuacuccuauaguuauauuaauuauauaggcuauaguuccuucaccuagaugcauguuuaaggguaguuacauuuucaccagacacuuuagccacuuauuucuuacagaugaagacaagauagauaaaccuuaccuuagaaacagcagggcaggaaucucuucugacuguuucuauuccuuuugcaucaaauacuggguccuucugauccaguguuucauacauguaacccacauaccucuuuuuuguuuguaaaacacagggcaaauauaccugugguaaaauuaauaaaaugccucuuaaaaaccauuuccccccaccaagaauguuuuauuuuuaugucuuugugcuuucuuuaaucaaguaucaauuauuuaaaaaauucuauauaugacuuugggcccaacaaauucaugauauaacacgugggagcaaaaugaauugucuuuaaguuguuaccacuugcucacuccuuuucuugcgcuaccaguuuuguuuauuuacugaauaaaguauaaacacuuuagcuuggcauucaagacagucuacagucuggucucaacuuuauuuuuccggaucuaucuccugcuuccccguauuuccauacuguccuuuuccaauuccauacaugccauuuucuucugugcagaaugauugcagccccaugucugccuacugaaauucuaacaauuuuucaagacauaguucauuguuacuuccuauauggagucucccuauccagcccaggaggacgcaauuccuccuuuccuuugugcucucacaguguuuaagcgggcuauucucaucuugcuuuccguuauguuuacaacaagagacugcuuauauacauuccuaaccuuuccuuuuagauuacuggcucuuagagggcaggacugugucuuaugcuucuucguauuccacacaguuccuaggcuaaguaucuuuuauacagaaagaaagaaauacauauuugauaucuaaagguaagugaaaaagaguucaaaguccuugugguagacuuuguuuugcaaagaaagaauauaucuuccauccuacauggucuucuuacaaugugacuuugacauucuuccuauuaauaguggggucuaaguucacucccuuuaaaucuagagaggcgugggacacuguguuacuuugagccugggucauacaaaacaaagcagcuuuuguguuucuuugggauguucacaccuagaacccaacccucauguugugagggagaacaagcagccccggugaaaggccacugguagguguucuggcugauguuccaacuaguagccagcaucaaccaccagacaugaugguaagcaagcuucagaugguuucaacccuuagcugcugguuggguuaccccuaaccccuaacagucuucucagcugaggaacuagacaucgugcagcagagaaaagccauuccaguugcacccugucugcauuccugagccagaaaaucugugagcagaaugaaaugcuggcuguuuuacaccauuaaguuuggggugaucuguuacacaauaauaguuacuggaacaaaguuuucauuuccuuacauauauacauuacuaaacaaauuuugagaaaauuauacaaaagagaaaauauuuaaauacuuuuuuuuuuuuuuuuuuuagagacagggucuuacuuuguuccccaggcuggagugcaccggucaaucacaguucacuguaaccuugaauaccugggcucaagugguccuccuacuucagccucuggaacagcugggacuacaggcgugugccacuaugccugguuaacuuuuuaauuuuuguagagauggggucuggcuauguuguccaggcugaucucaaacuccuggucucaagcaacccuccugcuuuggccucccgaagugccaggauuacagacaugagccagugacccaaauuuaacacuuuaauagacccguauacuguuagugauucugaaaauguacugaacaaaucagaggucucuagaagguauaugaauuuuauauguaauuacuaauauuacauuccucuuaccuuuucaaacuucaauuucacugguuuaggauugguagcaguuacagcuucggcaauuuccugaccaaucuuaaaagacugcuccuuaguggcuccuuucaguagcacaaacauacuaaggggauuaaaaauaaaguaagguaaugaggaagucauuauaacaaaaauuuuaucaagaguaacuuuccuggcuaugacucuugucuaaugccaaagaaaacucccuuucuccuauuuacucuuuaagaugcuuucuauguaagcucuccuguuuuauuacuuuccuuauguacuuauaucuuguuacaaaucuuuuaagacauccaauauuucuaacacacagaucagcucagauaucccaguagucaagaaaguccuggaucaucccuggacauuuaaggcuuuguaugguacacaaggggucacuaaccccaaggcuacagacugauaccagucagucugugaucaguggcagaucagucagaucaguggcagcauuagauucucauaggagcaugaacccuauugugaacugcgcacaagugaaggaucuagguugugugcaccuuaugagaaucuaaugcuugaugaucugagguggaauaguuucaucuccaaaccaccuggucugcggaaaaauugucuuccaugaaaccgaucccuggugcuaaaaagguuggggacugcugugguccaggcacaguggcucacgccuauaaucccagcauuuugggaggccaaggcgguggaucaucugaggucaggaguuugagaccagucugaccaacauggugaaaccccaucccuacuaaaauauaaaaauuagccaggccugguggcaugugccuauaaucccagcaacuugggaggcugaggcaggagaaucgcuugagccugggaggcagagguugcagugaacugagauuauacuacugcacugcagcuuaggacuccaucuaaaaaaaaaaaaaaaagguuggggaccacugugguacacaguuaaguacaucacaaaauaagagacuauaugauuauaagaaaauggaagauguacuugugauaugggagaaguucccuuaaggcuagaaucacucaacuuaaaaaagaaagacauuggcugggugcgguggcucacaccuguaaucccagcacuuugggaggcugaggcggguguaucaccugaggucaggauuuugagaccagccuggccaacauggcaaaaucccgucucuacuaaaaaaauacaaaaauuagccaggggagguggcgugugccuguagucccaguuacuugggaggcugaggugggagaaucgcuugaacccaggaggcagagguuacagugagcugagauugcgccauugcacuccagucugggugacagagcaagacuccgucucaaaaaaaaaaaagaaaaaaaaaagacagacauauauucuguaauguauguuaacugaaaaauaguuagaaaacauaaaaagacacacggaagaaaaucaacaucuguaaucauaucauauacaaaaaagacauuacaaacacuuuguguauaucuguaaaucuuuucauaugcuauaauggaucauguuacuugguaaugaauaauauugaauuacaugaauaaaaaacaccaauauaaaauauacucaaaauaccaauacaaaauauacucaaaaauaacugauaaaaugcauugggcaucuuuuuuucuauuucaguauauucuacaaccugaccaccaacagaaguaaugguuaauaaauauuuaaguaagauagauuauaaaguucaucuucacuuauauuucuagugaaaagacauuaaauaguggaaauggaugauaucuugaaacaugacuuuaagauucuuuuuucuagccauauaaaccaaucucauauuucugaaguguuuuuauacuggauuuuuaaaucccauuuuggaugguuucuuuggaaaaagucccugcuaauaauggagacaguacuugccugacagccuaauaugaaaaauuaaaagaaaggaaaaaaguaguuuauucaacucuacuaaaagucuuuaaaauaaauauugucucaaucugaauuaauuuuaacauucacuaagguagaauaaaaaugccuuaguuaauuagaccuucaaucuaggcuauacuucgaaccaucugaagguuuuuuuuaguuucuuuauaggccaucugaugcucauuuauaccaauacuaccuuacuuuauuuuauuuaagaggcagggucucacucuguuaccgaggcuggagugcaguggcauaaucauggcucacugcgccucaaccuccuuguacuccuucacaauaauuuuucagucuauuccuggccccagguucaauacauaagacuugcuuucuguuauauagguuuuuuccaagaauuuuauauaaaugagcuggguacaguagcuuuugccuguaaucccagcaacucuggaggcugaaguggaggacugcuugaggccaggaguuugagauggccugggcaauauaguuagacccugucucuaaguaaauaaauaaaaauuuuauauaaaugaaacuauauaguauguacucuuuuauaucugucuucuuucacucagcauauuuugagauucauccauggugucagaauaacagcaacugguugguuuccauuguugagcaguauuccacuguauggauauaccacaauuugcuuguccaaucacucacugauagacguuuagauauuuugcaguuuuggacuauuacgaacaaagcuccaaugaagaaucauacacaaguuuuuguguggacauagguuuuccuuuuucuuuuuucuuuuuuuuuuuugagacggagucuugcucugucacccaggcuggggugcaguggcgcgaucucggcucacugcaagcuccaacuccugaguucacgccauucuccugccucagccuccugaguagcugggacuacaggggccuaccaccacgcccggcuaauuuuuuguauuuuuaguagagacgggguuucaccguguuagccaggauggucuccaucugcccgccuguauuuuuaguagagacgggguuucaccguguuagccaggauggucuccaucugcccgccugaaccucccaaagugcuaggauuacaggugugaccgugcccggccagguuuucuuuuuucuaagauaagcauaaaggaguggaaucacugggucauaugcuaaguguauguugaacuucaugugcaacugccaacuuuuuaugaaagauuauucuuaaaauguucagaugcaaugaugaaugcaacauuuuuuuuguuuguuuuuugagauggaguuuugcucuuguugcccaggcuggagugcaauggcgugaucucagcucaccgcaaccucugccucccaagucaagcgauucuccugccucagcuucccgaguagcugggauuacaggcaugcacgaccacgcccggcuaauuuuguauuuuuaguagagacgggguuucuccauguuggucaggcuggucucgaacucccgaccucaggugaucugcccaaagugcugggauuacaggcaugagccaccgcgcccggccguaugcaacauuuaaaauaagugcacauacacauauuucuguacgguuuuauaauaggcaaaacuaagcuacaguaauaaaaaucagauaagugguugucuagggcauggagugagggcgagggauucacuguaaagggagaauaagauaacuuuuuagggugauaaaaaguguucuauaucuugacgggcaugauagcugguaacuugggccuauauauuuuaauauuuuauuacauacuauacauguuguuaaaaauuauaauuccauaaaaaugauaaagaaauaaagguacauauacuuuacaucuuaaaaguuauuauuggcugggugcgguggcucaugccuguaaucccagcacuuugggaggccaagguggguggaucacgaggucaggaguucaagaccagccuggccaacauagugaaaccccaucucuacuaaaaauacaaaaauuagcugggcaugguggcgcaugccuguagucccagcuacucaggaggcugaggcaggagaauggcgugaaccugggaggcagagcaugcagugagcugagauugcgccacugcacuggacuccagccugggcggcagagcgagauucugucucaggaaaaaaaaaaaaaaguuucugcuagguugccacggcugggaaagguacuguguauguguggggaaguggagaugguuaauggguacaaaaauguaguuagaauaagaccuaguauuugauagcacagcagagagauuacagucaacgauaacuuauuguacauuuaaaaauaacuaaacguuuaauuggaaugucaucauaauuggaaggucauuuaccuucgucuaucagauuuccuucauuuugaugaugaggcaacuaagccucagagaggcaaaaugacuuauuaaugguuaugccaucaucuaggaguauagcuagaaagagaauccaggucuccucacucucaguugggaacuccuuuuuuuuuuuuucucugagauggaguuuugcucuuguugcccaggcuggagugcaguggcgcgauuuuggcucacugcaaccuccaauuccugcguucaagugauucuccugccucagccuccugaguagcugggauuauaggcaugcaccaccacacccagcuaauuuuuuuaauuuuuagugauccaccugccucggccucccaaagugcagggauuacaggugugagccacugcaccuggccuuuuuuuuuugagauggaguuucgcucuuguugcccaggcuggagugcaauggcgcaaucuuggcucacugcaaccucugccucccggguucuagcuauucuccugccucagccucccaaguaacugggauuacaggcaugcgccaucacgcccagcuaauuuuguauuuuuaguagagauggcguucuccauauggucaggcuggucucgaacuccugaccucaggugaucugccugccuuggccucccaaagugcugggauuacaggcaugagccacugcgcccagccaggaacucuuuuucacuccaccaggcauuaccuauuaucccaagagcaguguuucucaaccuuuuaucauuauuguccuuccaaggaaaaaaaaacacaaauuuaaauuauauuuaacaaggcaaaguaauuacuaagaaguaaaauauuguuggguaggucugggcacuguggggccaaaaacuaugguacugacuuuuuuguguccuccuucaagaacuuacuuguauucugccagggugacacuguugugaauugcucucauacagaugucacuaaacguuuggguuucuuguuuuugagacagggucucauucugucauccaggcuggagugcaguggcaugaucaugguugacuacagccuugaacuccuggguucaagcgaucuucccaccucacagccucccaagcagcuaggaguacaggugcacaccaccauguccggcuaauuuuuaaauuuuuuguagagacaggguugcacuuuguugcccaagcuggucuuaaaacuucugggcucaagcaauccaccugccuuggccucccaaagugcuaggauuucaaguaugaggcagcacgccuggccaauguuuguugaauguaucagguagugaauggugaucaaaaguuuuaaugacauugcaaguaaauuuccuuugacuggaaucauauaauaacuauaaaaucugauguagagagaaagcaucagcuaggaaucaaaacacugaauaucaauuuauggcucuuuacugacuaguugcaagaucuuaaauuucuuauccuagggaaauuuguucuuaauaagcaucacuugaggcacauucuaagcucuccccaaguaugaaaacugcuggccuaaauaauaucaaaaucccuuccggcucugacauucugugagucuauuauuuuuuguagcuugacuucuuacagaucuuaaaggguaaauaauauaacuacaaucagaaucaugcugacuucuggguguugucaacaacauggauagccccugaauuaaaaucaguaaguuaaaggauuaacauuuuucccuaaauauuuuuuaaggaguucugcuaacaaguggagaacuuauuuuaguaacucuuauuuugcuggaauacccagcagaaguaguuucauagaacaauaaaauaaccaaagccaaacuaagaaguggcuuuugaugagcaacaggagagaauauggauaauuagggccuggauaauuugaaacuauccccaccggcugguaaugaaacagcugcucuauaaggcaaggucucauucagcauuaauaugauuaugcugucuguaugaacauuuuaaagaacuggauaagauuaaaugcuguucaaagauuacuuauaagcuauuuaaugaucagaagcauuaucuccuauugcucuguuggacuguaaagagaucagaggucuugaagcaagugcucuuagcaugaucacacugugacucuacguccccaauauggaaaaaauuucacuguaagaaauuugaauagugccuacauucuagaagaauuucaauaagccaugcaaaaaagauguuacauaaauaacugaaaccugaaaaauaucacagcaagcaggaagcaugcaagcugguguuaauaacuuacauuauuaauaacgugccuucaaaugcaggcacauuauuugccaauccauaaauaauaggcuugaggaagucuguggacccucuggaaucaaauggaaaacuguauuugccuauaugcacuucucuuagaaggucaacauauucuggggccgagugguaaguuaaccauucacaguucuggcaauuguccuucaaaaacaguuuauuuuaagauauacacuuaaauucagagaguuacagcuauauuagaggaauuauucacauuaaaaguaguuucuuuaaauaaacuagacuccuguguacacaguuaguuuacagaucacuaucuacuuggcuuagagcuaccuggagggaagccauagguaucuucaguuuguggcucaggacacaaacugucucuuacgauccuaucugguaaaucaggaucuguguuaacucugaucaugagaucguaaggacuggaaaggacucagacagaacucuguuuuuagaaaagauucccuuaagccauuuuaaacacugaaaugaagaucuagagagaugcaaaagacaacuacaaaaccaaaaacccauuaccugucaguaucgccauauacaacccuagccccccauuucuugguaucauucaccaguuuaauagcucguuccaaggucucucuggcuuugugaacaauacuaucgccaaccuguugguacaaacacauuggaaauaauuucuuaacauagcucaguauaaguuaacagacuuuaacauauaauacauuuaauuacuaaauauuuccagaaaugaaacgagaaaagaacguaaaaaagaaaucaaaauagccaucaguaucaucauucuuucuacaaguacucaagaagaaacugaggugaagaauuugaaagaaccaaucaauauacaaacuugucuuugaguauaacaguaaguggacugcacuuguuacaagguacucagcuacguuggauucuuggaagaauaauccuucuuuauucaagaacuuuuuuuuuuuuuuugaggagucucacucugucacccaggcuagagugcaguggcacaaucuuggcucacugcaaccucugccuccuggguucaagcgauucuccugccucagccuccugaguagcugggacuauaggcgcacgccaccacacccagagaauuuuuguauuuuuuaguagagaugggguuucaccauauuggccaggcuagucuugaacuccugauuucgugauccacccaccucggccucccaaaguacugggauuauaggcgugagccaccgugcccgaccuauucaacuuucuuaugugcccuuacaacucaucaggcagaaaagcacucuuugugggugcaugaguauauguacguguaucucucaaaauuuuucuguugaaguguugaugauaaugucuuucaauaucauuaaaguuaaugcugaacuucaaucuugucacuaguuauacaaagaaaaauguaucuaauuauaugaugggaaauauauuaaaacuguucaauuuaaauuaaauagguagauauauaucuaggaagguuuuacucauuggugauuagugaauuuuaacagugaccacagcaugaguuuacaaaacaaaaagaugcugggccuugacaaauaugagaagcaugcuaaugagauuuuacaguuaaguaaauuaaggagacuauauaacaaugcuguuuuauuuauuaaacucauuaaagcuaagagugggaaaaauugccauucaacauaaaacauaaauggagcauuccuuuugcaauuuuaaaacgcaaacugcacauuuuuuuuuguuaagaagcaaacaauagcaauaaucauccuucucccuuuacuguaaaauuugaauuacuaaauauaggauugaauaguauuuaaaaggcuauuuaaaauugcauuacaaaggacauauuaaguacaugaacaaaggaauaaauaauaaaacuaguaguagaaacgaguugggauuuauuuauuuauuuauucugauuuauuuacuuauuuugagacagagucucguucugucacccaggcuggagugcaguggugugagcuuggcucacugcaaccucugccuccuggguucaagcaauucucgugcuucagucucccgaauagcugggauuacaggagugugccaccaugcccagcuauuuuucguauuuuuaguagacaggguuuugccaugauggccaggcuggucuggaacuccuggccucaaaugauccacccgccucagccucccaaaguguuguaauuacagguguaagccaccaugccuggccuuagguuuuaaauuaagauuaugaauucugcugagaccucuaguacaucagaaaaucuugagaauguaaacuguaacuuaauacauuacaaaaaucauguuaucuaauggaaacucaaauugaauaaaauguucuguuaccuacugccacuuucaaacaaggucaacuuuuaaauaugugaggaaaaagagcugcauaagcaagccauuuuagugucaaagucaaauauacuucugagauguauacuuacaaguauauacucgaacauauacauaguggucuuaaaugucugccuaaugcucuuacucuggcgcauuuaaguuauaccccaaagagucagaacucugcaguuaccccugaagaccacauaauaagaagaauucagcagcacuagagugagggggaggcggaagagggaaggagaaguaauuaaauuaacagauucugcuacuuugugccaagguuccuaaccugaaaagcauuacuucauuaaagggcuaagagaggauuuaaaagaggaaaagaaaugguuucacaauuuaggccaugauuggggaugcucaaaagucuuuuuuuuuuuuugagauggagucucacucugucgcccaggcuggaguacaguggcgcaaucucggcucacugcaaccucuaccucccggguucacgccauucuccugccucagccucccaaguagcugggacuacaggcacccgccacuacgcccggcuaauuuuuuguauuuuuaguaaagacgggguuucaccgcauuagccaggauggucuuggucuccugaccucgugauccacccgccuuggccucccaaagugcugggauuacaggcgugagccacugcaccuggccucaaaagucuuaauaaaaacaaauguuuuaaguaaaaauuaauucccugaaaagacauaaaaaggaagaaauaaaguucagacaauuuuuuaaaaggcacaaauauaccuuuaucauaaauaugaaugaccaauaauuuaguagaaaacugucaacauauaaaaauuuuaauuuaugaaguaaguccaacugagacagagacauuaaccuccacuauuagcuacuuuauucuccauauucucuucauaggaauuuuugcuuaccaagucuugucuuucucuaugaugguacugagacagagacauuaaccuacaacuauuagcuacauuuauuuauucuccauauucuccuuauaugcuuacaaagucucaucuuucucuaugauaguccagaucuaguacuuuuuugauuguguguucucugaaggaaagcaggagaccacagucaguaauccauuugccucccgcuuuuaaaagcuuuuaauuauucuggauacauaacuguuguauauauacguauaugcgguacauaugauguacacaggcagacaauguguaaugaucaaaucaggguaacugggauauccaucaccucaagcauuuaucauuuauuuguguuagacauuucaauuccauucuuuuaguuauuuaaaaauauacaauaaguugcuguucacuauaguuacugugcuacuaaauacuauauuuuauucauucuaauuguauuuuuguacucauuaaucauuucuacuuuaucucccucccuccccaccucauugccucuggcaaccaucauucuacucucuaucuccaugaguuccuuuauuuuuuuuaguuuccauaagagugagaaugugugauauuugucuuucucugucuggcuuauuucacuuagcauaauguccuucaguuccauccauguuuugcaaaugacgggauuuuauucuuuuuuagggcugauuacuggacaaaugggaucacauaaagcuaaaaagcuucugcacaguaaaggaaauaaucaacaaagugaagagacaacccauagaaugggagaaauuauuugcaaacuacccaucuaacaugggauuaauaaccagaauauguaaggaacucaaacaacucaguaggaaaaaaacaaauaauucgauuaaaaaugcacaaaaggucugaauagacauuucucaaaagaugacauacaaaugacuaacauuacuaauuagagaaaugcaaaucaaaauuauaaugagauaucuucucaccccagcuaaaauggcuuuuauccaaaaaacaggcaauaaugaaugcuggcaaggauguggagaaaggggaacccacuguagugggaauguaaauuaguagagccacuauguagaacaauauaggaugcugcaaaaaucuaaaaauagaacugccauaugauccagauaucccacugcuggguauauaccccccccaaaaaaaaaaauggaaaucgguacauugaauugauaucugcacucccauauuuauuguagcacuauucacaauagccaagauauggaaacaaccuaaguguccaucaacgagugaauggauaaaggaaaugccauauuauguguacaauggaauaucauacagccauaaaaaagaaugaagccaucugcccuuuaaaaaaaaaaaaaguggcugauaucuuccauuuuuacucuauuggugcuaacuuuucacuuauucaugagaggcucuuucugugauguuagcugcuuuuuccacucaugauuucaccuagaaguuaacauuguacuguugcgaaguuagcauaugaugaggggucaaaugcaugcuugcagucauuaaucugaggauagcugagaagaccagggucaaggaagcagguacugcuuggcagucugaguucaccgugcaaagcagcaacguacucccuggugaaacccuauuccuaaacuuccacugcuaguucaaaaauccuaccaaauucugguuauucuaaaguuacaguauuuacauauuuuaaaaauaguauaauuucugcauuauuacuaaaauacauuaauaaacacuuuuaaaaccgagaggcagggaagaaauuagggaaauguggaaauggccccuaagaaaggauuugggacaagcauggucgcucacaccuguaaucccugccaaggcaggagaaucacuugagcccaggaauucaagaccagccugggcagcagggcgaaaccccaucucuacaaaaaauagaaaacuuaacugggcauagagguaagcaccuguagucccagcuacuuggaggcagaggugggaggauugcuugagccugggaggucgaggcugcagugagccgugguuaagccacugcacucuagccugggugauaaagcaagacgcuguuucaaaaaaaaaaaaaaaaggauagcuuuugguuuuacauuaguaauaucauuuccauuuuuuuuuuccugcuagaucauauagaucagugguuuucaaauguauuaauaugaacccccaggacugacaaaguauuuuuuaucuuaccuaaaaguauacaaauauaaaccuagauacaaacuuuuauugcuuacagccuuuacagugcaacuauaaaaaaauuuauccagcacaaaaucauauuacuguaccaaaauauucaaguuaacaauauuaaguuuccacuauagaugguauuuugcugcuuucaaugugaauaugccacuacugccuugcucauguuuuuggaguucauuuugccuacugugagcugugugaagacuuuaugcuuucccugcuuuucucuuacugaacuaaugcaaauaugauauaccacaauguucucugaccuucauuuggcaugaaaagaucacaauauaacaaguuacucuguucuuuucucacucacuaguauauuauuuauauuacccugucacacuauauuguauuuguaucaaauaaacaccuuaacuuaguaaauaugaaauuaagucauucuaugaaaaaugucuuucaacugucacuaucauugcaaaaaagguugugcuuuauaucuacugguauacuaguaaauauggaaugacuguuguuuauucugacuuaaaaaauuuuuuuaguuuuuaauuuuguguauuaauagaggcaagggcucacuauguugcuuaggcuagucuugaacucuugggcucaagcaauccucccaccucagccuccugaguugggaucacaagugugagacaccacaccuggcuaauugugacauuuggacaagccaacauaacuauaaucagaucucuugucaauacauaaaaugaauuaugcaguaccaaggcuguuguaaaaacugcuacaaagguggcacugaaauuuuaugcuaauagaaaguuacaguauaguuaugaagaucaugcagaaauagguguaugcuaauuucuaaaauuaucauuggaauaaagacacagagguaucuuauagagaaaagucacagauccccaagaauauauauauauuuaggcuuggcaugagaaaaacugauguuaugucauagaaaugaaaugguuuaaaguuuuaaaacaaaaugaaaugcuugaaugaacaggcauucauuuaaugcugcuuuagucucuuuuuuuugagacagggucucguucuguuacccaggguggaaugcaguggugcaaucauggcucacugcaaccuugacuuccugggcucuagugauccucccaucucagcuucccaaguaacugggaccacaggcacauaacacuaugcccggcuaguuuuugcauuuuugguuagagaugggauuucaccauguugcccaggcuggucucaaacuccugagcucaaguaauccacaugccuuggccucccaaaguguugggguuacaggugugagccacuuuuuugagaccaagucucauucugucgcccaggcuggagugcaauggcgcgaucuuggcucacugcaaccucugccuccuggguucaagcaauuauccugccucggccucuugaguaacugggauuacaggugcccaccaccacaccuagcuuauuuuuguguuuuuaguagagaugggguuucacccuguugaccacgcuggucgcgacuccugaccucaugugauccgccugccuuggccucccaaaguguugggauuacaggcgugagccaccaugccuggccuuuuuuuuuuuuuuuucuuuuaaaaaagagaugaggucucacuauguuguccaggcaggauucaacucugggcugaagacccccgcaccacaucuuagcuuccaaaguaacugggaauacaggugagugccaccgugccucacuguauuuuagucucuuuugaaaaaacuacagauuuguaucacuuaccucaaugcauggcauucucccagaaaaauuagcagauguauagccaaaugugacauuugcuaucagcuuaagucccaacugacgcgcaucaagcauucgugacagggcucugucuugcuuguaagccuucauugacugcuucaccauaaaucuagucuucaaaauuucuucaagcauucuugguaguacaccuuuucuuacugaaggcuaucauaaagaaaaaaaauguuuaaaaccccucaaacauuauagauuuacauaauuaagaaggaagcauaaaacauaauaauggccaacugucaggaauugaaacaugcuaacaacagagugaccauaguauuaguggccgucaauauaaaaucaucacauuuuauuucuuggaagaggauuucuccuaaaugguuccugcaauguuuauaaaucuaacagagcacuucuaugugaguucagagaccuccagggaggaggaugucaacuagugcauaagugaccauacaacaacuucagagggaaauuuuguucgaaacuuugacagaaacccccauucuuucaaaaugacacaugggacuuguaucacucauaaccaacucaguuuuuaaagaucucauccuaaugaccccacacagaaaucugcauggaacuccauuuaucuaccuuggaagaaugaugagcuggguugacucugcugacauucaaaccugcaguuccagggacucuagguauuucaaaucugaugcuuagaccacuaagccauccccuccggccuacauuuauuagcaaucuggaagaggggaugaauagugaggugauaaaauuuguugaugccaaaaaaaaaaucauuuguauucaucaagacuagggagaauuuaugagaacuccaguaggaaugaaaaccacaaaacaguauuaacuuugaugaugauucacagacacgugcaagguaaugcaugucagaccuaacaauuaaaaucucagguauaggauauucacacaccugaauauuuaaaaaaucuuauuuucauuaagcuuuacacacuggguccaaaaguagaugcaaguuuaaaaaaaagcuguuaaagggagauaauaagcugcuagauaugcgacaauggaacauauucuaaccucuaauucauuugguguacauuuugaagcagccauaauguuuuaagacauaagauaaaaagaacagggaccaaauucgcagaaaugugacuggaaaacugauuuuuauauagagacccauuuaauaaaaaaaaaucuguuuccauuucuccaaguagaucucaucuacaucaguccuuagaaauacuacauuuuaaaauuuuccaaaaagaaacauaccaugaacucuuugguuaaaauuuucuucaucuacauggcuaauuuuaguuuaguauucccucuuacugguagagaaugaugccacuuuugauauaguacaccagaaugaauuugagggcuggugggguccacucuaccaucaaccacucuacugucucaugauucuaguacagacucacugcuaagaaaauagaaaagaaaggaauaaaguuggcauuuaagaggcaauauaaucuucuuuuaagaugucucuuauuugucuuuaauuuguaaaguuuuccucugucucuuuugaggggagauacaggagagaaaaaagggacccuauuuuuaguuuggauaucuucugaaaaauauaaacaauaagccuauuagaguaucauuaauucuaagauagucuuaauuuaaaauaauguagaagaacaacuaguagcaucuacacauuaaaacaauuuaaaucuuuguagguaauauauuuugaccauuaaguugccauuuaagucugccugauucuaauaaagggcagaaaguauaagcauacguuuauuucuuucaauauuucguuaacuaaaauuuaacaauuuaaagauuuaaaaccuaaauucaagaaaaacaaggugacugguuuguuccugaagugauuucuuagaagauucucauaucuuugacuuuuugagauaaaauauucaagcaaacucgguguuuuuguuuucuauuaugugccaacaauaucuaaaccauuaucagcucuccaaaaguuaagccauaguuguuaucuuucauuuacaagagaguauuaccuugacaaaagcuacuccauugggggacacugugauaucaugccuaacuugguaaaguaaaucuggagguacucucagagagguacagccaaauuugaacucaucauaccuguuaagaaagagaacauuaagcaaauacuuccucaaaucauagaacagagauuuuacgcaauuuaaaaaaucuuucuaacuccauuagaaauucauuuucaaacaucuaaacaagaauucauguacuuaguaauauguuuauuugccucauuaccaaaauaguuuuucaaauauucauaauuuauuacaagaaacauuucuuaaauggcacuauccuaaaauuuauggguaaaaucuauacugaaauaccaaauuucaacucaacaucugaucaucuuauuuauuuuauuauuauuauuuuuugagauggagucucgcucugucacccaggcuggagugcaguggcgcgaucucggcucacugcaagcuccgccucccggguucaugccauucuccugccucagccucccgaguagcugggacuacaggugccugccaccauacccggcuaauuuuuugcauuuuuaguagagacaggguuuccucauguuagccaggauggucucgaucuccuaaccucaugaucugcccgccuuggccucccaaagugcugggauuacaggugugagccaccacguccagcccaaucaucuuauacuaaauuacuuaaauaaaaauuuauuuuaacauccuugugaauauauuuaaagaauaauuuaaaccuuaaauagaaauacuguaaaucuuguaaauuuuccaaauuccuguuuuuaauaaaaagacaggauuaccaauauaauuuccacagaugcuuucuaugaaggaauauaggauauacuaaaaccaacacaugaucucaaauacgcaaaaaucaauaaaaaggaagacuccguuauuuccuacaauuuaagaaaaguaucuaauccuuugagaauuuaaaauguuauuaucaguuuauaaaauuuaauuuacauuaauuaauaaaaccuaacauuuaauuuuuaaaauccuggacuauuuauaagaaaaauaaagaggaggucuaguugaaguuauaagaucauaauccucaaacuguuccacugaaagguaauuuacaucaacaauuuaacuuucauuuuaaaagagacuauaguuacauauggagugaaacaguugcaaggcugaccuauucccaauccucuucaugagucauccauccaugaagcuggauuaaucauauggugauccaugucaauugguaagacaacuauaaugaauggauuagcugggauacaguccauuuaucuugcucauagggaagguguccagagcaaagagacacucagaaagugucuaauuuuaguaagaaguacaaagcacaacaauauuauuguaaaugugaaaaaaaccuuacuuucccaaguucuccacauggccaaggcagguggaaaagcaguaguuauaugcaaucacaauagaaggauaaagugauuggaaauccaaaacgagaacagaguugcuauagaagcgggauucaggcuccauaauuagaggaacacacuguggggcucucaucugggaucuuugcugaacacuaggugucacaggaauauaguucauugguuuagcaauacgcaacaucauugauuccacacgguacugcagggagaaagggaggugagaagagaagaaacacaguuaaauauauuggucauuugaauauauaaucauuugaggauaaucugcuuuucagaauaagauuguaugacuuuuuuuuuuuuuugagacaguguuucgcucuuguugcccaagcuggaguacgauggcacgauugcggcucacugcaaccuccgccucccagguucaagcgauucuccuaccucagccucccgaguagcugggauuacaggcaugcgccaccauguccagcuaauuuuuuguauuuuuaguagaaacaggguuucaccauguuagccaggcuggucucgaacuccugaccucaggugauccgcccaccucagccucccaaagugcugggauuauaggcgugagccacuaugaccagccuguaauacugguuauuuagucagcuuucagaugcgaaaagggauauauguaaauccuuuuccuauuccuacgacuuuuauaaaaacuauaaaacaugucaaauaacuuaaaagauaagucaauuuuaaaagacagaugcaauuagaucucuuuuuauuuuuauuauuuacuuauuuauuuugagaugaagucucgcucuguuguccaggcuagagugcaauggcaaaaucucggcucacugcaaccuccaccuccaggguucaagugauucuccugucucagccucccaaguagcugggauaacaggcuugugccaucaugcccagcuaauuuuuguauuuuuaguagagaugggguuucaucauguuggccaagguggucuugaacuccugaccucaagugauccccugccuuggccuccuaaacugcugggauuacaggugugagccacugcaccuggcccucuuuguauuuaaauacagcuacaccauaauaaaaaacuguaggacagacagcuguauaguuugacaauuucguuuaagaaguugguugauaauccuggagaaauuuauuugggaaaauuagagaauuaaaaagcugucaggagacuuaagauagaaaauguuaucccaguuuuucaaagaaagaaacaaaaugauuauagaauuauaaaguauugaauguggcuuuuguuguggaaauaauuaaaaaauaaaaaaaaagaacugaauaguaaucagcuuauuacuggucccuagcaaaacugaaucaagcaauuacugguauguuuguuucuaauaauaacuauuagaaggcuugggguauuagaaaaaaaauuacucacaagaaccagccuggguucacugaaguauucucaugagguuuuaagguauuuuugccuuuuauuacagacuagcucaaacaguuguuaaauuugauggguauaaauaaaauaaauagcuuauaagcaauuaaaugaaauaaacagguaaaacaaacguaguuggaacucuauuuuugcuauauuuacugaacugguugauuauguuauagacacagguaauuaaaauaaguaaggauuuuacaacguuaaggaaucugaguguuuuaauaugguaucgcugaugccuaccaccgugcuuaacaaacuacagguauucaaauacauauuuguugaauauauaaaaucauuuucagcaaggcguuuaguaaaaaucucucauuauauccuugggaaauuacuuagauaugaauuaaauggcuucuuagguuucuuuuuuuauaacauuuaaaaaaguuacauaguccacuuauauugauuuucaagcuuuuuauuuuuauauuaaaauuaucuaugggaaguuuuaacaagccaaaauuaaaaauguaaaacaaaagaaagguacuuucuuuguugcuucucuaguuuuaagggacaucuuuaaucacaguaacaauauucaggaauauuauauccuuaagggcauggacauuuauuuucuuaauaccauaaaaaacuuggcaguggccggaaaguuggcauagaaagagaauaaaaugacaagauuuaauuacccagcuauugauuaguugguaccaaacagaaaguuuaaaaagucaaaucacuucaaacaucacaaaaguguaucacucauacagaacuuucaagucugcaagaaaacugauuucccaccugugaaccccuugucaguacauguaaaaacugaaugccaaaaagucuagccaucucacugguuuucccaaucagguccagcuguucuaacauuuggagauuuccacggacacggcuaacauaaugaucaaccauuuuccaucuguuaaaaaagaauccacauuaugaacaucagggaaaaauuuggacacuugaaaacaguacuuuuuuuccugccaaaaaucuacaugcuaaaagugagguuacuuaaggaaagaguaaugauaugagccuuuaagcaaaguaugcuaaggaauuaaacauuagaaaauuuuagguauuucaagggcaugaaaaccaguaaagauacacaaaauuuaaaauaguacuugugauuaggugguaagauuaaggaucacucuuuuucaauauuuugcuugauguugcucuauucuuuuuuuuucuauucuuauuauagaaaauuaacauucuccuuuaagauacagcugcugauuaugcaauaauuauuuaucauaucuauagauuuuuaaagaacaugaagggucuggguuaucauuguaagucuaaaauaaaaacaugcacuauguucauggcaaaaaaaaaagaguaauuuggugaagauuuagaaaaaucaggaacauaaauuuuagugagauaauacauggguuaaacauauuucaauaaguauuuuuuguuaaaauauaaaaguucuguuuuucaguuuaaaccuuaaauuuaaccucuuuaccuuaccuucuuaagaaaacaaacaauaaaacccucagcaaauccauaaaaagaauuuuaauauuauaagauguaaaaaugacccagaaguauacuauaaggaauaaaauuuauucauuugaagauuaagguucacauauauuguaaucuuuaauuauauugcuuuuagaacaauauagucacauaauugucuaauaaauguguuuaaagaccuuuuccucagacacaugacuaaugcuuaauagaaaaacuagaaaaugcaugugaaggaagaaaaaaauacccuauuauaaaaaagauaauaacaguauauuaccaagaaaguagagacauuggaauccucauauacugcuggugggaacguaaaauagaguaguugcuugggaagauaauuuggcaguuccucaaacaguuaaacauagaguuaccauauaauccaccaaaaauucuacuccuagguacauauccaaaaggaaugaaagaggguaucuacacaaaaaacuauauaucaauguucauuacaguauuaaucauaguagcccaaaguggaaacaaccaaaaugucuaucaacugaugaagaaauaaaaugcaguauauauccauacgauacaguauuauucagcaauaaaagaaauacugaaagaugcuauaacauggacaauucuggacagcauuaugcuaaaagaagccagccacaaaagauuacauauugcacgauucuguucaugugaaauguugaggacagucaaauuuauuugggaaaauuagagaauuaaaaagcugucaggggacuuaagauauaaaucuauggggacagaaaauagaucagcgguugucuaaggcaagagguagaggguggggggacucugguggagggggugauaggagugaugaaagguugaagagugguggcuaggugaugcaggauuuccauuuagaguaauuaaaauaguauaaaacuuacugugaugauguuguacaacucugaauauacugaaagccagugaauuauauacuuuaaauggguaaauuguaugauauacaaauuauaucugaauaaagcuguuaaaacauuaggcaaacaugaaagaauccuaaacucuauaaauguuuaagaaacagaaauuuuguuucauaauuuacauuuuuaacuuaauauacugacuccccauauuuauguuuuguagcuaucgagcgugcuauuguauaaugauaacauauuuaaucgaaacacuuacugaauaucuuuuauuacuguaagcaaugguaugaugaacauuuuuaaagcuaagucuuuauacagaugauuaaauaauuccuuaaaauaaauuccuagauuuggucaguuuucaauaccuaacaauacacugcuuuccagaaagguuuuaauaauuuauauucauacuagugaugauaaagugcuuguuuccuuguauauuuguuaacaaugaagauuauaguuuuuaaaauuauuaugaguuugauagacaaaaaaugauacauuuuaaucugcauuguuuuguuuuagaucauuaauguaaccccucaacaauacaaaacugcaaaguguaaaucugaaauaaugcauuauguacaaaucagaucagucccuuuaaaauagaacaaaauggauuuaauggcucaccacuccuucaggauguguggauuuaucuauggagagugcagaaaaaggagauaacauuuacacuuugcccucucaacauauggacagagagcugaccuggagaaacaugccaaaugagauaccaaaauagugagacaccaacauaauuucugaaaaugccaggcagcacacaagcauuuugcugagauuuguaaaacaugagaaaaauaaguguuaagucucaaccaacacagguuuaacagaaaacuuuaaaaagguauguauuacacauauauaagaaucuguuucaacagauaaucaugcugacugggcacgaauauuuccuugaaaucuguagguggugauucaggagaagaguuaccaauugaaguauguugacgauaauuuguuucggaaaauguguuuuaaaacauacugguuuauuuucuuuguuuacuccagucuaaaguccuuuuuuuuuuuuuuuuuuuuuuuuuuuuuuuuuuuuuuuuaaauaagacugaucuugccaauagguuuuuguaauucaugguacaauuaagaaacauaaucagcagauuaagaauuccuuuaguaagguaaacauuugaauauuucaggauuuuuuuccuuugauaauuguucaugucuuuuacccuuuuuuuuacuaauuuaaaaguauauaauauaguuaauauacauaacuguuacggugaaaaugguuuuccuagguugauguuagcuuuuuacuuuuguugauguuauuuaaugaaguacagaaguuuguuuuugggcaaaaauggugaaaguaagucuaauacuuuauauacaaaacugauuaaacugaaucuuaaagguuccugauuuaagugauuugacuaagaucaacucuauuuuuuuaggcaguauagucuauuagaacuuaaauaaauggauauaauaguauauuucaaaagaaauauuuuuacuaugcuacauauaacuaacucuuuuuaaaaaguggaaaugguuuauuucacauuuugaagaauauagucuaagagauuuucacauauugguugacagcacagacuuuggagugagauagucguagguucaaauuguggcucuacugcaagcugcuacgugacccuaggcaaaucauuuaacucucuaguuuucaguuucuguaugugugaaacagugguuucacuguuguaaggugaaacuguuguaagguguuaggcaaaagcaaaaacuuaauaaccuuugcugcuauuauuaugauaauuaugguaauuacuauuuccccauuucauucagaaucuaauucucuauccugaaaagaaagacguaccaauuaauuaacauuuauugagagccuucuguguguugaagacucauacuaucucauuuaauucuuacuucacuucaugagguagaauauauuaacaucucucuauuauagauaagaaaacugaggauuacuguaagacuaauccauccuaguuuacaaaccuaguacacuagaaccugagauuuuggccaaauaaacgaaaacaugaugaaaagaaaacaagauaauacauuauaaaugaguaacugucuuguuaaauuucugucaucacagcaaaguacucauuuccucacuaacaaaaaugguagaccauuuugugaaaugaaugcuuauucauuucacacuaaauguauuccucuccacugacugguaaccaaguaauauaaacaaauuagaugcaucuuaucuuucauaacuaaagguuaauuuaacaagggacauuuuaucuuauacaguuuauccagcagguaacaacugcuguuuucugaucuaaaucugcugaccuauaggcaugaauauaaaaaauacuuugaauggcuaauuuaaaaaaauguauuuuagacuuuuuaauuuaaaaaagugaucuuuccgaaauaaaaucaucauccuuucuacuuucggguccuaucugacuaaccauauaacauaaaagagaaagaguaauuguggccuuuacuuaugguuaaaggagaagauugacuuuuguuaguuuuuuaaauuguuguuaaagaauuaugccauccuccuaaugcuuugucaaacuuaacgguaauaaauacaaguuuugauccggaaaggaggaagggaaacauacuuauaaagcacaugcuacucaggauaggcuuggguagugcugaaaugggaacuuagagcauccugaaggcauggauauuuuucaagauaguucaucuggggagaaggugacaaaaaaggagacaggagaaucccgaguacaaaauucacuuauucugaaguuuuucuguggacuggcucuauacucagcaaauagaaaagaaaauuucuuauauuaucuucuucagcuacagaacucugcucccaggauauaccuccuagcucagaaacuggaaucuggaauaguauuuaauaacuauuccuugaaugacagauaaaaucaugcugguauuaggaauuauauagauuaguaauauuagagauuaggaaaaguuuuauaggcuggcuuaggaaucuaaucacaagacauuauuuuaugaaaaaauguguucuaagcuugaaacaauaaaauguugggaacauaauucauucauauaaaucuggggcuuccaggagacaaaaaucuggguuuauuaaaaaaaauuaggguaccuuuguguuuuacagguuuaacacaagaaauccuugacuagcaaguucuucucauucuaagucgauuuacaauauauauguauguccuuaaaacacuguagaaagcaaauggaaaucaaaagggguuaccauaccuaccaaaaaaguaagucagacuuauuuuuuuguauucacuuaaaguuaagaauguacucauuuaaauuuaaguauucacuuaaauuuaagaaugaaguugucugauauuuccaagacuacucaaagagugcauggucuucucauauaacauaauccauuugacauaaauggucuaaugucuagucuaagucccuucuguacaauuuuaguuccaguccucuauuuuacuugucaaaaacaguuaucauccuagauaauaccuaauuaaaggugguaaaacauguauuuagagauuccggggcuuauaaacaaaccacugaauauaguuuucaauguuaaguuaaauaucaaguuuuauuuauugguguauaauuucuccucagcuuuuuuuuuuuuuuugagauggagucuugcugugucgcccagacuggaguggagcgcaguggcgugaucuuagucacugcaaccucugacuccugcucccggguucaagugauuuucaugccucagccucccgaguagcugggauuacaggugugcaccaccaugcccggcuaauuuuuuguauuuuuaauagagaugggguuucaccacauuggccaggcuggucucgaacuccugaccucaggugauccgcccgccucggcauuccaaagcacugaaauuacaggcgugagccacugcacucagccaacuucgccucagcuucuauuucuauaaggcuuugauagaagcuaagugcuuucuguuacuucacuucacuucccugagauuccucaaaagugauuggaauaugcgaugacaugcucaggaagcaguuuccccaaauauuaucaaguuguuuucaaagcuauacuuuuuccauccucaccaccauacagccuuacaauucaguaaguacagauucacucauuuaaaaaauuagacacauuaauuuaaggacuuuuccuagacacagugcagugugccacagucuacacagagcaaggcuguccuacuaagccaaagaugaacagcucagaguucauuuaggcagcucacagcucgagucugugggacggagcacaggagagaaagggagcugugcaaguggcaggaguuggggggggucagaaguauagcuggauuccuuaugagugauagcucaaggcugucccgaaaacgaacaggaugaaaccacaugaggcugaauaaagagcagcucgcuggggguugagugugggcagaaauggucagauagugcugggguuggaggcucaccaaugccagaguggagagaccucaucacccccuuguuaacaaccuuggcauucaguugugagcccagaaaaaaacagaggccuuugcccuagagaaaggccuacucuagauaaaacuuaaaaccaaauacugacaauauguacagacgacagaguuuggagauugaauccuacaucaaguuggaggagcuuaggaaacaccuugggccugguauacuugccuguuccaaccauaggcuuugaacuaaauaacaagcaacuggaaaaggggcaagaaaacuuccugucauagauuccaggcaaaggaacaguaucacugagaaaggaguagaagaaaaugcuaucugccccagggggagggucaggaagcuuacuugggcccaggaccugccagugguacaaagcagaggucuguugccucugugggaagagcaggagugcugagcaaaccccagaagaauaggaagauccaggccgggcacgguggcucaugccuguaaucccagcacuuugggaggccgaggcgggcggaucaugaggucaggagaucgagcccauccuggcuaacauggugaaaccccgucucuacuaaaaauacaaaaaauuagccaguugucguggcgggcgccuguagucccagguacucgggaggcugaggcaggagaauggcgugaacucgggaggcggagcuugcagugagcagagacugugccacugcacuccagccugggugacagagcgagacucugucucaaaaaaaaaaaaaagaacaggaagauccaaagacugagguuagacaggagaacugagaaacucccccugccuccacuauaaaccuugcagagaguaaaaagugacaucggucaaccacucauuaaaucugacuuuggaaagaaaaugaaucacaaauacuggaaaaaugagaauaacuguugacuucucaucagcaaaaugagaggcuggaagggaacaaaaucuuuagaguggugaaagaaaaaaacgcaacugagacugagaaauuauccuucaaaaauaagggugaaauaaagacaucuucauauaaacaagggcuaagauaauuuuuugccaacagacuugccaaagaaaacagauuaaguuucuuaaaauguuaacacacaacagccauaugacccaguaauucuacuccuaagagauaugaaaauguauguucacaugcugacucauaugcaaaucuuuauugcaguuuuauucauaauagccucaaacuggaaacaacccaaauguccaucaacagguggguggguaaguuauauucauauaauugaauacuauuuaauaauaagaaugaacaaacuauuuaugcaacagaaauacauacuauguuuucugaguuucuucaaagccaagauagauuaugaauauuuccauuaauaugaaguucuauaauuggcaaaacuaaucuacaguaauagaaauccaauuaguaauuaucuagaugauuagggauggguagguugacugcaaagcuguagaagggaaucuucugggugugagauaugcuccuuaucuugauuggaguaaugaguacaagauaaaugcauuuuucaaagucauugaacaauaauacacuuuauuuauuuauauauuuuuugagauagagucucacucugucgcccaggcuggagugcaguggcacgaucucggcucacugcaaccucugccuccuggguucaagugauucuccugccuuagccuccugaguagcugggauuacaggcaugcaucaccacaccuggccaauuuuuguauuuuuaguagagaugggguuucaccauguuggccaggcuggucucgaacuccugaugucaggugaugugcccgccucggccucccaaugugcuaggauuacaggcguaagccaccgcaacuggccugaacaauacacuuuaaaugugugcauuuuauuacauauaaauuacaucucaaugaugauuuuauauuaccuucuucagaguuauagaacaguaccuguauagaucugucuuguuaucaaaccagucugacaagacucgaaagguaaagaggggaaaacgcugaugaagaacaugaaagcucacauuuucaaagguguaguuaguuagagccaccuaaaaaaaaaggcaagacaccauuauaauaaugcuuacauuuauguagcaaauuugguucuaaaagauaccaauaucacuuuaaacuuuucauaguagauauuaaagcuacuuguaaaacugaugugcaguacaacugaaucauaauucaaaacuauguagagccuacuggacagaaauguucauaacaaauuggaaaauuauuuaauuagagaaagcagaccugaugagauucaacuuggucauauaauacuuauuuuaagagauucuaguucuuaccauuuuuauacuccaugauaauauacauauugacagaagcauugucaagcaaauuaauuuuuuguucuuuccauacuuacuuuuugguucuugaugacaugcugauuaaugggauuccacagauuugaggugaguuaucuaguuaaaggcaggcauucuccucccaauaauuacauuaguuacuagaccccacuacacagacauuauagagccacucaauuucauuccaaaagcaaaauacuaaaaugucagaaaugucuccccauguuccaaauacguaagugaaagcaguguuaauggguaaaggauacuguaaaagggcccaaauuaauaaauauguacuuccagcuagaugauuucucugaaauaucuacaagacaaaagcaaucuagacaauggcagguauuucaaugcaaaauggaaauuaaggaaccaguaguccccauucuuaggucaguuucggauucagaaauaguucaaacagcacuucacauuuguauauuacauuauaauuuuaaauuacuuucuuuuccacuccugugauccaggagguacaaaauagggauugaauguuaaucuuaucucagugcagugacccaaauuggucuuacuuuaucuacaauuucugucaaucuucagaacaauggcacuacaaugcagcacacuucacaguguguguauguacuuguguagguauacauauacacagaugccccucauagguuguaaaaagguagagagcaauagaaugaggaaaaggccacaagauuaaaugaggaaggauuauaaaaucacuaacagaaugaaagcucauauugaaagcaguaaauagcagaacaguucuacuaaauaguucuacuaaaagucaaguuaggaauauggaaaugucucagcaugcagauaaagaggaugaaaacaugaaaaugagaagagggaagauauggggaacagagaacagaauguuaauauauaauuagguuccuaaaggaaagccuaauauggagacaggagcaauaaucaaauauauuaauuagcuggaccuuagauuucuccucugcaguacuaaauuccagaggugaauggcacuauaucuacuugaauuuuaaaggaaaaggacuacuguuauuuuauaugcaguaaguguaacaauuaugugggaagaaaauaaagauacuccuugauuccuugaacuccucuucucuaaugauuuuguccuccauccuaccuaagcuacccacucccauaaucauaccccaggaucuaucaacagcuguacucccuccaaaaucucaugcaucccauucucugaccaucaucuccggugcuuccagcuuacuccccuugaugcucugaccucucugcuccuuauuuaguuuaaauuucauagucaaucaugguaaucauuccccugcauguacccuucauucccuugucccuuuccugcugcugccgccuuuuuuuuuuuaauuuuuaaagcaaauccauaacccuuugugagugaugguuaaaucuaacuugcaccugugaauuugaacauagcugguggguaucacuuuaauuuccuaacccaaaucucaaaugggcucuuaauguggcccaguguuuauauuuucucucaaauucuccuaauaaccauuucaaacucaucucuccucaaaccccaaaagccucuccacaauucuguuuuagcuaagaacaguaauuccuauuuuacugagaaaaugaaucacaagagaacuuccacagauucucacugccauaucucuaccuaccaacauccauacccauauauuccgccuuccugucuguuacuauacucuuacuuuaucuaaacccaggccccucaaccagugcaccaaagauggcauucaguaaauauuuguugaauugaaucaagucuguuuccaacccacuuggcaaauucuugaaaagccuagauugacuugacauccagaaggccucuaaguauaacugucuggggaagagcuauuuauugucauuuaagcagucaacaaauaucuaauaagcauuacuauuuaagagguauuuugcuugucacuacgaauucaaaguccauaaggaaacugcaggaguucuauguucaaaguaaaguaagagaaagaaaucuaguacuuguauauuaaaaaaacaaacaaaauuuaugauuacuauuauuuuaacagaugggguccugcuuuaucucucaggcuauucacaggcauaauaaaacagugcacugcagccuugaauuccuggccucaaaauguccucccgccugagucuccugaguagcugggacuauaugugugugccacuguacccaguuccaaauuuuuaaaaaacagguuacccagcucauaacuuucuuacaguuguuucccacauuugcauaaagaucagagauacuauauauucauccuaaaugagaggaaacauuugacccugaauuuucagugaggacuagagaaggcccuaaacuuugcaaaaauauuuguucucuaauuugcaauuuuaagcuacuaguuaauuugcuacuguugccuuuuggauauacaggguugaaaagaccccugaaacuaggauucaguaauuuacuuuguguuuauacacuuaaaguaugugcucaucucaggcaauaucagacuauacauuaaaauauauaaugaggccugggcuguggcucacaccuguagucccagcauuuugggaggccgaggugggcagaccacuugaggucaggaguuugugaccaggcuggccaacaaggaaaaaccgugucucuacuaaacauacaaaaauuagccaggugugguucaggcaccugucauccuaccuacucaggaggcugagacaggagaauugcuugaacccaggaggcggagguugcggugagccgagacugcaccacugcacuccauucugggugacagagcaagacuccgucucauaaauaaauaaaauaaaaaaaaauauauauauauaaugaaauauacacaccaaauacaccacaaucucuguaucucuuauauccugugcuguaucacuagaaauuacuuuaaaucacuggggacucuaacacucuucuauuauuuuaagaacaacacaacaagauaaaaucauucucaagcagagucauguuguauacugcauacagcagcuuagaaagucaaauguuuuauauaaauccaaagagccaagaagauaauaauaauaaguauauaauagaaagugucuaaugagaaaguaguuucaaagagcagaagcaauugaagaauuagcuuucuuuuaaauauaaacauuuuaguugacauuauccaaaguccaaagucuaagaauagaccaauuuauaguagguaucuuuguuucuguuuugucuuuuuugagauaggcucuagcucugucacccaggcuggagugugguggugcaaucucaguucacugcaacccuugccuuugaggcauaauaaaacagugcacugcagccuugaauuccuggccucaaaaggucuucccgccugagccuccugagaagcugggacuguaugugugugccacuggcucucaggaucaagugauccucccaccucagccuuccaaguagcuguugccuggcuacacgcuaggcacaugcuaccauacauggcuaacucguauuuuuugguagagacgggguuuugcuguguugcccaggcuacucucaaacuccugggcucaagugauccacccuccuuggccuccccaagugcugggauuacagguaugagccaccaugcccaaccuaauuguuuuuuauuuuuuauuuuuaauacagacaaggucucgcuauguuacccaggauggucuugauugaacuccuggccucaagcuauccccuccuaccucggccucccaaagaguugggauuagaggugugagccaccauguauggcuuuuuuacauuucaaauaagagaaauuggguaacuucaaggaugcaaauauuacccaggaaaauccuaugaucuuacuuuuugugugugaaauaauucuuuuucuaagugaaugcaaauuaaugggauaguucauugaaauuacucuacuaaaaaauccuuaucugagcucccaaagccuuaauuauuaacuauuucaaaguacugucucuuuaucuuauuaaucugacccaguauuuaaauauacuucauuugagaagcuccuuccuauuucuagacuaaauuuuucuuacuauaauaaaucaacaaggccagcugaauucaucuggccuuaagugcaaaaaugacuuccgugaaaaaaauacggugaaauuagacaauauucaacauguacaacacaauauuuuauuguauuuugagacagggucucacucugucacccaggcuugagugcaguggcacaaucacagcucaccgcaaccucggcugccugagcucaagugauucucccaccucagccucccaaguagcugggaccacaggcaugcgccuccacauccagcuaauuuuuuuuagcuauuauuuguagagacaggguuuugccauguugcucaggcuggucuggaacuccugggcucaagggaugccccugccugggccucccaaagugcugagauuacaagugugagcacugcaccuggccccaauauuuuauuauagcuauagaccuuucuaguuauugcuaccuuagacacaagaaaaaaaaaaaaacucacuuaaaacauuaaagucuauuaccucuguaguuuugcauuuuagaaaguacuauuuuaacucuacuuaaguauaacaguaauugacaaacgcauaagcuauauaguaaaucuuacuaauacucuauaaugauuaaaucauuauauugaccgaauaucuuauuucuaaacaacauuuuggauaaaucacccaccucauuucucaugauucuccaaagauuuaguguaauucggccaacaauauuuaucucacucauuguauaugauccauacucaucucuuucagcugcaaaucuguucucaauuuugucaucuauagaaaugaaaacagacuguaucagggcucacagaaaacaaacuuucaauaaaauuaugccagggaaaaugagaauauacauuaaggaugaauauuaaagaugaaauauaauucacaauguaugaaaaaauuuugugaaauaaauauaaccugaagucucucccucccuccuucuuucuauauuuaaauaagaaacacuuuuuucuuuagauuugguaauuuuuggcacuaccuuuuuuuguuuguuuuuuauguugcccagguugagugcaguggcuagccacaggugcaaucauagcacacuacagccucaaacuccuggucacaagcaauccgccugccucagcugcucgaauagcugggacuacaggugccugaugcuaccuuuauaaacaccuaaugcuaacauuucuuuggucuuagcaugagaaagauccacaguuaaucugguaauuucuuggaaaaaaaacuaguucaauuuuuaaccuaaacgauucucugaaaauuuguugacaucauguucacauucaggaugaaauucucuugaaugcauauggagaacuagaugaagaguuccucauagcaaauagcguugugagucuaguuucuuaggagaugaaguuuaccuagaauauaaauuaaaaugcgucucuccuauguaacacuagguauaugugaauguugaugauuagagguuccagaauaauaaaaauauuuaccauauugaagguuuauuauguucuaagaauuuuaccaacaucauuuauuuuaauacaaacauuacuuccuuuauuuuaacaggaccauuuaagaaguuaguauaauuuucauuuuguauuacggaaaauucuacucagaaauguuauaucuugcccaagaucuuacaguaagaaaacuaguauucuaaacuaggauuaccugaauccaaagaccauguacaaccacucacccaauucuuuuuauuuuaaagagauaauguuuaaaaguuuguuuuucauuuagcaaacaauguaacauauacucuggugauuguuuuaaguucuucaaaauaacccuaugaaauaaguucuauuaucccuauuuuacagaugaauaaacugagacaaggauauuuaaaaccuaucccaaaaaagauauugaaaaaaaaaaaagauauaccacuauugcuaucaugcaaaggacacacaagcuacacaaaaauucauggaaugaaaagcuaaacuuaaagcaucucugccccccauucccuuuuuauaagacagagucuuguucuauugcccaagcuugggugcaguggugugaucauagcucacugcagccuugaacuccuggguucaagcaaucaucucaccucagucuccugaguagcugggacuacaggcacaagcuaucacaccuggcuaauuuucuuucuuuuuuuuuuuuuuuugguagaaauggggucucacuuuguugccugggauaguuuugaacuccagggcucaagcaagccucccaccuuggccucccaaagaugggauuacaggugugagccacugcaccugaucuuuuuauuccaauuuuuugcaaagcuaaaaaacuuuacuguccuggaaucuuccagcuucaacuuuuccuaaaguauacacuacuuuguuuuaguuagacuugugggaacccuugggaacaaauuuauuaaaaauccuauguuuauaaagaaaacauaguuuuaaaaagugcauuauaaacuacaaauaauuuugguaugaauauuauuauucccuucuaguuagaaugaaacuuuggggaauggacuucaaaauuucugcaauauuuguagccugauauccaaauaaaaaucaaugauuaguuaacuacuaguguuccucaacccauccuguccuucuuaaccaacaaaauggauuaaaaaaaacagaggcagacaaacaauaaaauuaugguacaacaagucaaagaaaugcuauguagcuucauaauaauuaugaagacuauuucauaaugcagaaaaauaugugugguaagacacuagaugaaggaagcauaauaaaaauggaauauacgguaugauuauuuaaaaaccacuacauauguauaugaaaagugacugaaaggaaaaaacccaacaacuauacuaacaguacauauagcagugagacuagaauauuuuuuauuuuauuuuuaauuuuuucuacaauggaguuaugcuauaucuaaaacuuacacaacuuaguacuaaaaaauugggcuacagcauaaguacucuuuaacauucugucuuuauuuccuuuauaauuugcucuguaguugaaugacaaaacauucacaaugacacauaccuggcacccgagagaucauccgacauaagucaauacuuaaagcggcagcccuuuguaagagguaaccccaggaaugcaucugaaucucauauccuagcagaauaucaggaucauaccuaaaaaaggaauuuaaaaaaguuauauaaguaccauacauuugaaccuuuaaccagaauaauuguuucuucaugauauaagguaugaaaacaaaaaccuauguucucuaacggugcccagauggagaagggaugauacagugguaccuacagaguuuuuauacaggaagagauggaugguuaagaguacuugauuugaagcuacuuuguuucuuucuuucuuuuuuuuuuuugagauggggucucacucuguuguccaggcuggauugcaguggcaugauguuagcucacugcaaccucugcuucccagguucaaacgauucuccugccucagccuccugaguagcugggauuacaggugccccacaccacgcccggcuaauuuuuuguauuuuuaguagagaugagguuucaccauguuggucagguuggucucagacuacugacuuccagugaucugccugccucagccucccaaagugcugggauuauaggcgauuugacgcuauuuuuguaaaguaaacauaauuuuuacuuagacuguguauuuguuugauacaagugggaaaagaggcugauggaaauugggguggaaggcaggccauuaccacugaaguauaugagugaagguacaagugagaauauaaugugggcaggggaaggugaagugugaggguguguguggguaugguauuuugaaaaagaucccuaggucauuguguugccacuuaucuacccuucuaaucuauacugcccuuaaacaguuuuaaugcugagaaagaaaaaugagaaugcuuuccuuuucucacuuaauuuuaguaauuauuugguucucacacaaaauaaggccuaaguaaugacaaguuuguccuuuaaauuuaaaaggauggugauucaacuuaauggaagaaugaaauauuaauagaggugggauuaagguggggaagguaaacaucagaaucuagaagaaaaaugugcuccucguggucagagcuucacuggcaaaacugaaccgaccaccugcguccaauccagaaggagccucuuuguggcuccucuuagaaccuccauguugugaccaccauagagaaauguuuagcuauaaauaugaaaauuuauuucgaguggaaaauugugugggagagagcggaacuaauuauaguuauaaguuuugagagcaaaaacuacaguaaguagcucuaucaauuaguagcauuaucuuguucuuuauaaaugccaaaaggccaagugaaauaucacaaaaauuuaaaucguugaguuuuacauaacuacucaugaaacacuaaauugugagaugugcagccuguccaauuuacagcauuuaauacccuaagccucagccaaugucuacaguacuagacuaauuuacugauauaagcuaucuauggcuacucugcaagucuggcauaacaauggaucaugaccagaucaccagaucugcuuuuagaaccaauauguuaauauuuuaucauaauuccauagcugucuucuaaaaauggguauugaauggcuuucguuuuuaccuagucaauaaaaauuggaaugucacaauaaauguuuucugauuuuuaauucuggaguauuucaguggcugaugucaaaagaacuggguucaaacuucugcaacagcacacuuuuaaauuuuccuauucccuaaaggcccuaugaaaguacauucuguaguauaaauuuuaauaucuggugaucuguucaugauccauuguuauaccacagacuugcugagcagccuucaaacuuguuaggagaaaaagauaauaaacauauuauuuaugugcuuuucucuauacaaauaggguugacauuucugagaaaauggcuuaauuuaauaaacagcuauugaagcaaagcaauaagcaacaauggcaugaauauccagaaaggaaguccagaaagaucccagggcacucaaggaaagagaaauaucccaauacucuuucuguuuagucuuccaacauaacacccaaacccuuaaccaaauccuugauacugacuucaucucuuucauuaaacucuucuuaguccaaagacagacuaucuacuuguccaguauaucucccuuuaaaacuaacuguguaaugaauggcuacauuugagaauuggggcacaaguauuaaguggcucuaaggaucaucaggggucgcagacuugaagcauucucauacaaacacaacagaacccacacaguugucugcuaaguacucagaguggcucagaauaggcauuacaguguggccacaguugaccuugaucuuaagaaucgggaagauuccuggaguuccuaucacauaguuaccuaucacauaucacauaguuacacagcuacaacaugaagaggaugccagaugauuacacaggccuucuguuuuaaauguuauaaagacaguucuucuaauuucuucaucugaaucuuucucauuuaugcaacaucuuguuauugcaagacuuauuccagucagcuauuuguucuguuguggcaacuaagggaguuggcuacguacacuuuuuuuaaaaaaaauaauguauugaaaauaacuucgucucagauaaaaagcugucuauuuuuauaaacugcuacagcucagaaaugacugcugaaaaaaguuacccugcgcuucucagauuuauuucacagauuuugucccuuuagaagaauuguaaaguuguuucaggcauuuuuucagauauauuacauauauauuuauuuuuugacccggaggauguuuagucuggaggauguaagagacucuuuuaaagcugauaaaacaccuguuuucaaguucaaaagccaaaggauuccauuuuuccucucuaaaaacauuuggagacaauaacaaggucuugaugacuuguucuucaauuucuaguggguuuuauucauucuaucagguuucugaaaguuacagaaagaauaaaguuggguagaugggauuaguggugaaaacaacccaaaacuguggauaaaauagaagcagaagaaauagguaaaugguuccauuugcuuaggcagaaaaaagcugcuucacaguuaguauuuuaaguaacucacuaccaucuacacacaugacagauaaggguacucuaguagaggcaaggggcacggaggggaaggaaucaucuugaaaaagaauucugagguuaaauggauaugauguaauauaaauguaauagcauuuagggaagaggaaaagggaagaaucauaguuauauuuaaguuagggagacugcgcaaagugaaguuaauaguccaaggaaauacagaaagaggaaaaugauugugacaagauuauagaugagguuuuacuuguuuaauaucacuuuauauuacuuuucguguuugucacuugaggaagucaauauuaaaaauggaaaaauaaagauauauuuauuuuuauauuaguaccuagcacugccccuuacacacaguuaacauuuauguacucacuaugugccagaccugaguuuaagaguuuuauguguauuaucuacccauuuuacagauuaggaaaacaaagcugagagaguuaagcaacuuauucaagacagaaacacagugcuggcugacuccaaaggcugugcugaguagguacacaacaaauagggugaaagaaugaaauaaucaaucuuuuugcagaguuguuuggacuaauauauaaagaacacuauagaauugaaaaguugacauuuaagcauuuuucuuuuuaugacaguuuuguuuaccccauuuuccuuaauuacuaguacauuucauuuuauggacauuuaagaaaguuauuauacuugcaaaugacuaacaaaauucucaauguuggcagguaauccuaucauugggaauauacccaacaaggaaaaggcaagcauacaagcccagggacauuacuggacaugugcugguacacaaaauaguauugacugaaacucuuacauauuucuuucucugaguugcuugcagaaauaaaagaaguguggauacugaaagcaucugacauguugaugacaaccucugugagaagauaaaagguaggacugacaaugacaagacucaaauagaugggaaucuaucuagucaccagugcuauaaauaguaaaaauacuuuuuuuccuucagagucguggguaguagcauacuauuuuugaugcucugucauuuaauuuuguuuuguagaaaacacauguuuugguuuucuaauucucagaaugguuuauguuaacccaucugggauucaaucugaugacaagucuguagaauaucaucuuaauuuuucauguagaauacugauuuaguuuuuauaggaugaaguucaacuauauaagcaaaacaaaaaagggugaguauaacaacaugcucauggacagcuuuuaucuguauaucaggauccaaagaaugucuucuaucuugcuuuaggcaucuaaaacccuaaaccuagcaaugggcagaauccuuaaguuucuacaaagugaagcauuuaauaagagaguccauggcuaccaagagcuacacuguugagaaaaugcaaauuauccacuuaaugauuuuauuuuuaaauuaaaauauuuuuguuaaaaauuuuuuuucauaaacuuggacaagauucuacuaucggacugaggaccgacuaccaaauggucaaaagagauuuuuuaaggagcucugugcacaagaguauguaauagauaauccuacauuuaugaacagauaaauuuauacagagaaugcaucccaaagcuuuuugaaaauauuggcuuguuuagaacucagaaaacuuuaaaaaagaaaaaacaaaccaaaaaaagguacugaaaugguggcuggcucccaagguagaaaccuaguuaaugaauaauacaauggaacuuuauacaguucuccauuauuucagcaccacagaaaaaccaaccucaaguacaacugggaaguuaguuagaggcuaaacaaauauuugucuuucacuggccccucaaucuugagaacagaacacugcuuuuccuaucccuugucugaugaaaauagugaugguggugggaagugaguauaaaaucuucccaagaguaacucugcuuucaagggucauaggaagggauucgcuuucuuccuaccuuuacuuuuaucuucacuauuaucugcaauagcaugaaacgacucucugaauaaaacuggaaaaaucagauauacaaaacaauaccucuuuauuauauuugcaauuucaugaaaaagugccuucucaucagcagcauaggugacuucgaguccuguaauuccagaucuaauaaguaauggagucugauaucugauaucuaaaaaacaaacaaaaugucuauuauauauaacauuauauaauaauauaccuucauaauauaaaaguaauauuauccucuacuuuuaaguaaaauuguacuacugaaauauuucaaauuaagaaaacaucuccccaagugaaaacauaacuaacucaaugucuuuaaaaaacucucaaaagauuuuuuaguuuaauauacaacugaaaauucaaauuuuguauuuucagcuauucuccugaaaaggcugcauucauaaaauucccuagaaaauaacauaucacuggcugggugcaguggcucacgccuguaaucccagcacuuugggaggccgaggcaggcggaucacgaggucaggagaucaagaccauccugguuaacauggugaaaccccgucucuacuaaaaaauacaaagaauuagcugggcaugguggcgggcaccuguagucccagcuacucgggaggcugaggcaggagaauggcgugaauccgggaggcagagcuugcagugagcggagaucgcaccacugcacuccaaccugggcaacagagcgagacucugucucaaaaaaaaaaagaaaauaacauaucucuugugaagaaacuguauuacuuuguuucugucuuuacucuuccuagcaggagagcuuugcuuagcacaggacauuuuaaucucugguaugaugaaaaugcuuaaccaccacuucugcaggaaaaaaaagaaagccuuaauuuguagugcuggccuauuucaugauguaaggaccccucccccacccuaugacugauuuccaacugccaaagugacagcaacuaguuugaaaaauucaugaaaauccaagaacuggcuugugagcugguaugugucagcucaagcacaucacugaauaaauugcaaauucuuaauaugguuguauucugugcuaagacuuccuccucaguggacugaauucacuuguaauggugaccacugaaagcugcagagggacaguagguauuuuauaaaaugccuuauauggcauucuauaugaagaaccucugaaccaaaaguauauuauuuagaaagaaagauaaagagauauaagcaaaguaagaauauaucuuaaaaguaucuuauaaaccauuaacuuauagugguaagauaaacccucuaucagcaggaaaauaccugcauaugcauacauaaggaagacugugcaccuaaucuagggauacauaauaagguggacucuguauuaguaguaaguauuuuuauaaaauaauacuuagaacaaauuauauaagauaauuauaaauauuaagaucuuuauauugcauugcuucugacuuaaaaaaugaauaaauaaauggggucuugcuauguuacccaggcuggaaugcaguggcuauuuacaggcacaaucauagugcacuacagccccaaacuccugggcucgagcaauccuguugcccagccucccagguagcugggacuauauauaagcaggcaccacugugccuggcugcuucugacuaauccaaguaagaauaauaaaucuaggacaaaguuauacacaaucuccuaccccuaccucagcaaacauuuuagaaaagagucaucaugcuugcuuagauuagaucuucagcacaggaauuccccauuaaaacauucacccuagagugggcagguauaucauuaauaaaaauggacaauaccuugacugaaaacugucuugucuuuaucaaucacuauuacaccugugaguucuguuuuuucuguaucuggcaguggagugucagaugagaugcaguagaacagagcacagauugggucaaauucaggauccgguucuaagucucgucuaguucgagcaugcaacuccacacugauuaggguaagauuuuguaucuauaaaagcaaauaaauacuauguuuuuaaaacauuuuuuaaagacaugcucaaagaaguauguaaggcucuagggaaauauguauguaagauuacagaaaaaauggacauaaaggacaaagucacagcucagcagcacuccauauauuaaaacgaaagauuuuuaaucccaagauuagauuaaaucaauucaugauguuauuucagaaaaucugcucucaaugacaauauuuagacuauuuuucucaaauauaugcaggaucucucaaugccuguuugagaaagagaaugacuaguccaaguaguuauacaaugaaaccaaagucugucacguuuuacucuucauguaguuagcuaaacuauauaguuuuaccuguaguuuaaaguaaaaagagagcuuuuuuaaaauucaaauuuccuaccaauuaauucacuacuacuugagggcuacuuaaacuuagacuuuugcauacacuaggcagauuuuuaauuauaguuuuuccugaaaaaaaaaaaaaaaaaaaaaagaacuguuaugguaucaacuacacaacagccagauuuuuacacaugcacauuuucucuuuaacauauaaugcaaaaaaguuaauauuugcuuuucaugcuuauuuuucuaugccaauauaaacuuuuaacuguaauucuuaguuuucuuucuaaaaucaagacagaguaaauaagaaaaacaaaauauagguugaauucaugauuauagcuagaauuauaccucaucuuuuuaucauguacauguaccuggcaauggaaaacagauuccuguuucaauauugguaauuauucagaucauauaaauuuaacaaaggauuuguguuuuguauuaucuugcaugcaaacuguugaagaaauguaaauucaaguuucucacuagugacaggaguagaauuugguaaaucucuaucaaaauuaaaauccauugauguggcaauccuacuccugaaaauuuauccuagagacagauacacucauacauguagauaaaauauacacaacaaggauguuuacucgagaauagcaaagacuggaaaaaaacuaaauguuuaccuguuggggacagguuacauaaauuaugugguauccauaaaggauacacacaauggaauauucuguaaccuuuaagauuuucaagggaaugaggcagaucuguauguccuaauauaaaaagaucacuauaauacacugauacauggaaccaguaaacacaguaaacuucuauacaugaaaaaauggaagcacaugcauagaaaauuucugaaaagugacauaaaaaugcagacauacuuauugcuuugggggaaagaaauugcuagccuaaaguaggagggaagcuuacuuuucauugcaaauuuuuuuguccugauugaguauuuuugguauauauacuauugcaugugcucauuguaaauuuguuaaauaaucuuuuuuuuuuuuuuuuuuuuuuagacacagggucucucucuguugcccaggcuggaaugccauggugugaucauaguucacugcagcccugaacuccugggcucaagugauccacucacuucagcuuuccuacuagcugggacuauagguacauaucaccauggccagcuaauuuauaaaaacuucuguagagauggggccucacuauguugcucaggcuggucucgaacuccuggccucaagcaauccuccugccucaaccucccgaagugcuaggauuacaggugugagccaccuugccuggccacuaaguacuuuuuaaaauauaaagaacaucaauuaugcauguauaaggcauaauaauaaaacaaauacaaaucuaccacuuuccucagaaacauauacugcuguuucuacuuuaaaauauuaguauuaaaaaaaaaaucaaaccacaugaaauggagagcuaagggaaaaaacuuuuacuuuuaaaugcauacucuucagaacuuaauuuuaacaauaagcaugcauuaauuuaguaaauaaaaaauuuuuaaauggaaaacuccucccacaaacccaaauaaaacaaaacaaccaguuucauuagaaagggaugaacauaugaggccgggcacgguggcuuaugccuguaaucccagcacuuugggaggcugaggcagguggaucaccugaggucaggaguuugagaccagucuggcaaauguagcgaaaccccgucucuacuaaaaauacaaaaauuagccggguguggugacgcaugccuguaaucccagcuacuagggaggcugaggcaggagaacugcuugaaccugggagguggagguugcagugagcugagauugugccauugcauuccagccugggugacagagugagacuaugucucaaacaaaacaaaaaaaaacaaaaaacacacacacacaaaaaaaaaaacaaaaaaaaaaaagaaagggaugaacauaugaaaagacaugaagacucugaaaacaauuuuagguuaaaagggucuuagagguugauuuuuguuuacuagaucaaauuuucacacucaaaauuugcauuucuauuccuuaauaacaaaaugcauuacugugcuuaggggguauuuuuuuaaagcaaacuauauaaagacauggcuugagagauuuagugagugugacuaggcaagaggcaggugagaagggggacaaagauuacaacccuugucuucugcacugaguacugaugugcagaagaaagagagauuauccuaggguaauggaaacagagggagaaaaugccacaagcauaauuuccuagagaaaggaagagaacaguauuuuuucuuugguuuauucccuguuucaaccaccgggcggcaguuuggaaugugccuugagaugaggaaagccgguuaucgggaggaagaagcugucagagcaaccagugagaccuccagagugauuuuaacuuccagagggcccaugguucugaaacaggguuaccuaggaaaauguagaaaagcguacuuuucaaauaagagaauaaucaaauguaacaugucuuuuugcuauggucuaucaaauuugcuuuaauacauauuuuuaaaaaaguuuuuaaaaauuugcuaauuucaaguuugcauuugaugguauguauuacugaauuuaucacuuaauuuaucuaggcuucaggggcuaguauagaccuagguauaaaacagaaacugaaugaaugcugcugaaugagaaaaaugugcaaaugaauaaaugagggagagacuauguuccaaucuaauucuaaaaaaacauaauucucaguucaaaugugaagaacaaaggaggacaauauuaaaauuuuucccucaguuuauguuaaucuaaucucuagaacaguuuacaacagaauugacuugagaaaaaaaaccacacuuaaaaauugaauuauaacuuaaaggugguuacuaauccucugcuuuaaaagcaaagacauaaagugacuguauaaaacuagcauuguccaauagaaauauaaugaaagucacauguaacuuaaaguuuucuaguagucacauuuaaaaaaauaaaaauagguuaauuuaaaaacacuuugaucugauccaauauauuuaaaauauuauccuuucaacauguaaucaauauuaaaauuacuaacaaaauauuuuaaauuauucuuuccaugaagucuuugaaaugaguauguacuuuauccuucuaguauaucucacugugcacgcuaaauuuucuacagaaauacuugaucuguaauuucauacaacuuaagaguaaaaaauaguauuacauaccuaagucguuccaaacauacuuugagucaacuauguuuuaaaaucuaaauuaaaauuaaauaaaguuuaaaauucaguucuucaguuguauaagccaaauuuuaaguucucaauauccaugcugcuagcggcuaccauacgacagcacagguguaaacaaugaaaacauacuccaauuucuaucuuacugccagucagauaugugcuuugaguuuguuuucugcauacaaauaaauuuacagugacccauucacauauucuuuccaaugcauacuguagcugauguauauuuuugcaaaguccuagucuuuggcaggcagccugugcugugaagauagcuggauuaaguagagaguauaugagugaaugaauuuauccucuuuuguagcaagcucuaauccacucagccaaucaaacagaaaauacaaguaaauaucacauuucagaugugacauaacaucuuaauauaauaauccccaaaauacagacuuacuucuuuuuuuuguuuuuccccaaagagacagagucuugcucugucuguagcccaggcuggaguguaguggcgcaaucacagcucacugcacccucgaacucccaggaucaagugauccucccaccucagccucccaaguagcugagacuauaggugcgcgccaccaugcucaucuaauuuuauuuuuauuuuuugguagagacagggucuuccuauguagcccaggauagucuuaaacuccucgacucaagggaucaucccaccuccaccucccaaaaaucuuuucuuauuuuaauguccauaagcugaauuucaguuaugagauuugugaaagauaugaaaucacaaagcagucucagcaacuuaaaugcuuuaaguuuauguauuguacauaaacauguaaauauacaaaauaguaaaaugagaacaagaugaagauuaauaggauagaauucaauauacuccucccuuguuaaaaaaauuccauacuuguuuuauagaauaaaacaggaguuaaacugaacacaauguauguguccuuacuguugcaguuuuaccucauguaaagcuuuugccuccuguaaguuuuguaugcugacuuugaaaccguaaguauuguuuaaagaugguccaucaaucugagaaguuucuuucugugggguauuuacugcugcaaauugauucuauaaaaaaaaacacacacacacacagccagaaaaagauacaugagcaaucauuuuucuuuugauuacuuauucucagauaauaugcuuuauguguuuaguaauaaaugguaaacuaauaucaucucuaaguucaagaacaaacuguauuuuauuaauguuauuuucaugcuaacaaagauaucagaacuggauacauguagaaauauaagcaaaccauauguuaucucucaguucagaagcccucaauacugaaaauaacaguuuuguagggaguugacauuuauaccacauggacauuuaucuugaccuuucuuggaaguaagaaagacaagcaagcaaucaauauauuuccaacuacuuuggcuaaaguuuguaaaagauuugaaauacugauuuguauuuuacucuaauauaacaugugucugaaagaugaauuaaauaaaacaauguaaucuucaaagauucagaaaaaaauggaaucuuuccauuucuuacaaaauuauuuuuucugauuucuaaaucuauuaacuguuuuccccaaaguguuauguucacaacacacugauauaguauuuuuuaauauauauagcuuguaauucaacaguauuuuauaaaugaaaguuuaaaaaguuugauaaucucagaaauauuaaaauauauuuuauguaguuaaugacauuuauaagaaguggccaauauauaagugauuucuagcauauauuuccaaggauguaugucuaauguauacuucuuucacauaaccauauaauucuaaguuuugucauauuuuuaguauuugaauaaagacauuugugacuuuccagaguuucaguaguaaauaauguugcuuucuuuuacuacuuaguaaaauaaauuuuaaaaaaucaauaagguuauauuuuagaaaaaaguaauaaaccaagaaaaaggauauauuuuuggugggaucaaaaaucacuuacuugagcucugcugucauuggauuguucugauuuugccaguaaucaguuaauguauuuguauccucauaauccacauuuuggcuaucauauucacuuucucuguaauauuuguauuuacauauaagaaucuuuuagaucccaacaucaaaaaaaaaacuaaaaaaaggcaaauuuuuguugucucaaagauaugcaaauaaugaugcaaaaauuuaaguaaccaaaauuuuuuaauugagacaaaguuaacaauuaucuaacugaaaucuaggaaaaagacuggcucuuccacugaucuuuaaaaauguuuaguauaguuaccuuugcuuguguuaacaguacucuucuaagagugucaguauuacuuccuuucuuauuacucaacuucuguguuuuugguucuguagaaagaaauuuaauauuuaacauguauaucaaaauuaccugcuucugguuuuuaaaaaaccuuuuguuguuccaaacacuuaaguaccacuugugggugcuguccuaugaauuccccccagaauuucauaauuuaaaaaugaaauucaaaccucugaucccaaccaaaauaacauuuugacauuuuguauuuuaaauguuuauguuuuaauuacugaauuuuauaccucagucauuaaccuagagaacuguuuaauucauuuauucacuuauuuaucaaguaucuaugaugaggaagaaaagacauaaucucugcccuuguggggucuagagagagaaucagacauucaucaaacauacuagaaaaauaaaauuauaacugcacuaauacaacaaaggggaauauaauugggaauuuuuauguagucaaggagauuagggaagguuuccuggagguaaaaucugaagagaguaguaacuaacuaagaacagaguggggauuuuucccugauuacugugcaaaagaauuggaaguuacuaagaguagauaaaauggcuggugcaggagcccaggcaagagaugaugacaguuuggccuaagguugugguggaagaaguacaauaaaguagauagaucuggguuacuugggagauaaacaagugauaaggcuugguuagggacuagaaacuacaagguggguaaugagggaaugaggugaguguuaaaaauaaauucuauguuucugacuuguguaacuaagaaaugauggcacuauucauugaaauaaggaaaacugaaagaaggccagauggguuuuuauguggaggcauguauauauaaguguguuggggaagugguggugaauguaugcggugagaucaugaauugguuuuuaaaauacuaaucuugaggugccauuuagcauucaaguggaaaugucagauagguaguuggauauaguguucuggagcuuaaaagagagaucugaacugggaauauaaauuugcgaguuaucuguaguaauccuguagacaggaauuagaucauuuagagaaagauauaaagaaggcuuaagaccaagccuuaauaaacuccaacauuuagauaacaacugagaauaaugagaaaaucaagugggaaaaaaacagagaaguaggaggaaagccaaguggagaagcuccaagaaggaagguaaggucaacaagaaaauggcugcuuagaggacauaugauaagacucaggaacaucuauugguuuuagcuauaaguuuacugggaaucuuuacaagagcuauaauguagaaugacaggggcagaauucaguuuagagugggcugagaaaugaguaggagguaaauaacuggaguugucaaauuagauaaaucuuuuaagaaauuuggcuuugaaggggaggagaaagaguagaagcuggcuggagacgugaggucaaggcagguuuuuuguuucuguuuuaaaaugugggagaccuggguauguauaaaagccaacaggaaagucaaguugagaagauaagccuuuugagagggcuccugcauuucacccacaagacaggauggaagcaaauauaaguagauuucacagcagaaagacaguugccaugugacgacuuucuaagacaugacgaaaaauauuugcugagcuauaccuucauuuaaaaagcucugauuuucauuacagucuaauguuaucuucauuucuauuucugaagaacaauuauggagacuuccuguuauuuguacacuuaccuguugauaaugggcuaaggccaggugcuucaggaagccuuuccagaaguuuucucuguaugauugguguacuaugaaagcaaagugauucacauuucccaguucuugcccuaguauuaauuggagauaucacuagaggcucuugaggcucacugcaggggcuuuuuuguauaccaucuuuuauuggcuuuaagaaguucucaaaagccaaugaaggcagcuccucuacuggugaugagggucuaucaucuccauuuaaugcuuuggaaucuggggauauugguuguugccaagggggaauuacuggagaaucaggggagcuauaacuaauguaauaguuaucaucaucaucuucaucuuuuucgggaucacuugcagaggcaacugguggcagcaucugacuuucacuugcaguuugacuacaucccgugguuggugcuuguaaagcaaucugagaauuaucaacauccuccuugguaugugcuguaguggggaguauacauggacuuacauccauuuuuggaggcacuacagguuugucaucuggguuaacugaagagcuaaaguucucagcagauuuuacaacuccaguuggcuugguuuuaggcaguuucuuggaacguucguauucuucuuuggcuugaagccacacuugaaccaguugucgacuuggggcacauuugcaaggcauaaucacaauuuuuuuaucuucaaccaucuuagggcuauuacuugacccuuuauugacaacuccuuggccacugcgaaggggugacccuggccuuggauucugagucauugcugagaaugcuguuuuccaaagacgaaguccuuccaaggaaaagucucccucaaacucagccagaucauuugcaagucgaguuucuaccaugaggagccguccaccaaucucccuauaauaacauauuuuagaacaacuguuuuguuucaaagagcaauuaccaaaauauuuaacuccauauccuagauaaagucccuuuuggagucucaaaaauguccaugucuaucuucccugcccccucuauauugugcagguacauucuaucuuuagucucaauaugcuuuuccucacagguauaugacuacuacuuaauuuccuuuggaagguaccauuaaucuuagggagagaagguauuuuuuguuuuauuuuaaugccccaugaagccuucuguccuucaaggagaugacacaaacuuuucagauuccuuuccucuccuaaucuuaaaauaaauuuuccauuauuaccacauaugaauaaaaacaaugaauuuaucauucaaauacuaugucccuggauauuauucauagcuucuuccuauauucuccaguaucuguaguuuaacaaagccagucaauucaaaugaaucuucguacucucaaauucccuuaaacauuaaaaaaaauaccaacugagguaaauuacucuaauucuuucuucccauuccauggcagggauuaacacugacauaacuuaggagcuggcagagcccacaggaugcauggcuuaaauguuaccaaugcaugaauaugugggaaaucacuaaugaaaacagucugguuucauuuccaauaguuauaaauauuaagugaaaccucugucuuucuccaaucccuugauacuauuucugcuuacuacagcaacauaaaauaauucuacuucuucauguuaacuuuauuauggauauaaaguuaauucauaguuuuuucaaucacuucucuuagggcaugauuccccaaauguccccaucacucucuauguaaaauccacuaacuggaucauguuuucagauuugaagcugaaagaagagcauuagggcuacucugucuccuuuauaugaaaagacuuaagccccuacuaguuaacuccauaaccagcauccagcacugucccugcauccacucuuggcaaugugaaaaaacagaaacagaauuaaugcuguugaaggaaaugaauacacauaccaagugaccauacccaacucuaauacuaaggauagagaagucauaaugaggucaagaauaaaaaauggugaggugucgggaggcugaggcaggagaauggcgugaaccagggaggcggaccuugcagugagccgaaaucacgccacugcacuccaaccugggugacagagccagacucugucucaaaaaaaaaaaaaaaaaaaaaaaauggugagguguggugaauucaguuuucuuacauauugucagcagcaugguaauugcuauaacccacugggaaaaaaaaucuccuaauauguaucaagagccuuaaauuuuucaguaauccuacuucuagggcuauaaggaaaaacuccaaaauacaagaaaugcuuuaagaagaaaaugcuaauaucuucuuaacauacauaauaauauacauaauaucuauaguggcaaaauugcaaacaaccuuucuguccaauaauauauacaugaugcaacauaugcagcgauuaaaauauucaagaaacucauuuggaaaauguuuacaauauaauguuaagugaaaaauuuggauauaauacugugacuauaguaagaucacacuucacaaaacaaaacaaacuaaaaacuauacuuuuuaaaaaagaaaacagaauacacaucaaaauauuaugguggcuguuacuacauggaaaaaugauguaauuuuuauuuuuucuucuuucauacuuccuaaauuuucuauauugaauauacaguuucauuuuuuuuuuuugagacagucuugcugugucaccaggcuggagugcaguggugcgaucucagcucacugcaaccucugacucccugguucaagugauucuccugccucagccucccgaguaggauuacagacucaugccaccaugcccagcuaauuuuuguauuuuuaguagagaugggguuucaccauguuggccaggauggucucgaucuccugaccuugugaucugcccaccuuggccucccaaagugcugggauuacaggcgugagccaccgugcccggccuacaguuucauauuucaaaaauauuuuucaaaaaugauuauuuuuuauuuuagcugcaggacaagugucaaaguuggacaauaacaacaacacaaagguaaugacuagcacauaaaguuugguaacuaaaaguaaauauaccauaaucacuacuaauaacaccaaaguccccaaaaugauggaaacuaacgucuaaagaacagauuucauaugcuccagcagugaaauaaagaguuccauguggguacuaaacaaaacuguguguugaaaaggggcugggagguggacauuucuaccuuucacuucaagucauuacaggagagaacuuuuauucugcauuucugauaaccuuuucucaccccuuuauuaaaaaaauaaauuuuauuguguauauuuaagguauaaaauaugauauuaguauauaguaaaaugguucuuacagugaaacaaauuaacauauccaucauuucacauucucaacccuuucuuaaauggauuccuauaggaauuauugugaaucugcuggguaaaagccuggcauucacugucguguuuuuuuaauuuaaacuuuuuuaaaaagauauuuuaacagcuuuagguugacagcaaaauugaaaggaagguacagaaguuucccauauaucccuugugcccccacacauacauggccucccucauuaucaccauccccuaccagagugguacauguguuacaaucgaugaaccuauguugacacaucauaauuguccaaaguccacagauuacauuuggguuuguucuuggugugguacuuucuauggcuuugaacaaauguguaauauucauauuguaucuuucuuuuuuuuuuuucccacuggagucaggaacaugguacugccacaggucagugcauacaugcaguguguccucugcugcuuuuccuaucucuuuccaagauuuagacuaaggcagggccugccuuagcaguuccagccauccucuucugcuucugaauggauggcugaaaugaacugccugcucugcaacugguuaaguauaugagaucauggacacaagggcaggaacaagagccaucauuuaaacuuucuggauuaagccacauuacccaauuuagcuuucaucaguuauguccuaacuuggugaugaaagugguauacaccauaacuacuuaacuacugauaaauaaaccaguacucugauuucuauuuugcuauuugcugugugugugcgugcgcucacauguuugucuaucaauucccugaagagauuuuuuuuuugagauaaagucucauucuauugcccaagcuggaaugcagcggcgugaacacagcucacugcagccuugacauccugggcucaagugauucuccuuccuuagccuccugaguagcugggaccacaggugcaugccaccaugcccagcuaucuuuuuuuuuuuuuuuuucugagauggaguuucacucuuuauugcccaggcaacaaagugcaguggcgugaucucagcucacuacaaccuccaccuccuggguucaagugauucuccugucucagccuccuaggcagcugggauuacaggcaccugccaccauguccagcuaauuuuuguauuuuuaguagagacaggguuucaccauguuggccaggcuggucuugaacuccugaccucaggugaucugccccccucggccucccaaagugcugggauuacaggcgugagccacugugcccggccuaauuuuuuguagagagagagucucacuauuuugccugggcuggucgcaaacuccugggcucaagcgauccucccaccucggccucccaaagugcugggauuacaggugcacaccaccauacccagccaccugaaaaaauucuuaaaagaaaggagaauggaaaccaaaguccauuugcuaauaacugcauaaacuauaauaacaauaacaauauaauacaagauauugaaaccacaugaaaagugguuuauaauagaaacaacuuacaauaaucuucacuuagagauauaucagaggaauacuuaaaacacauacaugcucauuuucaaaacacuugaaaaugaaguucuuuuaaaaugguauaaaaguuuaacauuuaaaaauuaaauaccauuuaaacaaugaucauuguaauccuuuuaaaguaucaugacaucuuuacagugagcaccucuaaucuuuaaugaagacauaguguuaaauaaugguagauccaagucaacuuaaauaaauuucucuagguguaaccauccaguuaguuuuugaauuuucuuaguaagucuguaauuagaaauacuuuccacaaugauauacuuacaaauacgguaucacagaaaacuagcagucagguaaccaaauguugcauacauucuuuuuuuuucaauccccauagcauaauuuuauauaucauaauaauucagagugacccaagggaaaaaauaacugauuaccugggcuuuucugguacaucagaaggauuacugcaaaaugguuccugguaaauagucucagacaggucaugauccaacaaaguugccauaauuucuucccuacuugggggggacauaagugguuucagaauguuagcaguucgaggggugaagcugccauuuuuagauugugaaggagagcuaguagaucuuggugaacuaucaggaguuggugucaacauaucauuguuucuugaaacauacaguucuaaaucuucacaggccacgucuacaaguucaccaucaggggaggagaguauugcaguaaaagagguauuggcugagucaagagacugucccauuucuuuucuggugugaccuugaauccagucugaauuguuuggcugugggaggcuaagaaacacuucuuugcuuacugaacuccuauucaaucuagauuuuucacuuagacagucuucugccugcugaacacagaaagaauccauuauugaguuagaccgaguuguuagaggaugaaagcuauuuuuccacugguuguggcgacgauucucauugcuaucuaugguugacuucucaaaaauuucaggacuuaaaguaccagaucuaauccaugaggcugagucugugguaugaugcuugucuucaucacauuucugguugucaugacuuaaaaacucauuuuuuucuauagcuuguccuggaaaaagauccugaacagcaucacuuaggaacuucugaggcaaauucugaucagcugggacaaacugacuuccagaauaaaagcuacaaaauccagucugaccuauuguguuaauaucaaaauuauaauuauguucaggagauaaacuaucuucaagugaguaacaacuuucaaagccuggaucugaaaaaaagaugggacuaucaucugauacagaguuauccaacuggcuagaguuuuguaaauuuaaagagucuacuuugagaaguuuggggauuuuuucuuuuuguuuuguacuucugggaguucgagguuuucuuggggacguuaccgaucguguccguuuauuugcuuuguuaugcucaagggaaccagaaauauuuuuauuugguugauguuuauuggauaaugggucuuguguaguauuugcauuuugugcuuucugcugucuuuuuuguaacaauucuuuuagaacugccaguccagacuguccuucaccaaaugcugaagguguugacacauuucgauuuuuacacugagaaagugcuuugguuugugaaauugcuucugauaacgaccucgguuuuacucuuucagguuuaaaauuugacauaucuaaaauaaagccccuuugcuuuugcucccaugcuauuuguuugauuggacuucucaaggaaguuacaaagcaauuauuaggcauuuggcuuuccucugaagcuguauuucccggagaacaaguuucacugugcuuugacuguuccgcuaugcacacaaucugcugcugacugucuuugcaaugcaaaaaauuagggguauaugcuugguccagcuuugauucuagggaauugcgauauucacuuaacuuuccgauugaugacaaauaguuucuuuguauauuauuugcauuaucuucuaucuuugaggacauaccagaagauaucuguguauucugugcuaccugagauaaaugauuggaaaggucaaauauauuuuuuugaauuaacguugauuccuuuagaguaaacauagcacuuugauuaugaggccuuugaacauuaauuuuugagacuccagguccuauagaauuacaaacaacugauggaugcaaaucaucucgugaacuggggaaugucugcaaaucuacagacuucuugcuuucuaagaaagaagaaaagcagccagauaacuucuguugugcauuaauuccaguggguagggaagcagaaaggggaugaucuacagcagagcccauuaguggcauaucuuucuguuuaaaaaguaguugagagccuccagaacuacuugcaaauucagacacauucugguguuucaguacaaacuuaaccucagcaccagacugagauuuuauuuuuucauccuuaaguguuguaugcuuucucgauguaccuuucucauuuguuuuuuguuuugcucuugguuucuuuuuuccaucaucuacuaguuuauuugucugauuucguuuguuccuuuucuuaguaacuauagagggauuagcaagcuuugcuuuugauuucuuaaucugugcucuugcgcgacuaguuuuuccuauacgagaauuaacagucuucuuauauacauuaggacccuuaaaaagcauugccucuuuuucugcagcagccaugauuucuucagcucuuggaucugugggagaccagcagcgagguggagaagaauuuaugggacuugugcuucucucagaaagaaaaccuaguuuagacauaacaucacuauaauucaggucacaaucuucgguuucagcauuguaagauggugagggaggagaaagaauagcaugugaccguuuuuuccugaaagacaaaguucuuuuaauauuuucauuauuuguccuuuguuguuuaccaguuuuuuucuuagcagauuuauguuuugacuuucuucugugacuuuucuuugguguuaguggauaaaugggauauuugguugcaggggagucgggaacuuuuggccaaaaguccuucaaaggugcaagcuuuuuauauaguuccauuuuuucuucuguuaauauuacuuguuuuucuuuagagucuauuuuuccuagcuucacaagcauauuuuuucucccucuaaaucuauuaauaauaauauacuuuaugaugacagggggcagcuuuuuagacauuuuucuucguuuucgggauuugagaguuccaucuaaacuuucaccaauuuccaugggaugagguagacuaauuuuugaguugugaguuacaaaacuugacucacugucuucagucucauaauuuaccuugcguuuggcucuaaguguguauuuauuuccauauaguccaaaggacugcucaguuucuaacguuccaucuccaaagugacagucuauaaaaccaucuguggguguuuuauuuucaaaagcuccacgagugguuuuaguuaaaucacuagccaaugcauuauccuucucaggauuacuauuacaaggauuauuuuguauaaaauuaucuuuuguggauccagucucacuacuuuugguagaagucuccugaugaccugcaaguuuccuuuuauucaauuuuaaccgggaugguuuauugccagguuguaauuuauaugugacaggagauaguuucuguggucuaguaagacaguuagaaagaacaacacugggaaaaaacauauagugugcugcuugcuggcugaggcuuggcuuuucuguuuuauguucuugaaauucuucauaccuaauuuuaaguuuauuuaguccacuuucaucagcagugcuauuaagagaaugcaccauaguucuauucuccccugagcaugacaguaauucacaauuuucaguaaaugaugaagggaauaaacuacucagagcugugcuguuuccuuuuucauuuccuucagaggauacuuuauuuuuugaaugauuuaagucagaaaaguugaaagaauuuuugcccaauguauucucguuagggugacggugcauauguauaaaaggggaauccuuuucgauuuuucuaauguuuguauauuuucuacuugguacuugucuuguaacagauggaauaucuucuucauaaucaaaaauacuacuuucacaggaagauacugggaggaucucuuucuuacuauucucuuuaugagaauuuucugaaugaacaguacugcuuaaagauccaggguauuucauagaauaagugcuuucguuuguaaaagaagugacugaguuaucuagaccuuuuucuguauuuuuguuugucugugaaaggucuucaauuaaaucuuccuuguucaaaacaugggaagaaagggcacuuguguguuuacacugaaagguaaucuuagcagaagaugaggguucuaauguagcagcaucuuugugaaagauggaggguuuaacugaaagcuugcuuguugcaauuacagaagaguggguucuagaauuuucauuguucaauggauugucugaaaugaggagggaaaaacaguuuauuucauuuuacucuuuuaauuuuuaagacauuuucccacaccaagauauuaaugcuaucacuaugaaaaaauuacaucaaauuaaguuugguuaucuuaacaaaaagguaaugcuuaucauuaaugacucaaucuaaauauaguuaguuacaauuauuagucaucauuuuaaacaaauauuccauugaucagaaauagauuauauuacuauuuaguuccuuuggggcauaagggaaaaauacugucacuuuaaaaauguucauaaaauaauaugcuuuacauuaucacuucaaauaaacugagcauauuuuucaguuuauuauucuacuugcacaacaaacauuaaaguuuucaaagcuugaauucaguggucaacaaauguuauauccuuuuagaaaugagaagcaaaucauguaucuaauucuuucaaaagaaaaaaauccugaaggacgaaacaucacuauagccucccuuagccaacuauauagaaaguaugauuacaguuucaaaaucaauagaaaguaugauuaaaguuucaaaaucauauuuauuuauuuauuauuuuuuuuggaggcagaaucuuguucuguugccuaggcuggaaugccauggagcaaucacagcucacugcagccucaaacccuugggcucaaguaagccucccaccucagccuccugaguagcugggacuacaggcauguaucacuaugcugggcuaauuuuuuuaguuuuuuagagacgggggucccacuacguugccuaggcuggucucgaacuccugaauucaagugauccucucaccuuggacucccagaaugcugggauuacaggugugagccagagcgccuagccucaaaaucaaauacauuuuuagaucgugaauaaccaauuucucacaguagacuuguuuacuuaccacuauuuucaucugcaguuccaucuaacugagguauagaaagacuggcuagaagcaaacuguuaucacuccauuccauuucuucuccugaagaugagucaucaucuucaguugaacuucuguggguauuucugcacagugaucuggagaacauuaaaauucacuggugagcaugaucauuaguaaagaccaucucagaugcaaauaaugcaucuaaguuaacucuauaauaauguaucuaaguuaacuauaauaauguaucuaaguuacucuauaguaaaacaauacaaaaaaucugaaaauuguaacuucuagaaaagcauauuuacuuugcuuuauuaacaugucuuacuauaguaacuuacaaagaguuauuauaauuagacuucauaaucccuuucaugugagcuaaaauacaccacaauuccugcauucugaauuggaagaaacaagaauaaaaagaugagugaaggggcauugaggucagggcugaagagaaaaugcugaagaagagagaggguaauaggaaguaguaaagguguucagucaaccugacaauaacuacaaaggguuacugagaaauucagauggacagugaaguccagucuuuaaguuucaucucauauugguauuaacuugauguuuucccuuuuaauugaaugggcaaacuuuuuuccuauccauacccaauuuuuucuuucacuaaucucaacaauuugaaauuauuauuauuuuauuauacuuauuauacuggaacuguuuuuccauuaagccuuuccaaaucacaauuuaucauaaaaaucacucccuuaagagcugaaagagguaucagagguccaguccaacuuucuacccaaugcgaaaaccucauuuuuaacgaaccugacacaaucucuguuuuuacauaaucuguauaaggggcuugcugucucacagggcaaucuuuccacuguuaauggcuuuaauuauucauaguugucuucuuguaauacacaaacucuuucaacuuccauacaugauuccuauuuuguucucuguagcuauacagagcagguugaugucauuuuccacaugauaaucuuuaaaauacauaaaggcauuucucauucaucuuguaauucuaauuagaucaaacauucuccauucaaaaguucuucaaaagugacaaugcucacagauccuucuaguuuucuuccucuucuuucccuuuccuuuuucaguauucuuaaaauaugguacucagcacagaauauaauauccaauauaaagagcagaauuaacuaaacccuuuucuagacaccaugcuucuacuauucaaucucucucuaauauauguguacaaaauguuuagguuuguuuucccaagguuaaauugggcaugguuuucaccaaauugguucagccacugaacauacaaacauaaauuuaaucauaggauugacuaugccuauuauuacagcagugacaauguuagaggaaagaauuuaacaucacaucuggagauuucuauaucugauuuauuaaguagaaaaauaaaaacuuucaucauauacauguaaacacugaauuuauggauuaaccuguuucaccuuucagugauggcuuuggguuggaaauuucaaauacagacuaaaaaaguucuaaucuagccuauagaaguuuaaaggagaggcauacucagucuuucaggcucauaggccuagauuuuucuauacacagagcauauaacuaaagggcagacucaaaccaaucaaguucacagagacugauuuagaaaaccacaacaccaacuuauucauuuauuuugagaaacaaaccacaacaccaguguuugcuucuuagucuuuuauuuauuuguuuuuaaccuuaguucccuuagucuaaucagagcccaaaaccauacccugucuucaggcugacucuauacauuguuguucugauacccaacaguucaacuaucacagggcauucuuuuucuuaaguucuaagauaagaaggcacuucaauuuugcuccauuuaucacucacauauguuaauacuguguauauaaauggauaacuucuaaaaguuagguuaaucuuuuaaaauguagcaaaacuuuauuuugcuuggaauauggaguauacgccauaugaaaaacagaucacuaaaggggaauuuuaaaacaucaauuuaguucauaagguauuuuauaucaugaacaauaguaauaaauaauuucugauugaaggacaauaaugauaaaaguuaauaaaacaacugcaauaacuaaaaaauuaccucuuuuuggcacaauguucuucaauauugcugucccaucucugggacaucaccaaacuaagcuccauuuccucuuuuucaaucugugguucauuuucuucaucaucacuauuuuguggauauuuauuauuuccaaaggagcgacauggugauggcauccuauuucuuuccccccgauauccaucacuuuccaaaccagcaagaagauguaccagagccucaucaggacuacuguccacuauaaaacaaguacaauaaucaccaacaaauaaguuuucuuuuuuuuuuuugacacggagucuugcucucucacccaggcuggaguuggagugcaguggcgugaucuaggcucacugcaagcucugccuccuggguucaugccauucuccugccucagccucccgaguagcugggacuacaggugcccgucaccacaccugguuaauuuuuuguauuuuuagcagagaugggguuucaccguguuagccaggauggucucgaucuccugaccucgugaucugccugccucggccucccaaagugcugggauuacaggcgugagccaccacgcccggccuguuuucuuaauaauccaacaauucagaucacucagaauaaaauaacaacaucauagauacuggcacaggcugaaagaauacaguugguacaaaggcucagguguugagguagcucuccuaucaaaguugauccuuggaccaccugcauuagaguaauuuagggacauuauuaaaauaacauuguugugugcuccagccagggcugccugggacugcacagggucuuggccguggguacagcucagcacugucagccccuaguugggaggccuugccagggaaggcuggcaguggcugcaggaagccugagaugccacucaaggggaggccacugaaggacugguugagugcagcccuggccagugagaugaggaggcugggaccauggcccuagccacccguguuuccuccggugaaauuugugauacucaccaagaaagaaccacuuaugguguuuuaguaauguacugaacuuugcaaaauauuaauucaaaauaaaugcauuuuccuucuuaaguaauacgguuuuccgugaaucaaaguacaguuaaaaaaacuauuuucuuucacaaauuuuuuuaagcuguauagaaaaaaagcaaagcuacuugauuuaaugcaagguuucauuuucauauucaguagaguguuuacugaacaugcaacauuuaccucuucaagucaauaaaaaaaaaaaugccucuucacaacacacauuuucucugaauuacaauacugaauauuuaugguagcacuguuacuuacugaaaacaggugacucacucagucuuugggucaaaggcugaaaagucugacuauuuuccauaagguucaaaauugcuucuucauuaauaagagcuucuuccacuuugugucuagugugaccuuaauuugacaaagaauaaaaaaaauugaagcaauggccuaaauccaaaauuuaucauuuagaauuuguguaaauuuggaagcauuaccauauaaaccuauuuuaaauuucaaaauguuaaugaugcaugccaaauaaaaacauaauaaaaagccacagaaauauuuaaccagucacauggauuuaucaaaacaaacacugaaucuauaaaucaccaaauauuuauaaccucuuuaauccuacuuaauguguguaguuauauuacucugauaaaaaucacugcauauucaaauauauaaagugaaaaggaaagauaaacuaucuuauuugaauacuaaaauucuuuauucucuaugguucaaaaacaacaaauuuagaauaaauguuuuugaacucuccuagaaaaaaaaaauugacagugcucauuauuugacacauguguauuggacucucuuuugaaugcauaaaaaauaaagagcuuaguguaaucccuaauggggcguguguugguuuuucaugccuguuugugaacuguaguugugguuucccauuucauugccauaacugggcagaaauaguuuuuaagugcuauaaaaauacaaagaaaugguuaagcaauuaaaaaauucauuuuacauuaauauuuuucagaaagcuuucauuauauaucacauucauuacauuuucaugauaucaaaaaauauuaguccauguggccauauggaauccuccaacaauugccguccccugaaggaacaccaaacugaacuacccacacaagaaagcgccuucauuagaauaaaaaaucaggagagcaaucacaguacuugguuuuaacaacguaucaaggaaagaggcagcgaagaggguagaaaagacagucgugaauugcugacagcaccucccaucucucaggcaguggucuugaggcacggagagagaaaucugugcuuaggagagacagaacagagugaauaugggacuuugcuuugcauuggaacucagugcuacccugucacaguggaaagcaacgucccugucacaguggagagcgacacgguauagaauuuagccagcacccaugaggagaggauuugaccagccccagccagagggaaacugcccaucccagcaguccagaaccugaguugcagccagccuuacuacuaugggcuaaagugcuuugggauccuaaauaaacuugaaagccagucuuauccacaaggacugcaauucuugggcaagucccagugcugugcugggcucagagccaguagacuugggguacacgcgccuggugagagaguagcuggggcagcuaaagaauuauuugugucacccccccucccccaaccuucacagucccaggcagcacaacucgcagcuccagaagacucuuucauuccacaagaggacaggagaggaaggagugaagagaacuuuaucuugcaacuuggauaccagcucagccacaguagaggagguagagucgugacacacauauuccaggcccuaacuccuggaugacaucucuaaacacacccugggccagaagggaaccugcugccuugaagagaaggacucagaccuggcaggguucaucacuugcucacuaaagagcccuuuggccuugaguaaacacaagugacacucaggcaguacuugcugcaggccucgggugagacccagggacaugcugacuucaggugugacccagugcauucacagcacugggaaaaauugaaagcccguucucuaagaucuggaacaagacaaggaugccuaguuucaccacuguuauucaacacaguacuagaaguccuaguuagaguaaucagacaaaagaaaggaauaaauaaagugcauccaaauuggaaaggaagaagucgaauuauccuuaucugccgaugguaugaucuuauauuaggaaaaaccuauagacuccaccaaaaaacaaauucagcgaaguugcaggauacaaaaucaacauaugaaaaucaguagcauuucuauaugccaacagugaacaaucugaauaagaaaccaagaaaguaaucccauuuacaauagcuacaaauaagauacuuaggaauaaacuuaaccaaguaagugaaacaucccuacaaugaaaacuauaaaacacugaugcaagaaauugaagaguacaccaaaaaauggaaaagauauuccacguucauggauuggaagaaucaauacugauaaaauguccaugccuacccagagcaaucuacagauucaaugcaaucccuaucaaaauaccaaugauauucuucacagaaacagaaaaaaaaaauccuaaaauuuauaaggaaccacaaaagaucccgaauaaccaaagcuacucugagcaaaaagaacaaaacuggaggucacauuaccugacuucaaauuauacuacagagcuauaguaaucaaaacggcaugauacuggcauaaaaacaggcacacagaccaauggaauagagaacccugaaauaaauucaugacugcagugaacucguuuuugaugaaggugccaagaacauaccuugggggaaagaacaauuucuucgauaaauggugcugagacauuggauaucuacaugcagaagaaugaaacuagacccugaucucuccaccauauucagaaauuaaaucaaaaugaauuaaagacuuaaaucuaagacucaaacuaugaaaauacuaaaagaaaacauuggggaaacucucuagaauauuggucugagcaaagauuuuuugggaaauauccccaaagcacaggcaaucaaagcaaaagcagacaaaugggaucauaucaaguuauuauacaaagcuucugcacagcaaaggaaacaaucaacaaagugaagagacaacccacagaaugggaggaaauaucugcaaacuauccaucugacaagggauuaauaaccaaaauauauauaacucaauaguaaaaaaucuaauaauccaauuaaaaaaucggcaaaagaucugaacagacauuucucaaaagaagauauacaaauggcagacaggugaaaagaugcucaacaucacugaucaucagauaaaugaaaaucaaaauuacaaugagaaaucaucucacccuaguaaaaauggcuuuuauccaaaagacaggcaauaaugaaugcuggcaaugauguggaggaaagggaacucucguacacuguugguagaaauguaaauuaguacagccacuauggagaacaguaugaagguuccuuaauaaacuaaagauagaacuaccauauaauccagcaaucucucuacucgguauuuauccaaaggaaaugaaauugguaugucgaguugaagagauaucugcacucccauguuuaucacaguccuauucacaacagccaagauuuggaagcaaucuaaguguccaucaacagaugaauggauaaagaaaaugugguacauuuacauaauggaguacuacucagccauaaagagaaugagaucaugccauuuccaacaacauggauagaaguggaggacaucauguuaugugaaauacgccaggcacagaaagacaaacuuugcauguucucacucacuugugggggcuaauuaauaauuuaaacaauggaacucauggagauaagagaguagaaugauggcugccagaagcuaggaaggguaguagggugggguggggaaguggggaugguuaaugaguacaaaaaaauagaaggaauaagaucuaguauuugauagcacaacacagugacuacagucaacaauaaucuauuguauauuaaaaaauaacuaaaaguauaauuggaauguuuguaacacaaagaaauauaugcuugagguuauggauaccccauuuauccugaugugguuauuacauuguaugccuguauaaaaaucucucauguaccccauaaauauauaugucuacuauguacccacaaaaauuaaaaaaaauuuaaaaguaaaauguaaaauuucaaaugcauuaaagaccuaaaugugaaaaaccaaacuguaagcacacguaagccuuaaaaugaauacuuaagagaaaauuuucauuacaucaggguagggaaggucucauaaaucacauaccaaaacuaaaccauaaaggaauauugguaaacuugacauuaaaacugaagacauguaaaaccccaaggauaacuuuuuuuuuuaaauggggggaaaagaaguuaacauuuuuuuuugaagauuuuuauaagauaagccuagauggagagaaaacaucucuacaauaaguauaacugauaaagacuuaauaucuagaaaauaugaagaacuccuacaaauaagaaaaagacaaaugacucaauagaaaauaagcacaaaauguaauucacaaacagagaaacccaaauggccuuuaaagaugcucaaauucauuaguaauuaggaaaugcagauuaaaaugcagagacacuauuucaaagaaucagagcagcaaauuuuuuacaucuauuauuuuauccuuauuauuugaugcuaucaaauguugaggcuuugcuugccuaguaaaauugcguaugauacaaugugacuucugaguaaaacuuuuauuauugucuuguuuacuaaccauguauaagcuaauugcauuauagaaaaacuguuagaacagaugcuaucuagguagaguacaaugcauacacccuaacauucagcaacucacucuucuacauguguuugguagagaagcuccugcacauagccauaaggagacagauguagcacuaagugcaaaaguaaagaccaucuaauacuuguagagaaauagcuaacauuguuguuuagucuuaaaauggaacagucaucagcagcuaaaaugaaugaacaaggauaaauuucaaaguuauaauguugacauaaagaugcucgacaucaguaguaaugaggguaacgaaaauuaaaaccacaguaggauucuauuucacacacuaggauggcuacauuaaaaaaagacagauaauaacaaguguuagugaggauauagagccagagaaacucucauauauugcuggugggaaaguaaaacauugcugucacuuuaaaaacagcuugggaguuuauuuaaaaauuaaacacaaauauaccacaugcccuaguaauucuuuugcuuggcagagguaaucuuuuuagugacguuuauucuuaaacuguuucauuuguuacuauugauaucauuuuacaacuuuaugauauuuauccuaaaauuuaugcuuuacugcuuauaacagcacuauuuuuuuuuuuuuuuuuuuuuugagauggaguuuugcucuguugcccaggcuggaaugcaguggcaucaucuuggcuuacugcaaccuccaccuccuggguucaagccauucuccugccucagccuccugaguagcugggauuacaggugugcgccaccacgcccggcuaauuuuuguauuuuuaguagagacagaguuucaccauguuggccaggcugguugccaacuccugaccucaggugauccgccugcuucagccucucaaauugcugagauuacaggcaggagccacugcuccuggccagcagcacuauucuuaccaggcaaaagugaaaacaacucaaaugcugaucaacugauaaauggauuaacaaaaugugguaucuccauacauacugauagauacuacaacauguauaaaacuugaaaguauuaugcuaaguaaaagaagccagacacaaaagacuauauauuguaugguuucacuuacauaauauacaguaucuagacaaggcccauguauuauuagugguuacuugggguuugagguggaaauaggcauaacuguaaauggacacaagggauccuguggacugauggaaacauucuaaaacuggauuguggagacguuugcacaacuuuguaaaucauugaauuauacgcuuaaaaugacugaauuuuauguuauauaaauuaaacuucaagcugcuuaaaaauauaaugcugagugaaaaaagcaaguugcuucaucuacgccaagcagaacaucauuuacguaaaauuuaaaacuuaaaacaaugguauauauggugggcaaacauuauaagaaaauauaaaauuauauaugguaacaguuugcacuaacuucaggauacugcuuaccuuuagagauguagaaagggugacagaaugggagaaauuuuugcuauauccacaauauuuauuucauagggaaaaaaaucccuagcaaacucaaucaaauauuaacaucucagugcuagauaucuguucuaguaguuucuguauacaugaaaagaaaaucuuaccuuugcuugacucuuugucuuugugaacuucuaccauauuggcugguguacacugaagcauuucaggagacagaaccucagagugcaauguuaacucagcagagaacuccugggauccaucgcuguaguccacagauccugauaauguucugcuuaauuaaaacauauccuuuauaacagacuacauaacaaaggaauaaaauuaguucugagaucuauaauaaauaaccacuuacacagagaaaucauucuguuugagaauuuccugaagucucuucugaaauuuuuuuucacuuucuguugcuggcacaaaccugugaucuuugaauuuuaaaagugcauuaaaaaauguaaauagcaaaugaaugaaauauuuucccuucuccuaaaguagcuuuaaaaaugguggcaauuuccuaucuuucucuagauauacauaauacaaccuaacuguaguuuuaccauagaaucacacaaaagagaaacgguuguuacuaaaguuauaaaauuaggcacuuaagucaguucaagauuaaguucuauaauuauaaucuaaaucuaaaacagaaaaauuguucucuaccuauaaauauauuguauccuaaagcuaaaaauuuccccucauaaaauauauuucuauuuuuaaaaguauaaaaggcacucaaaguuuaucaaaacauuuuuagugccuaagauauaauaauuuuaauugaacuucaauauaggcuuacugcuguauuuugaaauaauauaucugccuuuugaaugaugucguucacucuuuuaccuuuauuuuuaaaacuguuguauccaugguauuaucuaaacccccucgaauucuuuuugaauguggcaccauuuagcaauaaauguuucuuuagagcuguacauauugaacaaagugagagcuuauaugacauacucagaaaauaaacugugggcagcauuucaauggcuacauuuucaaagcuuaauguauuaaacaguguuucuaaguugagauucaugaucuucugugaguuuucuauagcucauuuggaaauacagagggcuagaacauacuagagaaugaaaacaaaaaagugaggcaagaggacaagguacauuaaaaacaaagaacaguaaaaacgucaacuucuuacaaagagauaauaagcgacaauuggagacagcuguaaagauaaauaguggcuguacagcaaugacaacaagaaaaauacauacaaaauauaaaggucauuugaaaaguaaaaucuaaugucaaaggaacaacucaaugacaaacuuuuccauuaaaauacuugauuuaaaagaauaaucagagcacuauuagguuuauaccuugugacucagguuggcucauuugagaaguuucauuucuguuucuucgccguugcuuuucaucuucccauauggccuguagaccaggguuuccaccaauuugagcuguaaucacaauaauacuucaauacuacagggucaaaguaagaaaugccuaaaaaaucuaaacuuuucuuuaacaaauacugccuuuaaaaaaaccaaucacauauuuuguguaauaaaguggacaaauuaucccaaccuacacuuacuauguuacuccuuuuuuaguuuucuuccuagugguuccccaaaauccagcaagugaauacaauucaaacaucugaugauagucaauagaccuaagagucccuuugcugauauauaauaugaaaauuaagaaauuaaaaggcacaguacauuaaauugcuuuauauuagcuaauuuuauuuagugucacacuuauuuuaguaucaucuauucaaauauagucauuuggacaaaaauauaaacaaaaaauuaauaccucaucagaaguauagaagcaaucuucauaacauuuuguauccuccuucuauaauaucuuaguuuccucguaaaguuuucuuuccuacuuuuucuauuccauuuuggucauuaauuuuuuuuuuuuuuuuuuuuuuuuuuuugagauagagucuugcucuaucaccaggcuggagugcaguggugcgaucuuggcccacugcaaccuccgccacccaggcucaagugauuccccugccucagccucccaaguagcugggacuacagacgugugccaccacacucagcuaauuuauuuuguauuuuaguagagacgggguuucaccauguuggccaggauggucucgaucugaccucaugauccacccaccuuggccucccaaagugcugggauuacaggcgugagccaccacacccgccggucauuaauuuuaaaaaauaaaaacauauauuaagaauaauuguguaugaaccuucaauguccagacgauuuaagauaucagcagcuacagcauccacuucuaauucacauguacucugugguucaacaccuuccaauauuaaagagcugcaauuaaaggauauaaaaaacauaauaauuaugugagagcaaacuuucuaacauuuuucuuacuuauacaauuaucuuacauuuagcuuguacccagaaaaccugauauauuaauucacaauuauucugacaaaauugauacuuuauauguauauauaaugaaaaauaggaugagaaaaauacaaaacauauuauacugacuacccuagauccuuuugaaguaaauucuacguauuuugguucauuauauuuuauauaaaaggaauauaaaacguuuuagcauaugguuauacccggggcagaaugggauaggauaauauaaaaaccucagaggaaugcauaaaaaaccauacacauaugaaaucaguugccuagagacaucuuuuucaguauucaaaaaacaagggagaacaugcaauaaaagggaaggugagcacacugagaaaugggcaaacgauauucaccauucuuccugcccucaacuacugcugagauagggaauacuuuaaaauucuucauaacuacagaacugauaaaauguaugaaugaucaacagugggaucauagcuaggaaaaguaaugauaucaccaggucauuaauuuuuaugagaacuacaaaggauuguuucccagucuggaucuuugacucaaaagcauuugcuuuucaucagugccccaaaagagaagauaaagaagacaccacauaauugacccuacuuaacagaaugaagagauaacaucuaguguggauccuaguuuacucauuccaaaauuuaggccuuguacaaaaauggacaccaaguggaaaaggggagauccuuaauuuuacuacaaagugguugaugacauauuucauuaacuuuugauuugaaacacuuugguauuuuuuuuuuuuuuuuucagauggagucucgcuccaucgcccaggcuggagugcacuggugcgaacucagcucaccucaaccuccaccucccagguucaagcgauucuccugccucagcuucccaaguaacugggauuacaagcaugugacaucaugcagaguuaauuuuuguauuuuuaguacagaagggguuucaccauguuggccaggcuggucuugaacuccugaccucaagugaucugccuaccucggccucccaaagugcuggaauuacaggugugagccauugcgcccuggccuugaaacacuuuuuaauguuuuaagaaaaacauguuagcaaaaacucauuuuccauugucuauuuuaaaggaaauuuugauggaauauuacauguuaguuguuaaaccacagaauuuucacaacucaaauaauauacguauauauguacucacaaguauauauuuagauguucaaacacacguaucuuuucaccauugauagagaaggaauauaauuagccaaccuaucauaauauauuccuuucucuuucagaaaaaauauuucucaauauagauugucagcugcgcuugguggcucaugaaugugaucccagcuucggcuugggaggccagccugagcaauauagugagaccucaucucuacaaaaaauuuuuuuaaauuagccaggcauggugcugcacaccuguagucccagauacuugggaggcugagcauuauaguaagaccucaccucuacaaaaauuuuuaaaaacuagccaggcaugguguugcacaccuauaguccuagauucuugggaggcuaaggugggaggaucacuugagcccagaaggcggcggucguaguaagcugagauugugccacugaccuccggucugggcaacagcgugagaccuugucucaacaacaacaaaaugugaauuguccucuucauucauacaauuuaacacacauugaaguaucaaauuuaaaaauguuuaugauccacaguuuucucauauaaaaaaguuuuauaauuugaaauaauuauguuguaaaugucaaggaugaauauucccgaaguagcacauuugagagaaaggagggaaacaauaaccucaaaaaauauaaucucacaguagaaauuuacaacuugcccuuauacaaaacuacuucagacauucagaacaggagguguuccuauggaggggaaguaguuuucagaauuaaaaauuagcaccaguagacagaaaauguaugaguaaaaaauuugcauaagcaaauacauagcugcuuugaaauagagaaauccaagcauuuggaauauacugccuccaaaaaaaaucuaaucaauaaugaaacaaauaaauuacaaauuauauuauucaaaaccagagcaugucaaaauacuuuauuacuuauuuaauauuuauaaauuuuagggguuauuaaaaauauuuagauuuuuguuuuaaauuacuauuuuaucauaaauguaauuguuuuacuugacaaguuauaggauaucaaauuagaauagaugaugaagaugaauguugcagaaaaguauaacaauaucuaccuuguauuccuuuuguuaauuagguaauaacuaguacauuuucaugguuuguuuuuaaaaucguuuauuccuuguaauacacuaaugucaagguuuguuucuguuaaguguauagauuaaaaagauccaauacaauaaaagguuaaaauuuaauuaugguaaccacugauuucugaucacaacuaggauauauguaaaauuuucauuuccuuuacaacauuaacuaaccuugguauuucaucuuguucccaccgaaauaaaguaucagcaagagaauuuccugauaaaugauucuugcaggauccaguugcaugcaauguauuaccuaggaauagaaagguaaaaggaauaaauucuacuuucaauuuucauauaauuacuuuuuagaagguaaauuuuuuuuuuuuugagauggagucucgcuuuguugcccaggcuggaguacaguggcgcaaucucggcucacugcaagcuccaccucccagguucacgccauucuccugccacagucucccgaguagccuccaagcgcagcaaauuuuuuuuguauuuuuaguagagacuggguuucaccguguuagccaggauggucucgaucugaccuugugauccgccugccucggccucccaaagugcugggauuacaggugugagccaccaugcccggcugguaaauguucuuuaaaaaauuuuauuacucauaaauuacagaucccuuuuuauugauacauaauauuuguacauacucauagagccacaugugguauuuucauacaugcauacaaucuguaaugacaaaaucaagguacuuaggaugccaucagcccaaacauuauucaccauuugugucgagaacauuucaaaucuucucuucuaguuauuuugaaauauauaauguauuguuguuaacuacagucacuccuguaugcuaucaaacacuagaacuuauuucgucuaauuguaugucuauauccauuaaccagccugucuucguaucuuccuggaacccuucccauacacccuucccagccucuaguaacuaccuuucuucuuuuuauuuauuuuuuugacaugacaucuugcuauguugcccagacuggaaucaaucuccuggacucaagcaauccuccugccucagccucccauguagcugagacuacaggggugcaucacgacuccuggcuaaagacgaacuuuuuuuaguucccacaucaguaagaacaugugauauuugucuuucuaggccuggcuuauuucauuuaacauaaugaucucaauucuauccauguggcugcaaaugacagaauuucauuuucauaaaaaauaugguagaauauaauuccauuguguauauauaccacauuuucuuuauccauucauccacugaugugcacuuaagguugauuccgcaucuuggcuauuauaaacagugcugcaauaaacauggggguguagguuaucuaucuuugauauauugaauugauuuccuuuccuuuggauaaauacccagcagugggauugcuguaucauaugguaguucuaguuuuugguuuuugagaaaccuccauacuguuuugcauaauggcuguacuaauuuacauucccaccaacaguguauaagaguuuccuuuuccuugcauccucaccagcauuuguuggugucuuuuccguaacagccauucuaacugggguaagaugauugcuuacugugguuuugauuugcaucucccugaugauuagugauguugaacauuuaaaaaauauaccugccggccauuuguaugucuucuuuuuugagaggugucuauucagauacgaaacuauuuuuuuuccuguugaguuccuuacauauucuggagauuagucucauuucaugaauaguuugcaaauauuuucucucauucuguaggcugucucuuuacucuguugauuguuuccuuugcugugcagaagcuuuuacacagucccuuuugucuauaugcuuugguugccugugcuuuugaagucuuagccauaaaauuuuuucccagaccaaugucccagaguaucuguccuacaauuuuuuuuuuuuuuuuugagacagggucucacugucauccaggcuggagugcaguguaugauuauggcucacugcagccuugagcuuccaggcucaaaugauccucccaucucagccucccaagcugcuggggcaacaggcaugcaccaucgugacuggcuaauuuguagagaugggcuuugacuaucuugcacaggcuggacucaaauuucuuggcucaagugauccucccaccucagccucccaaacuguugagauuagaagaguaagccaccaugcucagccuaugugucuguuuuuauaccaacaccaugcugauuugguuacuaaagcuuuguaguauuauuuugcucagccuguguguccauuuuuauaccaacaucaugcugauuugguuacuaaagcuuuguaguaucguuuugaccucagguaauaugaugucuccaacuguucuuuuugcucaggauugcuuuggcuauuuaggcucuuuuguaguuccacaugaaguuuagaauuuuuuuuucuauuuccaugaagaaugucauugguauuuugauaugaacugcaaugaaucuuuagauuuuauuggaaaauauggccauuuuaacaauauuaauguuucugauccaugaacaugggaugucucccauuugucuauuuccacugucuacuucaguuaauuuuaucaguaauuucuaguuuuccuccuauacaaccuuuacuuccuugguuaaauuuauuacuauucuuuuugguagccuuaauaaaugggauuguguucuuguuuucuuuuucagcuaguuguuauuggugcacagaaaugcuauuaguuuuuuguggguuuuaaaaaaaaaucugcaacuuuacuaaauuuaucaguucuaagaguuuuuuguuggagucuucagguuuugccauauauaucaugucaccugugaaaaagggacaauuugaccuccuuuuucccaauuuggugucuuuuauuaccugauugcuauggcuagaauuuucaguacuauguugaacaggagugguaaaaaugggcauccugucuucuucuaguucuuagagggcagguuuucagcuuuuccccauucaguaagauguuaaauguggguuuuucagacaugauguucauuauuugagguaugauccuucuaugauuaacuuaucaagaguuuuuaccaugaagggacauugaauuuuaucaaauaacuuuucuguguuagcugagaugaucauaugguuuuuguccuucauucuguugaugugauguaucacauuuauugauuuguauauaaugaacaauccuugcaccccugaaauaaguuuuuuuuugagacagggucucacucugucacccaggcuugaguacaguggcaugaucuuggcuuacuguaaccuccgccuccugggcucaagccauccuccuaccuaagucucccaaguaggugggacuacaggugcaugccaccauacccagcuaauuuuuuuauuuuuuguagagacaggguuucaccauguugcccaggauggucucaaacuccugggcucaagugaucuacccacuucagccuuccaaaguucugggauuacaggcaugagccacugugccuggcccuaggauaaauuucacuugaucaugguguauuuuuuuuuuuuuauguuuuguuggauucgauuuguuaguauuuuguugaggauuuuugugucuauguucaucagugaugcugaccuguaguuuucuuuuuuuguuguguccugucugauuuugguaucaggauaaugcuggcuucauagaaugaguuaggaagaauuucccccucuucaaauuucuagacuaguuugagaagaauugguguuaguuuuucuuucuaaguauggcaggauucagcaguaaagccauccagaccugggcuuuucuuuauugggagaccuuuaaauuacagauucaaucuuguuacuugugauucgucugcucagguuuucuuuucuaaaaauuuaaaauagagacaaggucucacuguugcccaggcuggucuugaccuccugagcucaagccuuccucccaucuugaccuuccaaaaugcuaggauugcaggugugagccacugugccuggccagguuuccuauuucuuccugguucaaucuugguaugcuguaaugcguccaaaaauguacacauucccucuagguuucccaacuuguucacauauaguuguucaugauagucucugaugauccucucuauuuguuauauaaauuguaaugucuccuuuuucaugucuaauuuuauguaugucuucuuuuuucuugguuagucuagcuagcgauuuauugaucuuuucaaagcaccaguuuuucauuucucugaucuuuuguauuuuuuuuuuuagucucuauuuuguuuaguucuacucugaucuuuauuauuucuuuucuucuucuaauuuuggcuuuguucuugcuuuucuaguuucuuaaaguacaucauuacauuguuuauuugaaaucuuuuuuuugauauaggcaccuauugcuauaaacuuaccucuuaguacuguuuuugcuguaucucauagguuuugguauguuguguuuccauuuucauugguuucaagaaauuuuuaaauuuccuucuuaauuucuucauugauccaauaaagguucaggagcauuuuguuuaauuuccauguauugguacaguuuccaaaguuucucuuuuuauugauuucuaguuuuauuccauaguggucagaaaagacacuuaauaugauuucaauuuucuaaaauuuguuaagacuuguuuuguggccuaacguaugaucuuuccuggagaauguuccacaugcagaugaggagaauguguauucugcaacuacuggauaaaauguucuguaaaugucuguuagguccauuuggucuaaagugcaguuuauuuauuuauugagacagugucuuguucugucaccaggcugcagugcaguggugugaccacaguucacugcagccucaauuucccaggcauaagcaauccuccuaccucagccuccugaguagcugagaccacagguguaugccaccacaccuggcugauuuuuaucuuuuuuguaaagaugagaucucacuauguuaccugagcuagucucaaauuccugggcucaagcaauccuccugccucagcuucucaaagugucaggcuuacggugcccggcucuaaaguaaaguuuaaauccaauguuucuuuuuugauuuucugucuagauuaucugccuaaugcugagagugggguguugaaguccccagcuaucacuguauuguauuggcuaguuggggacuucaacaccccacucucagcauuggacagaugcuaagaaucaaaucuaauaacauuugcuuucaaucuaauaauauuugcuuuauauaugugggugcucugguguugggugcauacauauugagaacuguuacaucuuuucagcacucuacauguucagagaaacuucucuaguagcaaacuauaggaauguucccuuuaaguaaaauaauauauaacuuaugugacuaguuacuaaaauuguauccuaaaaauucauauacagcaagaaauacauacucaguugaaaaaugaggauguuaaaaaaauauaaaaugcuucuguggugcucaaaacauuugcuccauuuauuccucuuuuacccauguggggggaaaaaaagaaaaaagaaaaaaaaaauugucccauuuacauacuuuauacacuucauuuuaacaacuacaguaauuagcaucauuuccauuucauuugaccacugauuauacaacugagugcugaggcaaaacuguauaugcacauauaauauucaaauuucuaaaucauuuucauuuuugaauguauuuuacuuucaaaaguaaaacuccauguauuauauuaauuuaucagguaaaaugaaguuaugcauacauguaauacauauauuuacuuacaagaaguuuacugucaaguuaaacuguaaugugccugagauaacaugauaaaauaaaauaaaaaaaauuauucacugauuuuguacaugauuucaguauaaucuuuuaucucauacuaaacaaaaacaaaaaccugagggcuaacuauaugauaaaagaagauguaaauuuuuuuaucauacugcaauuucccuguuuuuaacuuccuuucuaccaaaacuaauugugauuuuugccauugaaaguaacagcaaaagcugcaauuacuuuugcaacaaccuaauaaauuucacaugaugccuucaaaucuguaaacacuuccgauauucugaaaaaaacccuucugaguaccauuccaauaaucuaacuuuuauaaauaaaauaaaugguuucuguauauuugcuaauucaaacuauucuugugcuuuuucaccuacuggaaaaaacuaauuaugaaaauuaucuccucuuucuauaauaucuaauguauauacucuagaaacucuuccauuccucaaucugucuuaaauucuugguuauacuugacaaugauaacuaacuuauuauuuuccccaguaaccuuuuuauuuuuuaauaacuuuagauuuacagaaaaguuccaaguuccaaggguaccacagagaguuuccauauaccagacaccugguuucccucauuguuaucauauuaucaugguauaucugucaaaacaaagaaacugacacuggaagauuacuauuaacuaaacaaaaccuuuuauuugaaugucaccaguuuuuccacuaauguccucuuucuguuccaggauccaaucuaggacaccacacugcauucaguugccaugucuuuccagucuccucuggucuauuuaucugucuuuccuugcuuuucaugaccuuugcagucaugagaacugaugagauaaccuguaggacaacucccaauuuggguuugucugauguuuuucucaugaguagacugggguuacgaguuuuuggcaagaauaucacacaggcgaaguaccuuuguuaucacaucacaugaggggccacaugacacccacaugacauaauaacuggugacauuaaaccucaucacuugguuaagguacaucacgugguuauagaguuugaugaaugaauagucauguaaccaccaacccaggacuguacagaauaauuccuucacucuuaaaaaguuccccuguacauccccuuugcagucaauacuucccucucuccuaaacccuaacaacuaauaguccauuuucuacuucuauaguuuugccuuuuccagaaugucaugugaaugaagucacacaguuuguauccuuuucggucuggcuucuuucacuuaguaaaaugcuuuaaagauucauccauguuauaugaaucaauuguuuguuccuuuuuaucacuaaauguuaucaaaguuuauccauuccccuguugaguggacaucucgguugcuuuacauuuuuggcaguuaugaauaaaguugcuauaaacauuugcauacagguuuggguggaccuaaaucacuuagguaaacauaccuaggagugccaucacugggucgcacucuaagucuauguuuaguguucugagaaacuaucugucuuccaaagugacuauauuauuuugcauucccaccagcaaagaaugucagcgcugcuguuccaccucuuggucaacauuuguuauuguuagucuugcgaauuguagucauucuaauagguauauagugguagcccuuuguaguuuuaaucuguauuucccuaacgacauauaauguugaauaucaucuuuucauguguuugccauccuuauaucuucuuuaggucuuuugaccauuuuuaauuggacuguuugcuuucuuauuguugauuuuuaagaauucuuauauauuuuauacacaaguccucuaucagauuguaauuugcaaacauuuucucccaguccaugacuugucuuuucauuuuuuaacaguuuuucacaaaguaaaaguuuuuaauuuugacaaaaucuaacauuaauuucucuuuucauggaucaugcuuuuggugucauaucuaaaacuucauugccaaacccaagacuggguacauuuucccuuauuuucugcuagaaguuugauagguucauauuuuacauuuaaguuugugaaguauuuuaauuauuauuuaaggugugaaguaugugacguauaaggugugaagaacauacaaaaauauguucuuuuauuuuuauuuucuggcauauggacauccaauuaucccagcacuauuuguugaaaaggcuaugcuuucuccauugaauuaccauuauaucuuugucaaaguuaaguugacuauaugggccaauuauggauuauuucaaauauaggucuauuucuggacucuauucuguuccauugguauauguguuuaucuuuuugccaauaccaugcugucuugauaacuguugcuuuauaguaagucucgaaaguggguaaugaacucccuaaaccucaacuuuuggaagucuccauacuuuaaaaaaggauuaucuccuggacaugaaauaauacaaccuucacaaagaugggagaaauugguggacaguugucucuguccugcuuuucuucuaucuucccucuuccuuccuuuccuuucagucauuauggagaaaaagccaagccuacuucauccuucauuauaugauucccucuugggaauucuaaggaccaagggcaaguuauuugcucacauacuuugguuuacugugggaauuuuauacuacucuaagauacagagaagauaagaaaaacuggcauuuaguaaacuauaaguugucaucuaaaccugagguuauuauccagaagaauuaguuaugaacaaaugaauuacucugcucuaaaagggaggcacaugcuaguuucaaugcuucaauauuuguguauuuaaaauaaaaauguaauuuuaacaaguugucaccacaaaacauucucuucugaaaaaaaguuuaaaugcauaaguuguuccacauaagaaaauuacuagcaugcuggagagacaaaacaaauaaaacuauuagugaauauaacaugacauuagagcauugcauauagcaucauuauuugauaaagauucuggaggccaggcaugguggcucaugccuguaaucccagcacuuugggaggcugagguggguggaucgcuuaagccuaggaguucugagaccagccugagcaacauggcgaaacccuaucucuacaaaaaaaauacccaaauuagcuaggugcgguggcaugcaccuguagucccaguuacuugggagacugaggugggaggauggcuugagcccaggagguggagguugcagugagccauguucacacuauugcacuccagucuggugacagcaaaacccugucuuacaaagaaaaaaauaauaaaaaauaaaaauaauauccucuagggaggauuugcacuugcugcuucugucagaucugagucuauuacuagaccagcaccaccuuagaucaagcucuggauuugggaaucucuuuuagucccaggagauucaaacuauacugaaaaaaaaaugucugaaguauguuccauuucccagucugugcucaccuuaagagaauaugcauuugaggcccuaccuuaaccugcggagggcucccaccugcugggcaggacccacuucugcuuuucaucucucucacccagcauggccuucccaaagaagguucuuaauuuuccaagauuaguaaaugcccucaggucaaaaguugcuuuaagcguucuauucccuuuuggccugcacuucuuuauuguucauaaacucuucaauguauuuaaauuuuuuuauuucaauguugccuggcccuuaaauuguuuuuagcagaagggcugaucccacuaaccuagcccacuauucacggcaacaaaaagaaacccucccuggugacuuuucagagcauaguuuggguaugguagaagaaaugcgaggaguuaaaccaaaagugaacuaagagacaaaaaaugcuaaccucugcuucaagaagguugacagugauggaaaagaaaaaaaauuauggcaguuagaaaggauauuaggacuggaagugucaguuucauuuuaagagaaguagaagggaaggaauucaaugagaagaaaaggcaaaagaugcuaaaacacuugacacagaaauucuacucccagguagguguccaagagaaaugaaaauauauagcuacacaaaaauucauaaauggauguucacagcagcauuguucauaauagccaaaauauccauuaacugggauaggaauaaauaaaauguaguguauucacauaacagaguauuauuuggccauaaaaagaaacgaaguacugauauaagcuacaacacugaugaaccgugaaaacauuaugcuaaguaggaaaaaaccccacauauuauaugauuccacuuacauuaaaugugcaguaugggcaaauauacagagaccaaaaguagauuaguaagguugcucaggagugggaaacaugggaagcuugggggugacugcuacaggucauaggauuucuuucagaggugaugaaaauguucugaauuuguggugaugguugcauaacuccaaauacaggaauaccccauuaaauugugcuuugcuuuauugcauuuugcagauauuaaaauuuuuacauauugaacauuuguggcaacucugcauugagcaaaucuauuggugccauuuuuacaagagcauguguucauuuugugucucucugucacauuuugguuccucuugcaauauuucaaaccugugaacagugaucucugauguuacuauuguuaauuguuuucagguaccacaauaaaccgugcccauaaaagacagcaaacuugaguguguuccaacugcuccacugacuggccauucccguuucuuucuuuccuagcaccuuccuauucccugagacacuacgauauugaaauuaggcaaauuaguaacccuacaauggccucuaaauguucaaaugaaaggaagagucacaugucucucacuuuaaaucaaaaacuaaaaaugauuaagcuuaccaaggaaggcaugucagaagccaaaauaagccaaaagcuaggucucuugugccaguuagccaaguagugaaugcaaaggaaaaguucuugaaggaaauuaacagugcuacuccaauggaacacacaaacgaugagaaagugaaauagccuuacugcagauaggugaaacagcaggggcugauguagaagcugcagcaaguucucuggaagaccuagcuaagauaacugaugaagguggauacacuaaauaacagauuugcaauguagaugaaaacaaccugagagcagucaaugccugauuucaaagcuucaaaggacucucuugguaggguuauuuaaugcugcugguaacuugaaguugaagccaaugcucauuugccauucugaaaauccuagggcccuuaagaauuaugcuaaaucuacucugccuguguucuauaaguggaucaaaaaagcauggaugacaguauaacaguugcagcaugguugacugaauauuuuaagcccauuuuugagaacuacugcucagaaaaaagauuccuuucaaacuauuucugcucacuaacaaugcaccuggucacccaacaggucugauggagauguacaagacgacuaauguugguucccugccugcuaacacaacauccguucugcagcccaugggucaaagaguaauuucaacuuucaagucuuauuauuuaagaagugcauuucauaaggcuauagcugucacugacagugauuccacugauggaucugggcaaaauauauugaaaaccuuccagaaaggauucaccauucaagaugcucuaggcugcucuggucuguaacuuuccauuccaacaguaaaaaaucugggaucuccuacuuuucaccucagaaagcuacaaauguaaaaggaaaaauaaauuuguuuugagaggaaaucacuuauucaaauagccauguuauucuguuuuguucauaauaucaacggcucuauaaauaaagaacuuuaaagaaauagcaaauucacccagagaaagcucugccugcaauauuuuucaggucaugucacacaaagaaaaauaacaaugcuugcacagcccacugagauaaaauggacaaggauguucagugguggaggugauggcucaagggacuuaggaauccgucuggaaugcugagagaccaacacguccacuaaccuacagcuauucacaccaucagggaagugcuggacuaaaguaacaaggcucuaacaacuccagggauuucuagaauuguguaucauauacuauuccuaaaauauaaaaaguaacauuaaggucugagguuaaaaaaaaaaaagaaucacaauacauaucaauugcuaagcaguguaaaggguucacuuuugcaguggucuagaacuaaacccacaauaccuuuuagguagccuguauacuaaaaaccaucaaacuguccucuuuaaacggauauaaauuauaacucaauaaagcuguuaccaaaaaaaauuuuuucugagaugcuuuuccugacaaucucuaaucccacuuugcauguauuucuuuucauucuuuagucacucaacauuuauuuucuaaauauauauuauuuuauaaaucacugacuauauaacacuuguuucaaaacuuuaauuugacaaaaauuuaauuugacugaaaauuaaccuuacuuuuccuucuugcuuuucggaacuugacagcagccagauuuauuaaauucaugccauaaagauuguagucaaugaagagcuguaggagguagggaauaugcgcuucaugaggcugguaaaauuuauucauuauggcuccgcuuugcaaaaguucacauauccuaaauuagaaaaaaaaaguuuuaucauaaaauuauguucccuaaaauguuaaaugaaacaaugauuauagaaauauacagaacaaagcacuuauuagcacacaaaauuuccaucucaauuuuaccggaaauuuguauuuuguuagaaauuaaaaguuucaaucaaguuuucaaguaagcaacauguucugaauaacaaaaaacugcauggaugaagaauauuuugucuuaaaccaauuugauacuaacuauauuuaaaaauuaaaagguuuuuaaaauaaaauuuuucuuuuaaaaauaacaaauaauuuugaaaagauuaauauucaaaaaaggaaaagaaaucauuacuuauaaucccaccacucagagguauugccauuuugauauuuuucuuuccugaguauuuuuuuucccuucaugaugacgaauacaaacaacagacaauuauauacagcauaguuaaguacuauguggggaaauacauuaaacaucuagaaaagauacuaaacagauagagguacagaggugguuucugcaaaaccuuagagaaacucucuaagcaagagacuaaaugaugaacuagaggcacuuuuuucucugaagagagggaagaguauucacguaaauaaaacugcacauguaaagggucacgagaaaacacggcuuauucaggaacugaaaccacugaguaagacugugaccuagugucagaggcagggauagagaaguaaugagaaguaagagcaugaagagccuguuaagacauuugaagagguagugaaauuugucugagaggugaauagcagaaaagugacaucaccagacuagcuauagaacacagaagacuacagguaaggaguaaauaggcuguuguggaaaaacuaaggaugguggcuauaacaaggaucauagaaauguacugauucaggagacauauaaggggugaaaugaucaggccuugaugacuaacuagaugugaagggugagacagaaaaggggcugagggugaugccuagauuucuugcuuaagcagcugguuagugguggugcaauuauuugaaaggggaagaacuguaagaaaaauugguuugggauuuuuuggaaggggaauaaggauaaacucaauuuagacacaagggcauuuagguauaguggggauccaauaauaauauuggaaaugaaucauaaagaaaauaauaaucauuuuauuaacacagcagagguaacuaacauuucugagcacuauauauuggauacugugcuaacguacuuuauuacaaguaauguuuauuacaagucugugguacgaucaucuccauuuuauaaauaaagaaauuaucuuagauuuaaaaaucacacaaaagauagaagagcucugaggugggaggaccaccugagcccaggaguuccagguuacagugagguaugauggcgccacugcaugccauccugggcaacagagcaagauccugugucuuaaaaaaacaaaggggcuaaaauucaaaucaaaauuucucugccuugugagcccucacucuuaaccacucggcuauuccaucuauccaguagaugguuugauauauuguuuagaagcucuagagagaaaugaggcuauucauauacauuuggaagucaaaagcauaaagauaaacaaaaacaaaaguuaaaaccaaacaaacccaugggaguaaauaagucuguagagggaacagaaaauauacagaguaaagaugaaagucuaaggcagaauucuaagaaacaaccauagauguuaaaauguaaaccaacaaaauggcagaaauaugauugaucacacuggaaugagaaaaacuagaggugguauauaucacagaagcuaacauuuaggauuguuuuaaggcaccauaagcaucaccaugaggucaaaaaguaaggaccuaaaauuggauuuagcaacacagaggucauuagugaaagcaauuuucaguaaaaugguugggguagaagccauauuguaguaaguuaaagagugaaugggaaagccgagcacaguggcuugugcuuguaaucccagcacuuugggaggcugaggcagguggaucacuugaggucagggguucuagaccagccuggccaacauggagaaacccuguccuuacuaaaaauacaaaaaaauuagucagacguggugguggugccuguaauccuaacuacucaggaggcugaggcaggagaauugcaugaaccccggaggaugagguuacagugagcugagaucgugccauugaccuccagccugagcaacagggcaagauuccaauucaaaacaaacaaacaaugaaugggagguaagaaguuggauacacaaaguauagauaaaucuuucaaggagaauggcuaaaugagaaagguguuucuaugaguaugaaugugugcguauaauuagcaaaguuuuauuaauauuaaaauggaauuggaaagaaagacgggaauagccgacagauggaagcgauccuugaaaacaucaaagaagaugaaucuugagccucagaggugaggaggaaaaauuucuuucacggaauaggcagcgaggagagaauggauguaaaugcaauuuaagguuaagaaagccuuaagagagcuuuauuccagugguucucaaacuuuuuggccccagaaccccuuucauucuuaaaauguuauugaggggcugggcacgguggcucacgccuguaaucccagcacuuugggagccugaggugggcggaucaccugaggucaggaguuugagaccaccuggccaagauggugaaaccccaucucuacuaaaaauauuaaaaaauuagccaggcaugguggugggcaccuguaaucccagcuacucaggaggcugaggcaggagaauugcuugaaccugggaggcggaaguugcagugagccgacauggugccacugcaccccagccugggcaacagugagacuccaucuuaaaaacaaaacaaaacaaaacaaaacaaaacaaaacaaaacaaaacaaaaacaacauuauugagaacacuaaagagcuuuuguuuaugugguuuauaucuacugauauuuaccauauuagaaauuaaaacagaaaugcaguggugcgaucucagcucacugcaaccuccaccucugggguucaaacgauucucccaccuuagccuccagaauagcuaagacgauaggugcuugccacaagcccaacuaauuuuuguauuuuuugguagagaugggguuucaucaugcuggccaggcuugucucaaacuccugaccucacgugaucuacccaccucggccucccaaagugcuggaauuacaagugugagccaccgugccccaccuacuaauuuuaaaguaacaauaaacuccuauguuaacauaaauaacauuguuuuaaacuauauuuuucaaaacaagaacaacuuagugagaaaagaaacauuguuuuacauguuuacaaauccuuguuuuuacagaagauagcuggauuauuacaucagcuucuguucaaucuguugcaguauauugcuuuuguugauguauauaaagaaaaucuagccucacacagauauggaguugaaaaagaaaauaauuuaauagccuuucauguuacuuucauuuugucacauaaauguuacaaagauauauaaccaagggucaaaauucaauaaaauaauuuuuaccauguccuaauggauauucuaaugugaaaccggcuuuuuuuuuuuuuuaaaggugaguacuuagugguagaaaacacaaugauuaguaguugaugucauuacccugauuugagacaaggugccagauuaacccacuaucaaugaaaacagugcaaaaggaaaaucaguauaaucuuaguauaauaaagaucuuaguauuuuaguauaauaaagagaauucugaccauacaaauccccugaaaggguuucagaaauccccacuucacacuuugaaaaccaccucucuagaaugauggguucuguuuucucuaagaagguaaggccugaguagaggauagagaauaguaaagagacaauuaacuagaaaaaaguagacauacagcacgcagggaagggucugggugaaguugaaaaccaugaauuuacaguggcaccaguguguaauuuuuuuuuaaauuuuuuuauucugcaguaaucagaaacugaggcuuaguggagagaaaauaaauggaugaauucagaacugacguuuucauuuggcagaccaaagaguaccacaauuuuugcuuauauauuuggguuaccuguguauucucuaucuccccagcuuguuguaaguucccugagggcaugaaccaugcacacuuugcucaccaugucugcccaucaacuuccacagagcaucaaguaauguagguacuuugcaaauauuuauuaaacaugcauaaacaggucugguaugguggcucaggccuguaaucccagcacuuugggaggcuaacgugggaagaucacuggagcccaggaguuugggguugcagugagcuaugacugcaccauugcguacuccagccugggcaacaaagcaagacugucuugaaaaaauaauaaaugaacaaauaaugaugaauaaaugaaugaauccauuaauaaaucaggaauuuuagaauggcauugugauaagcugacuauauaauuuaaagcaaacuuacugagaacaguuuaguguuugcuaugguugcaaggaaaaaaauugauuguauuuauaauuuguuuauagguuauuuauaaaacacuuaagccucuuuuaaucauggcucccacuccagcacaacuuguggacgagaaagggaaaaaugacugagguuuacucucuuaccacucuguaugugugugagagaauaagaguccacagaaauugcucuuuuguacuccacgaauaugaggaaguaugaguagaggggaacugguacagaacagaaguuauuuuggguaagaucaagggcaggauguaagaaaacuaguuuucaguuacaagggaauaaccauugggaauagagcugugcuucagugaaguacucaaaugguuuaauccaggguaaaccucauguucugggcagucgugcccccuguagugcuuuaauucacuaugggaaaacauccaaucuguguuuuacaaaaaaguuacuuuuuggaacccaguaccuacuagcagagaggaccuccugaaaaaauaauacucaguacaccuccgaggccacuuuuacccuagcuucccacuauacauagugaaaauccuuguuuugaaucugaaaggaugauuaaaaucuuccauauaugugcccuucccugcccuccaggaugauugagaggauaagcuagaggcagggagacuaacugagggaagaaaaaacaaccaaaaccaaaaccaacaaaaaaccuggaauauaaaauuucaccaacaucuaguaaacagucaacagguuucugagaucucaaaagcccucucacucuggacucacuccuacauauuuccccuugcuuugaagcuaaagagcaacuuucucuuaaugcugaacuaaggucuggccagaagaggccuaacaucacacaaggcagccguaaucucuccuaaccuacuucuacgaacucucuaaucuguaacaggaaagaagcaguugggagccuccaccucuaaaauauccuucauagaguccaagccacuggucucucucuauacacguacauguguauuuuacggucucugucuuuaauaagacuacaaacuauagaggccuucuuucuagauuuuuuuuauuauuaaaauacuucaaugauaguuauucauauuuugguuucauuuaucuuuguaccuuuucaccauuguaggauuguaaagauagaucuucauaaagugucuuuccuucucaugauaaccauaaaaaggccugaaauauaagaaaaaaaauuucaaauuauuuucauaauucagagaugaaauaaugcaacuuauugcccuaauuagauucagcuggccaaauucagucuuacguuuaauauuauccaccccccaaaaaacaacuaaaaaaucccaaaccuuucaguuaaaccuagcacagguuaacaugaaauacugaagcuuuuuuaaaaaguguaaaaaauaucacuuucuuuaauuacugacgaugggaauuaaaaauuaucacucugaaaaaacuauggacaaaaaggaagaacaaaccauccaccccuuaaucucaaacaucaagacucuuuaaguggcuuuuuguuuucuuuacuccacauauaagaaaacauauuuuuguuugcuuuacuccacauaugagagaaacagaccuuucagccgccuucuucuggcucccauuuuuuuguuaaaaacugaaguucuucuucaacaaaguccuuuacuuaacaacacuuacauuacuuuccuuauucagcuguuuauuauuauuuuauaaguucaauaagcagagacaauguaccuauuauauguacacacagcauguauuucaguagcugauaugaauaaaccuguaacacacaaccauaucaagugcauccugugaaaaaacuguguagacaggaacuuaagagacugaaaaagaccauggacuuacuuaagcaacauaaucauguuauggcugaguuuuuucucgggguaucagcuggaaugaggaaagggggaagcaaaaggcuauauaacaggaagagaaauccucggugcaagaugaaauaagcugaacucucacaucauuucaggaggaucugaaacuacacuacaaccucugauauacagaacacuauuuucaaggaugauguaauuagaaacaauacauaaacaggcguaaauuugugaaugaaauaaaaggcuuuguauuggcugaaaaguggucuguuaauacacgguuaaaucuuuagguggauaaacccaaucacucuuuauuuaaaaacauuguucccuuaugacaggcagcagauaauagaauuuacucucauaggacaucaccucucugugaugucuaauaguguaguggacaucaaauaaaggacuaauuugguagcagagacauuauuuuggguauaauuuuuuaguuguuuuaagccaucuguauuauuguuauaaaguaauuucuguuaaaaaaaaaaaaaaacaacuauuuaccaaggucuaaaggguuccucaucucauccuugccucucacuccaaucucaagucauaccauucuuccuucuccuccaaccacucuaaacauuucagacccucuaacucgaucccucaaguggaaagcuccgcucuggacuuuugcauggcuuguuuaaucuucauucagaacucugcuuaauuuaccuucucagaaaagucucaccugaccaucccucccucuuacucuucacccuuuucuuaacuuuuuauaauaccacuucccgucuaguuugcugcuguauacccuauuuuguugccaugaagaauugguuaaagaaagacauauuacauaaaugauaucauucucucucauuggcaaauucaaccuuaacuguagcccuuuccugcuaugguauuuuucauauauacaaagguaguugucuggaaacauggguuaucuucagccagaugaaugguuuugccaaaagaauuccucaucagggagacucuuugggggaaaaaaguagaauggaggaguaugaaagcagauguuuucauguuuaaaaaauuauaucucguaauuaguuuuuuaaguauaucaauaggaaggaaaaugaguguggauagcgaaaaaucucaccuaauuaauuuugauggauugagaaucucuuuauagaagauucucuaaaaucaugagugagaaggaaucccagaaauuagcccaaggucaugauccuaucucuuaacucagccucaggauagugauagucuaaaaagaauagaguuaaaccucauguaaauguuaauuugguagcuagaugcaacuuuauguaacuuaaguaggaaaaauugaaggaguaaaggaauuagagaagguagaaugaaugggaaggaaaaaggggaucuagggaagaaaaugaccaaaaaauuagaagaaaaaagaaaacugcaaugaaaaauuagagugagcagcucaucuguugccccauguauccagaucuguaacucaacuacucucaaaaauguggcaaugucuuuaacaaauacaaaaauacaggaagauaagugacuauguauuucacugggcuguuuggagacuuaacuuugaaaugaggauauauauaggaaaguuauuagaaacuaucaagaauaaacaaaacuaaaagauaaaguagauaauuaucccuaacauaauugcuccuguuauaggaugaguguaaacuuucaccucauucauuuauccaaccaaacaguuauugagucaucucauacaugcuagugcacuagcaugcaguuuacaugcuaguggaagaaacacauaaaaauuaaguaaauaaauaaaaauuaaaauaccugcaaacuguauuaagugcuaaagaaaacaaauaaugggcugagauacagaauaauaaaaacaguaauaauaauaaugcccuacuuaaaauaccuuauuuuacgugggauagucaaagaaaacuucucugaagaggucaaugaucuggaggauuggggaaggguagaacacucaaggaaagaaaauuguacauacaaagaacuuaggugagaaacaacuuggauagcagaggaacugagagaaagucacuguuucugaauggaauacagaaagcagaguuucagagguagauggggugaggucacauagguuauggcuagaaguuuaaauuguauucuauuaacaauaugaagccacucaagaauuuuuaaaugauuuuaaauuuacaguauaagaguacuucugcugcucuggaaugagauaaaaauagaaggaaauucaauuaaaaugauacuaucaugguccagaggaaagccuagauuaagguggaagcagagauuuaaggucuccacuuggauuucauauggacauaaaacaacucaaauguuccuguaugagcuccagaucuuuccugucaguugacucuaccucuaccuuccgucuuccuagcagaacacccuuaaacuuuugcagucaaccuugauuccucucucacaauccuuacccaaacacaaagcaaagcuaauacauuaacucaaccuucagaauagauccagaagcugaugauuacuucccugcuaccacccuaguucaagccacacuauuuucuuuuuuguuuuaauuuuaauuccuuggucuuuucuaccuuaauaucaagccaccauauuuucuuacccagauuaauguccuaauucucucccugcucuuauucucgucccccuacaaucuauuauuaauacaguugcuuaaguaauccuuuccaguuuaagccagaucuuggcugcucaaaaucauguaauaacuuacaguaaaagucaaaguccuuacauuagccuacugagugauuaacaaacuuaagcaugcauaagaaucaucagaaaggcuuuauuaaaacacaaauugcugggccccaagaauguaguucuaccaaguucccaggugugucagucccaguccuccaagaaguaaaugccaaaugugagagaaaaugagaaggcagccagaagaagccggcauagccaccagaccuagauaccagucucaucucaaguggacagagggauguuuuacagaucugcuuuaguaucuuugccaugcucagucauaggguaagaguagccuauggaaagcagcucauguggagugacagacuggaauugaguguauaguagcuggggccauucacucauucucuguguauuuggagaucugagagguauauucucauggcuguaaaacuagguaaagcuaaugauaguaggugauacuaggaaaccaaaguauggaaaccacacuuugagaaucauugguccucacagucucuacccucucaucucucucuuaucucauuuaguccaacucuccuuuacucuuccacucuagucaccuggcuuccaugcuguuccuacucccuuaccuccuucaggucuuugcucagauguuguuacuuugucaaugacacauucccugauuacucuaaaauugucacuagucuacuuccuuaccccacacuacuauuccuucuuauccugcuuguauagauucuuuccuuccacacgacuaauuaucauauagcaaauaaauuaauuuaauguuguauuuauugguuauuaucuguuucccguaguagaauguaacuuccacaugggcagggcucuuuguuuuguccagcaguauaucccaaacgccuagaacagugcuuagcacauaaaaaguauuuaagaaauauuugcugaauaaauuacuauaugaauuacuaaugaauuucuauaguuacaggaagcagagaaaugggaaaggaaacaacaaaaaucacuguugacucucuaccuuucauugccauaaaaauucauguuaaaaaguuacagcaaggaauucacuacaguuccauuagacuagaaguaaaagaaauagaguuuaucaacugaguauguuuuccucuaaauagaauagcaacauaaacagaaauuauaaaauauauuaucauauacuuacauuccugauacuaaugacacuuugaacacaugcugagcaguggaagauggauugccuaaagccacauuaagugcucugucgauacugaaugccaucugagaaagauagcuuucuggcugcuguccauaaccaucguauggcacauagagguaaggaaagaugccauguagaugaagacaugucuucugaccuaaaauguaacacauuauaaaguuuaguuuccagacacaguuuaacaauacaaaacucagaaugaaacucauuuaaauguucuaauggcaacacagcuuaucuaagggaagaguugaaaaaaauuaacccauaguucaaaguaaccaguauuaacuacauuuuacaacagaacauuuggaaacauuguguaaacacaagcauuguauaacaguaugacuuaaacaguaguuuugaugaaaguauuuucacuauuuaacccucauaauccaacuagucuuguguacuucacugaaucaucuauaaauaccaguguuaugaagguuauaagcacaguguuaugaagguuacaaaaauucacaaaaaguuuacuaaauaaaucaaugaaugccugucuuggcauuaauguuuucaaacaagagccuucccuaaaagagaggcagcucugggagaaaggggaauguaaaagcaguuccagugugcagaauuuugcuauugcagugggaaggaggguaaaaaugaaauuuugccauuaaaaggaaaaaaaaaaagacaaaaccaaaucaaaacaaaaucucuacagaucaauuaucuauaauggauuucaggguaucuaaauuuuauauuuggugguauggaacaaggggagacaaaaggccaacaugcacacuucucagaaaaccaauauaucagucaaggugcagaagggguaaauggugcugacuugccaacagacaauccagcacagccaugauaaagaaaguaauuugagugagaacccacaaaagaaaugccacagaaacgauaaucuguccaugacaagauuaaguaacaacaauggcaacaaaaagcagaugcaccauugcucucaugaaucuggcagggcuguauggaagugguuacuguccucagagcauugucccuaguuccccuuggguaugugccauuugucuaauccaaacagagaggagaacagcagugauggaagaacacauccauuuuucucaugcugucacccgcucucacugugcuguuccugccaacacaagccucaggcuucuuccccaccccuuaucccuccucacucugcuucacugggccuuuucuuuugguaggaauguaaauauuuguuugaucacuauuucccauuuaugauuuagaaugauuuauauaaaauauauagaaaguaguucuacacuguguugauaucuuaauguuuacauuucuuauaaagaauaacauuagcuucucuuauuuuuaagguacacuuacgacagaaaaauaaaucuggaacaguuauuacauaaagcagagcaaauuuagaaagaucagucacauaaugaaacaagaucugauucuccgaacuguaauauucugauuugaacuaccaacugucgugcuuuugaaaaauuacaaauuguguugcuguuauacaaauuucaguuuccaguuuggcuauuucauuucuaaauacaacaugguauuaauuccuaaauuucauaguuuuucaauucuucaaauagagaacauucaaacuauauuaaugagucuuaauagauuuaaucaauuuacugaugacuuacuugaaugcuuuuuaaauaucucaugaauaaauguuauaaccauuacccuucuggacaaaaaccacaauuugacuaagaguaacugguaugcuaaacuacagguugagggaggugggaagacagugaauuauuuccucuuaaguugacaaaugcaagaccagugauuacagaauuacuagugcaaugccauauuuuacaagcaauacuguaaauuccuaagguauuuguuuuauagucaauauaucucaauaauggaauuuuggguaaauuuuacaagaaacaauuacaaaauuggacuguauuaauaguuucuuuauggucagaguguucacaaagugucuuaaaaauaauuuuauauccacuuuucacaucuccugugaaguagggaccagaagaauuaccuuucuauuuauaggcuucagaacuacaacaauuuugggauguacaauuuaggaaaaaggaagaaaugauuuacucagcagguaauaggguaagugcuuuaccuauguauuucuaauuaggauaaucuugcaguauugauggagguuaacguucccaaagucacauaacuauuaagcaauagaauccagcucaacaaaaccuaaaaccaauacucuuuccauuuaaccaugcugguucaauguuuuuaaaaagucaauguuggcuuccuuaauuccucaguuuuuauuuuuuauuauaauugccuguuuccuuaucuaacuuucccauuucauggcaaaaacucuuagggagguguuauuguguucaaaugaacacuauguccccagaacucaacaaaaaacacaugguaugugcuuaacaaacauuuauuaaaugaauuaaagaacccacaacaaaacagaauaacugcuuaaggacaaaggaaugaugugaaagccuuugaauaucugaagaaacacauccacgaaaaaagagggacucugauacaauuaauguaacuaccaucaggguuagaggaggacaugggugugugggguugagaaggauccccaacauauugcacuuuccuacccugaaugaccugaagugccauccaaaucuguagucacucuaucaacacagacguaccucucucuccagugcuccugcagcuagagauggcucagugccuuacucaucacccuuccucaagaacaaccuccugaagaacaaccacaacacaaggaauucuuggcauagcacuaacagcucuaauauagaauaagaaugauauaagagaaaaugaaagaaacaggauaaaauaaaaaacucaaaaguuaaauaaggaaagagaaauguguaaaaaugaacacgagagucaacugcuuuuuggaaauaguaugucuuuuauuaccauaaaauuuguaguucuguaauuugcuuuaucuugacaagauacagaccacuucuauuuauuucccuccgcuagcucuaccucacacaaauguguggagauacagagcuguaaagucuuuagagauaaaccagucuacuacaacucccguuaguuaggauuagguuaaauugugagaaaaugcccccaaaucaguggauuuagcauuaaaauuaguggcuucucuccuaaaagaaguccagagguagguagcugguacuagaaacccagcuuuuuucaacaucuaguuaguggucuaauuaagaacuugugacuucaguccaggcgcuuuuccacuauacuucuagaaguuccacauacaggaugcuuucaagaauguuuuuauaaaauuagugaaaguuaugguauuuugaaaccuucuacuaaaugauuuuggauucucuuuuuuuuuuuugagauggagucucgcucugucacccaggcuggagugcaguguugcgaucucggcuugcugcaagcuccaccucccgggcucacgccguucuccugccucagccuccggaguagcugggacuacaggugccugccaccaugcccggcuaauuuuuuguauuuuuuaguagagacgggguuucaccguguuaaucaggauggucucgaucuccugaccucaugauccaccugccucggccuuccaaagugcugggauuacaggcgugagccaccgcgcccggccauuuuggauucuuaaaggagucaggguauuagguauuucuagguaacauauagauuuaaggaaagaaaauaucccuaccccuucaacucuauuaacguaaacugauacauaaaaauuguacauauauaugguauacaacaugaaacuuugauauguauacaccaugaaaugauuaagucgagcuaacauauccaucacuucacauacuuauuauuuugugguaagagcauuuaaaaucuaaucucuuagcgauuuucaaguauauaauacauuaucaacuacagucaccaugcaguacaacugauguccagaacuuauucaucaugucuaguugaaacuucauacucuuuaaacaacaacuccccuuccccuccucugaagguucccucuuacuaucauggcaaacugaaguuagacaacaaguccaagagaaauaagaucgucuguggcugaacaagcccauguacacagguuucaaaaauuucagaguuugaauuuuccaauuugauugauguucccuaauucagaagcugcaaaaguuauuuuaaaaagcgccaccaaaacuugacaccauggcaaaacucuguggagcuggcuacuucccauuguguguaaguacauaacaaaaggcagaugccucuucaacaaggaguaugugggugcucugaauuucaucuuucacggaacccagaauuauacuaaacauuaaguccuuggcugggcaugguggcucacgccuguaaucccagcacuuugggggcugaggcagguagaucacgaggucaggagaucaagaccauccuggccaacauggugaaaccccucuccacuaaaaacacaaaaaaauuagccaggugccuguagucccagacacucgggaggcugaggcaggagaauggcgugaacccgggaggcggagguugcagugagccaagaucgcgccaaugcacuccagccugggagacagagcgagacuccaucucaaaaaaaacaaaaacaaaacaaaacauuaaguccuuuauaucccaacauuucuuauugucauuuuucaacauuuuauucugcaauuuaggugucuugauuuggucucuaaauugcccaucuaaaaucuuguuagccuauuuguaguaaaauuacuugggguauuuuuguagauucaguuucgauaaacacaaagacuaaauguaccauuccucuaauuugggggucugaaaacuuuuucuggaaggugacaguaaauauuuuaggcuuuaugggacaugcuguaucugacacaauuacauaacucugcuguuguagccuggaagcagcuguaugcaauacuuaagugaacgggcaugaccguguuacaauaaaacuucauuuacaaaaacacgcaacaugagggauuuggcccauggauaguaguuugccaaucucugcucuaauuaauuagacuucuuucuccaucaucaucuggaauagaaaaguuuuuuuuuuuuuaaagcugauggguaaucaaaaucaaaauagugauagccuaagaguaucuuaggagaauaagaaauacucauuguguaauuugcauaucccaucucccaaaucucaaauucaaucuaaacaagguuuuaaacaaaccucgacagagcuauaaaacagaaaaacuugguaugugagcaagaacauuuacguuuacaaaaauuuucauauuuucuucuuccuggaacaucucaaguuuuauaucacuaucauuaacuccaucuguuuccuuccagucuuucuuugcuucugucuuucuaaauuuuacuccaucuuucuuuucccaucuccacaaaaccacaaaacgaacuaaacaaaacucagucacagaaaguguuaaauuaucuauucucauggaaaaagaaaaguuguaaggauguacucuuagccuuggaaauuagauuuucagaauuuaucuuacagaaaaacuuaaaaauguacacgaagauucagauacuaagaugugagguaugacuaacaauagugaaaaaaaugaagauaaucuaaauuuccaaaaauagggaaauaaguaaaauuauguuauaucuguauaauagcucuguggcucuguagcaaauccugcuuccugccugauuuucuaaauaaaguuuuauaagaauacaccacagccauuuagaauggucuauggcugcuuaugcuauagacagaguugagcaguugcaauagacacccuacaacccucaaaaccuaaaauaugugcuuucuuguucuuuauagaaaaaguuugcuaaccucagcaacagaagauguuuaaguguauuuccuaguauaagaaaauguuuaugaugucuuuauagucagaugaaaaucaguuauaaaauaacauaguacaugagaccaggugaugagugauucuuuuauauauauaugggugauucuuuuauauauauauacacauauauauauauauacacauauauauauauauacacauauauauauauauacacauauauauauauauacauauauauauauacauauauauauauauacguauauauauauauauauauauuuccccccacuaaauauacaacuuguguaaacaaaagggaggaagaaagaauuuaccuacuuuuaaauaacccagaaacuuaaaaggcaaaacaaagcauaauauauaacaguuuccuuucauuuucuccuuuuauuuguaaauaauacuuuggaguuucaaauuuauuuaugccauuuuauuucuucaaauaaaauauacagaacuuuaucuagaaucauuggcuuuaaaugauuaaucccaaauuacuaagagaaacuauaucgcugaaauaccagauguuucaaaagucuauuuuauucauacauuugucuaaugugucuuuguauauacagugcaggguauaguugguuccuuuauucauaaauguagucauaauuucucuacucaaguaauuuguggagacccaauguuuggugcuaaaccauaggcugcuuauaacacagccacuaacuucaugacuauaaagccacuaacuuuauagucuacuuggagaaaaugaugaauaaauaggcaauuacaguaugguaugacaggugcucagaagcacaaaauccuauggcuauauccacaaguaucuaacucagacuugugagaaucuaggaaggcuuaccagaggaagugacauuugagcugauaucugaacuaugaaucagauuuagccaagcaaaugaggaagaauguuuucaguauguacagaaaccugacagcaacagaaacauggcaucugggaacaggaaaaguguaggugggaugaaacaaggagugcaguggagagaaaagaaaaagaguaugagaaggagagaaagaaaaagaguaugagagagagaaaaacagugugugugugugugagagaaagucuguguuuuugugugugugcgcacaugcauguacuaaugaccuguacagauucgcauuuuauaaaguucccuguggacacauuguggggacacuagcaacagaacuacagaaaggaaaaucuguuuaggaggcugcuggaggaauucagucgagaugucaguagagguggagaaaaggucaaggauuuagggaguagaaucaagaggcuaugguaacuggaauuugagaguaggauaaggcagaaggaaucaaagaugacucuuauuuuuggcuuaggcaacuggacggaugauaaugucacucaaagaaaacuguaaaagaggggcggguugacuucuguuuugcauuuauacaauuuuacaugucuauagaauuucuaaauggauauuuaaaugaaacacauacagauauggagcuuaagaaagagaucugagcuagagaagaagacagauuugccaguaugagcaacaauuggguaagauuucucagggaaaauauccaauacccaauacaagagaagggaccuaggcaagaauccugagccgauauuuaagagaggcacuaaauauuuugauuuaugugaaaugugacagacagagcccugagagggcuaccaggcaagaaagggaagcuaauagugaaaauuugauaauauaaacauauuagccauggaaccaguguuccaaggauccaguggaaauauaagagauaggcaaguaacgagaggcuggaucagagauugguggcaggauguagauaaaaguauauaggacugaaaagaggcauuuacaaaauugcugaguaaggaccuuucaauaucuguuccuccauaaaagcaacaagaacacuggcaaaaacugucaaaagcaacuuuuucagaacucuggaaauuaaagguuugcaacaauucaaggcguauuuauucaagaacaccagaugaaugcuaaaacagcaagcuuuguggcauuuuaacuuguucuaaucugaucucucccucugcagcuucaaaacagucuugaaaaucaaagccuugcauccauagcagcuguaaaaaccagcagccaggcagccacuggaggagccggaacccauuuggagcuccuccaaagcccuacccucagaaaacugccacuauuggacuugucuggcagcuugcugaacaacacuccauucccagcacuugccuuuauuugauuugaagaagggcucacacuaugugaagagcccuauaugcggcagggucuuuguggaaaacaaucaacagcaauuauuuaauugcuguagcugccuggagaaauuuuaccaguugggucuaacaagaggcugaccaaaaaauucaaaaguacaaacaggaaugaaauguccaccgggggcuuggaaaagcuuugauacaguuaagggaauuuagaaggccauaagcauguguagggcuauguacaugcccaggaaagaucuaagaagacuaauauuuugccucugguugaucuugaggcucugccccaacauacucacagagccccucagcaaaagcugagaaaagaggcauuuaaagaaaucucuggucaaccauuaacugaccacuaugcuagcugagcagagauuucaaauagagacugccgggcgcgguggcucaugccuguaaucccagcguuuugggaggccgaggcgggcagauuacgaggucaggagaucaagaccauccuggcgaacauggaaaccccgucucuacuaaaaauacaaaaaaaaauuagccgggugugguggcgggcaccuguagucccagcuccucgggaggcugaggcagaagaauggcacgaacccggcaggcggagcuugcagugagcggagauugcgccacugcacuccagccugggcgacagagugggacuccaucucaaaaaagaaaaaagaauagagacuauacaaaauaagcccaugaaaaucacugaagaaauaaacugcagcaacaacaaaaauaaacuggguggguagagaggaaucuaacuugagaacugcuacauaauuuaaaaugucugguuuucaacaaaaauaaaauuauaaaacacacaaacaggcaaauauggcaccauauauauauauauaugcacacauauauauaaaagcagacaacagaaacuguucaugaagaagccaagguguuggacuuacuggacaaagauuuuaagccagcuauuucaaaaaacuaaaagaaacaugucaagagaguuaaaggagaguaugagaccaacaucuuaccaaauagagaauaucaaugaagagagagaaauuauaaaaaaagaaccaaauagaaauuccagaauugaaaaguucaauaacuaaaaugaaaaauuuacaagaggggguaugauacuaugauauaagaagaaauauauauuuggucuuugucccucuuccugguacacagcuccuaaaacguuuggauucuuuuaaguguuaaguguuuacauguguaccaaugagaugacugguagcugggggcuccuggauagccucagguagggcagaagugcagggagccuagggacuccauuuguggcuggugucugaagugagcaguacuaucggacagaacccuuacccuguaggguauacauuaguaguaguuagugucagaauugaauucaauuguagaacacccacaguugaugucagaaaaccgagaauuuguuacuguaaaacugaugcacaggaugucuuuuucaaauuggguggccucuaagaaggcuuucaacugagucuagcugaaaauuugauggauuuaaaucuuacuuucuccuuauaaacuauuuucuuucuccuuauaaacaaugaagauauguauaauguccucacaucuccccuuuauggaacggaacuagaagggaaucaauuaacccauuuaugccagagguugcaauuuuuugugugugaaaaaucagacuuuggugaugacccugagcaguaggauauaaauaacucccacaagcuuagcagcccaauaauggaacacuaggcauaaauggguuaagggccaacuuccaaacugaacaacaguaguuugaugauuaauaugauucuuuuaugauuaauaugucagaaaucugaugaaauguuguauccaaaguucauaagcaauuuaaucugcaauuauuguuauagaaaguaaaucaacaauucccuugauuuucaauaacuaugaaacuauauggguacugcucaaaggcacacgccaugguacaacuauuucuaaaaagcucagucuuaaaaaacaaagcuucuaacaguaguuucaagcacaaaucuccaagaaaaugugcaccuuucagacuaaacgucauaaaaauaauuaguguuauuaaccuuagugaaaaauaaaauucuggcuuguaaaacaaacacuuuuuaguuucagauaauuuagccagaauggucacacacauuaauuuuugugguauuuuaauugaaagguaaauaaaccaaagucucaaaaaaaaauucugauuaugacaugaaaauucaucucaauuuaaagcaauaucaaaaguuaaucaaaacaaacuuacugucuggucaaauuuguacauaaauaccuaaaugcuccuucaaaugcaaauaaauaaaauauuauugguaauuaacauuauaugcaagucuaguaaauuauucaaccauauuuuaugguagcugaauacuaaaggaccuuaagcuuuuaccugucuaaaagaaaguugaaaagacaaugcacagaaugaaaaaaaaguugugaaucauauauuucauaagggacuuguaucuagaacaaacaacucuuucaacucaauaauaaaaagacaauaaaauuuuaaaauggacagagacuucugguuguaaaacggugguacagaaguaaccuggcuucacucacugccacaggaaaccaaaaccacaaauacagugcugacacgaucaugagcaauaucccgaacucaaauaugaggagacaguucccaaggccacaaagaagugaaaaaacucugagcaaaagaaagcaaauuagacuuucauaaucacagugccccuccccucaaucuguccagcaccaagcaugcagaaaacuuucccaacucagaguugcuacacuggaaaaaguauaacugagguggacaacuggcuucuccaccaucuuggguuuguuggcaagagaccuaucccuguccuaauaacugggagcaguggaaauaccuaagggagaaauaaucccugaaaaccaccagaaauaaagagaagaggucggaggugggacuaccaucccuaguccuggaaacucugcuauguaacucagccaaaagagaugccaaguuggaguggcuguucagcagcaccacacuguuaagagguucauuucacagguucauuggacaugaaccucuacccagagguuaggugcugaaaaggaggcagcaaccuagcagauuuaagaaaaaaaaaaaaagaaagaaaauuaacagguaaacuucaaagaaucucuaagcaagcauauucgauaaaaaccaaaacaagccagauagagaagacuagaauaaauaacuaauccuugaaugcaaagacacagauguauauccacaacaaacaacagaaaacagggaaccaugaccucaaacagacaaagcaaggaaccagugacugacccuaagaagacagugacaugagcuuucugaucaagaauucaaaauaccagguauaaggaaauucaguaacuuuuacaaggcaaagcagaaaaguaauuaagaaauuuauuagagaaauuuagcaaggagaucaaaauaauacaaaaaaaaccaaacagaaaucgaaauugagaaauacauuuggugaacagaaaaauucauuagauacucucaauagcacaauggaaacuaaauaaccuacaagacaacacagaaaaguaauacagaaauuuauuagagaaauuuaacaagaagagugaaauaauacaaagaaaacaaacagaaaucaaaacugagaaauacauuuggugaacugaaaaauucauuaaagucucucaauagcaggauauaugaaacaaaaaaaagucagugagcucaaagacaggcuauuugaaaauacaugaggagaaaaaagaaaaaaaccaauggaaaggaaugaaggcugccuuuaagauacagaaaauuaccucuaaagacaaaaucuaagaaauuuauugguauuuaagagugagggcucuuguuaagcaagggaaaggggcaaaaagcuuauuucaagaaauaacagaaaaaaaucccaaaaacuugagaaaaagauaaauauccagguacaggaauaaagguaagacaacaccaaauagauuugaugcaaauaagacuacucccaaguuauauaauaaugaaacacucaaaggucaaggacaaagaaagcagcaagagaaaagaaguaaaugauguauacaagugcuccaacuugucuggcaacagacaucuuaagagaaacuauaaaggccaggaaagaguggaaugccaucuucaacgugcuuuaaaaaaaugccaucuaagaauaaaguauugagcaaugcuauccuucaaauauaaaaaagaggguuuuugguuugucuuuuuauuuuuuaaaucuucuuuuguagugaugggaaucaugcuauguugaccaugcugguuuugaacuccuggacucaagcaauccucccaucucugccucccaaagugcuaggauuauaggugugagccauugugcccagucaaauacauagucuuucccagacaaacuuaagcuaagagaauucaccaccaccagaaccaccuuacaaaaaaaugcacaugggaguucuuccaccagacagaaaaaaacacuaacuuacaaaaagaaagcuuguaaagguauaaaacccacugguaaaauuaaguacacaaacaaaccagaauacucuauuacugcaauuuguaguguacaauccauuuguaacucuguuugguaugaaguccaaaagacaaaucuaccaaaaacaguaauacuuauagcaacccauuaagagauaggcaauauaaaaacauaaaaauuaacacaacauagugucaaaauguggggggcggggugggguggaguuauaggaaagaggguuuuuuagcuucucgagaggggccucgcgggccccgcucccgcccucggcucgccuggcccagaccggaagcagcgccgcacugccugggccuggcgcggggggugagcacaggggcccggucggacauggacaagaagcacaagcacaagaagcucaagucggacaaacaccucuaccaggaguauguagagaagcccuugaagcugguccucaaagcaggagggaaugaagucaccgaacucuccgugggcagcucggggcacaacuccagccucuucgaagacaaaaaacaaucaugacaaacaaaaggacagaaaguggaaaaagagaaagaaaggagacaagcagguuccaggggaagaaaaggggagaaaacagauaagaguuaaggaggauaaaaagaagcgagauugagacgggguggagaaugaggcagaaaaagaccuccagugucacgccccugugggauuagacuugcccggugagaagccucucacaagcacuuuagccaaacaagaagaaguagaacagauaccccaccccuucaagaagcuuugaaucaacuggcgagacaauugcagagaaaagauccaagugcuuucuuucauuuccugugacugauuuuacugcuccuggcuacuccaugaucauuaaacacccaauggauuuuaaaugaaagaaaagaucaagaacaaugacuaccaguccauagaaaaacuaaaggauauuuucaaacuaauguguacuaaugccaugauuuacaauaaaccagagaccauuuauuauaaagcugcaaagaagcgguugcacucggggaugaaaauucuuagacaugaaagaauucagagccugaagcagagcauagacuucauggcugacuugcagaaaacucaaaagcaggaagacagaacagacaccucgcagaguggggaggacagaggcugcuggccgagaagagagaggacucuggagaugccaaagcacacgccuucaagagucccagcaaagaaaauaaaaagaaagacaaagacaugcuugaagauaaguuuaaaagcaauaauuuagagagagcgcaggagcagcuugaccgcaucgugaaggaaucuggaggaaagcugaccaggcggcuugugaacagucagugcaaauuggaaagaagaaaaccagacggaacaacaauguugggacuucuccauccuguggaucucauuguaggagagccaggcuacugcccugugagacugggaaugacaacuggaagacuucagucuggugugaauacuuugcagggguucaaagaggacaaaagaacaaagucacuccaguguuauauuugaauuaugggcccuacaguucuuaugcaccgcauuaugacuccacauaugcaaauaucaacaagaaugauucugauuuaaucuauucaaccuauggggaagacacagaucuuccaagcgaucucagcagccaugaguuuuuggccacgugccaagauuauccaucugugauggcagauaguuuacuggauguuuuaacaaaaggagggcauuccaggacccuacaagagauuuagaugucacugccugaagauggaaggccauacuaggacaccugacacagcaaaagaaauggagauuacagaaguagagccaccaggaugucuggacuccaauacuucaagacaggcucauagcgcugaaagcaguaacaaacuuuggcguuccgguuaaaguuuuugauucugaggaagcugaaauauuccagaagaaacuugaugagaccaccagauugcucagggagcuagcuccaggaagcccagaaugaauguuucaacaccagacccccucccaacaugaucugucucuugggucccucauacagagaaaugcaucucacugaacaagugaccaauaaucuuaaagaacuugcacagcaaguaacuacaggugauaucauaagcacauacggaguuugaaaagcaauggggauuuccauuccuucccccgucauggaaaacaacucuguggauuugacagaagauacugaagaaccuaaaaagacgaauguugcugaauguggaccugguggaaguugaggccaccuguauuugauuauauauuauguacauacuuuuucauucuuaacuuagaaacgcuuuuuagaauauguuaaauauuuguaaauuguguuuuuaauuaaacuuugcaacagugaauuugaauguuccagagguuggacuuguauuagguaauaaagcgggaccugaggaaaaaaaaagaggguuuuuaaaaaaaauuucuauucuuuguuuuguaauuaagauguuuuuguagucucaugguuaccacaaugcaaaaaccuauaacagauucacuauaacuaaaaagcaaugaauuaaaacauacuaccagagaaaaucucuuaaucacaaaggaagacaguaagaaaaagaaaaaaggaaggaguucuaaaacaacagaaaacaagcaaugaaaugacaguaguaaguuuacuuggcaacaguaacacugaaugcaaauggacucaauucucuaaucacaaggcagaaugaauucugucuaaacagauaaagaagcaagaguuaaacuauaugcugccuauaagaaacuuacuucgccuauaaagccacacacagacugaaagugaaaggcugaaaaaagauauuccaugcaacuggaaacaaaagcaggaguagcuauauuuguaucagauaaaacagacuaucaagacuguaaaaagaaacaaagagggucacuauguauugauaaaagggucaauucagcaagaggauauaacaauuauaaauaucuaugcaugcaacaccagagcaucugagugcauaaagcaaauaauacauuuaaaaggagagacagacugcaauacaguaauaguaggggacuucaacaccccauuuucaguaauggacagaacauccagacagaaaaucaagaaagaacacuggaguuaagcuacacaguacacaaacaggccuaaucaacauuuauggaacauuuuacccauggcugcagaaaacacauucuuuucaucagcauauggaacauucuccgaaacaaaucauaucugagacaaaaaacaagucucaccaaauuuaaguaaguagaaaucauaccaaguaucuucucuggccacaauggaauaaaacuagaaauuaauaacaaaaggaagcuuaaaaauacacaaacacaugaaaauuaaacaacauucuccugaaugaccaaugggucaauaaagaaauuaagaaggaaauuuaaaaauuucuugaaaccaaaggaaaugaaaacacaacauacccaaaccuaugggauacagcaaaagugguacuaagaaggaaguuuauaacaauaaacaccuaugucaaaaaguagaaagacuucaaauagacaaccuaaugguauaccugaaggaacuagaaaaagaacaaaacaaacccaaaauuaguggaaggaaauaaauaguagcgaucaaaucagaaauaaaugaaauugagacuaaaaaccaauacagaagaucaacaaaaugaaagguuguuuuuuuuaaaaagacaaacaaaauuaacuaacaaaccuuuagcuaggcuggaaaaaagagagaagauccaaacaaauaaaaccagaaacaaaagaggagauaaaacaacugagaccacagaaauacaaagagacuauuaugaagaggcuaauauaugagagacuguuaugaagaacuauacaccaacaaauuggaaaaccuagaagaaauggauaauuuccuggacacagccuaccaagguugaaucaaggagaaagagaaaccuuaauacaccaauaaugaguaaggagacugaagccauaacagucucccaucaaagaagagcccaggaccuaauggcuucauuccuaaauuccaucaaacauauaaagaacuaauaccaauucuacucaaacucuucaaacaaaauugaagcagaaggaauacuuucaaacucauucuaugagaccagcauuacccugauaccaaaaccagacaaggacacaaccaaaaaaagaagacuacaggccaacaucccugaugaacacagaugcaaaaauccucaacaaaauucuagcaaaccaaauucaacaucacauuagaaagaucauucaccacgaucaaguggaauucaucccagggaugcagauuguucaacauaagcaaaucagugaacaugauacaucaaauuaacauaaucaugaacaaaaaagccuauuauuguuucaacagaugcuggaaaagcauuaaauaaaauucaacaucacuucaugauaaaaacccucaacaaaggaacaucccucaaaauaauaaagaauauauauuacaaacccacaccuaacacuguacucaauguggaaauauuaaaagccuuuccucuaagaucuggagcaagaccaggaugcccacuuucaccacuuuuauucaauguaauacuggaaguccuguccagagcaaugaggcaagagagagaaauaaagaguauccaaauuggaaaggaagaagucaaauuagccuugcuugcagaugacauggucuuauacucagaaaagccugaggaacucaaccaaaaaaacuguuaaaaaugauuaaugguccgggcgugguggcucaugccuguaaucccagcacuuugggaggccgaagugggcgcaucaccaggucaggagaucgagaccauccuggcuaacauggugaaaccacgucucuaauaaaaauacaaaaaaaaaaauuagcugggcaugcuggcgggcgccuguagucccagcuacucaggaggcugaggcaggagaauggcgugaacccgggaagcggagcuugcagugagccaagauugugccacugcacucuagccugggcgacagggcgagacuccgucucaaaaaaaaaaaaaaaaaucaaugaauccaguaaaguuguaggauacaaaaucaacauacaaaaaucaguagcauuuauauacaccaacagcaaacaaucugaaaaaaaaaucaagaaagcaaccccacuuacaauaacuacaaagaauagaaaauaucuaagaaucaauccaaccaaagaaguaaaauaucucuacuagaaaaaguauaaaacacugaugaaagaaauuaaagaggacacagaaaaaugaaaagauacuccaugcucauggauuagaagaaccaauauuguuaaaguaacaauucuggcuaaugugguaacucacgccuguaucccagcacuuugggaggccgagacugaaggacugccugagcccaggaguucaagguaagccugggcaacauggugaaacccugucucuacaaaaaauacaaaaauuagcuggacgugguagcacacgccuauagucccagcuacuggggaggcugaaaggugggaggauugccugagaccagaagucaaggcugcagugaacuguauguaauugcaccacuguacuccagccuguaagacacagcaagauccugucucaaaacaaaacaacaaaacaauucuacccaaagcaauuuacaaagucaauggaaucccuaucaacguauaaaugacguucuucacagaaauagaaaaaacaauccuaaaauauguauggaaccauaaaagacccugaauagccaaaucaaucuugagcaaaaagaaagcuggaggcaucacacuaccugacuucagaauauacuacaaagcuauagaaaccaaaucagcaugcuauuggcauaaaaacagacauacagaccaaugaaacagaacagagaaccuacauauaaauccagacauuaacagcuaacucauuuucaacaaaggcaucaaaaacauacaauggggaaaaaaacagucucuucaacaaauggugcugggaaaacugaauaaccacaugcagaacaaugaaacuaaaaacagaaccuccuuaucucucaccauauacaaaagucaaaauggauugaagacuuaaaucuaacaccugaaacuaugaaacuacuagaagaaaacauuggggaaaugcuccaggacauuggucugugcaaagauuuuuuuggguaagaccucaaaagcacaggcaaccaagccaaaaauagacaaaaggauuacaucaagcuucuguugagcaaaggaaacaaucaaugaagugauaaagacaauucauaaaauggaaaaaauauucacacgcuacucaucuaacaugggauuaacaaccaaaauauauaaggagcucaaacaacucaauaacaacaaaacaaauaaucugauuuuuaaauaggcaaaaggucugaauagauauuucucaaaagaagacauaaaaauggccagacacaugaaaagaugcucaacaucacuaaccaucagagaaauacaaaucaaaaucauaaugcgauaucaucucaccccaguuagaauggcuuuuaucaaaaagacaaugaauaauggaugcuggugaggaugcggauaaaggagaauccucguacaccacugcugggaauguaaauuaguacaguuacuauggaaaacuguguggagguuccucaauccaacaauuccacuuuugaauauaaacccaaaagaaaaucaauauacugaagauaucucuguacucccauguuuauugaagcacuauauucacaauaacaaaaauuauuagaaucaauguaagugcccaucaguggaugaauggauaaagaaaauaugguauauauacacaauggaauguuauucagccauauaaaaaaaaugaaauccugucauuugcagcaacguaagugaaacuggaagucauuauauguuaagugaaaaaagccaaguacagaaagacauuauuacauguucucauucauaugugggagcuaaaaaaguggaucucaugaagauauagaguagacugguaguuaccagaagcugagaagggugggggugcagggaugaagagagguugauuaagggguacaaauauagaguuugauagaagaaacaagaccuaguguuugguagaucagcagggugacuauaguuuacaauaauauguuguauauuucaaaauagcuagaagagaauaaaucaaauauuucuagcauaaagacaaauauuuaagaugagaugaauaucccaauuacacugauuugaucuuuacaaauuauguaaauguaguaaauuaucacauguaccccaaacauauguacaucuacuaugucucaauaaaaaauacuaaauauuauaaaugggcaaaggaugugaauaaacauuuuccugaggagauaucaaauggcaaauaagcacauuaaaagauucucaacaucagcagccaucagcaaaaugcaaaucggaaccacacgcucacuaggacagcuauaauuaaaaagucagacaauaacuaguguuguggagaaacuggaaauuucauacacuacuucuaggaauguuaaauggugcaggugcuuuauagaauagucugguaguucuucaaaaaguuaaaaaaauagaguuaucauaugaccagcaauucuacuccuagguauaugucuaagagaaaugaaaauacauguccacacaaauaccuguacaugaauauucauagcagcauuauucauaauggucaaaaggugaacacaacucagaaguccaucaauugaugaauggauaaauacaauacagcauauccagaaaauagaauauuauucagccauaaaaaggaaugaagugcugauaaaugcuauacuauauauaaaauuaaaauauuucaauuaaaaauuguauacuaaaacuuuuuaauuuuuagcauuuuuaguauacaauuuuuaauuaaaauauuuuaauuuuauauuauauagagaaaaauuuuaaauauuaugcuaagggagccagacacaaaaaaucacauauuauaugacuccauuuaugugaaauguccaaaauaggcaaauuuauagagaaagaaaggagauuaaugguugcuggggcuuagggaauuggugggaaaugaguacugacugcuauuugagacgguguuucuuuuuagggugacaguguucuaaaauugauugcgcuuaugguugcacaacucugugaacaaagaucacugaauuguauaaauagguaaaauguauaguaugugaacuacaucucaauaaacuuacauaauuuuuuuuuugagacagggucuuccucugucacucaggcuggagcacaguggcaggaucacaguucacugcaggucugaccaccuggcucuagugaucuuccugcuucagccucucgaguagcuggaacuacagguaugugacaccugccuaauuuuuuuuuuuuuauuuuuauuuuuuauagagacagggucucgcuaagugcuuagacuggucucaaacuccugggcucaagugauccucuugccucagccuccugaguagcugccuugccucaaagugcugggauuacaggcaucagccaccucaccuggccuauuauacaaucuuuuaaacuuaucuauacucauuguuuucuuuagcaguugcuaaugagaugaccuaauuuugaauauaccauuagagaaaaugcauucauuaaauuauucaauuuauaucauaggaauaaauuaugaauauacagaaauauaaucauuugccacuacaaccacuuacauaucuuuauuuuuauuuaaugaugcacuaaauauaguauuuuuauuuuaauuauuuuuuuagagacagaaucuugcuauguugcccaggcugggacuauaagugugcaccaguguaccuggcuuuaaacccugaaucauauuaagauuaaaaaaaaaaaaaaagagguaaagugaucauuaccaaaaaauaaacuaacaagaaagaacuguuaauguuaagaaaguuuucucagacaauaaaacuaaaugacaaaaaaacaauuuaauauuugaacaggcuccucacaucccucaaaaucccauaucccaacccgauauccuauaacuuucauacaugaauuaaagaaagguuuucuuaggacuauguuuaauuauuuagaguccuggguugauauggcaagugaguucuacuaagcauacaguugaucucacgggguccugaauaaggcaaaaugauaaaucauaaaaauccaaaguccaaagcuuugggcaaaaacacauuaacuaaacuugucaaaaacagugcaaaccagaagucaguggagcaacaucuuuaauguauuaaaagacaaaaaaaacagucaauuuuuuagugguuacccuggaguuugaaguauacauuugcaacuauucuaaauccacuuucaaauaauacuauacugccucaaagguaacuuauauuagguuggugcaaaaguaacugugguuuuugcauuguuggaauuugcuguuugauuguaauacauucuuaaauaaaugugauuauguuauacauccuuuuaacaggcauuucucacuuuauguuuuuuugcuaaugacuuauuacuugcuguucauuuuauguuuagaguauggaaaugacgucagacaaaaagcaaauuugagcgauuuucuuauuugaguucaaaauggguuguaaaauagcagagacaacucacaacaucaacaaugcauuuggcccaggaacugcuaacaaauguacagugcgguggugguucaagaaguugugcaagggggacaagaggcuugaagauaaggaacuugguggcuggccaucagaaguagacaacaaccaauugagagcaaucaucaaagcugauccucuuaaaacuacacgaaaaguugccaaagaacucaacauagagcauucuacagucauucaacauuugaagcacauuggaaaagugaaaaagcuacauaagugggugccucaugagcugcaugaaaacaaaagaaaucguuuugaaguauggucuucucuuauucuacccaauaacaacgaaacauuucuugacuggaugguaacaugacagaaaauggauuuuaugugaugaccagcucaguggcuggaccaagaaaaggucauggucacaguuugguggucugcugcccguuugacccacuacagcuuucugaauccaggcaaaaaccaauacaucugaaaaguaugcucggcaaaucaaugagaugcaccgaaaacagaaagggcccaauuccucuucaagacaaugccugaccgccaaccagcgcuucaaaaguugaagaaauugggcuauacaauuuugcuucagccaucauauucaccugaccucuugccaguggacuaugauuucuuccagcaucuggacaacuuuuugccaggaaaaugcuuccacaacccauaggaugcagaaaaugcuuuccaagaguucacugaauccugaagcacagauuuuuuuuuuuugagacggaggaguuucgcucuuguugcccaggcuggaguacaauggcacaaucuuggcucacugcaaccaccgccuccgggguucaagugauuuuccuaccucggccucccuccuaguagcugggauuacaggcaugcgccaccaugcccggcuaauuuuguauuuuuaguagagacgggguuucuccauguuggucaggcuggucucaaacucccaaccucaggugauccacccaccugggccucccaaagugcugggauuacaggcgugagccaccacgccgagucccaaagcaaagauuuuuaugcuacagaaauaaacaaacguaucuuuuggcgaaaauguguugauuauaaugguuccuauuuugauuaauaaagaugugucugagccuaguuacaaugauuuaaaauuccugguccaaaacugcaauuacuuauaagggacagcccuccugucccuuauaaaauugcugccauuaauuucacuuaucccuaagcuauaacugaaugcauuacugcuauuauuauuuugaacaguuaccuaucaguuaagaacaagaaaauaaaagauuuuaccuuuacuuauuccuuuucuaauacucuuccuuucuuuauguagauccaaguuucucaccuauaucauguuccuuuucucuggagaacuucuaacauuucuuauaaggcaaguaacauuucuuacuggcaacagauucccucaauguuuauuugucugagaaaguuuuuuauuucucuuucauuuugaaggauaauuucacugcacacagaauaauucgagguugguguuuuucuuucaacacuuaaaacacuucacuccucucgcuucuugcuugcauuguuugugaacagaaguccgauguaauuuuugcuuucuucacauagaaguaagguggguuuuuucgccucugguuucuuucaaaauuuucucuuuaucuuugguuuccugcaguuugaauaugauauguguagguguuuaauuuuggaaaauucucagucauuauuacuucaaauauuuauuuuguucuucugaaaagcccaucaaagguauucuucauuucuguuauagauuuuauuucuagcauuuccuuuucuuacaauuccaaucccuaugccucuauuauccaucuguucuuuuuguuacuguuguuguugucgucauuguuguuuuugagacagggucucgcucugucacucaggcuggagugcaguggcgugaucuuggcucacugcagccuugaccucaugggcucaggcaauucucccaccucagccucccaaauggcugggacuacaagcacauaugccaccacacccagcuaauuuuauuuuuuauagagacaaggucucacuaugcugcccaggcuggucuugaacuccugggcucaagugauucucccaccucgcuucccaaagugcugagauuacaggugcgagccaccacguccagccacucaucuguucuuguauauugucuacauuuuuuauuacagaccuuaccauguuacucaucauuauuuuaaauuaucaaucugacaauuccaaaaucucugccauaucuagcugggaguuaagacugucauguuuacuauuugcuguaguuauagguguuagaggcuaauauuuucucuacuguccuuguuuuugucucauacugucuuuggguuucccuagaaacucuuuacauagugugagucuaagccuugcaguucuuucagcuguaaucuucuguuauuauacaggagccugcugacaugaggggaggggaagaaccuguugaugugggguauggggagaagauaaaguguucuauaguccuaugauuacguuucagucuuuaagugggccugugucccgggggugugaccgucacaagugauuuucagcuuuuccccccacuuaggugaaacaggaagaauaaagggggcuggaguuagauacuucccuuucccugaguugguuacggcgcuggugguuucccuuggcaaauguuacaugugaccuuguaaacaauguguauucugaaauuauuagguagguguaggguucuaaaaaugucaauuagacugaguugguugacaguguuguucaaguguuucauauacuuacugauuuucuacccacuuguuucaccaaaugcugaaaagaggaguguugaagucuccaacuguaacacuggcuuuaucuuuuucucucuuuaguucucccuuauguucucccuugaugucaguauugcaucaaguuuuuugaacuuuuugucuuuuugaaaacuugaacuuuuuaucauuuugaaauaucccucuuuaauucugauaauaugucuuaccaugaagucuacuuugccugaucuuuagauacgccaguguuccuagugacuuuuccuugcaaaguacauuucuccacuguuuuacuuucaaacugucuauauauuaaguaugauucuuaugagcugcauaugguagugcuuugcauuuuaaguuagaauaauaaguccacguaaaacuaauccaauuauuuaaguaauaagguuugagguuauguuuugccauuuuguuuucuauuuuuccugcuuauucauugcucauuuuuuuccccuaaccugcucucuuuuggccugaaaaaauuuuagauucaauucugccuuaucaguugucuuauuaacuacaucucuuuaaguaguuguucuuaugaugauuucccuguauaugguuugagagauuuuucuuggcugcuuuaaagauuuuuauuaauuugcaacaauucaauuaugaugugccauggugucucucucucuguguguauguguguguguguguccuguuuaggaucgguggugguguuuuuuguuucugggacaggauuucacuuugucgcucaggcggcuauguuguauuauaaguuuuguucuauuguguuuucauuaaaauuacuaaauacacuuaaauaccuaucuuaaaguccuuuuauuugaauuugaucacauauugcauucugggucuguuuuuauucacaagacuuucuccuuuuuauagauuacauuugccuacuucuuuauauaucuaguaauuuuuuuuuuucucagacagagucuuucucuguugcccaggcuggagugcaguggcucacugcaaccuccgcuuccuggguucaagccauucucaugccucagccuuccgaguagcugggacuacaggcgccgccaccucgcccagcuaauuuuuguauuuuuaguagagacgagguuucaccauauuggccaggcuggucucaaacuccugacauugugauccaccgcgcccggccauaucuaguaauuuuuaaauagauggugggcauuguagauaccugcuuauauguggauuuuauugucuuccuuucaagaaagguuugucccagcaggcaacuaauuuacuugcagaucaaucugauuguuuugagccucguuuuuaaauuuuguuagugcagguccaggaaagccuuuacgcuaagacuacauuagcccuacucauaagaugugaccuuucuggaauuucuacugaaugccugguguauucaagaaggucucaauacucugaauagacaaaauguucauauuuugcagaugugugcaaacuuugguaguugcuuaauuuaugguuuucaguagcuauccuuucacugaaaauuggccucauagggucuuaaccuguccauacacagcuuaacauucagccauaggcuguucauuuauucauuucaugaaggaauuuagaaaagaugcuauccuuuagucugauacaugacuuuaaugguguaggccagaaauucuuaauuguuuuauaaaaaggaguuaauucuauuucccaaagcucugaggucaaagagaacugauuuuaaauauuccaaaccaaacagaaaacagaguaccauuauuguccauguuccauucccucuauaaaauaugggcaaacaacagagaauuaacaaaguguguauagcaaugguaacugacauggaaauguaacauguagacaggccuucaaacaucuacuggcagauuaggaaguauugguuaaaaacacagguucauaaaacuauagaucagcagaaaaggaacugauugcccauugcauagugcuagaccaagugguuaucaagcugggaaaaaagguaggguuagauuuccaaaaucauacugcccaagaaaucaauccagauagauucaaauccaaguauauacaaaauauuuuuaaagucucugucuagaaggagauuuuuaaaaacaagcauaaaaggcuuaaacuacaaaagaaaaagcuaugacuuuaaauuaaaauggccacaaauaccacaaauuaaaagacaaagaccugaaagagauguuuccaauacacuuaaccacaaaugaucaguauccagaauauauaaagaacuccuacaaaucaguaagaaagauagcaacccaaaagaaaaauggugaaagaauaugauggggccauuuccacagaaaaggaagaaaaggaaaguagaacgacugauaauauaucaaaugauaaucaaccuuuagguuuuacguucugaaaauuccuacaaacuucuuucacucaaaacaaaacuuuuugauacagccaagauaaaaugccuaacggguuaguugcuugguguaggcuuucucuacuccaguacaauaaaauuagacuuauuugaaaggaaaaaaaugccagggcuauaaugucaucugcuaauuuguccuuuuugucauuagaaaaauuucacaaagcagguuaauguuuaagguauauuuuccucaacuggcaaagagaacugaauacuguucauccuacuucuuucccagaaguauaguggccaaagcgaaggagauuuauggaaggcaaugauuaacccagagaacuaaccuaggcagucaagcaaccgaucaccucaucguuuucaagaaucaacuacagauaauaagacggcaacaggagagaaauauaagaagcucucggcauguggccaacugccuuggaagggaagaagaaacaaaaacuuuugggguccacuuaaaaacucaaugagaauauacuucuaucugaagaaaaaaguguuaacaagaaugcagguggcaacaauagacagugggaacuacuagaaaggaaagguagggaggggggcaaggauuaaguaaccauugggugccaugcucacuaccuggguaacggggguaaaucaugucccaagccucagcaucaugcaauauacccauguaacaaaccugaauauguaccccugaauccaaaauauaaguugcaauuuuuuuaaaaaacagcuaaaauaaagaaaauuaaaaguauuaaauauauuuagaaauuggaguaaaguuacucuuaaaaccuuauaaagaaaaccauuuuuuaaauauuuucugguuauucuaaauaaauuagggggauauaccaacaauucaccauacguuuuuacugaacaccuaaguguguacaaggcuuuauaaagguaauguggauuucaaaaugaauuaaguacaaccucuaccuuuaaagagcuggggaugggguuguugcaaaaaguuauacugcaagacagagauggaaacaaaaugcuuagggagccccccuaaaaagggaaacuaauuggaauggauguggcaagaaaggauucauagaaguguuauuuacaccagucuuuaaaggauggguaggaauuuaacagacauaggaaaaggagacuggaaaagguaaagcagacaaaaaaacagagggaacaguuuaagcaaagguauggggguuagacaaagcauaggauauauucaggaaaugccaagcauaugaguggggcugaaauauaagauucaugguaaagagaaagaaaaaugggaaauaagccuagaaaagaacaauggagacagacugaggaagucccuuuacacaacacaaaaaguucauuuucagcuguggggauucaaaugauuuugugcuguacagacauacauaauguagcccuuuacugucagaugggccuguguaugaguuaagucucauuuuaacaauugugcugucuuguggucaucaauccaccaacucccaugagaguuaacaguuaaucagaauaaaugcugagguugguuaaaugcuaaauuuuaaaacagauccugcugcuccauaaucaauaugauucuauuaauagaguaacaauauaauuucuuguacaaacuggauuguugagaauaaaggugguuccuauuaauaauaaugcuaguguaaauuaggaacaucccaacaaacugggaugaagugacuuuaguuauaaaaacucccaaaucagcugggcacgguggcuggcucacgcuuacaaucccagcgcuuugggaggccgaggcggguggaucaccugaggucaggaguucgagaccaaccugaccaacaaggugaaaccccauuucuacuaaaaauacaauuagccaggcgaguuggcaggcgccuguagucccagcuacucaggagguugaaacaggagaauugcuugaacccaggaggcagagguugcagugagccaagaccacgccacugcacuccagcaugagcgacggagugagacucugucucaaaacaaacaaacaaacaaacaaacaaacaaacaacucccaaaucacagggacucuacuuuucuuccacaaauucccuucagugggaaucuccuuuuguaaagccuuaggagaaucuaguauuugauacugagauuaguggcuauggcauuuuaaagagauaggcauauauuaaaaaugaauaaaucuacucuuuguauaguagcagagacuugaaggaugaauaacuucguguaaaucuauaugagacuucuuuaccuuaacuaaugacaaccaugaagacacaagaacuacauacugaucacuaaccucacaaguauaauuagacucagaugguauuuccugagcuucgguguuuuuuauauuugaaaacaguuaauuuucaacuauaccuaccaucccaaaauauaucagucuuuauuuuagcauacugaaggaaaaaaaucuguuuauugcuaaaauuacagaauacaccugaugguuugcaaaagacuuaauacggguggcugcaaaacuuagccuuuagccucuugccaaauaccguaccagauguguucugaaucaccaguaaaccgggaugcccucgugugagauuauuucaacuccaacuuucaaaugcuugcuauuagaaaacacuuacagagaaaaaugcaaucucacuaacuagaaauuaauaaagagacaaaacaaaccuguggucuuuaugagcaaauaaaaccaaaaacuucaaaugucacgacucuaaggaaaguaauuuaaccucuauuaauuuucgucaaagucuaagaccugauuaaagaugguuuucacccuguaaaaaguuguuaaccuuuucacauuaaaaaaauucacuuuacgucagggguuggcauaagguauaacaggacaaauggcaaauauuuuaggcacugugggucacagugaaccuuuggugcaacuaccuccugcugaagcaugacaacagccauuauaaguaaucgaugugaggggcagugauccaauaaaguuuuacuuagaaaaauagguggcuggacuggauuuggcucacagacuauaguuggucaaccccucuuucagaauauaagcucugggcaguccuugauacauaauagaugcucuauauauguuuauugaugaaucauauuauuuaauaagcaaaaaacuuaaccaaaugucucuacuacuauacaaacacuguguucauugaguauugagacucaacuuccuaaguuagaauuuauagguuauuuccccacacaaaauccuuacuuuaaaauuuuuuuaauuaaaaauuuuacuuuaauuguauuaugaaucauggaacacuaucaugucaguauugaacucuguucacccaagauaugaauuuucuggcuccuuggggcuguucauauaaauaagcaauccaacgaucagguauaaggacuagagcugaauggucauguugaguuaaggccacaguuaauaccuuaacaggcaagugagagccaaaggcaaaugggaagaacuguguggaaacuggucugcagagaaaacaauggaagagaaguaagacuuguuuauaccaugcaacgaagaucugugagauuucucuauacuguaauaauaaauccccuuuuuauuggagguuuucuuuuuuuucuuuucuuuuuuuuuugagacaaggucucgcucuguugcccaggcuggcguauaauagaguaaucuuggcucacugcaaccucugccuccuaggcucagaugauccaccucagccuccuggguagcugggaccacaggcaccggccaccacacccagcuaauuuuuguaguuuuuggaaagaugguguugcccaggcuggucuugaaauucugggcucaagugauccaccugccucggccucccaaagugcugggauuacaggcgugagccacugugccuggccauuuucuuuucuuuccaagacagggucuaacugucacccaggcuggagugccauggcacaaucacggcucacuguagccucaaccucccaggauuaaaugauccucucaccucagccucuccaguguaugggacuacaggagcacaccaccacacuuggcuauuuuuuuuuuuuuuuucaauuuuuaacaaagaugaggucuugguauguugcccagccuggucucuaacuccugcuugaggaguuagagacuccucaagcaaucuugccucaagcaaucuuccugccccggccucccaaagugcugaaugggauuacaggcgugagccaccacaccuggccaauuacagcuuuuuugaaagagcuuguggucuuugcaaacaaaucauuccugaauagaaaauggaauaugaaacacuuuggagaggauuuaaugcuugagcuuaaacuuuaaaaacgaguaggcaggguuuugagucaaggugaaauaauagggaauacauuuacccacugccugaaauaauuaauaaacagaaaagcauguaaaucaauggucuuuacacauuagacauuggccagcauaggacaguaaucccugagagacgggaaacaaacauuguaaguccuucuucaauagcuccccacuuaacagcuuccacggagcagagggauaagaaacccagguggaagcuggcaaucucccugaguugaggaaacaaaguugaaggccaugcuuguuagaauuugccuaguagaauaccgggagaagagaacugcagagacagacaggaguagaucugcagaggguucccucaagguuuuacugaaaguaucagcacgugcuuugugaggaauguaccuaaagcagaaaaauaaguaacuaaaaugggcagagggaacaaucccaagggcucacacaguagcaggaauaacuuauguuucaucuaagaaggaaacauacuucacaagacaucgaguagaauaaucauaagauuauugacucaguagaugggcaacauuagcccuaguuaaguuuguucuguucccacccaacuaagcauaaaaagacuugaaaggauuacacuaucuccaaauaacuuaagugucccagaauaaagcucaagaauauuucuaaaaauacaaugauauccagaacacaagguaaaauccaccaugccuggaauccagugaaaaaaacuaggcauguaauaaacagaacaaugugacccauuaugaggaaaaaaauguagcaauagaaacaagccaggaaaugauacagaugauggaauuaguaagcaaagauauuaaaauaguuauugcaacuguaaacuauauguucaagaaguagaagaaugccugaauauauuaaauagagauguggacaauaaacaaacauaaaucaaaauuuucaucucaugacggaugaaaaauaaaugaagaggaaaaauaugaguagaacuaagaauauaucagaaaugccggaauuaaagauuaauaaacuugaagacaaagccauagaaaccguccaaaaugaagcacagaaaaagccugaaaauacaugaacaaggcugggugcgggugugguggcucaugccuguaaucccagcucuuugggaggcugaggcaggagaaaugcuugaggccaggaguuagagcccagccugggcaacauugugagacccuaccucuacuaaaaauuaaaaaauuagccaggcacggugaugcgcaccuguuguuccagcuauucaggaggcugagaugggaggacugcuugagcccaggaauucgaggcugcagugagccaugcuugugccauugcacuccagcccgggugacagagcaagacccugucucaaaaaaaaaaaaaaaaaaaaaaaaaaaaccaaaaaacauuaguauccuauguuacaucuuuaagcaggcuuauauauguauaacuuaaguuccugcaguggaggguaagugcuauauacaauuaccaaaaaaacaaaacaaaacaaaaaagguagaaaaguaugggcuuaaaaugguacuacaagagcaaacuauuacauauuauggagaggaagaaaguaaugagaaaagcuguacauuuggauaauuaaagaaaaaaacugugaaaagacagaaauuguuuuacauuuuuguaaaucacucuaacgucuggguuucagaagagaaagcuggguuaucauauccgcuuuuguccaaucuguugcuuaugcuguuuuggcugggaaagacaaccaaccagucuguguuaugcagaaaaguggaaugagauauuaccuauaaacuauccuagucagcucacaacagaaagaaccagagaagcuauuuguuuaugaaacuuaucccacacaggugauaaggcagaaaggagacagaaucauaaugaguuuccauaaaaaacauuacagguucacaguucuucaugaaguguaaguggaugccaugggucugagcuggguguuaguuaaguucuaaguguaagaagccaaauugccagaggucauagaagaaaaaggggaaagggaccaaguaauggaauuacaagggaggaaagccagagcagaguugagucuaguucagaauaucucacaauauuauauuuauuauauaguccaacauauuucaaguugagucagaacauuuuaacugguuuugucacucgcauuuauauaaaucugucacuuucccaacuucuucugggcuuaaauucccuaacaaaaggcauucuauaacauucauaauccucucagaucugauucacacaguaccuauguuccuaucaguaacucagaaaaugacugaaagagaacuuuuaggugcacuuuugacaggcuggcuuacauguuaaaagucuuacccuaagagcaauuaucccugggcagauaccaacuauaaccaggaggucagaaauuaaaauccuagggcacagaauagcucuguguugccuucuacugauacucugccuauauuuaaagcaaauuuugggcccaauaccgaagggaauuuuuauaaagcuaccucacagcuuaaaaagccuaucaaaauaaucuccauuaauacuucuaaaaaguaccaccuaaugacaacuuagaaaucaaaccacaaucugguaagaacagaggacauaaacuacaagaaaacagaaaacauuugauauuuuagguuaggcaaagauuucuuaggucaccaaaaaguaugaaucacgaaaggaaaaaaaaaaaaaagauaaauuggacuuuaucauaguuuaaaaccuugacucuucaaaagauaccacuagaaaaauaagaaugcaagccauagauugggagaaaauaucugcaaaacauguaucugauaaaggacuugaguccagaaugaauaaagaacccuuucaacucaacaagaagaaaaacaacucaauuuuguaaaaaagauuuggauacuucaccaaagaagauaugugaauggcaaauaugcacacuaaaagauguucagauucuuagaccuuagggaaaugaaaauuaaaaccacaaugagauaucauuacacuuucacuagaaaagacagaauuuuaaaagacuaaauauaaacaaauguuggagaggguaggagaaacuggaccucccaugaguugcuggagcuaaugcaaaaugguacagccacacugggaaaaaaaucuggcuguuucuuaugaaguaaacuuaccauucaacccaacaaucccacuccuaaguauuuauaagagaaaugaaaguauauaaucacagagacuuguacauaaaugcuuuauucauaacagcccaaacuggaaacaauccaaauguucagcaccuagugaaugguauauccauauaauggauaaaugcauauaaugcaauuaaaaaaaaacauuaacucauacgacaauguggaugacacuuaacuacguaacacaugguuccauuuauaagaaagucuagaaauggcaaaacuauaagugauuacagugauauagcagauaagugguugugagggaccaggaauagcgagagagguuuuacuaaaaggagcacaagggaacuuuuuagggugauagaaauauuuuauauaccaugacuguggugaugaugguuauaugacggcauacguuugucauaacucgucuaauugguccauuuuauuauauguaaauuauaccucaauaaacgugauuaaagaaaaagaacaggggaauaaacauauuugccccucauauuaccugucacucaccagaauuuaucaacaccugacagaaaauagcaauagguaggaaaguaaaaauguggaaaucacuggaaagagcaagaaauugauaagaauuaugcagucaagauaaaagcaaugucauucuuuacauauuuuaauauauaauaauguaauacauaaauauauauuuuaaccauucaauaauaagaacaaucugauucuaaaagagaccuucaucaauccaaaauaucaccugcuuuaucaaaacaguauuucuuagaguagauucuaaggguuaccuaaaucacaggcaucaacauauuucugggcaccaucccagaccuacuccauccaucacacacucuuagguaaaaauaagaccccauuuuaaacuguuuccagauaaauuauuuugcaaauuuagucucacagaaugacuuuauuagaaguucuaauguacacguguguacucacacauauauaucaacuggguuugcaauuaugccagguugauaguauucaauagcacauauacuuuccuuauaggaaaauagagguaucuccauuucauggagacguagggggcucaaaugagauuaucuauaacauaagauacacucaagguuguacuguuccccagucauccuggacuuggauaggaacaucauucuaagcagguaaaaaagacuuuuugaccuuaccaagccugaagucucacaaugccauacugccucucuuuuaccacuauauacugcuuaguagcaggugacaaccacuuuaguuauuaauuuuaguuaauauuuauauuaucacaagaauauuuccuuuaaauaugugauauuuuaaaguuaugugcuacagcugggugcgguggcucacgucuauaaucccagcacuuugggaggcugaggcggguagaucacuugaggucaggaguucgagaccagccuggccagcauggugaaaccccaucucuacuaaaaauacaaaaaaauuagcugggcgugguggcgcaugccuguggucccagcuaccugggaggcugaggcaaaagaauggcuugaagcugggaagcagagguugcagugugcuaagaucaugccauugcacuccagccugggcuacagggcaagacucagucucaaaaaaauaaaaaauaagaaaauaaaaaaguuaugugcuauguuuccucccuuacuuuauagauucaguugguuucuuagacaauaucccaugcgcuuacacacaauuuaauuucaaacuuuuuuuuuuuuuuuaauaauagagacagggucucacuauguuguccaggcgggucucaaacacccagccuggagcaauccuccugccuuagcuuccugaagugaggggauuacaggcuugagcuacugugcuggacccaauuucaaacacuuaaaaaaaucaaguacuaccaugucaaaagaaaacaauuuaacaauaaaacaaaacaaugugaggaacuacagaaaacaaagcugaguaaacaggccaagguccuuaccuucaugaauuuuuuuuuuuuaaaugugguaaaauauacguaaaauuuaccaucuuaacccuuuuuggguauacaauucaguggcauuaaguacauucacauuauuguguaaccaucaucacuauccaucuccagaacuuucccaucaucacaaacucuguacccauuaaauaauaauaaauccccauuccuccuccaucccacccucaguaaacacuauucuauuguuuguucucuauaaauuugacuauuguagguaucucauauaaguggaaucauguauuuguccuuccuuccugaguuuuuucuaacuuuuuuugagauggaguuucgcucuuguugcccaggcuggagugcaacggcacgaucucggcucaccacaaccuccaucucccagguucaagcgauucuccugccucagccucccgaguagcugggauuacaggcauguaccaccacaccuggcuaauuuuguauuuuuaguagagaugggauuucuccauguuggucagacuggucucaaacucccaaccucaggugauccacccaccucagccucccaaaguguugggauuacaggcaugagccaccgcgcccggcuguuuuuucuaauuuuuaaugcauguguaggcaauaagcacuaaggacacaaagacuggcagcauacugaaucugcccucaugaaacgcacacucuaagaggcaagucagacauguuaaaaacaaacaaucuugcaaguuaaugugauaacugcuuuaacagggauacaaaguacaaugguggcacaaaggacugauaugacuaaggguaguugggagaggcuucacaguguagaugaugucucaggacagucuugaagugugaagaauucaccaguagaaaaggccauuccauccagaggaauggcauucagucauuucauaagggaugacaccacaccagacacugaacaccuaggacagccaagguaccugcuuucauuaagcuaacagcauaugcaaagucaugagguacauacauuugagcaagagcaagcaguucagacugaaaagcaaagugcuugagggagaagcagaagaugaugcugaaaagguaggcaggugcucgaucaugaaaaaacuuuauguugucuagaguuuuauuuuagauuauaggccagggcuauaaucuaaaauauauaagggcugaauuugaaaacagguaaaguuagagacaaacugggaggcuauuaugaugauccaugcaaaaauaaugacaccucaauuaaaguaguaaccauggaaauggacagagaauggacuugaaaguccacaaacuacauguaagugauuguuaccuguuuaugauuaaauaaaaagaaauaauuucucuucuucaguaaauaucuaccaaagccccauaauguauuaaaaauuauugacaaaaacauauuaggauaaaagaacacaaugcauuuucacuuuucuuuuauguauguguagguguguggaaucagggcuccaauuacaauccugugccacauaacaauguuucagucaagauggaaugcacaugcaauggugguuccuuaagauagagcaucauaucgaaaccucguauauggcacuugauauugacacugcagaucaaguaggggaaauagcugauauucaguaauggugcugggacauuucguuuucuaauguaacauacaaauauauuuuuauuuauacauauuuuuucuagguuuguguaguauacucuaugauguucacacaaugacaaaaucgccuaccaaugcauuucucagaacacaucccugucguuaagcaacacacaacuauaccuuuaaguaauuuuagagucggucuuccuuuuuaccagaggaaaaacaauuccuuguuucuguucuacaacugcaagaggagugccagaaagaguuaacaguugucaacagaagcuugacccucuguucucaaguaugugcuggggauguagugggaauuuaacacacuaaacaagaaacuguccauaauccaguuuacuucaauuuuuaagaagaaaucuguauauaaauacugaggcuuucugccaaaaaagcaaaugcuucacggauuuggcuccuugucuuuucuuguggcuguucuccaauaucaacuuggagaugucccuaucucaaaaucugccagcuacugaaacaugggucaaacaaaacacuuuccucucuguagaguauaauguaucaagacuaugaauccuauuagguaaagcagagaucacauuuaaaaaugcauauaacuaguucccccaaaacaaucuuuucucagauacuaauacucauuccacaauauuaaacuucagauuucaaauauaagguuuucuaugauuaaacuuuuagacacuggaaucagacauauccaaagaaucucugguaaaucugacacaccugaauugauguaaauuuaauagaagcguaucuugcuucccuuugcagguaauauuccuuuucacuugacuaccacauaauuuuaagaagaaaccagaauaacucucauucaucacuuuuaguaguucaaaaagucugaaucuacucaaaaaaaucuccacacuuugauauuucuaaguuuaaauuuguuuuauuuacacuaauucaguuuauuaccuuuuagcggucuuaaauauuuuaugcauuacaaaaauccuucuuuaaaaggcaucccauuuauacuuucaaaccacuuucuuaacauaaaugcaaauuaacacacuccagaaaaaaaaauuauuguuaauuccuuaauuguacuguaccucaagucuauuuaauucuacauaguuauaggagagaaaaauaaaaacaucuaggucuagcuacuugauaauagguaauacucuuuauuccaaauuaaauauauaacaguauaauaacgagcauaauuccgaagacaaucaaaugacauucaagugaucuaacagaaaaauaagaaaauauuuugauacagaaaacuaaaaacauagcuuaguucauaagucauuaggguuauuacauuacauuuuaucaucacaacaauagccacaaccccaggcuauaucucauggucccuaaaucuaagcagauuguuuuuaguugggaaaaagauuaucauaaacuuauauuuuacuaauaaucugaaggaucucaaauaugccaagaagccuaugucucuaaaauauagcuucaucuuuugaaauaauugaugcuucaggaacagcaacaauaaccauuaucaucaagguaaucucccugaaaaaucucaucauguuagaaaaaaaacaaguauuaaaaaaacaaaaaugaaagcagaacaaagcauacaagagcaauuagacaauuauuaaauggcccauauaccugcaauugaaaucacagaaagagaagacagaacaggucaaaugaaauacaugaagagacaauggcuaagaauuuuccaaauuaaguaaaagaugcuaaaccagagaaccaaaaaacucagagaagaccaaacaaaccaacaaaagaaaacagacacaucacauucaaaauaaagauaaaucauaucuaaagauagagaaacucuuaaagacggccaaaagaaaaauaaauuaaaugaacaaaggacauuauaugcaaagaaucaaagacaaaugacaaaaauauguaauagaugcaaaaaaucucaacaaaauaccagcaaaccaaauccaucagcacaucuaaaaccuaauucaccauaaucaaguagacuuuauuccugggaugcaagguugguucaacauaugcaaaucaaucacugugauucaccacauaaacagaauuaaaaagaaacacgauaugaccaucucaauagaugcagaaaaagcuuuugauaaaauccaacaucccuucaugauaaaaccccucaauaaacuagguaucaaaggaauauaucuaagagccauuuaugacacacccacagccaacaucauacuggaugggcaaagccuagaaacauucuccuugagaaauggaagaagacaaugaugcucacuuucaccacucuuacucaacauaguaauggaaguccuagcuagaguaaucaggcaagaaaaagaaauaaaagguauccagauaggaaaagaagaagucaaacuaucuuucuuugcuaaugguaugauucuauaccagaaaacuccgaagacuccaccaaaaggcuccuugaacugauaaacaacuucagucaaguuuuaggauacaaaaaucaauguacaaaaaucaguagcauuucuacguaacaauaaccuucaggcuaagagccaaaucaagaacacaauuccauuuacaagagccacaaaaacaagaaaauaccuaggaauacaucuaaugaaaguagugaaagaucucuacaaggagaacuacaaaacacugcuuaaagaaucagaaaugacacacacaaaugaaaacauauuucaugcucauggauuggaagaaucaguaucauuaaaaugaccauacugcccaaaguaauuugcagauucagcauuauuccuaucaaauuaccaauaucauuuuucacagaaucagaaaaaacuacucuaaaauucauauggaaccaaaaaacagcccaaacagccaaagcaauccuaagcaaaaagaaaaaaccuggaggcaucacauuacucaacuucaaacuacacuacaaagcuacaguaaccaaaacagcacaguacugguacaaaaagagauacauggaccaauaaaacagaauagacaacccagaaauaaagccacacaccuacaaccaucugauguucaacaaaguugacaaaaauaagcaaugaggaaaaagucccuauucaauacauggugcugggauaacuggcuagccauaugcagaagaaugaaacuggacucuuaccuaucaccauauacaaaaauuaacucaagauggauuaaagacauaacuguaagaccuaaaacuacaaaaauccuagaagaaaaccuaggaaauucuuuucucgacaacagcccugucgaagaauuuauggcuaaguccucaaaaacaauugcaacaaaaccaaaaacugacaaguaggaccuaagagcuucuauacagcaagagaaaccauuaacagaguaaacagauaaucuacagaaugggagaaaaaauucagaaacuauguaucugacaaaggccuaauauccagaauuuauaaggaacuuaaaucaacaaguaaaaaacaaauaaccccauuaaaauguaagcaaaggacaugaacagacacuucucaaaagaagacauacaaauggccaaaaaaaaauugaaaaaaugcucaucacuaaucaucagagaaaugcaaaucaaaaucacaauugaaauaccaucucauaccagucagaauagcuuuuguuaaaaagucaauaaauaacagaucucaguggggcuguggagaaaagggaaaaccuuuacgcuguuggugggaauguaacuuaguucagccacuguggagagcagcuuggagauuucuaaaagaacacaaaauggaacuaccauuuaaccuagcaaucccauuacuggguauauacccaaagaaaaauauaucauucuaccaaaaagacacaugcacccauguguucaucacagcacuauucacaacagcaaagacauggaaucaacacagguguccaucaacaguaaaugagauaaagaaaaugugguacauauacaccauggaacacuacacagccacagaaagaacaaaaucauguccuuugcaacaacacggaugcaguugggggccauuauccuaagcaaacuaauggagaaacagaaaaccaaauaccccauguucucacuuacaaguggcagccaaaccaugaguacauauggacauuaagaugggaacaaacagacacuggagaauacaagaugggagagggaggcaaggauggaaaaacuaccuauugaguacuaugcucacuuccuaggugacggguucagucguacuucaaaccucagcauuaugcaauauaccuuuguaauaaaccugcacagguacacccggaaucuaaaauaaaagcggaaaaagaaaaaaaauuuaauucaaauaaaaauauauacguaaaagccauauaacaaacaguagagugacaucuuuuaaguacugaaagaaaaaaaaggcaauccagaauucuauauucagcaagaauauuuuagaaaaauaaagucuuuuugagagaaacaaagauaauuuauuacuagcagacuuggccuauaagaaauguuaaaaguucuucagguagacagaaugauaccagacagaaaacuuggaucuacacaaagacaugaacaacaguauaaacgguauaaaugaaaguaaauacaaaacuucauauuuuucuuauuugcaauuguucuaaaagauaacugucucuaaagcaaaaaugcagucauguacugcauaaugauauuuaaucgacaagggaccacauauauaaugguggucccauaagauuacgaugaagcugaaaaauuccuaucgccuagggacauccuaguuguauuaacauuguaguacgaugaguuacucacguguuuguggugaagcugguguaaagaaaccuacacugccaguuguauaaaaguauagcauauacaauuauguuaaguacauaauacuugaucaugguaacaguuacuagcuuauguauuuauuauauacuuuaucauuauuuuagaauguacuccuacuuacauaaaaaggaaaguuaacuguaaaacagccucagguaaguccuucaggagauauuacagaagaaggaacuguuaucauaggagauggcaguuccauguguguaauugucccugaagaccuuccagacaagauguggaaguggaagacagugauauuuauagcuugacucucugugggccuagggcuaauguauuugcgucuuaguuuuuaacaaaaguuuuaaaaguaaaaauuaaaaauuuuuaaauagaaaaaagcuuacagaaugaggacauacuuuuguacagcuguacaauguauuuguuuuaagcuaaguuauuguaagagaguaaaaaaguuuaaaaaacuaagaaguuaauaaaguaaaaguuacaguaagguaaggcuaauuauugaagacuuuuuaaaaauaaauuuauuauaaccuacaugaacaguucuauaaaaucuauagcaauauacuguaaagucuuagaguaguaauauauugcauguugauugcauauauauaaaaguaaaguguaugacaacaaaaacauaaaagaugaagaggagaaaugggaguauagaacuauaagguccuaauacuacauauaaagcuauguauuauuauaucaagaaaacugugauuaauuacaaauauacggcaaacccuagggcaaccacuaaacaaauuucagaaagagguauaaauaaauaagcaaaccgcggagagaaauggaauuuuuaaaaaguccaaguaauccaaaagaaaaaaagaacagauagacuaacauaaaccagauaccauagugguagauuuuaauccaaccauauuaccaauguugauaaauauaaacaaucuaaacacacuaaauaaaagagacaugucaaaaugaaagacagagauuaucagacuggauaaacaaguaagcccaucuauaugcugacuauaagaaacccauauuaaguguaaagauacagauagguugaaagugaaaguaaaacaaaaaacaaaaacagaaaaaauauguugggagacaauucuccaugggucucuguugagguagcugccuuugaaccuacuucucaguaucuggucugcaaccaucuccccaguuacucuuuauuaauaagugauacaauggagagauggaaaucucaugucuauugcuaauauguaugaaauucauggcaaacuucaguuuuugacaugauauaccauguaaauacuaaucaaaaggaagcugaagugguuauauuaauacaaggcaaagaagauuucagaacaaggaauauuaccagagauaaagaggcuguccgccagaaaggcacaccgaucuuaaauauguauggaucuaacaaacuuucaaaauacaugaaaaaaaaacugauagaacuggaaagagaaauagacaaaucuauuaaguuggagacuucaacacaucucucaguauuuuauagaacgaguaggcuauaaacauauggaaaaacucaaucucucacuagugaugaaaaauguacaaacccacaaugagauguuuuaaauuaauuccuaauuuaaaacuuaagucugacaauccuaaauauuggugaagauguggaacaucagaaacucacacuucuggugggaguauagauugguaugaucacuuuggaaaacaauuuggcauuacuuaguagagaugugcucauauuuauaauuuaaaauucuuaugacgaauaaauaguaaauauagauucacucagcaaauauuaaaaacaaaauaaagccacagaauguaaguacaacaccccguuaggccuaacuagacaccgagacucacauaacccaaacaggcugguuauacuuaacaugucaggcaggaguccucauugcaauucgggggcuaguaucuuuggcccucucagguggcagaucaaguguaagagaaugagagcauaagguccuugcaguagcuacucuagcuuacagguaccaaauagcaaccaauaucuccagucucauaggcauagcuuccugagcuucagcaacagauuugcuuaguugcaagaguuaucacacucagggaaguccaaagcuguuaacgguauaaguaccaguauuuacaauucauucacaguccuccucugguccuuaugcaauucaguaaucaugagucauuauuaccauaagcaauggugcucgguuauacaacugauauucuaccuuaucaagcuuccaagugaacaaagcuaggaaguuaagccaaggccaaaacuguccgaagagaagaaagguuaauguuacaacaaauaaagagauucaauuuagaauggcacuaagcuaaacaacuauuaauauauuucacugaauccaagaugcuagugauuaugacauaauuaauuuuuguacuaagaaaagugcuguuaaguaaauauggugcacuacugauuguaagacauauccuaauuacugagaugcacaaggagggaaaauauacuucuuagaauugaugaaauacagaauaauccuucucuaaauuuuucacuaaaauauuuaagacauacaguaaauuuucacuuaacuuuguugauagguucuuggaaaccuaaacuuuaagaaaaacuuuguagcagaucuccaaaugacauuuuguucaacuucauuuuauuauaacaaugagaaaaaaacgguuucauuauaugugauuucacuuaaagucacaauuuccaagaaccugucauggacauuaagcaaggacuuacuguguaacucuuuucucuaccuuggggacacggucugcuccaacagaaaccaguccccuacuaaaaauuuucuaagacauguaauaccucuguucaucuacucuaaaaacaaccaauaucaacauaauugacgcagcauagcugucuucauccuggcauguuaaaaagcauccaaaaucuaaauaaaugaauuagcucccaucacugauuaaaucacuaaaaguccuaagggccuuuacaaccuggaggcuugcaugcaauguucugguaaaauaaauaaauaaauaacaaaaauuuaaaaaaaaaaacuguuucagguuauccauaaauauguuaguucccauauaccagcgaacugugcaaggagaaaaguggaaaaaaccuuaaaccucaauccaguagagguacacuaagugaauguuuucaucuaaguggguuguauacgaucauuaguucuuuaugcuagggaaggcaaaucuaucuuuuuauaagcagaaaauaaauaugauuaaagugaacuugccauacccuaccuacuggcaaacacuaggcuuggaaaaauagcccuuguucauagauagguauguauggaaugggaccuaaacaaacauucagcagcauagauaaaacaucuucuuaaaaaugccaaagaaaagaaucugugauaauuuauauuuagaaacagaaaaaauguaaaaaguauaugcuguguguucucaacaacauacauauaggaagaaauaaaaagacagacuuauaugcagucuaagauauaaauggaacucuuaagagauaagaaaaaagaaaugaauagaaacaacaauuuaaaaaacuacauuuugguacauacacuuuuaaaaaugaguucuguuaucuauguuuuccaaaaaggaaaacagggccgggcaugguugcucacgccuguaauccuugcacuuugggaggccuagacagguggacuuccugagcucaggaguucaagaccagccugggcaacauggugaaaccccaucucuacuaaaauacaaaaaacuagcuggacauggcagcgugcgccuauagucccagcuacuugggaggcugaggcagaagaauugcuugaaccugggagacggaggcugcagugagccacgaucgcaccacugcacuccagccugggugacagagcaagacuccaucucaaaaaaaaggaaaacacauaaaacggucuaugcugcaaaagucacacacuaaaggaaaggguaaaauaaaguuauuuuuauuuguuuuuuuuuuuuuuuugagauggaguuucucucuuguugugcuggagugcaauggugcgaucucagcucacugcaaccucugccucccggguucaagugauucuccuggcucagcccccugaguagccaggauuacaggcaugcaccaucacgcccagcuaauuuuuguacuuuuaguagagacgggguuuugccauguuggcuaggcuggucucaaacuucugaccucaggugauccaccugccucagccucccaaagugcugugauuacaggcaugagccacagcacccagccaaguuauuguaaaaauauaaaauuacaagagugaaaaacaaaaucaaaccucaauuauagcaaauuuuguuggcugagcgcaguggcucacaccuauaaucccagcacuuugggaggcugaggcaggcggaucacuugaggucaggaguuugagacaagccagaccaacauggugaaaccccaucucuucuaaaaauucaaaguuagcugggcauggugguacgcgccuguaaucucaguuacucgggaggcuaaggcaggagaaucgcuugaaccagggaggcggagguugcagugagcugagaucgcgcccgagcacucuagccugggcaacaaagcgagauuccgacucaaaaacaaaaaccaaaaaaaaaaaaaaaaaaaaacuuuguuuaaaaucuucagauggguuuaaaacugaacugacauaaaaagauuaaaaauagugaugaaaaacgauuuauacaauauaucgcagaaauagucaaacugaaaggaaauaggaauaauaauuuugacacaggacaaaaagauuuuaagaaaugaauuagucuuuuuauauugcuaaaaagaucucuacagugcuacucaaaugccaucuaugaacuagcuguuugcuacagcuaugcaacaagacaagaacaaagcucgaaacuuagcauuuagaaacucuuacagcagucugagagggaaauucuauaccuguuaaauaaaauaauuuuuaaaaauggagguuauauuacuauuuugucaaguuauucucauuucauuucauuuuucuaguaauucauuuuuaauguauuuuaaagaaguauugggaaaaaaaccugauucuucaccacaaauaauuugaaaagcacugugauaaaagacuuaucggucaugaagcugggaugugccaaacaacacaucaaaauauacaaauuuaaaacaauuacagaugcaaggcaaaaaugaaggacaaauguuuauuugggaagcaaacccauuccaugacacauuagauuuuuuuuaaaaaaagcacauagaggaauuuuaaaaugucacguuuucucuaagaagucacugauuauaaauguccuaucaguuuaauaccagcuuuucaggagggaaaauuacuguauuaaauguacauacugugagacacauuacaaacucggaaauguuaaaauugggccaggcgagguggcucaugccuguaaucucagcacuuugaggggcugagaugggcagaucaccugaagucaggaguucaagaccagccuggccaacauggcgaaaccccaucucuaugaaacauacaaaaauuagacagguauggugugguggcacaugcuuguaaucccagcuacuugggagacugaagcacgagaaucacuugaacccaggagauggagguugcagugagccgagaucgcaccacagcacucuagccugggcgacacagugagacucugucucaaaaaauaaaauaaaauuagaaaaaagaaauuuuaaauuguuuaaaaaggauuaaccaagaaaauaacaguaagucaauaauuugguauuaaaugaaaaacuuccuuucaauuuucagugaaacauguauaaagauguuaguaauaaagcagacgcuaaagaauacaucaauaacuuugaaaaacuaaaaacuauguaaagcaugguaaaaaacuggcuuucugccaugccccacuaaucacuuaaggauuccuauuuguuuuugaugcugcuggguaaaauuauauaagaagaaaggguucgacaacuuuaaaauguuuaaaauuauauuaaauuacucaaaacauauaaaauguccagccucgcaguuuucuaauaccuuuuuauacaaaagucaagggaaaaggucaaaguacuucaugucagauguggcauaggaggucacagaugucucugccaccuucuuccuggcuucccacaaucucagaaaaaaucuaggauauuauuugggcaguagguagcauuacugcauucucaaaagagucuacauucuguguguuuuucuucugugugguccacugcuaauggcuagccuaaucuagccauccuaacauacccaugugguugauuagguuaagguuggcugaacagauugaaaauuauauagcuggcccuccauaucuguggguuccacaucuguggauucaaccaaccacagaucaaaaauauucagggaaagaguugcaucuguacugaaugcguacaaacuuuuuuccuuguuauuacuaccuuaaauaauacaguaucacaacuauuacauagcauuuacaauguauuagguguaagugauaauuugaaguacuauauaggagaauaugcuuagguuauuuuaugcaaauacuacaccauuuuauauaagugauuugagcaucuguggauuuuuauauccucagggauuccugcaacgaaucccucacagauacuaagggauggauacagagggaagacuguacguaagaguagagcauugcuagaagcacuaccaugaucuaugcauguuuuauacacaucacacacacaaacacacacacaaugaaauuaacgagacucaaagcaacauuauuaacaauuucuucuaaguuacacagaguauuuuccaucuauacuauacaaucucaucaucuaaaaacagcccuccagagguuaugauccuacuccuuggacugcccggucaaaacgacugaugucauaauaaaaccaaaccuagaagaggaaaaaauaaaucaaagacaggauccuuuugaaguuuuucauuuuaacuauccagaguuuuaaaaaguucucuacaaaagauuugauaaugccaggaucuuuuccuuccauucccaugccuaauacuuaaaccuaacuucaucuaaaugugauuuaaaagccuaauucagauauaaagauuauuuaugaaaugaaaaaaagauacuacuuaaauaaaaaguaaucuaccauaagaacuaacggaggaaaacauuuggaacucaauuuacagauggagaugaacuuuacuaauauaugaaggcucuuuggaaucaguaaggaaaagaccaagagucucaacaggaaaauggguaaaagauaaacaguacgcugagaaggaaauaccauaagggccucucaagcauaugaaaaaacacucaaucucacucauaauaaaaggaaugcaaauuaaaacuacacugagauccauuuuaugucuauuagauuggcaaugaucaaaacauuugagaacauaaucuugaugaagacauggaaaaagucuccuauugcuggugggaguacagaucaaaacaaccucuguauuaguuuuucucauuugaagaaauccuuguaagauguuuaaaaauguagcauguaagauaauauuuagccuggugugggcuguuggucauucucaaaaaauuguuaaaaguuuucuacuuuuauagaauucuguuuacauaaugaagcagacagguaggccacuuuuaaaaacuuggaugacuggucgggcguaguggcucaugccuguaaucucagcacuuugggagggcugaggcgggugaaucauuugaggucaggaguuugaaaccagccuggccaaaauggugaaacccugucucuacuaaaaauacaaaaaauuagcugggugggguggugcaugccuguaaucccagcuacucaggaggcugaggugggagaauagccugaacccaggaggugaagguggcagugagccaagaucacaccauugcacuccagccugggcaacagagcgagacuguuucaaacaacaacaaaaaacaaaacaaaacaaaacaaaccuggaugauuaacacaguagucuugcucuaucugcugcucaccucuugauaccuuauugugcacuuaaugggugcucaauaaauauuuguugaguugaaugaaacuaagaauaaugcugaaggaugacaaaaauggaauaaaaacaagaacaaugaauuaacuaaauuuaucugaacuguugaauaaauugcuuacauaaacacuacuucaagaaaggagcaaugccacgcuaguuagugcauguuuccugaaaaaugaguuagccagcaacaguuggauaauagauuguuguaguaauggcccccuaauuagccccacucaguuaggaaaccccucccauaccaacucuggaauuggccauguugaucugcuuuggccuauggacaacagaaaauauacgaggcuugcugucacuaguuacuucuguaaacccuacuacugccuccaggugaaagagccacgccuagccugcgggagacacauggcccccaucacccaagcaaacaaccaguacggauuauccagacauagcuauccuagaccaaccagcucccagcugacccaucagcugacugcagccacauccgcaaggccagacauaagcugcagcagaauugcuuaauugagcccagcccagaauuaggcuaacaaaugccuauuguuucacagcacuauguuuuggggagauuuaucauacaacaaaagcugauccaaguagagaggggaauagguggucaaagaagauuuuucccuuaccuguucugcuuuucaaauuucacaaugagaauauauccacauacuauuuaauuacacugaacuuauaaaaauuuuauaucagauugauauuaaaaucuuacuaucaccuuguaaacacaaauacauuaauucaguccaaauaggagcaugaauuugagaggagacauuaauauugcuucagaaaaaaaaaauggguuaagaguaccaggguuuacuaucucucacacacacacacacacacacacacacacacacacacaaaugugaauaagaauauauucacggucacugucacaucucaauaauggcuauuaucaaauucuggaaguguuagaagacacucaucucaaauucugcuucacuguuucuucuguuuaaguggguaauggccuaauacauguuuucucauuuaauccucacaugguaugagguaaacauuaugcugcaucacuuuaggcaaaguuaauuaaccucucuaugccucauuuccucaacuguaaaauggggauaacaguccuauuuuauagaacuguugugaagauuacaucgcuuauaacagggcacacaguccuuaauaaacgguuuaccaccucguuuaguaaaaugacguaaaauuaaggucuuuuaacuauaauaacauggcuucuauuuucaaaacacuaagcauuaucaacuaaggugugagacaucauaauuaauuuggauaucuuucuaaugaccucauuaaaaaauuaaaagacaugccgggguguggugauggcucacgccuguaaucccggcacuuugggaggccaaggugagcagaucaccugaggucaggaguucgaaaccagccuggccaacauggugaaauuccaucucuacuaaaaauacaaaaaguagccgggugugguggcacguggcuguaauuccagcuacuugggaggcugaggcaggagaaucauuugaacucgggagguggagguugcacggagccaagauugugccacuacacuccagccugggcaacagagugagacucugucucaaaaaaauaaauaaauaaaaauaaauaaguaaaagacaauguuauuaaacaaaaccuaggaauguauguagaaaauauauggugaugagaggugaagcucugggcaauaauaaaucauuuaguccacauuccacaauccuaaguacguuuaaaauacaaaggcuuccauuuuuguguguguuacaaauucacaagagagcaauaaauccuacugacaugucaccuuuacugugacaucuagcauacauacuuucaacauguucuaucaccuuuuuuuuuuuaaggcacuagugauggcuuuggaaaauaagguucuuuucagguccugauggaccacuuauaaaacauagccaaauuuuuaaaaaguguuuuaaacaggcaauuaccuagacuguagauaugucacuaacgaaauguaaaaaaucucauaccacaaugugcagauguuuuaguuucuccuaaugugaggaauaccugcuacaaaaauuccauguuucauuucaauucaaacauuuuaaagaguacucaguauaugagguaauguagcagauucuggagauaagacagguaaagaaaguaacauuuauguuacuauguaugccagacauuagcugguuaucuuauucaaucauaauaaugcuaugcuguagaaauuauuaaaacucacuuuacagaggaggaaauuaaggcuaacauaaguauaauaacuugcucggggucucucagcaacagaaggcagugggguugagaaguaugagguggggcccaugaagguagugccacaugacuauucuuagagacaaacacaauauccauuguaacagauccuuuuuuaacagcaauguggaaggggaugaagacuuggaaaaccaaggagauaaucuuugggaaugggcaaaggagucacagaaggcuuuaaagagguugauauuuaaguuguuaguuaagggugaguaggauuuaccaacuucaaugccaaggcucacccccaccccccucacccccaauauauuaaccaaaauaaauuacuuacuugaaauugagaaaaacaauuuugagagaaaucuuccucagauauauuauuccauaguuuuaaaacaaauaauaugaugacaguuuaauuuuuagguugcuuuuauguggcuugucuuggguuuuauucugaaaugaaauuuagauuagucauuuucuuguucugagaaacugcgaguaugccaacauguuuuaacuuuacauuuuucacauaucaacauguauucuuauuuacaaagucuuucauuucaccaucucaaacaaaaccuaauuuaguauauaaauuacuuugaaguauaaauauauaugcaaaauaauauauuucuuuuaauucuuguuauacuucuuuguaaucguaauaaauggaagaaaaauaguauucuugugaacuguuauauauuacacaaggcauuuuugagguaacacucuuuuauuauuugaauuguuuauauaguaguaaugcucucugaacccaaagaaaauuaaauaacugccccaaaguaaauugagcucaaauucuuaguauuucccaaaacuaucaucuaaaaaaauagaauuggccaaaaaagaaaaaaaaaaaccacgaaauuuuccauugacaauuacuacucauuuuucucagaauuuacuuugcuaggcuuguauucaauuucugcuacagaaaacaguccaguuuaccaaugcuaauuaaacaacaaaguauuuuucauuuauaaaaugaaauauuuaaaaacccacagagagcuggaagaaacacaagaucaucuggaaaacuuagaaggaacgacagaaaacacacacacacaccaaacaaaaacaccaaaaagguuaaauaggcugucauuaagagggucuuacuuuuacuuauaauuuguuuuggucucaaaauccacaucauguuuggacaguagacugaguuauuucuaauugccuaagacacucauuccugccuuaucuguaucuacauggaaauuacaaguuaacacaauuucacccaaaguuuacuguuccuuaacucccauuauuuccucuuauuaucacuaugauguuaaaauggcagccagauaccagagugacauaccucauaccauggcccauuucuuacuuuauaaguaaguucaaacuauuucuuugaaauauccagcaccaaugacaacauccucuaaaaccuacuuuaacccaaccuauuuagacuugaaucauuuuucacuuagauuuuuuuuuuuuuuuaaagagacggggucuugccauguugcccagacuggucucaaaauccugggcucaggcaaucuuccugccucugcuucccaaagugcugggauuauaggugccuggcccuagauuaucuuuaauugcgugaauucuaauccaaucaaaagcaagaugagagaaaauguaauuauaguaccagaggaacuugaaaggucucauauauucccuccucccuuuuuuggaaauagcauacauacgauuuuaguaucaauuuuuauuuauguuugcccuaaacuccuuuugcuauaaucuuuuguuuucuuaaagauacagcccaagucaucauaaaacgaauccuacuauaaucuauucuagauuauagaauauuaauaauauuauuauauaagaagauucuaagcacuauuagauacaguagggucucaaagauuucugaacuacauaugugcaguucuuuuaauaauuccucugagguucuguauuuuugucuuucaauuaucaucaaugccuuccuccaauauucccucauguuucggggggagagggggucagugugaggugaugagagcugaagagucaagauccaagauccccaauuuucaaauccagccucacaccaaccaacuguaggacacuggacaaaucccugagccugcuauguagauuucaguuuucuucauacaaaaugaguacauuugacuagaaugaugcuucucaacccuuuuaacauugcaaacaaaacuugucagcaaaaaaaaauuuagcacacuggacaacaggagggcauuuggaggcaucuacacagugccuggugaaaaaaaauuaucauauuuucuaauuacagaagaaaaaauguaaaguguuaugguagauauuuuuugacacauguaaugcugaaaauuuuaauaugaauuucaaaaccaaacauuuucacaucaagaauauuucaaaauuaaaaucaugcuuuauuucugacaaacauacaugcacuauuaggcagucaccuugcagagcauaucaaacgcacguggugagcagcauccaauacaggugaauacagauagucaggccuggagcugggccaccagagacacccucccugcuuccuuguccucucauuguaaguggguugcaccuugugguagguggcauguuccuucggcaccgugaauacaaacuccaguaacaauuccaugaucccuuucccacaaaaggcagcuguacacuguggcuggcugcugaaguagauuccaaguaguaaggcacaccucauuuaaugcacuuaaaauaucaaaaggagcaguaugcugcuuuuaacuguugguugucacucaccaugcuauuuguucacaggaaccccaacgccuuccuucagcccccauucuacuaggacuacccuucugugagccauguaacaucaacugaaaacuuugaauuagaagaucucuaacaauaacuaaaguuaaaaacaguauugcaguaaucauuuguuuguaacaacuauuauggucucuuauuuuuuccuucuuaccaauuccuguaagcaaaacauaacuuaaaaauauuaacuuugaauaguauuacaugcacaugauuuuaaaauacugaaaaauuaccaaacaguauacuuuaaaaguuaguccaucuuuguccucuaggcaaccacuucuacacacuggagcaauuacugucaucagacucucccguauccucccaugcacauuacauucuauagcugccuauauauacacacacacacacacacacacacacacacacacauauggauuuuauuauaauaaagaauuuuauucuaauacauaggcauauauagcauauaaaaauauauauuuuaaccacacgaauggcagcaaacugcacaugcagucaugccucuugcuuuuuuuccucauaucuuugacauagcaccacagcaguacacauaguauucucucauuauuuuuaaaggcugacuaguauucuguugaauauauacaccauaauucaccuaacuacuucccuacugauauguuuagcauguuuccaaucuuuugcaguaacaaauaaugcugccacaaauauucuuagauauuuauuugacauauaugcaaaaucuucuagagaauaaaauccuauaauggaauuacuagaacgaaauaaaucuguguuuuaauuuuugaaaaccauuuucaaacugcuuucuauagaguaugaauacuuuauaaucccaccagcaauguauaaggcugaccauuuucucuucucaccuuucccgaguuauacuauacauaaccuuugcucauuugauaggugacaaagaguauguuguagcuugaauuuacaucuuuauuauauuauaaauaaaguuguacauuuuuucauaugaauucucuuugcuaauuuuucuacuggauuauuuucuaguucuuuguauuaagaggaacuuagcccuuugugaaguauacaaauaaguuuuacuagucuguuucucuuuuaacuuuguuugauuuuuuccccuguacagaauuuuauuuuuauguccuaaaauccagcaacccaguaugcuauuaaaggacuucaccaauccuggauuacguaaaaaauaauuacccuaccuuuuuuguuucuuuguuucauauuuaaaucuuuaacuccucuggaagccaacauuauuuuuccagaugacuaacuggcuaucccaacacuguuuauuaaacaauucuucuuuucccuacucauaaaugaaggugggauccauuuucauauacaaguugaauaccccuuaucugaaaugcuugggaccagaaguguuucagauuuuagaauauuugcacauacaugagauauccugaggaugggaccaaaccugaauguaauuuuauauaauuuuaaauaauguuacacaugaaacaaaguuguuuugauuguuuuugagacagggacuugcucugucacccaggcuggaaugcagucauacaaucauggcucacugcagccuucaccuccugggcucaagcgauccuccugccucagccucccaaguagcuggaaccacaaacguguaccacccugccuggcuaacuuuuguauuuuuuuguagagauagcgucuuuccauguugcccaggcuggucuugaacuccugggcugaagcaauccucccaccuuagccucccaaaguguugggauuacagacaugagccacugcauccagccugaaacgaaguuuugacugcgacccaucaugaggucagguguggaauuuucuacuuguggcaucauguugguguucaaaacauuucagauuuugaaggauuucagauuauggaguuuuagauaagggaugcucaaccuauauuaagcucucauauauauuuaaguuaauucuagucuuuacucuguuuuagugcugucaugugccaaaaccauguuacuuuucaaaacauuuuaaaauuaaaaccacuuuacauacaaguaagaauaauacaaccagaaauuacuggcuugcuuuaauuuaugaaucauuuugcaauuucuaaauggaauuuauauaauuaaguucaauaugaucaucaugcaaucaugcauuuugguugacacauauuuuggagaccauuacgaaucucaugucucccacuacauuucuggaaccauaucuagaaaaucaauuuuuccuuaauuuuguacaugguuuuuuuaaauuauaaaaucagcacauguuaucuguaaaaaaucugaaaauauaaaacauaccuuccagagauaaccaacuuuuauacuucgguguauuuuuuuccacacuuuuaauaagugacuauuuuguaaacuaauuuuuucacauaauaugacagcacuuucccauguuauuacacauacuucuacaacauguuuuaaacacauccucccaaaugaauauacccaguuuaugcaaccauuugccaauuguugaacacuuagaguuguucucugugaugauuaucaucuauuuauuaauccuugccacaaaugaguuccaagaauuaauagacgaguuucaagcacugugguaagcauuaacucuauaauggugaggaaaaagaaacacauuaucaggauuucuggagguuacaaucuauuuggaaaaacagauguuaaucuccaacacauaugaaauuacaaugacagcaagugcuaugaggagaguucauggugcucugagagucugugauagggaagccuucccugaggaaagauaaaucgaaguuuaggugaaagaaaaguaaaaacauucucagcaggggcaacggcagguacaaagcccucacugugggaaggagcauggcaagaacaagggacugagauaaggccaacaaggcuggaacaaaaagaguaagucaagaacauggcucaagucaugacuagacagaaagguaagggccagacuaugcaagaccuuguaagacaggcagaugccaccauauaagacacagaguucuguccauauccugaaugcaauggaaagcuacugaagcauaucaaacaguagggugauguaaucagguuugcauuuuuaaaagaucccucugauuacaguguaggaaacagaucagaaggggacaaaguagauugggauaaaccaagauuaggaggcuacuguaguaaaccugaccaaaaaugcuaguaguuuaggguggugauggauuaugaaaagaaguagacggauucaaaagacaaccagauuugccaaaagauuuaugcucauagauuaaaaucccuaaaacuagaauuacugggucaaaaaagaacacuucaaggauucuaauauacauugccaaacugcccugcaaagagcaguugucuucaucugucaauuaccuuguagcuguuccucuaucugaaauuuuaaguuccuuaaaaauuccuuuaacaugacuaauccauauuuccuucacgaagucuucccugacuccccuuuuugccuggauauagaacaugucucccaaugaauccuugcuuugucuuauacacauuucuauaguccagucauacugcauuugacuuacguuuacaugcccaucaucucuacuacauugugagcuucuggagaguaaagcuguucuuaaggcacuuaaagcuaaaacaacuugcuacucagggcuucaaauaccuacuuuaaaaaaagugaccaauuuguuugugaugagucauuacaucuccauagcguuccugaaaaucucuccaauaauuguaaucaaauagguguuauaugaucuuaaaauauuuuuaaauagcuuaguaaaaaacagacuaugaacaaagcagauucuauuagagaaacuuuugaaccugaguuguugauacacgcuaauuuucaaaauuauucuuauugcaaauuuaacuccaauuuaccaaaaaaaaaaaaaaagguuauucugguaguuucuuauauuuaauuuuauaaaauauaaacaaugagaauauauuuauaauuggauaagcaucuacauaaacuuauauagcauuucagaauuaucaauuccuuauguugaaaagcuugauuucauggcuaacaguaucuagaacaaucuaccaaaauauucacuaagcuagaggaaguggcagaguuccuuagaguaaucuuaaagacaagcagcucccucuauagucugucuggccuacuuuguuuaauuccuugcuuuguggacaucccacacucuucuauuuacuccuacucugcaucucagcagggaagcucuuugaaaggauaguucuguuuaaccuggugcugaggaaacugugagagcugucuaaacucagcaugaagugaguuacaucaagcaacuaagcaaaagucgagauguggaaaauggacagcuucccaaguccaccucagucaaauccuuaaaugaagccugaugauuucauuuguagugaauccucugaguggucacaccuauauucaaaucuaaaugaaaaaacauuguccuauacuuuauucacaaccuuucuucccuccauuaaaacaaguuaccaaaauguuguucuaaaagaaaaaauuaacaauuuauucuacaaaugauacugcucaauuugauuaugucaaaauaauguucaagacauuuuaaaaacuaguuaaaaaaauggagaggaaauuuguuuuuguuuuuuaaaaaauuccauaacucagaugaagaaacuuuaagugauucccuuaggaaucaauauccucaguuggcaagggauuaaaucagucaggauuuaccauucaaaucugaauauccccccccgccuuuuuuuuuuuuuuuuuuaagacaggcucuugcucuguugcccaggcuggagugcaguggcgugaucuuggcucacugcagccucaaccuucugggcugaagcgauucuccugucucagcuuuccaaauagcuaguacuacaggugcacaccaccacgcccagccaauuuuguuuguuuguuuguuuguuuuguacagacuaugucgcccaggcuggucuccaacuccuggguucaagcgauccuccugccucugucuuccaaaguguugggauuacaggcaugagccacagcacccagcccugaauaucccucuuuuuaaaaauaccuuuucaaauuucaccaacuuaagacaugggagcuuuuaaacccaaaacacuuuauuucuuaaauuacucaagauacguccucaaaacacagaacaaucaaaagucaacuggacuguuuucuaaagcagaaaaaugcuuuucaggcaauaauagaaaaacuaaacuaguaaaaggguauuaauccaaucaguucagaauuuguaauauaauuuugaaacggccacuucauuugagaaaaaauaucuuugguugcuauuuuucaggaucucauuuguaaagcaaagucaauuuuaaaacauuuucucuccaaaccaaaguaaagcauuaaggaccucccaaaguaauucuuauauaugaaaaaaguauguuuaugcuauuuuauguagcauagguuuaucauguguuacacauuuuuauuaccuuauuuuacuuguuaguaaagauauaaacuauaaagauauaauacaaaccauguuuauaucuuugcauuauguuuacaucuuuacuuucaaauaaaucugucuucauuaaaaauucuagcauucagaguuuuacuaagucagacuggccucucuuuuauauuaauaauuuucaaguuuuauuuuauuggacuaguuuuccuuggggagauaauucaaaagcagguaauucugcaguuuuugauuauguuuaauuaauauuaaucucacugggaguuucugacgugcuaauaaaaaugcuggcuugguuuaugaaaaguguaaacucuaaauguaugccaaugacuucaaauuuuuucuuguugaaacaaacauuuuguuggaaacugugaacuacauggcaaauucaauuugauaauccuuaacaauuuaaaauuugacuuucucuguaucaaguuuuaugucuuucaauguacauauaaaaaguguuacuuuuuaauucauuuaaaauauaaauuucaaaguauguaccaaaaaaaaaaccccaauggggguuuuuagucuuugguuuuuucguuuuuguuuuuuuuuuuuuuuuuaaggugcugguaaucuauugugggauguccaugaaggauuaaauaggaaauaguuaaugugucuuuuaaaaaauauucaggaaaacaacaguauauaauauucuuuauuuuuuaaggaacauuuccucacguaauagaauuacauuagcuuacagugaaacucauuuauuuccacaaacgaaacuuuccuauacaacaaagcuugacuaucucucaggaaaacauauuuaaugacuuguguggaggagaaaaaauuauguguggaaaaguaacucaaaccauacaagcuguaauacacagaaaugccacaguauauccuauuagcaugucacuuuaugauucggaaauuuggcugaacagggccauaucaacuucacuauuuuauccuuccucugcaucugaagugagaacagugcauuacacugaaauuccaauuggaaacaaagacagcaccacuauauuuaaaagggcagaaaaccuaucuuauagaacacuucaucgccucgauuucccagccuccaaaguuucaaguguuacacuuucaacacguuaaaagcacucaaauuccccaucuuucaagguucauaucaaaaucauauucacuaguuuaaauaggaauaugcuaccaaaucucacaacauugacauuuuaacaaagagaauucacauuaaaagauaacugcuuuaaaaugagugcuuguguuugggaaagcgcuauuaucuugguaguccacagaaacugacuguaguaauaagaugaauggugaugagggcaaggagcaucaagugggaaaugcuaucuaaaaucccauagggcaauucauagcuagagggaagaacaaccuuuccuaagaugcauuauuuccuagaacuccauuauuucauggaagcaguucaaagcaugcaaaaaagcaaaaccauuuuaaaacaccuaguaaacugggccucuaucuuuuuuauauuaucauaagccccaggaguuuuugagaacguaccuucugucacggcugucuccccuucccaucccuucuucaacauaguuguguuuaaaaaauauauaccuguacuuaaaacgcaauccuacagcccagccuaggagcauuucaaaaugucugugcugcugagucuggcugugguuccuaauaaauucaccccauuaagugugauguuuuagguugggcaacauaaacacgcauuuccuacuuccauggaugcacauuuccugaaagcacugcaccuaaggaugcugcccugucccccgacgcucaggcacuaaacucuaaggagucacgaccugcacucacagcagagccacacggucaccccagugagaaagauuaucuggccccaagcgccacucucuccggcccacugcaucuccggaacuggcagaggagagcgagggugagaagagaccauggggagcgacugacaacaaggcugacacuuccccguuuccagaaagcggcacuugggggacacaagggaugucccacuagcgaccgaccucagagcaggcccuacgaacccguccaccgauggacauggcgcggccaccuggcccgccguccggggcgcccgcggcuuucgcucucccggcccgcgcccuggagugcggcucccgcucccggccgccacacgcagucuaaacacgcggcgcucgccaccucccugcccgggggugggggcgccgcgcagcgcucgcgcggacccacauuuuugcggcucuugucacgcacgagagaaaaggcgaggagggcggaggggagggaagacgcggcagcgauccacggagacggccggcgccgguggcgugugcgcgugugcgcggcggggagggcggccccggcgccccgccgacucccgcucccgccccgcgcccggcgcccgcuuaccugccggggucgcuccgaagacucgcaccaccggcaccuucuugacaggggccugggugaggggggauuggcagguauccagccccugcagcgggcuggccauguaguagucugcagucacuauccuuacugaaaacauguucgccgccgccgccacugccucccuucacuggcgacccggcagcggcagcagcagcggcggcggcucccuccgcagcggcggcggcgcccccuccccuucucggcacggcccccuccccucacacagaggcaccucgaggagcggcgggcggggcgguguaggcgcugcugccgccgccuccucaggagcacccggcaaggggccgcaggagagaagcccucgagcuuucgucggugcuggugcugccgccacugccgccaccgccgggaaucacacgggcuccucggucccaggcugcagcucuuguugccaugaugaug

SEQ ID NO: 192957 - RNA, 5275 nt, Homo sapiens
cggggugggauuccaacccagaagcgggcauuuggagcccucaugcuucacccuagcucccugaaacaagcacggaggauggcucugagcagcgaggaaagugcuggaagcaagcaggccgagcgcgucccuggcuggggacguuaaucauuaccggagggcggcccgagcgcggccccgccccgggacggcagccugcgcgcccggccgccgccugcccucuccgcuggccaccugcugccgcccgcgccauggugaguccaggggugcgcggccgcgaucggggcagcggggccggggcagccgcgggcgaggugggagcgggaaggggcgggggaaagucuuuucgaguccccugcggagccgccgggguccgaaaguggggucucugcccggcucucugucgcuggcggcggggaggggaagcugaagcccugagaggggcgguggcggguucgaaucccacccaguugggaggccaggccugcccugaccccggccagugcuuguuccgggacccuuccgggggcggggccuacgaccuuccugggccggggaagacagucguggaggaguccacggaucucguccccuugguggcccgauucugcuuuauacuggggugggagcgagagggaggcugaguuugcgcgcucgugugcgugccuguccgcugccccuucccgcuggcacucuggguacggggucugccugggacucacgcucugcgccgguaugcuggccccagagccacuccccgcgccggcuugaggcccgugccaggccacgggggcuugguggcgcuggagcagcccuccucccgugagcuucccccacccacccccggggcgggggcgggggcggggcccuugcucugcuguaagcucgcgagcuucaucagaccauuucugguccacaggccuucggagcaggcaagacugggagggccuuuugauaggagagggacuugggggagggaggaugaguggggcuguuugugaggggcgcugaggucccagagaugcaggcuugggaaaucgguaaccacuccccacaccucgccagaggaggcaaacggggcagcgucccccucucugucuccagagccggcaccuggaagguuugucaguucagccgcaggcugugcgaccugggggguuccagaaggcucuaccgagaaagggaagccuccuaagagcucaccuggacucacccaccccuuuaagagccaaggaaguaaacagugggcucugaugcuuuggcugacuucugguugucuagauacacggaccaggcggucagccacggggagaaggccagcucuggaguagagaccuaccuacugggcagaugaugcaaaucgcugcugccauucaaucccuauagucauccagagccgaggggaagagaggggccaagcuacaucaguccagagagagcucacguuuucaggagggaaaacagcagggaaaaaagacggacuuaggaaagcacugcgaugcuucagcuaccccaaaugcuaccaggcccaucacaagccugcuugccuuaggaaguuuuuuuuuuguaaugcagaugacauuugcuuuauagcaguggaguuuccuaaagugucccauuggcaccucaugaugaucuguggagguggagguucugccaagagagguacagccaccuggcugguaaauggugaaagcgggucucaaaacuccugccaaucaacacaugguguccagucugcaggcugccucauaaaagcuaaaucaaccucccucacauucccuccccaccccuaaggguaucuuuucaauucagcacucuauuucugcccugggguggugcuacucuagaagccuagguucugggaucuguuaagcuccuagaccuggauccuccuaggaugaaacugacccuugcuuccuugcuuucucugagguuccacucauggccugaauugugccaauuugggcugccuugagggcacuucgcacauuagguaaauaggauggggcacuagguuugccagcugccuuuggccaaguuccuuccacuuuggccugagcuucccaaccagccagaaaagcagacggaaaaccagagaaaccuagcccuggcggcucaggaccagaggcugccugggagcaugacugaggaccuacuagagguagugccaacggcggucagcugcaguguggcuaagaaugggauggacacuuauuuuaaauguagcuccuucguccagccccagcaaugcugacacacagacaacacugcgccaucacuggcuaggggugggcgggaaagaacagcagacaagucguuuccccucucuaggccuguuuccucuucaauacacgugaaaguuacgguagggacguggggugcauaugaugaaguacauaauaggaaaaggaaggggggagagucauggguacucuuccugagagguuguggaguaacauauuugcaucugggauuuauuuugcuuuuacgcccucacugauguaauaaucucauggagggaagguccguaaggcuuugagggcagggugggggaagagugcuucucuguccccgucauaugaauuacauugcuuuugugauuucccuuguguguguguggaguguuaaaacccaagaccugagggccuaucggcagacgagccuggaccccaccuccugggcagggugccacccuugaggccucccagccuauugcucaaagaccugcugcccuuuggucacccacguccaaagcagccaguggaagcuaaguuccccuaaagguuggagccccucuguuuugaccuauaaagagaaaugcccuugggccucuguuuuuuucccucuucuaggcuggcaaagcacacaggcugagcgcugaggagagggaccagcugcugccaaaccugagggcugugggguggaaugagcuggaaggccgugaugccaucuucaagcaguuucauuucaaagacuucaacaggguauggcaccagggugggacagaguuuucugagacgggcugauggggucaccuuacaaagcauguucucucccuucacgucuuguuagccaagacucucagacaccacacucauccaguuauuugggcacugugccaguggggaaauuaauuuuccugucuaacucagaaaguaucaucuuuggggauuggagagccauaggaggaugugucuugggcucucccuuccuggaacuuuuagcagcagucuucugaggagauaguucaaguggaaaccaugcacaucugaagacauuugaacagacggccaagacuggccaggccaaaagccuguugugguguuuccaccuuguugacauccuaaauagcaagacuuucuuccuacugcaaggacaaucucuaacucaagccugagaaccagugacaggaugucaagggggaaaugauuauagaggagucuccuggggggaagcuaauucauccuccugcgucuaggccuugaauuggugauguccagaaguccuuucucuuagaacacuaaccuggcucucacuccacuuaaauaggccuuuggguucaugacaagaguggcccugcaggcugagaaacuggaccaccauccugaaugguuuaacguguacaacaaggugagugaugcugugugccucuguugugcucugcccccauccaaauacugcgaacucugacacauucugaaggcuuuuggacuuaacaaugagccuuccugacccauaggucauccacucaucucauuuccaaucucacugagauugcacaugccuagaaucaacauaaauaccccugggaaaaaaaaaucagucuuacuauaaagaaaugcaaauuaaaagaugcaugagauaguugugguuaaaguagacauuuaaguagacauuaagaaggcaaaacccaagaaaggaaaggcugugggaaucaggcauacuuauucaguguucauagcucuaaauggcuuuaaucuugcuggagguauggaagaaugaaaaaguaauaaacuugaacuaagaauacacacauauuugggaggccgaggugggcagaucacgaggucaggagaucaagacccuccuggcuaacauggugaaacccugucucuacuaaaaacacaaaaaaauuaggcgggcgcggugguggacgccuguagucccagcuacuggggaggcugaggcaggagaauggugggaacccgggaggcggagcuugcagugagcagagauugagccacugcacuccagccugggagacagagcaagacuccgucucaaaaaaaaaaaaaaaaaaaaauacagacacauagccaaccuaucaaauuauuugcuuaaugaauagaaacagucauuaaaugucuaccaugugccaaaagcucugcuggucucuguuuauaaaaacaguaaggguggaagaggucgucuaugaauggauaguguuuaggaguuggcauugguuuuugguuuugucuuuagcuuuuagguugcucuugacauucagauauuaagcuuuuauucuauagcugaagucaugauuauuuuugagagacagcaaaggggagauguagaagauguuguuacagacaugucaggaaggaguccccaggagagaucguacuggccagcugcuauucuggagcuccuagcagggcugagcccagcagcuagugacucccuccuguucuuaagugaagucaguggaagcagaauuucugguuucauuucagguccacaucacgcugagcacccaugagugugccggccuuucagaacgggacauaaaccuggccagcuucaucgaacaaguagcaguguccaugacauagacccugcccuuccucuuugaauucuuccgggggaaggggugacugaacugggaguccagggagggagcugaggagcccuuacccucccaccacuccccucccaagacccagccgccgccguugagggcugaguccuugcugugggaugugccaguguccccaccaacaccaggaauuuagaccuuuucccugcaccacucucuucauccugggggcucuguuacacuaauuugaauaaacucuccccuuucuuugcaacuucccagcaacaauaaugauuuucuugccaggccgucucuugcucccuaauucauuucccaggaagcugugauacagggugaaauaaagucuugucuuagaaaccaggacccuaaaccccacacuauguaauagaaacacauguguuuuuaugucucaaauaaaacuauuauaucacuugg

SEQ ID NO: 192958 - RNA, 5275 nt, Homo sapiens
ccaagugauauaauaguuuuauuugagacauaaaaacacauguguuucuauuacauagugugggguuuaggguccugguuucuaagacaagacuuuauuucacccuguaucacagcuuccugggaaaugaauuagggagcaagagacggccuggcaagaaaaucauuauuguugcugggaaguugcaaagaaaggggagaguuuauucaaauuaguguaacagagcccccaggaugaagagaguggugcagggaaaaggucuaaauuccugguguugguggggacacuggcacaucccacagcaaggacucagcccucaacggcggcggcugggucuugggaggggaguggugggaggguaagggcuccucagcucccucccuggacucccaguucagucaccccuucccccggaagaauucaaagaggaagggcagggucuaugucauggacacugcuacuuguucgaugaagcuggccagguuuaugucccguucugaaaggccggcacacucaugggugcucagcgugauguggaccugaaaugaaaccagaaauucugcuuccacugacuucacuuaagaacaggagggagucacuagcugcugggcucagcccugcuaggagcuccagaauagcagcuggccaguacgaucucuccuggggacuccuuccugacaugucuguaacaacaucuucuacaucuccccuuugcugucucucaaaaauaaucaugacuucagcuauagaauaaaagcuuaauaucugaaugucaagagcaaccuaaaagcuaaagacaaaaccaaaaaccaaugccaacuccuaaacacuauccauucauagacgaccucuuccacccuuacuguuuuuauaaacagagaccagcagagcuuuuggcacaugguagacauuuaaugacuguuucuauucauuaagcaaauaauuugauagguuggcuaugugucuguauuuuuuuuuuuuuuuuuuuuugagacggagucuugcucugucucccaggcuggagugcaguggcucaaucucugcucacugcaagcuccgccucccggguucccaccauucuccugccucagccuccccaguagcugggacuacaggcguccaccaccgcgcccgccuaauuuuuuuguguuuuuaguagagacaggguuucaccauguuagccaggagggucuugaucuccugaccucgugaucugcccaccucggccucccaaauauguguguauucuuaguucaaguuuauuacuuuuucauucuuccauaccuccagcaagauuaaagccauuuagagcuaugaacacugaauaaguaugccugauucccacagccuuuccuuucuuggguuuugccuucuuaaugucuacuuaaaugucuacuuuaaccacaacuaucucaugcaucuuuuaauuugcauuucuuuauaguaagacugauuuuuuuuucccagggguauuuauguugauucuaggcaugugcaaucucagugagauuggaaaugagaugaguggaugaccuaugggucaggaaggcucauuguuaaguccaaaagccuucagaaugugucagaguucgcaguauuuggaugggggcagagcacaacagaggcacacagcaucacucaccuuguuguacacguuaaaccauucaggauggugguccaguuucucagccugcagggccacucuugucaugaacccaaaggccuauuuaaguggagugagagccagguuaguguucuaagagaaaggacuucuggacaucaccaauucaaggccuagacgcaggaggaugaauuagcuuccccccaggagacuccucuauaaucauuucccccuugacauccugucacugguucucaggcuugaguuagagauuguccuugcaguaggaagaaagucuugcuauuuaggaugucaacaagguggaaacaccacaacaggcuuuuggccuggccagucuuggccgucuguucaaaugucuucagaugugcaugguuuccacuugaacuaucuccucagaagacugcugcuaaaaguuccaggaagggagagcccaagacacauccuccuauggcucuccaauccccaaagaugauacuuucugaguuagacaggaaaauuaauuuccccacuggcacagugcccaaauaacuggaugaguguggugucugagagucuuggcuaacaagacgugaagggagagaacaugcuuuguaaggugaccccaucagcccgucucagaaaacucugucccacccuggugccauacccuguugaagucuuugaaaugaaacugcuugaagauggcaucacggccuuccagcucauuccaccccacagcccucagguuuggcagcagcuggucccucuccucagcgcucagccugugugcuuugccagccuagaagagggaaaaaaacagaggcccaagggcauuucucuuuauaggucaaaacagaggggcuccaaccuuuaggggaacuuagcuuccacuggcugcuuuggacgugggugaccaaagggcagcaggucuuugagcaauaggcugggaggccucaaggguggcacccugcccaggaggugggguccaggcucgucugccgauaggcccucaggucuuggguuuuaacacuccacacacacacaagggaaaucacaaaagcaauguaauucauaugacggggacagagaagcacucuucccccacccugcccucaaagccuuacggaccuucccuccaugagauuauuacaucagugagggcguaaaagcaaaauaaaucccagaugcaaauauguuacuccacaaccucucaggaagaguacccaugacucuccccccuuccuuuuccuauuauguacuucaucauaugcaccccacgucccuaccguaacuuucacguguauugaagaggaaacaggccuagagaggggaaacgacuugucugcuguucuuucccgcccaccccuagccagugauggcgcaguguugucugugugucagcauugcuggggcuggacgaaggagcuacauuuaaaauaaguguccaucccauucuuagccacacugcagcugaccgccguuggcacuaccucuaguagguccucagucaugcucccaggcagccucugguccugagccgccagggcuagguuucucugguuuuccgucugcuuuucuggcugguugggaagcucaggccaaaguggaaggaacuuggccaaaggcagcuggcaaaccuagugccccauccuauuuaccuaaugugcgaagugcccucaaggcagcccaaauuggcacaauucaggccaugaguggaaccucagagaaagcaaggaagcaagggucaguuucauccuaggaggauccaggucuaggagcuuaacagaucccagaaccuaggcuucuagaguagcaccaccccagggcagaaauagagugcugaauugaaaagauacccuuagggguggggagggaaugugagggagguugauuuagcuuuuaugaggcagccugcagacuggacaccauguguugauuggcaggaguuuugagacccgcuuucaccauuuaccagccagguggcuguaccucucuuggcagaaccuccaccuccacagaucaucaugaggugccaaugggacacuuuaggaaacuccacugcuauaaagcaaaugucaucugcauuacaaaaaaaaaacuuccuaaggcaagcaggcuugugaugggccugguagcauuugggguagcugaagcaucgcagugcuuuccuaaguccgucuuuuuucccugcuguuuucccuccugaaaacgugagcucucucuggacugauguagcuuggccccucucuuccccucggcucuggaugacuauagggauugaauggcagcagcgauuugcaucaucugcccaguagguaggucucuacuccagagcuggccuucuccccguggcugaccgccugguccguguaucuagacaaccagaagucagccaaagcaucagagcccacuguuuacuuccuuggcucuuaaaggggugggugaguccaggugagcucuuaggaggcuucccuuucucgguagagccuucuggaaccccccaggucgcacagccugcggcugaacugacaaaccuuccaggugccggcucuggagacagagagggggacgcugccccguuugccuccucuggcgagguguggggagugguuaccgauuucccaagccugcaucucugggaccucagcgccccucacaaacagccccacucauccucccucccccaagucccucuccuaucaaaaggcccucccagucuugccugcuccgaaggccuguggaccagaaauggucugaugaagcucgcgagcuuacagcagagcaagggccccgcccccgcccccgccccgggggugggugggggaagcucacgggaggagggcugcuccagcgccaccaagcccccguggccuggcacgggccucaagccggcgcggggaguggcucuggggccagcauaccggcgcagagcgugagucccaggcagaccccguacccagagugccagcgggaaggggcagcggacaggcacgcacacgagcgcgcaaacucagccucccucucgcucccaccccaguauaaagcagaaucgggccaccaaggggacgagauccguggacuccuccacgacugucuuccccggcccaggaaggucguaggccccgcccccggaagggucccggaacaagcacuggccggggucagggcaggccuggccucccaacugggugggauucgaacccgccaccgccccucucagggcuucagcuuccccuccccgccgccagcgacagagagccgggcagagaccccacuuucggaccccggcggcuccgcaggggacucgaaaagacuuucccccgccccuucccgcucccaccucgcccgcggcugccccggccccgcugccccgaucgcggccgcgcaccccuggacucaccauggcgcgggcggcagcagguggccagcggagagggcaggcggcggccgggcgcgcaggcugccgucccggggcggggccgcgcucgggccgcccuccgguaaugauuaacguccccagccagggacgcgcucggccugcuugcuuccagcacuuuccucgcugcucagagccauccuccgugcuuguuucagggagcuagggugaagcaugagggcuccaaaugcccgcuucuggguuggaaucccaccccg

SEQ ID NO: 192959 - RNA, 65229 nt, Homo sapiens
uuagaaauaaauagguuuauucuaaaauuaauccaaauaauugaaauuauagggaaggauauuaagaagagaaaagauuacaagacagaggaaagcauaaaagaaaauaagguaauuaaaacuucaaaucaggaaaaagguucucaaaaaucugacuuugccuacccagguacaguugguggcuaucaaauuaggacucaguaauuacuugugucacugagugaaagcugcucauugcugccaagaaccuacagagaaggccaaggggcugacguacagcuguauggagcagcaauaagcaccccagacacgacuuccuagauaagccaggccuccucauccaaguacauccuggauccucuuucucucugguuuccagguacucaggaacuaggccauuuggcagaaaacuguagcaaaaaagcaauccuuggcuugacucuggcaaagucugaaugggcuaaaagccaaaaggaaaagcuggguuaucugaaugacagccuucagauccugacuaacacuuuggaaaaacuucucguuucuuauucauaauagaauaagaucuccagcaguuacaugugugugaagauuaucugaggagcucuguuagccccuaaaccaaaugcaggguuugaggccaaugcccuuugguuagacagaaccacacugcccagauggcuagagaccacccagauaacucaauccaucauuaaguuauuguaagcagcaaacuguaagcagaaguggaugaugaagauggaaaaaaauauaagauagggccugucccuggcaaacuaagaaccugaauuucagaccucucugaaauagguacgacuaccacugcuggugcaaggaccaaucagcgaccuauugaagugccuggaaaugagauggauugcugcuuaacugugucucuuucauuggucuugguaucagugggcacacacgauuguuucaccaccagggggcaaucucucaccaggagcccauucaagcauggccacugccccauuugucaucucgugugugcccaaguaaucaaaugaaugcaaccauccacaguaauuacaauuagggucauuuaacuauuuaauugcuuuuugagauuauugcugaaauuaggaagggagcauugaaaugggaagggggagguuagagaagacagagauuuaaaagaagcaaguaccauuuuccaaguauaaaacucguaauauuaaaagugacauagcaguauauucacaugacuacuuaagucuaaugcagaaacaagacaguacaguuuuugcagaggccgaugugacaucugcaugcgacaugauacuauuaagugucucuacccaccucugcuacagaguagcugcuauaugcacacauacacaaaaauacacaaugaaaagccuacaaaaguguuaagucaaacuaaggcucuuaauuguaaauuaaaguggcuacaguaggucccuuugaaaaacaccaucuccccuggcaccaauguugucacagcacagaggaagcgaguggcucggggucugguucuggggagacgcucuacaggggcacaugcuucuccaucuuggcagcuggcaagccacaguggugucugcuggguggcucuggguuccuggaccucauucaacauaaugcacugaccaaacagcucugaccacagcuacucucaaagaggugccugccaggucucccucugacacacacacauacacacacuacccacucuuggaacccacaaugcacugcugggcaaacaggaaaaacacacacacacacacacacacacauaaaugccacaccagcccugaauggcguggccagcuagucacaguuguugggucaguaguacagugcucaagaacaauucagacuaacaugccaaggagccugaggaaaagucugguagucauggcucucccagccagcauucccagugggggaaacuagaagacaccagccuggagaggcugaauauucaggagucccugagauggggaauggaacagaggaaagugucuuuugacucaucuuaaguacuccccuccccaaauagaaaccucaaagacugauccauuuccccuagggccugggccaggaguagcucacugcucacugcugaggagaaaggcacaagauauaaugucauaagagcaggacaguggcucagccuacagaguucccuauaggggaaagaaggcaggaaauaggcgcagggucugguccugucccugcaccacccugagcagcuagucuugggaagggauuacaggcccugggccauaggcugcucgccauucugcuuuccuauccuguuucucucccugugcugcucccuuuuagccagggcugagaaauguucagcaccugaggcaaaacugccauaguaccucugaaagcugaaucaagggggaagaggcagaagaacacacuaauagagaaaauuuuccuugcuacgggugcucuuucacacccaccuaggguaagucaaggcaacuugugaaggugcuuugagcuguuccuucaagcaaacacauuuucauuacauaauggcuuaacgcaagggugcagggaaggaccaccaccaacuuuggugacauauuugaaucuggguguucauccuacucugauauucaaaaaagcauagaaaaaggucugauuucugcucaucaccagcccaggauaggguucaggugugcucugaccacugccaauucaggaaggcggcaccauggccaaaagcucccagauuauuuggaaaccauguuuucuuccuaguccaugguaacaagaaaaagccaauggaagcaucauuccaaacaauaaucuccaaagaugguggcaaccaagugucaaauggggacugcaggcacagaagagaccaccccaaacccugccuggguggacgaagcagguaugcuagaauaguccuguccugcagaauagggaacggcagcuuggucgaucugugcccuggaaaaagaaaaugaguugcaauagaagugacucuaagacagacaaugaaccuacucuuaagagagacagggccaggcacgguggcucacgccuguaaucccagcacuuugggaggcugaggcgggggggcggguaucaccugaggucaggaguucaagaccagccuggccaacacggugaacccgucucuacugaaaaagaaaauugaaaaauuagccaggcgugguggugggugccgguaaucccagcuacucgggaggcugaggcagaagaaucgcuugaacccaguggguggagguugcagugagcugagaucaugccacugcacuccagacugggcaaaagagcaaaauuccaucucaaaaaaaaaaaaaaaaaaaaaaaagagagagaaggcugaaaaagccuccugcuuagaguauaccucacacccagcugaggaaacaucuguuauguaaacgccuccugccugagauaacaaagaagcucuagcuaucucauaaacuguaccccagcuucucuaaagaaucaggacaggucagagcuaccacacaauguuuaaguaaaguugaaagcuagagaguuuagaaaaggaaaugguuaaaacaauuccuaggguaacauuuauaacaagggcaaaaucauuauguaauggaauucucuggggucuucaaauuaaaaaccacaaaaggaagauaagaggaagaacaagaauccugaggcucaagcugucucauggucuaucuugaguugugcucuauggagcaagaccagaugucaaaguugugcacggccuguuccauaucccaagaaccuucugaaggcuggaauccccuugagacuagaaaggguccaaguucagugggguuuuggagaaccauucaucuggcugcccugggugacagugucggugcuguacaagcuguccaagaagacugaggacaauucugcaaccauauuccugucaacaguugucugggccaugccauagauggcacccuacaaauccaaagaaagagacauuauuagugaggccagguccaaaagcaagaauaaaacugcagcaaugagccccuucuccccgaguccuagcuucgcaugugcacugcccuaccccauuuccaccuaaggcaucccaucauucuaucagaaaaacagcuggcauagucaauuuuucacagggacuuuccagucugccuuucugcauaaagggacuagccuaagaaaauuccagaaaaaacauguuuacuaucuuuccugugacaaaauuuucuuuucaaauggacacuaccaccagcugcuuuuauacagaagucucuaacuuacaagguacuuuauaguguaucucauuugagacuucagcaacccuaaggggugggugaugcagagaucaucagcuccagucaacaaauaaaagaugucuguggcaaaggggcagaggcaggaacagacuccgggucauaugauuccuucaaacucuccaccaacaccuaaauuuccaagagaagaaaaaaaacuccaagugucccuaccauuccuguggucuucgcuuuaggauucuucaugauuugagugacagauucucgaauguccuuuaggaauuguauagcuacucguuuccgggcguguaguaaugugaugcagaaaugaauacuaggaaagaagagacagagagagaugaaccuugaagaaagaaaaaauguucuaaaaugaugcagccccaaauacgggaauuuccugguugcccuuucacaauauuucugacaaguguagucauccaaguuguuccuaguccugggaaucucggcucucucaugcuuggggugucaggcaugggcuggccucagagcuucucggcaugacugagaaccaugcuaagaggaugaacaguguuggcugcuuugucccacccauccccucacaaauuccaccaccauuccuucaaccacgucaccaucaaugagacacuuuuaucuuagauaaucagcccccaugugcucucauggggacagggccacauggcuggggucuuaaaggacuucagggcacagaagaaauucuaccucgcccuggaggaauuuagugggguuuacuggaauugugaagagggaaaaagauaguccagaugggacuggcaaugcaccaacguguggaaggcuaagcuguacacagaggacaugaacagaccuguacucaguuggaguggugcauuuacucaaaggcaucauggaagauuagguuagaaaagucuaauaaagaaggcaguagcaggccugaaugauuagagacccccaggaagaucuugaacuaaauauuagccagguaacaaguauuuuauaagagcaauuugauggcuguguacaagauggauuggagaguagaaaggcuagagacugagagaaaaaccucaugaccaaccacuggucuaggaggcugucaccuaauucugccagaguuuaaagcuaauggucuuguucuuuguaucuaauaauuccagguggcaagagagaaauccuuuauauacuacaguugcuacuaacgugcuagccucuagcagucaaacucuauacuucagguuacuguaccacccaaguucuuccaaaaucauggagcaaaauaagggaaagaggcuucuucaagcuuaccugggugggaacugcaacugguucaaguuccaccccuuagcagucaucagguuugauagucgguagaugucaaaaucacgggaucccagagcaaugacugacaauuggggauucccaaaaacaaagaugccuuugauauuuuccagucuuaaaacaaaaaaauaaaugaaggaagaaaaaguaaauucagucacauacaauccccuggucacuaucucuuuaaucauucaaagucuuccuuauaaugaaugcaaucuaacccuuugggcuuuagucuucucaucuucaaaaaagaagagggcuacacuggaucagugguucuuacugagaucagaaucauagauggaacaauaaaaauggaauuccaaggcccaaaccccaucuagaucuaaugacucaaucacugacuucgaaccugucuacccaacucccaauuauauuccccuagaugcuucugaggcaugaaagauguacuaaaaaaauuucuggaaaaguaaucugcccaucuccacaguucuaaaaagucauauguaaucccuaaagcaagaaaugguauagcaggucuuaauaaauggcccuaucagagcuauaggaggaccuuuuauauauaucuaauuuuuauuuauuuguuugcuuauuuauuugagacagggucuugcucugucacccaggcuagagugcaguggugugaucauagcucacuguaaccucaaauuccugggcuguucaagcaguccucuugccuuaagccuccuguguagcugggaccaaaggugcacaccaccacauguggcuaauuuuuauuuuuauuuauuuuuuauuuuugagauggaguuucguucuuguugcccaggcuugagugcaauggugccaucucaacucaccgcaaccucugccucccggguucaagcaauucuccugccucagccuccugaguagcugggauuacaggcaugcgccaccacgcccggcuaauuuuguauuuuuaguagagacgggguucucccuguuggucaggcuggucuugaacucuggaccucaggugauccacccgccucagccucccaaagugcugggauuacagggaugagucaccgcgcccggccucauggcuaauuuuuaaauuuguuguagagauaaugucucacuauguugcuccgguuggucuuuaauuccugagcugaagcgauccuuuugccuuggccucccaaagugcugggauuacaggccggagccaccgugccuggccaaggaucuuucucaaaugagaaaugccugcaggcagcuuuccuucccccucaauauacuuaaagagccuccccaauccaagugacacauagagagaugggcagauaagauguuaacagauacauuagacaaagcaugcagccuguucuggccuuggcuuaacccaagauuucauugcccuccuuuccucauuccuucuggcccauuuccaauuauuuucuuauuccaaugauucuucaaguaugauuccuggagcaguagcaucaguaucuccagaaauggaaauuuuuagagcccaucccaguuccacugaaucagaaacucuaggggugggcccagcuaccuguguuuuaacaaguccuucaggugauuagaaugcaugcucaaguuugggaaucacuguccuaaccauuaaauuguacauuagccuuaggguaagagcugccaguuauuaagacauccauagagaugagauaaacuacaaaugaggcccccgucucaaagacccuccaaaagucagggcagagaaagggagcuucuucucccaggccagcuggucuggccuaagcccuaagcugcugcccuaagcccucuauaucgcaggagacaacaggugggcuagggcuauggauacuuagccaggcaggugccuugagccuacuaggacaaaaaagcaauagacaaggcagaaccccagucuuccacacauacucugacuugaggaagcgagcaguuuugaugaucuguuugguagcuucaacauagccguucucaccgaagugcaucaaggcagcccaacaggcugcgcuaaugccaccaggccgugagccugcgaugguuggggaagcauagaugccacccugccaaucuguaucgacgaagaacugauaguuccuguacuucuugucacuauacaacaccaaugaugagccuuuuggggcauagccauacuguggaagaaguagcagacaagaaaagugagaguauaguucugucuggcagaccuugucccagaacucucaucaugcaaaggaaauccuauuuauuucucaguuucucuguuauguuucccacucacauuaaggauucaaacuuaaaaugcuaaaggauaguaggaacuuaagggauggaguuuaaauucucucuguuaggaaugaggaaucugagacccagggaagaacagcgcccaguuaaucgguuuacucccucucuugcccagcaugugguuuaccuuauuuaaaauauuucucuggagaccauaugucaggaugaaagcaaggguaaguuugcaauggaagccaggaaaggauggaauuugucacuucaaguuaaaaucaccaucugacccccuucccaucuuuuuuugcuuaguauuacuaagaauauuaugcuuaugagaacauaauggugcucagaaacuaaaagcuacuuaauccagcuuuaaaauuaacuauguaacugguuuccuuauagaacaucugacccccuaauuaacucuuauuaaaacuaacguggaacuaauuucauuaccugaaccauccagaaauggaugguuaugggaaaaggacacaggagcuaucuggaugguaaggaaaaaacagaugcugacugaaaaucggcugcagaucacaccgauuuugaaaaacaagucuuuaauauacuugaguuuaaaacaagcucugaaaaugcaaucaaaacaagguacacauuccugaggcugcuaauacuucuuccacaucuggauguauauucaauagcguuaucaacugaucuagacuuugucucaguccaccaaggguggcaggcguggccaucucaaaugcugaauguuccugagcacacagguucuucccauuuuccaaaggacucuuccgucaacauuuucccgucauguacgcucaggagcccaguugcacagcagcucuaauguuaucuaccagcaugggaacuccacuaccaacccucacacuccucuacccuccaccucaaaucagcucaaggcuucagggagcuuuuuuaacaagggccacuacacuagcauguucuaguuacacacagucaguggauacagaaauucucuuagccaauuugagauaaagguaacagguucauuuucacuacugcuugucaccucuaccacuauaccccaucaccugaaccagcugaucuggugacggcaaagagagaguuuaaaacaagcaucugaugagaauucuauaguuaauuuuauacuuugcggggaagcuaccaauuuauuuuaucaauaauagucaaaauaaucaacugguaacacuugaucuccuccuuagcucaccuuaugggugucagcugaaaugcugguuacaccuuucacccggaaaucaaaugggugcuccaguggguauccugcuuucuccauaaagacgaugaggaagccucccagacaagcgucgacaugaagggguauuuuguauuugacagccagcuuguuccaaaaaacaaagaacauaagagaauuuccuuuauagcccuauaauaaaaacugcaagacauggguggaaagaugggcuauaaacacaaggcuauuuuguauuaugccucccauguuuuuaaaaaauggcuauuuuuaacauucccaacaaaauuuaucuuucaaauguauuuucccuucaaaauaauucaucugaaauaugguaucaauuuuauauuuaaauaugcaugaccucaaacgcucugcgguaucaagcaggaaaugaguagagcucugauuuaggcugccucucgcacaagggaaagguccugccucagucacugcaggaugaggcgugagggaaagggaggcgcugaggggcagcauguggaauaucacccuuuuggugggcacauuccuacaugcagauuauuuccagaucucaaucuagaaggcaauccuauuucagaauuuccaguuuaaaaggccucagccuuguacuaucuucccccacagcagagacuagcaacuuuuaaaggcuugcaacugagcugcagggcuuccccuagggcugaugagagcuacuuaucacuacuguggucaaaaacaaaaaaaaaaucgcuucuauuugccaaguacugccccauuaggcuuuguuuuaaaauauccauuugccugccuuagcagcccauuucucucauauaccuuggccacuucagggacaggaucuauuacaccaugaggaaacugugggguagaacagacgagcauggcaguguuccuggagauagcucuucucauugccuagggauuuaaaguuuaaaggaaaaugagaaucuaugucacaauuacucuucucuucugcugccaagagcaauuugggcugcuagcuuagaguuccaguuccaccaguacccccuccuucaccacuccaacugggagaagacugcaucccaccacggugacaggacacaggugacuccagguaaguccauuuggagaauagucugagagcacaaaauaagaacagaaucgcugugggggcgaaaauaauauugagcuaagaggccaaagagccaaaugugagccccagccccacaacguaccagcagugaaacccugaguaugcuacuucagucuguuccuuaucugugaacuacaauaauauaacagcuucaucaaccucucuggaaugucauaaagcucaaaugggauucugacagaacacugaaacuagaaaacuccucuacacaaaugugaggcauaaaaauaaucacuaucauaaugacaaugguauuaauuuaagccaaucuaaaccacagugagagucuuuuuuuuuuuuuugagacagggucuugcucugucacccaagcuggaguacaguggugugaacacagcucacugcagcaucaaccuccuggggcucaagugauccucccaccccagccucccgaguagcuaggacuacaggugcaugccaccauguccagcuacuuuuuuaaauuuuguguagagauggggucucacuauguugcucagacuggucgcaaacuccugggcucaaggguucaaguaauccucccuccucggcuucccaaagugcugggauuacagaugugagccaccaugcccgggccaugguaagagucuuaggggaagugaguccauguucauuuuacaaauagagaaaagaaagaaaaagugauggcgcugaccgcaaaaccagugucucucaagucccaaguuagugacuagaucaccucccuuucagaauucaugaaccuaugaaaagacugaagcugcagucaaucaccacuaucaaugcaguuuuucauauucuggcugccacaaucaaaggcagucagacccaucugacuggaaacggcuagucaacaggagggcccuucugcugucagggcccagcacagacagugggcccuccagagggacucacccgcacauccaccuccaucaucuucgucaaugggacccgcacaaucuucaucccaaaguaacuggcugcuuuguuaaaugcagcaugggcacuuuggggagccacacuaaaugacagggaagaggagaauaauguaacucaggccaaaauaauagaaaacaccauuagcagcuaaucuaaauuaccgggaguaaguucugauuauuuuuccccaaauuaaaaauuuaaguguuuagacugcucuacuuuucuuuuuaagcacacccaaaaagaggccaacugauuuucugcagaaacuucccuccuauuuaggaaaucauucuggcaauaggaagaggacucagaagugaucccacagugagggauccaaagcauaaagcuaggcuggcaggcggaaagcugggggacagagacuuuggaugagagcaacacaaggcagagcuggcuaacgguugccuaccaaagacaggcaccucagugagaaugagaagaaggcuucccggcacaacacauguucaagcagaaauguucacacagcggccaagcaucagcucaguggccccuuccaacucugaaagacaacaaaccugaagaaacuaaaauccccauuucuccuacacauuuggaaauaguauuucaaauaguguugaaagagaaaaugaggucacggguauuugcuuuagacuuuccucaacuacuccauucauacaacgaaucuguucccucuaaggagaaaaaucucuacuacugaggaaguaccaagcaccaaagaucgacauaugaagaaagaauggcagccugguuuauucucuuaugcuacauaugaaccacagcaugagaccauaugcaauaaauccccauugucaaguaauacuugcaguaaaaauauuaagauguaggauaaacauacuguacaaggggacagucuaggaaaaaauaauguaacuaaacaucaaauuuauguccaaggaaggcaauguggguaaaucucaaaaagauauuuuuauucuuccucccagaaaacagcccucacacuaaaguuuucccagagaguacccugaggcagccuauaauauuaaguaacuuucuaagguaagcagaacuaaaguaccuagagagguuucuuuaggcuccaaauaauuugcaaauaucacaggauucaaagauguaguccucaaacucucacuuuuggaaaaaggaucuuauuuuugcuuguaguauauacuaugcaugaucuggggguggggcgggaugggaaugaucuuuaaaaauaacuggcugauccauuuagaauuuuacugaauguaaaaggauaagggcagaggggcuaggacagggggaaaggggaccagaauuaccagaggaagagaagcagcaggaaaauggauuaucugcuuuaguuucauaaagcuguacuccagacagacaaauccaaaaggggacaaaacagccacacauacauacauuucuggaguuuugauccccuucucaaaggccagaucccgauaugcuuugcaggccaucaguaugcuuucuguucccccagaagucaccuauaauaaagaagagaugccaucuguugggggagucaggaaugccccggcucuucaugcccugaucuugacaauguuugauacagaaacagauaaggucuuggaugcaugcugcaaggcagacacugccaugucuuccagaaggaaaauuuggcuuuauuggcuaagccuaauuuuggcucaggugaagaaugaaagcuacuaaauaaugagcagaaacucagcacugccuagacaaaugcacacuuggccagaucccaccuauucacaauccauuuacauuucuguauuaauuuuucaauuuucagauaagauagggcauuuuaugccauucaaaaauaucagaauuuuaauuuaaauuuucaauaccuguuaaagaaugugaaauugugauuacaauucuaguaaacugugcaauacacuaaaaagagacauucagauuuaacaaaguaaacugcugauuuugacaaguuugaaagacagagaaaagcagaaguuucuacuugauggaaguuuguugccuuaucugaaauaaaacaaaaauccuaauuuuuuuuaagugaagugaaauguuuuccuaaaguuuggccuagccccucugauaaacacauuucuuuaccagaguucaaacaaaaagacguaggggucuuuuuauucaucuuauuucccucacuggacuauaaauucaugaaaguagggaccagucuguucaugacaaauuccuagcaccugacauaguggcugacaccuaacaaacccucaauccauuuuuuuuuuuuuuuugagacagagucucacucuguugcccaggcuggagugccauggcaugaucucggcucacugcagccuuugccuccugguucaagcgauucuccugccauaguuacccgaguagcucggauuacaggcgcccaccaccaugcccaccuaauuuuuguauuuuuagcagagacgggguuucaccauguuggccaggcuggucucaagcuccuggccucaagugaucugcccaccucagccucccaaagagcugggauuacaggugugagccacugcaccuggccuucacauuucuuaaugccugacuugacucucaguaaaccuugaccaacacaggcaugucauagccaccuggcuauuuuuuuaaaaaauaauauaugagaaugaaucauuccaaaacaaacaaaaagccacaauacuaaacuaguuggacaacuucuuagacuuaccaucucugaagauucauacaaucuuugaaagguuuuuucaauuuacaggugagaaaacugagcccuugaggaauuaaaguguuucacucaaugucauacauuagcaucuguugauaagaaguaaaacuuucuacguuuucauauuuaguguagcuuaauacaagauggaaucagagaaagugaccacugaacuuugcuaaaauaauauccacacauagaacaaaaauaccauuggauacaaaaucccuguggccaggaguuauauggaagaugaacugagaaaagucauuuuuugacucaggaagucuuuaugaaacaugugaccaucaccaaaaaauaaugcacccaacuugggcaugggacacuuguaggucacuacauuucuacgcugcagaagacaaagugcuuacagcugaggucagcucugcaaaucagcagcauguccugugguuuagcauaaaaccucagaaugucacaagagucgucaagccagcugugaagagucggggagggaccagcaaaguccaagucaccagugcaacaaucucuucguaagguccaguaaugaccuaagcaauaauauuuccaaauuccuagucaccugcuucauguguccuacuuuuaguccaauaacuagucaaaacaucauuguuaugcaaacaccaguggacuuuugacuguaaaaguaggaauaccuaaauucuacuuuuuucuuuuuuguuuuuuuuugagauggggucucaaucuuucaccuagacuggagugccauggcgugaucucggcucacugcaaucuccaccucccaggccuaagagauccucccaccucaucccccaaaguagcugggacuacaggcacaccccaccaugccuggcuaacuuuuguauuuuuuguagagacaggguuucaccuaguugcccaggcuggucucgaauuccugggcucgagcgauccacuugccucagccucccauggugcugggacuacaggcgugagucacugugccugggccuaaguucuacuuuuaauauguauuuuugauucuguguuuuaaaaugcuauuacucucccacuucuuucuaccuccuauacccaaagagaaacaggaauuuuaacugugaaguaagaaaauggaggccucaguaacuauuuguuaugucauucaacuucuuucaacauguauaaaaacucucacuuuaacauaugauauguauuucagaaaacaagagaacaacaucuacuuggaaaauuuucuuucagaugcuguuuggaucugauaacauuagcacaagccaagaagaauguuucacaugguaaccuaauuucuuuuaguaugugaaguuaccucuaucauuguaacugagacaaauaaaguuaauagaaggaaagauaguuuaaggcugaagaacaaagaaugagagagcuuacaacucuuaacucuuagcuaggaauaaccuaaagacugcccagccauuugguuuuaucuucuggcuucccaccucugaacagugaacucuuucuucacuagaagcagcucauccagagagagaaguaagaagcuaagggaggagugggggagacagagugggagagggaaaaagacaauaccagugcugauuaguuauuuuauaaaagucuaaauauuagaagagccugggaaucagacucuauccuucuucugaucccucacacgugcugaagaucaaaauaauagagauaugguuuaauugcagcaaugcaaaaaaccccuaggccuggacuucaggaguaagaugggaagaaaaaaaaaaagggugagugcagggagagaaaagagucaaaaucuacaauaacaacaaccaaacaaggaaagagagauaaucuaggcaauaaacuucaaauauuggcaaucaaaaaaaaaaaagaaacagugaaacagcagagagcagaaguaagcaaaacacuaguuucuaaucagcccuugaaacuguaccgcaaagucagcaaaauccugagaauuuuccuuuauacccccaaaucugcagaggcaagcugaggggguuuccuuauuuucuucuucuucucaugagugagugguaaacauggcugcuagggagaaaugagcaaaaugaagagagaacaucaggauuggcucuuuagagugaagacuucagugaauuaaauaaucagagcucaaaggguauauuaucucuuccaaauaagagagugaacucugauagguaacuuugaagagaaucucagaauagaccugguuauucuaauacagauagaacaaagcuuuggcugagcuuuguccccagccaaauggucucagacaggaagcacccacagugcauaagaacaaugucuggagaaugccaccccaagaugagagaaaauggcaaggaaacuaugcaaacaaacuaaaaggcaggggaaaagguaguauguagcaugcaaaauaaaaacccaacacagaaggaaacaagcuaagggaugaaggaaaccccuuauaacuuucucacuauaggaaaauaucauaagaacaugaauuuaagaaaacaaagaguucaaaaccuagaccaugaaacaaaaagaaugagcuacagaccuaaaaaaacaaagccaguagcauccauacagaacuaacaaagacauuaggaacagcaaggaauaaaauaaacauugccaagaauaaaaaugcugacuucaaggaaaaggucugaaauaaguuuauugaacccagauuuaaaaaagacagagauugaaagaucaaugccacuccaaauguggagaacuguguucaaucuggccagaggcaaccaaaagucauacagagaaugacugcgaugguuggaagucugugaaaucauaugaaaagcggaguaacccagaaaaauguggggcagagaagauucagggagaaaggggcuuucaaauagacgaaggucuguaacauggaaaaaacaauuauggaacuucuauuucuagcaauauuauauaccuugagcaaccuuccuaacugaaauaacuaaaaaacuugauaaaacaucaaaaaaaaaaaauuuaaaccuaucacuaaccuaacauaaagaaacuugcuaaacccccaaacaaagcaaaaucaagaauccugcaagauaagugaguggcaaaacuagcuuucacccugagguggcaccagacccuucagacuucaaacuccuacacugacagaugagcaaaggauggaccagaagauacauuagagacugcccaagauaaggaguccaacaggagauggcuggaaaaagaccacacucuacaguguacaagaaauaaaucccacuacugcaaaagagaaaagaaaaacuguuuuucucaacccugauguucaaguaaagaaaaauagcaaucuuucaagaauguguaacaaggaagccuuuaugugaguuuguggucagaauucacacuaccucugugguacaaaaugacaagcuaaggauuugacuuaauuugguuccagugugguggcaauccccagcaacucaaaaagguaugacaaaucuucucuggaagaagagaacuuccagacuuaacuucaaucuaggccucaaagaaucccuagguucccagaaaaaugaguggcucauaaaaaaauaaauaaauaaaauaaaaucacaaauauaaggaaacaaggaaccaugacugaagccagcagaaucagguaaggcucauggauauuggaauuaucagacacagaauacaacauauuuauguguaauauauuuaaguaaacaaaaguuaagccaaggaaaaggacuauaaaaaacaaccaagcagauuaaaaaaaaaaaaaaaaaaaaaagacggccaagcgugguggcuuacgccuguaaucccagcacuuugagaagccaaggcaggcagaucacuucagcuugggaguucaacaccagccugggcaacauggugaaaccccaucucuacuaaaaauacaaaaauuagcgaggcaugguggugcaugccuguagucccagcuacucaagggggcugaggugggagggucgcuugagcccagagaggucaaggcugcagugagcugagauggcaccacuacacucuggccugagcaacagagugacacccugucucaaaaaauaauaauaaaauaaaaggagaacuacaaaacagaauucuuuagaaugaaauuagaguaaauaaaauugaaaagcccaaugggcuucuacuguguccggaauugguggguucuuggucucacugacuucaagaaugaagccgcggacccucgcggugaguguuacagcucuuaagguagcacgucuggaguuuguuccuucugauguucggauguguccggaauuucuuccuucuggugcguucguggucucgcuggcucaggagugaagcugcagaccuucacagugaguguuacagcucuuaaggcagcgcguccggaguuguucguuccucccggugggcucguggucucacuggcuucaggagugaagcugcagaccuucguggugagugucacagcucauaaaagcagcguggacccaaagagugagcaguagcaagauuuauugcaaagagcgaaagaacaaagcuuccacaguguggaaggggacccgagcguguugccacugcuugcucuggcagccugcuuuuauucucuuaucuggccccacccacauccugcugauugguagagccaaguggucuguuuugucagggcgcugauuggugcguuuacaaucccugagcuagacacaaagguucuccacguccccaucagauuaguuagauacagaguauccacacaaagguucuccaagcccccaccagagcagcgagauacagagugucgauuggugcacucagaaacccugagcuagacacagggugcugauugguguguuuacaaaccuugagcuagauacagagugccgauugguguauuuacaaucccugagcuacacauaaagguucuccaaggcuccaccagacucaggagcccagcuggcuucacccaguggaucccgcaccggggcugcggguggagcugccugcaggacuggagcugccugccaguccugcgcugugcgccugcacuccucagcccuuggguggucgaugggacugggcgccguggagcagggaguggcgcucgucaaggaggcuggggccacacaggagcccacggagggggugggaggcucaggcauggcgggcugcaggucccgagcccugccccaggggaaggcagcuaaggcccagcgagaaaucgagcgcagugccgguaggccggcacuacugggggaccuagaacccccuccgcagcugcuggcugggugcuaagccccucauugcccggggccggcagggccggccggcugcuccgagugcggggcccgccaagcccaugcucaccgggaacucuagcuggcccgcaagcgcugcgcgcagcccugguuccggcucacgccucucccuccacaccucccugcaagcugagggagccggcuccgaccuuggccagcccagaaaggggcuccuacagugcagcggugggcugaagagcuccucaagugccgccaaagugggagcccaggcagaggaggcgccgagagcgagcgagggcugugaggacugccagcacgcugugaccucucacuacuuaucaccaggcuccagcaauuuucaauuuacagccaaucuuucaucuacccccaacugccccagccaucguugcuauugaguaucaguuguccuaacaguuaugccuuuguagguaaucuauuuucucuggcugcucucaaacaccaguuagauguguguuagccuucucauccuauccuuugcaucucuuagccucucuuucauaccuucuauuucuuugucucucuggacugcauucugguuaacuuuuuuuuuuuaaucugucuuguuccauaaaugugauuuuggaacuauguaauuauuuuaccuaguuuuaaaugaaccagggcuccuuggauaaauggcugauugaaggccuggagcaggaaauggacaaagugaaccugaaccuggaauauuucgucaaaaaaaaaaaaaaaaggaaagaaagagaaaaaaggcuuucaaagauuacuugggucauguaaauggaccuaggagccaauaugauguuuccacuggccaaagauggaugaggcaauuuguacaucaaucugaauaagagcuacaauggauugaggcacacacagcauuccacaauuuauucaucuguguccuguggauaggcauuugaauuacuuccaguuuuuagcuaucaugaauaacauugcuaugaauauuaauguccauauauccugauauauauguguacuaauuuuucuagaguauguccuaguagcagaauuucugggucauaagauauauguaucuucaaauuuaccagauaaggccaaacuguucuguggcuauucacucuggccucuuacaaguucuucaagagucuaauggcauaggagaauauacuguaaguacauuaucaucuucccucugaaagucacccuguucaccucaguacucuaagggaaacugcugcuguauuaugggugguucuguuuuuaacaguuucaguauuuugcuuugaaaaugaaugccaggcauaucaccuuuauuacuacuaauauuugaacaugaugauuuucauggcgccaacauauuagaaaaacaaaacaaaaacaaugcuuccuggaaaaaaaaaaagaaacuaaauuaggugcucuucgaaugggcccuucaauaauuaaaucugcagucuuuauaaugacugcaaauaugaugaguaucugauaggauuagcaccucuaggacaccauugcagcauauugaguuaaaucuaucuauccuacauaaccugagauuucguuuuuucuaaagacaacagaucuaaacagaaguuuaucuaucauaguuuacgaaaacuaacaaccaucuacuugaaagaacagguaaaacaaagaauccucauguguuucuuuaaauauaaugauguccucccccuuucuuuaugccuaauagcaacuaaaugagguucaguuuacagcaaaauaauaaauuaaacuuuggcucagguaaaaccagaaguacacuaaaaacacugcuggauggaacaacaaaaguauacacagauaaauaggggaaugguagguaugcaggugggggaugagggaagaagcggguagggagggaaagaguguagagagcagauauggcaacauauuuacauuuagugaaucuaagguguucuuuaagccauccuagcaacucaauguagguucaaaguuuuucaaaauaaaaaggugaaaauaaaaauaucuagaagaauauauaccaaaauguugacauugucuagguuacaaaauuacaaguaacauuuaaaacugcaguuaauuaggaucuuucuacaaugaucaaauauuccuuguguaguaaaaugaccuuucuacaaugaucaaauauuucuuguguaguaaaauauuuuuaauauuuuuuauuuuuuaaaauauaauuaauauuuauuaaaaacucuucuauuuuaaccuaaaaaauaaggcuauuggaugccccuugcauauacuuacacauccacacgaaucuggucccccauugaacagggaacaagcuauccucacgauuucugccucuaucuugcguaguccugggaagauaucuggaugcaggggguuacuccaugcaaaaucuccauaagccugcaaaaaaaugcaagcagaugugaaaucaaaacuauuacacuauacaggacaaagaaucaugcacuaaacaacaguuucuaaguauuaggcacaacaauauaaacuggaaaaaaagauaagauauauuccucaaccaaaagaucaaaacauagcagaggagacagacauguaaauaaauaauuuuacaaugugaugaggaaagaaguauaaauaugguuaaaagcgcagacuauaacaccaaaccgacccaggaggaagucuaagcuuugccuauuacuuucagcuguguaggucacauaaucuaagguuguuucuucauacgcagaaguuguuaugguagcuaucuucuaguguucuagcaauaauuaaauaacauaaugcaugugaagcacuuaguagagugucuggcacaaagcagcuguuguuaucgacugcaauaucagguguguguacagagugcuaagggacccugaagagggaacaacuaacauccugagugaucuagaggugucugcugaguggaacuuugagagaugaguaggaaucaucauuuggaacaagaggaaugauggaagggaaggaaaacaacguaaaagcaugacacauuuaguaaagagaaaaggcaggauuaguguuuaugugggaaaugaagagaaguaguuaagaaaaaauaagugggagcuggcucaugaagaaacuuguauucucugcugcauaagaaccugaguuucauccuguagauaaugggaagcuacugaaagauuuuaagcacagaagaucagagcauuacaccaacuuaugcaaaaccugccauauuuauuuaguaagggacaguuucauauuuauaauaaucaaacacaaagaccuuagagaucaucaguacaaccccaauuuuauaugaugaaguggaguuucaaaaauaaauaugagggccgagugcagugguucacagcuguaaucucaacacuuucagaggccaaggcaggaggaucacuugaggcugggaguugaagaccaaccugggcaacagagugagaccccaucuccaacaaaaaaauacaaaaauuagcugggugucaugaugcacgccuguagucccaacuacucaggaggcugaggugggaggaucacuugagccaaagaggucaaggcugaagugagccaugauuacaccacuccacuccagccugugugacagagugagacuuugucuguaaaaauaauaaaauaaaauaaaaauaaauuugauuagaaauggaagaagcuaagaaugagaauuauuugaaguauacaugagaccacugcucaucuugggucacaugauuugagaaaauuaugaaagaguuucccuaucuuaucucuucuuaucaaacaaaaucugucucaccacaaaaaucucaucugacaggacuaccuucccuaguaaucugccuucuagacaggacaucugcaaagacugaaaacauaaauaacauuuuacuauuuuacagacugaagaugucuuugauaauauuauacauauucgccuauguuugggugaagagaaacuuuuaugguuuuauuguaccaauaagcuuuccuuaaguaauuuuucuaauuacaaaaguaagggaaaaaaaggaggucauguaaacuggcacagaccucacaggcuucccucaagaacuggacacucaccuucacaaggagcucagugagcuucuccuccccacuguacacuguuccagaggcucuccccucuugccagaaggcgucugcagagaaagguaaggucacuggucaguaagcaagaaucucugggaagacagguucugauaaagaagaaacaggaagaaacuccucuggauacaaaagaaaaaaauguugaguggaaacccaacagcauucuuauagcaaaucaagaaaaaaguucaauagaguuagcacaauaaaauaaagaugaaaaaucauuauuaucagcaaugugaaaaagauauuaauagcauuuagcuacaauaaaggcaaucugauaauaauguuguccucauccucaacugccuucuaacagcaggaacauuugccuuugucuauacuuauuuuuuguucucuauauggcuuuggaguggccuuuuucugcaauagcuuccuucuucucuccuuuccuauccaguccuaggaauuuugagaacuauuaugagcagaguuggcagaagaaagcaaaaugaaaagugugaaauuucagcacacuaucaucagagaugaaaccagcaaacaaaccacaaugagguauaaaccaugagcaccccggucucagacgccggcucccuuaagccaagccuggaaacccacauaaaacuaguuaccugcuuccagcagcacacgcuguagcauauucaagaucaggaacacagucaacauugggauaaaccuccuuuaucccaguguggaaagaaaaguaaaguuccugaguagaauauaagaucugacuuuccacuuuccucucuccccgagacauucuucauuuuacccacaaauuuguugauaugggugucucagguccuugugcuacaaugcagcugugcccuauugaaaguggguagugagaaagcuauuacggaaacacaccaacuaaaaacugcauggagccaagggcucuccaaagcaaagaucuucagcucuugagaacagaaaacuaagugguaaauauacagacaaacucauucuuacagcaaucugccaagcucuggcuugcugcccguuugacuuucacucuuuccuuagaggacacugcucuguacuauacacagcuucagaccaguggucaccagccuuucaaaaauaagauaacugguuucauuuccuguucuuuuacugaugcuagagaauacagcaauggacagugacuuaaacauuaaagagaaggcaauaugauggcggcaaccaggucucauaaucauggaaaucuuuaacaccagguuuuagagugcuaaccacugcuuuauucaucuacauccuagacuauaucaaauuuuguacuauucaaugucaagaccucaacacaugucacuuagaaauuguaaggguauuugucaaggccgagcacaguggcucacaccuguaauccuagcacuuugggaggccaaggugggcagaucaccugaguucaggaguucgagaccaaccugggcaacauggugaaaucuuaucucuacuaaaaacacaaaaaauuagcuggguauggugccgcacgccuguaaucucagcuacuugggaggcugaggcacgagaauugcuuaagccuggaagguggaaguugcagugagcugagaucacaccacugcauuccagccugggcaacacagugagacucugucucaaaaaauaaaaaauaaggguauuugucaaaaugcaacauggcuccugguuggcuccuagaauagaaaaaagaacauuaguuuaaaacaaaacauagcaaaacaaaaaaaaacccugaugaacuagaaauagaauuuguaguguaguuaauagcacuguaccaauguuaauuuuuuaguuuugauaaacguaccaugguuauagaggauguuaacaucaggagaagcuggguauagggaaaucucuaucaucuuugcuacuuuucuguaaauauaucaaacuaaaaagcuucuuuuuaaaaaguacuuguaauaugaucuuaaucaguaacaaacauaaaucuguuugaguuaauaauagcaauaauguuuaacauuuacugaauccuuacuauaugccaggcacuauaaaacauuuauacauguaugaucucauuuaauccccauaaucaucuuuucagguaaguacuguacuacuauuacuauccccauuguagagauacaggaacugugacauacagaaguaacucgccaaaggcauacuuuaaguggcaaaccaagguaugaauccaggcugguuccaggguuacgcucuuaagcaccaagcuauuuggucuauuuauccaucccauaugugcucaugcauacauguguauacacacagacaaacacuauuagcauucucagaaacagacagauauacauauauagauagauguaaacuauauagacagcucuaccuauagcuacaugcauaaagauagacaccaucuguuuaucuuugauaguggaauuauagugacuuauuuucuuuugugccuuuaugcagauuucacauuuuuacauggaucuguauuucauuuguauuacauaucuuauauucucucuucuuaaacacaaauauauuuguuuuauucaugcuuacaaaaggaaauaaaagccaaguuccacugucucugagauuugcuugcuuuauggaugaaggaugaaucuaaacauaauuuuaaaaauaggaaauucaaccugugaaacagagaguaggcccuccuaaacauguauuaaccaaugaugaguuauucuuaaccuaugugaacauuaaacaaugacaaaaccugucucuuuaaggaaguagagagcauguauaugccaagcaucauacccauagagcuguacuccuuaaguuucuccaaaacagcagaugagcucagacccugggaggguaaagcuuucacauacucuuuguccacuuucaggaaugacauguucuugcuaauaucauccuuggucuuguucaacuugucuugaaucuccaaagguaagaaagacaaaguuauccagaugcaagaguacaguagagacagcagaauuauuaugacagucaagcaacugcucaaugcuaggcaccgcacaaguaacuaaacuaacauuuuuccuaaagauauauggugauauucugacugaucagcuacuuucuggcauguacaauagccucuuaaaaauuugaaaagcgaagcuucucucuaaaggucaagaugcacucagccggucgcgguggcuuacaccuauuaucacagcucuucaggaagccgaggugggcagaucauuacaggucaggaguucgagaccagccuggccaacauggugaaaccccaucucuacuaaaaauacaaaaauuagccaggcaugguagcaggcauuuguaaucccagcuacuugggaggcugaggcaugagaaucacuugaacccaggagguggagguugcagugagccaagaucacaccacuguacuccauucagccugggcaacagagcaagacucugucucaaaaaaaaaaaaaaaaaaguugcacccaauuuccccauaacccuuuucucugccacauugacaucacugcugcuucacuugguuggcauugcuaaagucagcacauccuugagggcaguauuuggacuuugauccugccuuggcagcagcuacaguguguguguaaaagaaucaaagguauaacuaggaacaguggccagaaaacuggccaugcugcaguaaaagugauucugguccuugugcaagugaugagcuccuucaacagacauacacgcagcacacuaggaauuuggaggucccauucaacacuagcacaaggcauucuaagaacugccaggaagacucuaauguaucuccuuaagcugcugucgacagcuugcacugucugaccccaaaauauuaaaaggaacuaagguccuuucugcuagguaguuuaucaacuaugguucccuucuuuuccauccucaaagccacagcuucugagcuguuuucuuuuauucacuuacauauucacauucauauucacugcauauucacaaauaugcaggccagggacacauagugaacaaaacaaacuuaggcaauggagcacacaggaaaaaaaaccuccuguccucaugaaguuuauuuucagcaggagagacagaaaauaguaagacagguaacaaaaagugcugagggaaaaaaaauagcagaguaaggaggcagaagggcaggggcugcugcuuauagcaaaaggcucuuggguaguagguuuggggagagaagcuacaugucacgauuugucacagugcuauuguuucagcaauauauuuguuaaagaacgccagaacucacuccacacuaagauuuucucaucucuagccaaggauaauuagaauacaagaagaucuucuuagauauggcccucagugaaaccacagggaaagccacuccuuucgagcaugucugcaauagucuaagaggcccacacuggcagggagcagaggcuacacuccugggcaaugccugggcaugcuauggaugugaagacauuuuuuaaguuguaaauuaaaaaauuaauucacauaaauggcgacucaugcaacagaacaggcuaugaaagcugagcuuccauacauagaguaugcuauugccauaaaacagacaaaaagugacagagagguauauuagaaagcacaaguacuuccuuacccccaauucuugccucaaagccuguauuacguuacccaauuuuaauuucuucaaagcauuuauuucaaaauaaaauuccacauauuuguuuacuucuuuauuuucugucuuuccuauuaaaauguaaguuccaugagaggaaggauuuggucuuguucaccaccauauccccagcacccagaaaaguacuugacacugagcagguggcucaauaagcauguguuaagugaauaaaugacagagguauacacacacgcgugcgcgcgcacacacacacacacacacacauacacacauguaauuuuuuguaucuaagccucagaaucuguuucugaaaaauggagagugauuggauaguccuuggcaagcuaaggaucuuccaauucuguuacuuucuaaguuuaagaguggguucuggaacccuagcauuuauuugucucaaagucugaaaacugaacgaaaagaagaaaaaaaaauucaggagauaaggggaaauccuaaucuccuuugugcuacaguccaucuucuacaauaccuucccuguccccaccccuuauacucuguaaggacuagauuuacuuuuagggauuaauauaauuuggagagcaaacagaagccuauaugcucacauuucccuucaccaccuguuauugcucccacucuccuacaggaaaugaaccugaagauaccuaucucugggagaguuagcacagcgaucugaauggauuucagccaaagguuaaagauaacuggccaacuuuaggucagggguuggcaaacaaacccugguauagccaggaaagggaacugaaagccaaaaguagaagaaaacuuaaaggcagguaaaguugggaaagaccaaaggggggucaggggagggcacuggaggagaugaagauuccaaggacucauaugccuuccuuagagcuugccaaguggccugcccuguuuaucuucaucugggauaaccugugggagacgcacagaggugacuaccuuauccucaacauggaugagggccaagaggacauaacaaaggggacauacuacaauacagaaaauugcaaacagcaagagacagcgcugugcaacuugggaucagcaaacuacagccaggaaccaacaaaggccuaccugaauucguaaagaaaguuucacuggaauauagccaggcucauuccugaaccucuugcugcugucccucugcaagggcagaggugaggaguugcaacagaaaugauauggccuacagagcccaaaauguuucauaucuagcccuuuauagaaaacauuugccgaccccugaccuaaaccauguaagcacccaacuccuagauaaauaccuaaagucagccagcugcauguuguuccaaagcaccuaacaauacagucagguuuucucaaauucuuacuuccuuaacaggcuucucaucucuccuuuggccaguuacauuggagaaaggguuaagucaggguucucaaccuuggccauuuugacauuuccagccagauaauucuguguuuggugggugggggggggcugcccuguacacuguaggauguuuaguguuuagcagcauuucuggacacgauccauuacaugccaagagcaccccuccauccaagcugugaccaccaaaaaugucuccaaaugcugccaaguguccccuggagguaagagacaaaaucaccccuccacuuugagaauauuagguuuaguaaauagaaagaaagagguaugauuaucaagaggggaaaaaaugacauacacagauucuacuuaccuuacgaccaauaaugggcaucuuccuggugagcuuaaaacauuucuuuuuaaaccuugaccauaaaccuaaaagaaacaaaugguucucuuauucaaauaaauuuccauggauaugaccuggcauauagcaaccauucaaugugucuuccaccucacuugccuuccaauugcaaagaguuucuuucguuuaaaaaauuuuaaaaaaacuuuuaaauuuaaguuugugaauaaguacuauauuuacaugguucaaaauuuuaaaaauacaaacacauaacacacacaguaaagcagugaagcuucccucucucaaacguauccccccaacccucaugcuaccccccugaguuuccuuaugcauacacgugcaacaguaaagcuauauucuuauuugucucccuuuuuuugcacaaaaaguagcacacucuagcacuguaguagaccuuguuuuuccacuuaggaguauuaucuuaaagaucagugcauccucauucauuuuuauagcugcagaguauuccauuuuauggaugugccaaaauuuauuuaaccugccccuuaaugauggauauauagguugcuucuaauauuugcuauuacaaaucaugcugaaauaaccuuguaacacacaccauacugcacaccuacaggauaaacuacaaguacaccuacaggauaaacucccagaagcagaacuacuaggucaaaugauauacguguuccagaauucuugaccuuccuaagguuucuagauguucaacauuucucuuccuucccccaagacuaaugggcagccuguuuuuaguuuuguuuuucuuggaucuauguccagccucucauccaacacagauucuaacauuuucuggaccuacaaaugcccucaaaauuguggaugcuggccaggcacaguggcucacaccucuaaucccagcacugugggaggccgaggugggaggacugcuugagcacaggagggugagaccagccugggcaacacagugagacccugucucaacaaaaagaaaaaaaaguuugaaaaaucacagaugccagaguccacucugucaggcaguacauagaacaaauagggaauacaaauccugucgaucauaauaaucauaaauacauggcaucuaaauagacuaauagaccuucugaugcauucacaaucaauguaucucgacugacucugacaacagcauucugaggcuggcacagaaggcauuauauaccaucuacgagugacauaaaaggcaaugcaagaucaaagcaucaaaacuugcucaaggccacagauaaaaucagugauagagcaaagauuuaacugaagucuuuguauuuucaguccaggauucccaggauucuauacugcuucaaaugcaccacaggaauuuucuguuugagucuauaagaaucuaagccuggcuuuuauccaaggugugaacugaauaugaacuucuacugcauuccuaggagaucuggaaauucccacuuuccuggccagaaggagcucccucuucacucaacaaccacgggaugugucugcacccccuuuuuguaucuaucacaucaugccuugcaucucugcuagcuguuuuugcuucagcugcaucccucucuuucuaacucucccuagaguccacauucuguaaacaccugggacaaaaccagguaacuaagacacagacugaauaagaagacaaagagacugaaaccacuuguuugugguuacuuuuuguuuaaauuuuggaguauuuccuucuagcccuauguucuacacacuguaauacauaccugagauucuguauaauguaaaauaacuguauccuccucacugauagcacuuucuacauuauuaacaauucuuucuaaacauauuuuuaauguuauaauaguucaucaaaugacuauaaucuaauauuggauauuuuagcuucuuguuauucaacuauuucuaacuguuaaagcuguacagauucagaaaugcuuccuuauuugaugaaguaauuaaugagguaaaaagaagucuaaaaaucagcaaacuggaccagcuguccagaaguauaguaaugugacuagguggaggauaaaagaauaaacuaauuuuguggaaguugugagaaaaaaugguacaggguaaaaagaacggaauacagcaucagagaugaagaaacuaaaaauaaaaagaucccauggcccugaccuaaaaagauuaucucaaaaguccccagaagguacagaaugaaaaguaauuagaauuuuuuagugggauugagaguaaggggaagaaggaagacugggagauggucaaaaggauagaaaauuccaguuagacggaagcaauaaguucaagagaucauggugacauaguaaauaaaaauguguugcauacgucaagauugcuaagaaaguagauuuuaaguguucucaccauuaaaaaagguacaugaggccagguguggugguucacgccuguuaucccagcacuuugggaggccaaggcaggcggaucaggagaucagaguucaagaccagccugaccaacauggugaaacccugucucuacuaaaaauacaaaaauuagcugggcgugauggcacgcgccuguaaucccagcuacucgggaggcugaagcaagugaaucgcuugaacccaggaggcggagguugcagugagccgagaucgugccacugcacuccagccugggugacagagcaaaacuccaucucaaaaaaaaaaaaaaaaaaaaaaaaaaaaguacgugagguaaucacguuaguuugauugagccauuccacaacuuacacauuugaaaacuucauguuguacaucauaaacauacaauuuuuauuuguuacuuuaaaaaaagaauuuuaaguuuaacaaaauagaaaaugccaguguaagaacaaugcaugguucuuaacaguuuacaaauuccacucaugcaaaagaugccauucaguccucauauuacccaugacuagguaaagcagcuauuaugauguccauuuuauugcaaggaaaugggcuaagagagcuuaagggugucacccaaggugacacaacaagaaacugagaguuuaucauuuccuccaugacauaaagcugauuucuguugaugaauuauggacaacccacaguuaaaaucagcauuaaaguaaaaguaauaaacugugagcugauaaucacagaggcagaauuaaggaagaggcugcuaaccccagcacaguucaugccgcugcccacuucuccucuaccccaggcuccauccuuuguuccagaaauacucucuucccucaagagggauucaguguuggaagaucagcaaaauucaucacuaguccagacuucagacuccuuuagugcaguguaacuaaaaauaacuugauuguucagcaacacauggcaagugagcaagugcuaaaaaaaaugaauauucuaucaaaauuaucccugaucucuggagggaagacauucuuaucugugucuaaaauucaaguuggaaauuaccaaaugaaagugugcuguguguguaugugcuaaauuguauaaaauugucaacauuugacgauuuuuuuuuuacaaaauuacauuuuguaugguucaaacuggauucagauauagaaacagagaaauacaauagugguauccuucaguaguaagauuuuaauuuuguucuuauuauauacccauauuguccaacuuuuccauagugaauauguacugcuuuuguuuuguaucuuuagaaacaaaauaacucagcugggcaugguggcucaggccuguaaucucagcacuuugggagguugaggugggcggaucaccugaggucaggaguucaaaaccagccuggccaacauggcgaaaccccaucucuacuaaaaauacaaaaauuaggcaggcgugauagugggcaccuauaaucccagcuacucaugaggcugaggcagggagaauugcuugaacccgggaggcagagguugcagugagccaagaucaugccacugaacuccagccugggugacagagugagacuccgucucaaaaacaaaaaacaaaaaacaaaaaaaaaaccucaaauggcuuggaguucagcccacaaggauuuagauggcauaucucaucaguauacuacgacuaacaauuuucucauggaaaauuggccucucagaggccagcauauuccuuuuugaccacuaaaagcagauaaguaucagaaccuaagauggcugugucucuacuauuagcuaagcaaaauguauggcauagugagcugcagaacugaaaacagaaguaaauaccuaaccacaaaaaaagaaaaauaugggagguaaugcauguuaauuagcucaauuuacccauuucacaauguauacauauuucaaaacauauguuguacaugauaaauauaaacaauguuuauuugccaauuaauuuuaaaauuuguuuuaaaaagaauaccuaaaauuaauauuaaucauagcaaguaaaauauaaaucucagaucucuaagcuuagccuuauuucauaaauguaccaccuuugaauuguaguacauuuguaaaacaaggcgauacaauaaauggugguuuccaggggaugcgggagagaguaaugggcaguuauuauuugauguuuauuaaaauggaguuccaguggggugaugaaaaaguucugguaauagugaugccuguacaauaaugugaacguacuuacugccacaggacuaacuguacacuuaaaaaugguuaaagugguaaauuuuauguuguauauauuuuauuauaauagaaggauaagcagagacugauuuuuuuuuuaaugaaaaguuaaaaaauaaaaagaaaguauauuucuugcuaccccucagaauccucugaaaugggccccuuacucacugaauugaauacuuccuaggaaaggaauaagcaagagcagaaggacacaagcuacauccauauccaaaccauugagcagaugcagcggaagggccggccagucuaauuucuuagaguuuaucagaaaaucuugcaaggacuaggagcagcaacugaggacaagguuuuuaaagcuggagugagcuacagauuuacacaggagagucaggucucauuuccacuuuaauuuaaaaacucuaagcaguuggaacuugcuucuugguugucagguuuugcaauguuuacugcgccauaaauggcuaagaagcuauuugcaggguaaagagauaaaaauggaaucuggcuucuaaauugacuuuccuugaacaagagaagaaaagcagaaaaaacacauuaaagagcccuuuuaaacagguguuaucagggaagcaaagugguggggaaauuucaagcaaaugagaaacagcuaaugauuaucuucaauguuacuguuuucuuaucccaaggaaguuaacucccauacccuacuaagaguggggaaaaggugcaggggaguguuauagaacauccagcaccaaauccacuacuuguguuuagguacuaacaacacucaccaagcacagacugcagaggaaaauaacucauaagaagguaacacacaaccagguuucuaggcgggaaaaaggugggugggcaggagaggggcuuaauccuaagcaaagguggaagauucagaagcagaucacugagacugcucaucuucugcacccugagaaguggccucuucuuccccauguugaucuggcacugagucacuucuaggaagcucaaaguauacgauccccugauaccaguucaacuccaagaggagagagauccuguacuacuugugcagauauccccacagccugauggcagugccuggcacauagcaagcacucaaauggucaccauguaagugcuguuccaauuucaccuaaucuuuacugaaaaggauagcacaaaaugaaagcaauaaauuccugcucugggaacuccaggugacauaauuauguucuagggaagaaacugguaccaaagguuuaaaccauacugagauuucuguggauccuuacaaugacuaauucugaggcguuuuuacgugaacuacaaauccaaaaaaaaucaauguaaggaguauuaguuauacaagaguccuguuauaacuugaccaaucagaagacaaaguacugcuuuacauuuaaacagauuuuaaaaauaagaaccaaaccagggccgggcacgguggcucacgcuuguaaucccagcacuuugggaggccgagguggguggaucacgaggucaagagaucaagaccauccugaccaacauggugaaaccccaucuccacuaaaaauacaaaaauuagcugggcgugguggcgugugccuguagucccagcuacucgggaggccgagguaggagaaucacuugaaccugggaggcagagguugcagugagccaagaucaggccagugcacuccagccuagcaacagauggagacuccgucucaaaaacaaacaaacaaacaaaaaaacaaccaaaaggcaauaaauuaguccuaucucucagcaauuaguuugaggcuagugacacaccacuauaccuuuacagaggagacagcauacuuacucucuggcuggaagacaaacucauauccccagacuaucagcaggguccacacgacacuccaugcaauuagcugccagggcucauacuuggugcaauguccauuuacauaauucuuggcuuuuguggaguauacuuccaaaaucucuaaguagggcucaaaggccuucuagaaauacaagugaaaaauaaaaacauuacauuuagagagagaaaagaagucuguucuuaguuuguacuucaacucucauuuuucaagggcaaggucauuccggaucuugcccuucuucagcaauaaucuuauuaucaucuacagcccucaaggcuucuguaccagucacuccagcagcacuccacugccacuuaacagcuaguggacuuugagacuauuuucaaucuugugccuauuuuauacaguaagaggguuaagcuagaucgucacuucagcccuaaaauuucuauaugacugcuagaaucacugucccacucucuuaacucacacuaauacccccaauaucaaugucauuucucuucucuauuugaaucuuuccuauucucuaccccaguagucagcaaacugguucuguaaugagcuugauacuaaauuauuuuauauuuuaaguguugcaaagcaaacauucuccuuuacaacuacuccucucugcugcuggaguacaaauauagucaguuauuguguaaacaaaggaacauggcuguguuccaacacaauguaauuacagacaccaaaacuugaauuucauauaauuuucauguucauaaaauauucuuuaacaauuuuuaaaauguaaaaaucauucuuagcacaaggaccauauaaaagcaggcaagagccagauuuggcuugcaggccacaauuuaccaaugccugcucuaaggccuuacuugacuauaaucucucagucagcaaccauaucuuaccaucauguguauuccucacaacaccugguacgagcaagaaaaaaccuguccucuguaaacuuaccagaguaucucauucacgagaauuccucucucccuuuaaauucuccuccaguacucauuuuugauaaguccuauacagagcuuaucacaaccugccuugcagucuacucaucuguuucuuaucucccugacuauaugguuaaguucuugaagacagaccaguucuauucauaucuacaauccccuacaaugcccuguacaaacuaaggucauuuuauaguuuacuauucauucacuuaaucaacauugauuaagcaucuccaggguugaaggcaguaagcuggggaaguguucagguacauaucauaguuccaagucuauacugaguuuacaaucuaauaugcaagauguagauguguguccacacacacacacacacacaggcacauacauauacaaacaaaucacgaaaacuucucaggggaauagccacaaaaagcauaugagugccaagauggagcacugaggaaggacuaucuaacucugaagggauaaagauaaugacagagggcaaaauuuaagcugguuaaaaggaugaaagaaaauucucuagguagaaaaguuaaaaggaaaaaagucauaccagaaagagaggauaguagcugcaaaugcauaaaaagagucugcauauggcaaaaguucuauguggcaaaguguaagcuacaugauggcagggaccauuucugucucauccaguacuaaauccccaacauguggcagagugcccggcacacaauuuauacugaauacaaacauggacaggggcugacagugcccaaguaacagugcccaaguaaaugagugaacacuuaaaucagagacgugaggcugggagaaguaugcuagguccaugauaugguuuggaugccuauccuccaaaucucauguugaaaugugauucccgacauuggagaugaggucuggugggagaugacuggaucacgggggugcaucuuucaugaaugaguucuugcucaguuaguucaggugagauccgguuguuuauaagccuaggaccuccccccacucucuuucuugcucucacucuugccaugugacgugccugcucaaguuuugccuuccgccaugauuguaagcuuccugaggucucaccggaagcagauguugaagccauguuuguacaaauaugcagaaccaugagccaauuaacccucuuuucuuuauaaauuacccagacucagguauuucuuaacaacaaugcaagaacgggcuaauccaguccauguuuaaaaaggacuuagaaaaacugauauacaaacugauaggaacuuuuguaaagcaauuuguugguaucuaucaacauuuuaaacgcauguucguuuugaccuagcaaucucacuuuuuggcaucugcauacuuugcacauguauacaaauaaacauguucaaggauauucauuucaguauucucuaacaaaagggaaaaaauaauguaaauguccacccacagaagaaugguuaaauaaacuauaauacgugcauuuuauguacccauaccaugaaacauuaagaagaagacagaucuacaugaacuacguagaaaaauuuccagaacauaguaucagguaaaaauaaguaaauuacaaacaacagcaauaaaacaaaacaaaaggcauggauuuuuaaguaugugaguaauuuuuucggguguggguauagaucauucaaaauuuucaaguucaaguucgacagacugguuaacuaugauguuaacaguuaauaucaguauuaacuaugguaagacuagaagaggaagggaagguaaaaaagguagaagauguuuugagaaaaagauaaugauacugacuuaaauauauuccuauuggauauccacauccaguguucuaguaggaacaugaaagcuuagaaaaaggacagauacucaacaaaugcuuguugaaaacauuuauaccugcaauggacugaauguuuacaucccccaaaaauucauauguugaaaucuaacccucaagcugaugguaggaggaagagggagccuuuggggggucauuagaucaugaaggcagaggccucgugaauaagauuagugacuuuauaaaagagacccccagagagcaaauuugccccuucuaccaugugaagauacagugagaagacauuuucuaugaaccacuuuuaugaaggccaccuuccaggaagugggccucaucaggcaccauaucugcuguugccuugcucuugggcuuccuggccuccagaacugagagaaauggacuuuuguuuauaugccaccacguuuauggcauuuuguuauagcagccugaauggacucagacaauacucuuaguaauuagacugugguauaagguaauuaacauuagacaacuacuaaguucccuggagggcuacccauggagacaguuuaucugcaauuccccaacaguucuugguggccauuccccagagcccacuguugcaucaacaaccucaauccaaagcaauggcaauaccagccaaaaccugggaaagaccagaggagucuaucaucaaaaguaugucaugauuucuaucauuauaaagacucgucuagugugaaaguuguggucaaaccagaugguuaaauacugugcaugaacgagaugaugaaagaacaauuauucagauuagcuuuucuucuggugauacuaauuccuaauucacccagaaaacagaaguuaccaaugucaaaagaugacuauagauauuaugaacaauucacagcacugagcaaaaaaguaacauaaccaguauuagggugacagcaaagaaccagcaaaugcaaacuaauuuuuaaaagccuuaaaauuaagauauaaagacauuccucacuaacauuuaaaaauuacauucagcaagaauauauuuucuuuguauuuguuuugauucuuaugaagauaauggcaauucuuaaauucaaaggagguccuuuaaaaggagauaaaucuaaauucuuuaacaccaaagacagaaugacacuguaguuggauggguccugacaagcuuuuugaguagucaacuaguugaucacagaaauuacaucuccuggcaucauucuaagguccuccuaguguuacuacaaacaaccuaggcucaguccccaauguagaugcaacucacaacacucacagcucacugaauuauugggcucuguggcauaagguauccuaucuccuuggacuaaaggaugaugcaguuccuuaggaccuugaaaacagcacaaaccccaggcuggguccugaugcaauacucuagcccuugggaagcacagaauguaagagcugaagggaaccuggaagaucaagucuaacauuuucauuuuacaagcagagaccccaaagugaaaugacaugacuacgcucauacagacaugcuugugauuaagugaagucuaggaacgcaugccuuuugacucaguauucaguacccuuucaaaucuugauuuucaguauucaugggcagaggaguaacacauuacaauccagcagcaucccaagaguuuucuuuucacaauuuauguucuuggcaggaucuacccuggauacaugguaccauguauaacauacuaaaauuauauaguuaggucaugacuacagauaaacaucuagaucaaccuuguccaacaugcaguccaggacagcucugaauguagcccaaaacaaauuuguaaacuuucuuaaaacaucaugagacuuuuuuuuuuugcaauuuuuauuuuuuuuuaagcucaucagcuaucauuaguauauuuuauguguggcccaagacaauuauucuucuuccaauguggcccaggacagccaaaagacuggacaccccugaucuagauagagauggcacagaaguucaugugauuauaauuacuauucccacuaugucuuuuuacuuauaacaguacuuuuuugucuauauaucucugaauauauacuuauaauucuuaggcuucuguuuauuucaauuuuaucaauguauugugucucuggaaauauaugaacuaugaauggucauccacaaaggccacuagcuuacugugcaacuccagguaaauuauuucaucaaucuuuaugucuuuaucuagaagaagaaacacaagaacaauacagucauaaaauaagcuguaucuguauaugugugugccugggcagggaagggggacaggggugcuuaucuccaacccuugcuuaauagaacaguaguuucaguacaguuucuauaaguaaaacauuccuuccuucacuguuauaaaauuggaaagguauuccucuagaaaaaaaaauuauuugcccagugaaugaauaauacuuuuuaaaguauaacauuaaagaaaaaaacaaacucuuauaaaccuuaguaguaggaauauucauaauauuaacuacuuuaaagagcuauugucaaauaaugaguaaacuagccuuucucuuguuuauuccauuuccaauucaaugauuacauuucagaugauacccaaaaggcaucaaaauaguacucaauaauccuaaucguuagacaaaaggcagcuccuagaauuuaugggagcuugguagcccacucgccccaaugacauaaaacucuuucagccuucacuuuaaggaugcaagaccuuuucaugaauguacccaacagcagaaggcuacaaauauuguaaauuugggguaugcuacuuguuagaccacugaguuucaaacuguuucaauauguguauuagagucuacguguaugagacuguguuguaaaauacagucccaaagaaaugucuuuuacaacacaaucuaauacauguagaaacagaaacauauaaaaccaaaaguuuccaaaauaauacuuagcaccuuauuacuuguaauguacucacauuucuauuucuuccuucuuuaacgcuugauauacuaaacugauuuugugucccucuaaauggaucauaaucugcaguuucaaaagcagugcuucagagugauuuuacuucuggcuuccuuaaauuuagaaugugguuguguaauacagugagggagcuaacacuaauguuauuuuccacucuacacaaucucagugcuuuuuauacuuacgauuuauucucuuaacauuuuugugaggucaggaauaugagcugaaguaauaagcccaggauaucuagucaugaguuacuuccuaacugacaguagaccacagcuauccccaaugauacuaaacucuuuuaaucuccaaaucacuucaagagagcaaaagauuccauaagcaaacuuccaauaguagcacuauccaccccuugcuaccuccaaaaaaaucuuacgaacugguacugcucgugaccaaauaccaauuaggcagugauauuuuuuccuuaucaaauuacuucagcaccaauuuauaccuaaagaaacauuccacaaaugaauauuacuaaaagagaaaagccaucuggcaaauauuuccagacccacacuggaugaugcaucuuuccuuggaacuaauacaauccuuucuccauuacucaacagggcuaacuaccuguuaugauuugaauguccccccuaaaacucacguugaaauuuaauugccauuguaacaguguugagaggugggaucuuuaagaggugauuuagaucaggaggguucugcccucaugaguauauuaaugccauuaucuugggagugggcuccugauaaaggaugacaucuuggcccauccccucuagcucgcgugcucacuugcccuucugacauguuauuauucagcaagaagaaggcccucaccagauaucagugccaugcucuuggacuucccagccucuagaaccacgagccaaauaaacuucuauuguuuauaauuacccaaucugugguauucugcuaucacagcagaaaauggacuaagacaccauguauauuuguuuuauucaaaagcaauggcaucuccauucagguagucccucagagcuaucuaccaugccaaccuagaaagagcucuacucuguaauguugucucugcuauacguaugcuuacugcuguuuaagaguuucagucauucaacaauuauuuuuggagugccuacuguaugaaggcacuauuuuacagggaucagaguucacccacuuguuucacuaaaaacuuucucuucccucuaaaacucaaagauuuggugacccucugauuacagagggaauaaaacuaauuuagaaaaagaggccaagacaacaugcacaggaaagagugaagcacuuaaaaaguauuaacuuuuuaauuuggccaggcaugguggcucacaccuguaaucccagcacucugggaggccgagguggguagaucaccugaggucaggaguuugagaccagccuggcuaacauggggaaacccugucucuacuaaaaauagaaaaauuagccaggcaugguggcguacaccuguagucccagcuacccaggaggcugaagcaugagaaucgcuugaaccugggaggcggggguugcagugagccaagaucguaccacuguacuccagccugggugacagagcaagacucugucucaaaaaaaaaaagcauuaacuuuuuaacguaauuaaaauuuuaaaaauaaauuuauuuuauaaaaauaauuuuaucuuuuaaauuuauuaaaauuuaauuaaugagaauacaugguauuauacaccuuaaaacucuaaauggcuuucauguuauuuuauuuguauuuuauaaccucaugaggcuauuagauuaagaauguacaggccauuuacacauuauaaaguacuuguaaucccagcacuuugggaggcuaaggcaggaggauccccugaggccaggaguucaagaccagccugagcaacauaacaaguucccaucccuacaaaaaaauuuaaaaaacaaacaaacaaaaaagcaguaggcaugguggcacacuccuguagucccagcuacuuggcaggcuaagguaggaggaucacuugagcccaggcauuugaugcugcauugagcuaugagcaugcuacugcacuccaauacaacuugggcggcagagugagacucuaucucaggaaagggaaagggaaaggcaaaggcaaagggaggagagggagagggaaggaaaagaaaaaggaaaaggaaaggaaggggaaaaagaaaagaaaagaaaccagugugcaguaucacucuauagauggggaaaacugaagucaagaaagguuaagugacuugcucagucaaacugauagaaagaggcaaagucaggacuucacacucagagcugaauuccacaagauauuggaaccaucgcucugggcuucaaaacaucauaaauaccuacauacuaauugggaaaguaugaccuaaaagaagaaaaccaaagagcuguagguaaagccaaacaggggaaccaacaagauauuccaauguauucucucuuuacuguucugcucacauuaaagaaaaacaggcugaagaucaaagaaaaacauuccugcugacaggcugacccacucuacaaauaauuucugaacugccacaggcacacagauucccugccaaggaaaauguggcaauuuugcucaguggauuacugcacagugcuaagugagugaagguuguauggucaaaacugaagugcacacaaaccaguuuucucaggcuuccauaacaacucguaccucucaaacugccuccuugucugaaugcagcuugcugggccacaacagagaccuagggccccugaguguaagucuguuauucacucaaggaaauguucaaaacaguaaugcccuaaugauuuuacugaucucuauagcuucauuauagagucaaguuucugggaaagcuacuucccuacagaaaguuucccuucauucuccuguacaaugucuucuuggcauuucuuuuuuuuuuuuuuuuuugagacggagucuugcucugucacccaggcuggagugcaguggugcaaucuugguucacugcaaacuccaccucccggguucaagccauucuccugccucagccucccaaguagcugggacuacaggcacccgccaccacucccagcuaauuuuuuguauuuuuaguagagacaggguuucaccguguuagccaggauggucucgaucuccugccucgugauccacccgccucggccucccaaagagcugggauuacaggcaugagccaccgcacccggccucuucuuggcauuucuaaugugccacguuuccagugugccucaacucaggguauuucucaagagucacucagggccaaacugcauuagccuauugcauuaugaguuaauuuguccuagaaggaaagaauucaacucugguuagggagaacaaccaaauaauuuuaauauaugaacucucuaugguaccaggugcugauaagaauacaaauuaggaggaggauauaagucuucuaucuccuacacugccuaaaacagcaucuucaacacagcaggaacucaacguuuauucaaauaaaguaauuaugauauugccuauacuuuugacaguuuuguuuugcaagauccuaggauguuucugccuccucucucccacaucucuccuauuuaagcuuaacaagacacaguggcaguggguugaaucugcagaggagaauggcugguuaucuguaacuggacucugcacaccguggcacucugccuacaaguucacaagguucaucacaucauaggccaucagagcugaaccuguccuucacagaugaagacauugaggccuacaggucacaaagcucggaaauagcggagccaggacucaaaucuucugguuuaaaaugcauuguuuuuuccacugccuaguuuuccagagccaaacuaucaguggcacaaaucaggagaccaacaguucucaaaguccugucagcuaguuuacuccaagagccaaaggaaaggcucucaucuucacuacgcucccagugaaggcauacagaacuuccagaugaccuaacggcauccuacaagggcugagcauuuuggggaagugaacugcuauugcauggccuuuucgaacugcaaacuucauucuucucugagcuagagacuuacacucauacuacuuauuugcuuacaaaagaaagacggaaagaaauuaguuugaaaaguacuucagaaaaguugucuucaaaaucauaaaaugcuacugucugaaggaaccuuagagaccaccuauaguccaaucucauugcagugaugaagaaacugaggccacagacuaauaccaaaaugugccuucccugguuucaaacuagaggcacagcccccaagagaaucuaucuucuucuucaauauucuuuccauaaagccaguggggguacaucaauaucauccaagaagcaugauuccuggaacgaaucaucuucuugggucagaauaccccacccacagggucagaguacagaauguguauuuuguaaaccucccuccggugauucugacaggcaacacugcuuaagaauccauucucuuccccauccuuuucuuuuauuaaaagaugacccaguagcugacuuaacauauuacugacacccaaucaccaaacuuaauggcuacccgguauucacgcagcagggaaaagacauccacgaagcuuuccugggaaguguuaaaagucagggcccagucacgucacucuacuagauaucaauucauuguuccugccuaauauuuauucuuuggccagauacuaauaaaaaucaaaaucuucuaccccacaauccugcaaagaagacagaauuuguuauuuguuuuccugaacuauucaacgcucaauacuuuuuccagaaggaccauaaaucugagcuuuacagcaggaaugggcuguugaggaaaagaaaaaucuguucuacccaguucaaauguuacucuaaggacuaagccucagccuagggagugaaguuaaaauacagaagagacucaguuaguauauuuauucuuaucagcuucugcccccccaccaaaaaaagaaaagccagaaagcaaagcuaauuuaaucugauuuucuuucauauuacagucuacagaacuucaaagugcaagguaaacagguaagaaaauacuauugucuuuauagccuccaaaagcauuaaaguuuaucaucaaaaacacaucacaaccccaaagggaaaauccucuugggucauuaaagaaguaagaacugagcaacaaaaccagacagccauuccaagcaaccaguagugacugugagaaacguuugaggaaacugaaucaucauuucuuaggagacaaaaagcaaaccacauacuucccccaaaauuccacuaugugagucaagagauccaguaucugagaaguucgucucaaaaagcuuaagagucuacauuuucccuucuagccuggccuugccagauauguacacuugguaccauuccccaagcaccaacugcuauacacuuagcaugggaguauucaggcaaagcaucuuuccaucccugaaauaacaaaaccaucuuggccacagaaagaacacacauaugaaauguucccaagucaucagaagugcacucauggaaaaccacagcuucuaaguuccuaaaagcugaacccgaaacacugcuaaauggucacuuuauuaauguacuuguggucaggacaaggcaucaaguaaagggagaugcugauucuguuaaguaacaauucugagcaccucucuucugaaauacauauuuaaaaguaucaggagcagcuuauacuaggagagaagacuaaaugcauaaaacugaauucaauaagcagaggaacacacugaaggacacagagauaagagcaauuaccaguuuuguaggaaaauagacucccagccuaaggcaaguagguaagauauggggggaaaaauaugcaaauuugcacauggaauguugcuaaguuugcuaugaacucucagagucugacaauaaauagcuaaaugacuuacugugcacauguauacagguuauauuucaaagcacaaaugaguuucaucauucucuaaaacuagaaaugauaauuucuuggauaauaagcaagaucuaguggaaaagaucccguauuucucacacagaaagaagucuuaacuucucugagcauaucacgauuggggaagggcagagguuagcugacuucuccagucccauacuuaucuuacuaacagaauucucuaucuuugucugggaguuaagacacuuagacuuuucauaaccauuuguggaaauuccuucccuacaacagucaugcugcuauuagagaugaggaauacugaauauuugcugagaaguguaaccuaacuaaagcuauuucucuagagauuuccaacacguaagccugcucaaaagaauaagcagggaccuaucccuaggucucugacugaccuucaacuauauaaacacccuuuggaaagugcaucuucgaaauuaccaagaaccuacuuuuaaaagcugaaguaagcagcugaguaaauuuaauuuaaaauuaauacuuggaagaguuucaaacuuugugguaucuauugaaagugagcaggaaagugugcuucugugauguuauacguauauauugguuugcauccaugguuccugguucauaacccccauagcccuuguuauagucuucuauuauaaugcuggggcacuuugggccucaggaaacagaaucucucucaaccuucuccuguccucuuuuaccugccucaaagcaagacucuaguccaacugugggccaaaaaacccucauuccugggaggguugugccccauauucuggaggaaggaaggcugcacagaaaggccagcgacaaccugaacagacaggccuugcuggguuuccggucagucuauuaguaugagaucaugccuccuguguccagucacauuucuacaugguugucaaucaugccuauguaacuaagccuccauaaaaacccaaaaggacaggguucagagagccucuggauagcugaacacauggagguuccuggaggguggugcacccagggaggcauggaggcuccacaccccuuccccuauaccuugccccaugcaucucuucauuuguaaccuuugcaguaucccuuaaaauaaaccuguaaaccuaaguaaauguuucccugaguucugugagcuguuccagcaaauuaauccaauccaagaggaggucaugggaaccucaccuugaagacagucagucagacauuuugaaggaccagacuugugacagguugggguugggggagacagguauggguugggacugagcccucaacccauagaucugaugcuaucuccagguagacagugucagaauugaauuaggcgacacccagugaugucugcuucuuggaguguggggaaaaaaaucccacacguuuggucacggaagucuucgguguugauuguuguggugugagaguagaggagagaguuuuucccuacggcuuccaaugaaaaauuaugcauuaucugggacgccccuccggguuaccagauucugauuaugaggaggcuguuuacggcucugaaaguuguagauaacugauagcagugcaaaguaaucuagaucccuaaauaugcaaauucugccgucaggugaaguuucaccugacuuuccuaccccuaugacagagaguuguuuugccuccauuugcacauucauuugauauuccugauccauaaaugagcagcuuuuuggaccucuccuuugaaccaguuauaacaucugccugguuuccucuuuuggaguaaaauaaaaucuucaacauauguucauuuuauaucuguauaagagucaggauauuacuuucgaaaauuaucuuuuaacaaaagcuagagaucuuugcuguuccagacuccuccgacgcccagaaaaugcuugugaacauaaaaucuuauauaauuacaaagaauucaggacauccuaaaggccagucauaaagguccauauuccccaguuaauaacuucuguucuacaauaaagcauagaaauagccucgauauuacaaaagguccuauauaaguaaaguaagcccaagauccugugucuccuguaggugagaacaagagacauuguuagauauauccauuacuuaaaauucuguaggaaaagcccuguaacugcaauaaaaaggagugcaguucugauccaugcuacaacauggaugaaccuugaaaccauuaaacgaaugguuaaucaggaagucaaucaggaaagaccacauauuuacuguaugauuguauuuauaugaaguguccugacuaagcaaaucuacacaaaguagacugguaguugcugaggaccggugagaaggaaauaaggaagugacugcugaguacuggguuucuuuggaaaauguccuaaaauugaucguggggauggcugcacaacugugaauauacaaaacaccagaguuguacacuuaaaaaagcaucaugaccuaacaguuccauuuguguucaccaaaugucccuucagcuaagaaaccaccuaagauucuuuggauucacaggcuuucuuuuaauaaaaaaauaaaauuuaaaaggccuucugaaaaaguuuuuaaaugggccaaggacagcagaaauugcaacuccagaaauagagaguaaagcucuggacuccaaaugaaagcaaccauaacuaccuaagaauaacuugccuaaagguauauuuuuacgaguuauaauaauaaauuauuaacgacuaaaaugaugagauuuuaaagaauauuuuuuuauccagcaauuccuaagcacauacuguagcaacuacccagauaucugaaaaggacagugaccuuugaguauuccccugaacugacaccucaccacuacucuugcggacucugagagucauguuaaucuguucuacagaaaggcagcugugguguccuagaaagucuggacugguaaucaaaaccuucggcucuaauuuuagcucucacuuagaagcugugugauguguggcacaacacuaaaccucuaugcaacuggacucugcucaucugcaaaaauagaagccauugggauaauucaacaaaacguucaggagaaaaaaaaaagauaccaucguccacucacaggguuguugugaauauuaaaugagauaagguaauaagaaaaugacugcagauaauaaacacucauuaaauauucagugaaccugaauuauccaaugauaaacauuuuccuuuucucuucaauaagcaacaaggaaaaguaaccuucccagucacaaaggagcuggaagaggcuuuaaguaguuugauucccaugccuauguuguauuuucuuacagacggugguaauaaaacacaccuuaguaaugagcuauuucucaguuuucuaagagagauguuaagucaacucuuaaucuucaacaaucuauuaaaucaaucagaaggcugcgagugcccucuggccuaccuauacaacaagauuaaaucacuuaccuacuaucuuuacagaucguaaaccuguguguuuucagucauccaaacagacuguugacucuuguggucgugauuguugggaaagcauuugaaaacauuuucagaaagggcuggguaacagagucuuaggcuuucuuccacucuggcccaacacagccagacagggagcagacuuacccuggcauccucauauuugcccuccccagcgcccuucaggacacuucugaaaggcauccccuuucagaagaaugugaaaacagaauuuccaauuugccucaauugucucaaagacucggugccauuaagacuggaauucaauacagaauugaucuauuccuuuuuagacccaucugucaaaacgaauucaaaagaauggaauuaaaugcuucagugaaagccuccaaaaaacauggucccccaauauugaguauaaaguguuacuacaauagccacuuagaaucuaaagcauucuagaagauuaugauuuuaaccugagaauuaacuacuacaaauauuuuaaauucugcccuuaacaggguccuuuucauacucaaaaagaacuaagguugcuuuguucccaucaauuguguauuaacauuuacagacuagauaaacaagaaugcaguaggcuuuacucucuggggaaauuacagaaaaggaagggcauuucacauuuuagaauugcuuguacaggcuggguacaguggcucacacccauaaucgcagcacuuuaggaagccgaggcuucucaaugaggaugguuagagacccagaguucaaggcugcaggaagccaugaucgcaccaccgcacuccugccugggcaacagggugaaacccugucuccgaaaaaaauaaaaauaaaaaauaaaauaaaagugccuauacaacuucaggaaagaguucucagugcucuucuccaugugugguaugcagaugacagaaauuuaacauuugcugcccaaagcuaaaucaagaaguuauauauuaaaacucugguagcguaaauuaguacaaccacuuuggaaaucuguuuggcaguacacguuaccacacagcaacucuacauuuuauguuuaccaagacauguucaagaaggcagcagugucauucacaauagccaaaaaacuagaaacauaaauguucuacaacuacagaacaaauuaguuauaauauaguuauacauuguaacacuacacagcaauaagaaagaaaaacuaaugcuaccuaagaacaugacugaaucucacaaacacaauguugagcaaaaaggccacucacaaaagagaauauacuguauguuuccacuuuauguaaaguucaaaaucagcaaaacuaagcaaaaccuuugguagguaucaacugggagggacauuaagaagcuggcuggagugcuggaaauguuuaauaucuugaucuggaaguauauucauacauaaauauuuacugaccuggauaauuaagauuugugcccuuuacuguaugcaaauuggaccucaaaaaaaaagcccuaugauuuuuuuaaacucaaaaaugacucauucacuuuaugggauaacagaacaaaucgcugauacauaaagccugaauaaugggcuaggauuguucugcaguuucugccuauacuaacaggcaacucauucauuuaucauacauuugaaguuuccuauuucaugacaaaaagcugauguagcuauauuaugucaaaaagcaaauuauaugaaaagcucaacuuacaagauguaacaauuuuaaaucugaaugcaccuaguaacaaaaucucagcaaauauacagcaaaaucuauuaauaauagaacuaaaaaggagaaauaacugauaaggcauaugacuugaagaggcagccacaaaacagaaaauccaagugguugguaaacauugaaaaggguacuuaaccacaucaguuaucaggaaaugcauacggaaauuacaauuacauuuaucugcuuaccagauugucaaaaaauaagcuuuauaaauaucagguuugccaaguuggguggaaauaacucucauauauuguugauagugguauaaauuguauuggccucuucagaaaaguuuagcaauaucuagugaaguuaggcauguaugccuuuacaaucagcaauuccacuccuaggcacaaaucccagaaaaacucuugcacuugugaucacuuguuauauaagaacgcucauaacagcaauguuugaaaaagccucaaauuggaaacaacccaaaugugaauuauaagucaaauggauaaauaacugcaguuuagucacacaauaaaauacuauauauacagcaauaaaaaugaaugaacuuaaacuacaugcaauaacauggaucgcaugaauacugagcaacacaggaaaaucacaaaaauaaaaauacauaugcauccauuuacaucaaguuuaaaaaaaaacaaacuaaacuuaggaugcauacacaggugguuaaaacuauuuuuaaaaaggcaagggaauaauuauaaaagucaggaugggguuauccauagaggggaagaaaggaaauauuuguaacagggugaagcguagaguuagagauaaaugguuuauauccuaaucugguaucguuguuuuauuauuguucauuaaaauguagauaugugcuuucuauacucuucugcacguauaauaaauuccaaaauaauuuuuaauuaaaauggagggcaagcccuucuuuuuccguuuccucuuccucuucaugaaugaaacaugaaccugacagguagaaccccaggcagcuacccuggcccaggaggggaugcacuacugauagcggaaugacagacagaagcagccuggcaccucaaagacucaggaauggccuuaucggcauggaauggaaugggaaugaauggaauggaauggaauuguacuggcauugcauuguauuguauuguacuguaguacuguauuguauuguauuguuguguuguguuguauuguauuguacuguguuguaauuuuuuugagagagucucacucugucguccaggcuggagugcgguagugugaccuuggcucacugcaaccuccaccucccgcguucaagcgauucucaugccucagccuccugaguagcugggauugauuacaggcacccaccaccacacccggcuaauuuuuguauuuuuaguaaagacgggguuucaccacauugcccaggcugaucuugacuucuggcuucaagugauccgcccauuucggccucccaaaguguugggauuacaggcgugagccaccgcgccaggccaguuuucucuuaaagaaauauauuuaugucuuuuaaaaaaucucuauuacuuuagguuuuucuguuauauacacucaaaccuaauucuagcugaugcauucagugaucuggacacaugaaaaauuuucuaaaaauuaaagcuguccaacaguggaaagaacccccugagaaaguauguagcacucacuccugacagggcauuguagagggauuccuaggcagcaagaaagcuggacugcaguacuuuuaaaggcccuccaggcaauuaagauucuaaggcuacuacuggaacaaagcagcuuugggcuugccaaagcuguggcaacugugugccucugaaucuauccuguuaaaaucagugggaacauucccuuucuauaauccauaugcuauccaccuucaagauucuguucaagaauuaucuccucauuugugccuuuuaagacaaacuagaccucucaacuccagcaugcuggauguucuccccuccagaugaucuccuccuccagauccuccauccagcauuuuccagcucggcuaugugccuccggauuccacccucugaauuaaaucaaccagacuccuuaaccucugguuuccaguuguauuagaccaaugggaggcuacagcaggagaucagaggguagcaaaagaguuugaaguauuuauuccccuugaugccuuuccuacugggucacuggcuggcauuccuacagguuaccuucuccuucaucucaacucucucaaaguuccagaaacuacucccuuccuugcccucucacaggcuuaagaguguaaucccagcuacuugggaggcugaggcaggagaaucacuugaacccaggaggcggagguugcagugagccgagaucgagccacugcacucuagccugggcgacagagcaagacuugucucaaaaaaaaaaaaaaagagaaaaaacaacgucagaauaaccaacaugaaaauuuuuuaggauaacuuggugccuaccugaaaaauguauuguguuuuagacucuugauuucaaaagguuccacagaacuagucugcgcuuaccuuacccauguuuauauauagcuguccuacagggagcuuuuauuuagaaaaugucugcauaauguuagauucuucuccugucuacauuaagcacuacauaauuggacuucauuaugcuuuugaaaugcuuaucugccugucacauaaguuaaacuauuuaauuuguuuugaauguuuuggauugcuacauaauacaauauucuaaauuuaggcaugaggguuuuuuuguuuuguuuuuacuuuuuuuuugucaucgcacuauggaacacaaauuaaacucucuuaauuuauaagaagauaguugcaguuaaauuuugaaaaugguuguaaugagccaugaaguucaaucuuuguaauauagguauugcucuuucagacaaauaguccauuuucaaugacuuauuauuuuguugaaauuguggucgcuaaucacuugguugccaaauauuuacuucaggagcaaagauuuucaaacaagcauacaugaugcaaaauaccaaucuggcuucuagucucuuuacuguuuuuguuucacucagauuagcucaguuuucucaucaaagcagaaugcuaucuuguauguauuuuuuucauuacaagacccaugagcugcuuuuaugcugaaaauggucauuucccuguucacuuacugacaugugaagaaggguuucuugcuuucuuaaacauuuccguaaggcaggcuagaaauguaaugcuucaaauguucgaugauuauggucuuuugauaggaacagauucugcuugggauauauauccaggcacucucuaaggucuaggguugauauuaacaaaggaauguacuuagaauagcaguacauuuuaugcaaauauggaaauuauuuuaagaaacaaugacauaucaaaacugcuuuuuauuuacaugauuuugaaauagacuagaaagcuuucccuauagacauaucaauauuccaaucauaacuuuaauucaagaaugcaguuuuaccaaaagaaaaaucugaaaauuucuauucaggcuacuggaauugguuauuaaaagaaaaaggaaaaagaagaaucuugcugcuuucaguauuuccugauuuuuuuguaaauauaaagaggaacuucaauuaugaaaaauuuuuaaaagauauauauaucuauauaucuauauauauguacuguuuuguuuccugucuugaagauuuugaguuaugguuauugguuucagauugauuaauucacauaugcuguguuuugaaaugagaucccauuagcuuuuuuuuuuuuuuuuuuucaauauaaaguguuuucuuuaaaagucugauauugguucguggccuagugccuuggauuuuacauauuuuucuuuuuaaaugcaaaaccuuuucaacaaaauaguguuugucaucagguugguacuaaacauuuauaauuacuguguaauuauaaacaaaaauacauaaagcuuugaauauaauuauguaggauaaaaguuaagguuguucacuaugauggcaucuuagaauuaaacaaaacuuuuacuagggcugaaaagagaagacugauuuaauguggugugauuauucugaagauaaaugucuggcuacagggaauauuuuguacuaaaaaaugauuacacauauggcuguguguguuugagucugugucugugagagagccagagagagugagagagauugacggagaaagggagagacacacacacgccccuugaauugcuuuaacuccuaaguguuucaguccucauuccgguaaacuccccaugcugauucuuuguuuuaaacugaaccauagguacaguuuccuuuuugccaaaugucaaaacagguacaaauuuuaaaauguaaugcuuuuuaaauagaaaaauguauaaaauuagaagugcccacauauaaaaaauacuugagaugaagauuaucuuuagugaauaucaucugcauaucucuguaaguucaauuguguuucuuacagucccugucauauuaccaauagaggcaauaaaagcuucagugaaauugccaugacaaaaaaaaaaaaaaaagagugauaauggcucuccuauugcuagcuagcccuuagauguuucaccuagauguuuuccuuaaaccugcucagccuugaaaauagucccuugaucccuuaguacgcuguuggauuaugccaagauaugacugauauauccacaaacuacucgcagccuucaccauuccaucuucucagagggccccuaucuccccuucccccacagcaugguuuuuaucucaguaauuggguucuguacauuuacacauacagacugauucacaucaauucccuauggaaauucuuaaacccaggcugauucucaauucugccaccaaugugcacaaacuguauauaauauuagauuggguaaaaccuaauuaagaagguaaauauuacuaaaaauuccugacacauagacugaaaagcuaagucaaauacugggauuuggauucuaucuguuuauaacccucuuuuccuuuaaaccaaaggcuguggaaauuauuacagcucuguuucaucuauaacacugggagauugccaaauacaguguucauccugcaauggccacucaaaugucaacaaauuuuuuaauguccuaucaacaaucccaaugaauuuucccuuucuucuagcaaauccuacaaacaagacacaaggcucaaauaauagaacagagcuccuaaggucaaucuuucaguuuauugcuuaaaucccacuugagauucagaaagaaagcaucccugaaaaagagucaagggucacagauaaagacgcucaaggaccuggaaagauucaauuuuugaacccaaaaaacaaaacugagggaagcuugcuguuugcaaaucaagaaaagaguggugcagaaauguugcaaaggacagcauuucuuaagaauucugcauugcuauaaaagaucagcugcaccaucuccaauauauauuccugagcagcaaggcuugacccaugggcaaaauaaccccaagugagacaauaacagacacguuaaccuccaagaagggaaucacucccccacccauaugaaagcauagacuacacagauauccagguaucuaugguaagaaacuucauaccaguuucucaaccucaccacuauugacauucuaggccagauaauucuuguuugcaggaaacugugcguuguaagguguuugguugcaucccuagccucuacccacuagaugccagcagaacccuucagguguaacaacccaaaaugucucuaggcauugucaaaugucacccagagggcaaaauugccccuggucaagaaccacugcccuagauaagcaauuaucacucaaaccccaccuagcacuaccagggugcacacgcuaaccuugauucaucuaugaauaucagcuaauuuagucaucauuuucugaugagaaaagaaaaaagccaccuaagggguagacuggcuuuauaaaauaccuuuuucuuaaaaacuacaaauauuuggcaacuugcaaagugauaccacccucuagcaccaaggaggagaguaugaauaaaaagaaugguugccaagggggagaaaggcugcuacaaagcugucugacuugaauucccucugacaucaucacaacucucagcagaugaacauacucauuuuauucucuaugagacacagguggaaaguacugcagucuaugacacaucacauacgagcaaauggaaaaaggcaagcaaacuauccuaaucaaaugauaacaaaauugagggcaggaacacacugagggcugauagcccgagccugucagucuggauucaaggcuuguuauauguggacuccaggucaucuccagguuuucucucacagcauacuguccacacaaguagucuucaacucuaugacccaaugcccucuuuuuauaacaaauauucuguaaucccuuuugcuacucugacauggcauuuaaagauuauaacacuaugccugcagauacaaguuuuaaaauuucaauauaauucauuaaaugcgacguaaaagaaaauaaaacacaaauuuuuuuuuuuuugagacagucucgcucugucgcccaggcuggaguguaauggugcagcuucagcucacugcaaccuccaccucccggguucaagcaacucucuugccucagccuccuaaauagccgggaauacaaguguacgccaccaugcccagcuaauuuuuguauuuuuaguagagacagaguuucgccauguugaccaggcuggucuagaacaccuggccucaaguacucugcccgccugagccucccaaagugcuggaauuacaggcaugagccaccacgccugacccaauaaacaagauuuaauaauaauuuaauaauaaaacauguauuuucagacuacacuagaagaaaaaagacucccuccucccccagucccccauugccaaagugcccccuagaggguggagcuauccuaucccaucugcuccacacagacccucucccaucagucacaauggucagcaaccucuacccuuaccagggguaaggacacaaaguaggcaagagggagggaucugaagucagaccaacugaggucaaacuuggcuccaccacucaacugcuguaguuacucucuauaagccucguuuuucaucuguaaaagaaggauaccaaaagguuuuugugaaaauuaaauaaguacaguauuccuacacuuaacauguaauacaugcucaauaaauguuagcuaucagaguuaacauuacuauuccugaauccaccuuguauuguuuccuagcuuuugcucacuuauuccauuagcagaaaagacgggagacuggauauccauuuaccagagauacucuucaacagauucauguauaauauaagcugcaucacaggccagguacaguggcucaugccuguaauccagcacuuugggaggccaaggcaggcgguuggaucccuugagcccaggaguuagauaccagccuggguaacauggcaaacuaccaucucuacaaaaaauaaauacaaaaaucagccgggcaugguggcaugugccugucgucccagcuacucaggaggcugagguggaaggaucaucugagccucagagauugaggaugcaguaagcugagaucaugccacugcacuccagccugggcaucagagugagaccuugucucaaaaaaaaaaaaaaaaaaaaagcugcaucccaugacuucuaagacuauuucuaauucugagaugcugcacugcacugagguuauuuuuuuauucacuuagguccuuucuucccagguggagggccaagaacauguuuuacauaucauauaaaguagcuugagaaacaccucauagaaugauggguuagugugccacugaaaacccagccaugguuauugguucuuuaccaguuaguuccaaauagcauuauacauuacagucaaggaaugaaugacaacuuuuccagugaaagcacuucaugcaacauguauguugucuucagaaagugaugacugccuagggccacucgcaucuauguggauuaauuccuuacagcaacaagcaaagcaacacuccuaaacauucuaaauuaacaggugaggaggugaaaggugguggcaacagcuagagaaauaccucaaaagaaaacugauuccaaaguuaauauuccgaguaaaagcagucauuguucuguuaaaguaaaugcauaggcccuauaaguaauaaccauaucucugugcauggggaaauaucuuacauauaagaaccuauaauuuacauaaacauauccuucuguaagaggauaaacagaaacugucaauugcuacaagucacucugcauuaaccauccaagaugcucacagcgguuauuucugggugauaaauuacugcacgggguagaggcgaaugaaggggauguaggagauaggggagauuaacaaauccccuuuccuuuugcuuacuuauaguuuccaguauuucuaacauaauggucuuugaauaagaauuuuaaguuauauaaggguauuaauuaaaacugaaaaauccaugaaauuuggggcaagauacuauuuuagaugaacuuuucauugggaucugcggauaaccuaaguauucaucuaugucucucacauacaaccuaaaauuauccuagaucccugccucaaaucacaauggaucaaaacuuaguuucucucuucuuuagccccccugcagaccuuacagguuaugccacuacgaugucagcacccaguauaaggaaaucucacuaccaguuuuugccaguuucccagugacgccaacccacccucugggauagugagauaaagagagagaaaugaauuguuuuuaaagcacugauuuugcacucagagaagugacaaaaacaaacaaacaaacaaacuuggcuggacacggcggcucacgccuguaaguaaucccagcacuuugggagaccaaggcagguggaucaccugagguuaggaguuugagaccagccuggcuaacacggcgaaaccccaucucuauuaaaaaacaaaaauuacccaggcaugguggugugcaccuauaaucccagcuacccgggaggcugaggcaggagaaucgcuugaacccgggaggcaaagguugcaaugagcugagauugugccauugcacuccagccugggagacaagagcuaaacuccaucucaaaaacaaacaaacaaaacaaaacaaaacgaaacaaaaaaaacuaaacccggacacuuuuucuauaccaccauuucaaagcuauaaacucuccauaauucucacacuaagaaguccauaaggaaucauaaaagucccaaaaauaaaaugucauuuugguaaacaugcauuuagcaacgcuauucuucccugcucaguaaaacagcacagaaagaucucaggaggagaggaaacagcucuaaagcaggcauaccucucuguccaacaaaagaacuuaaauucauacugguucaauccaacaagcauuuguuaagcacauacuauauucagagcaccaugcuagguguuuauucaucucuaaacaaagaagacaugauuaucugccugucgaggaaccauaacucuaaucuggaagacaaacacucagauaaacuaguauauggcagacccugauaaaacguaauaauagagguuucaaaacugcucugguaguacgggaagggagggauuaaaacugcaagaauuaugaaaaagaaagccaggagaggugaccugugcuccuaguccuagcuacuccagaggcugaagcaagaggaucacuugaagugggaguuccaggcuacagugagcuaugauuaugccuguaaauagccacugcacuccggucugaggaacauagcaagaccuugucucauuuaaaaaaaauaauaauaauuuugaaaaagauucuucaauaauuuaaguucuacauauacuguauugauguauuuaauucagcuauuuauucauccugaucauucauccaaaauaaaaggugguuggccaggcgcgguggcucacgccuggaaucccagcacuucgggaggccaaggcggguggaucaccacaggucaggaguucaaggccagccuggccaacauggagaaccccgucucuacuaaaaauacaaaaauuagccgggcgugguggcgugcgccuguaaucccagcuacucaggaggcugaggcaggagaaucgcuugaacccaggaggcagagguggcggugagccgagaucaugccacugcaccccagucugggcaacagagugagacuccgucuccaaaaaaacaaaacaaaacaaaacaaaauaaaagguggcaaaacgcucagcuaccaaaagcaagcaucagaggugaaaucuacacacugggauccuuuggacuaaaaaaacggagacaaaugccuuggaaccaggaggaugucugcaaaaggcucaccaacaucagaaggucugugcuaggcaucuuccucuuccagccuccucuccgcgcuccccuuuuucagacucuguaaaagggaaccagguuuguuuacuucuagagcuuuaaacugucucgccagcccgccuagauucgccagagcagccaaguuaugguucucucccuccuuugaaggcucagauuucauucccagauaucacaguccaccccuagcaccccagaccagcgaaucaaaauccugcugcaacuagguuucccucccacagcugaugaaacuaauccagacccagacucccacaaagcauuccacccagguggaaacuaggggaaacgccccgucugcgcgcgaucgggguggggagcccagcccaggccaccuaacccgggcugaaggugccgaggcuaccaggguccugccuccuccgcacucccuucagaaucagcacggccucgcucucguugucaccccucccgucggaggaccagcaaauccuggccgcccaugccuaccccgcggcaggcgugggcuccagacccgccccaccgcggccccgcgcccgcccgccguccacuugcuuggaccucagcggcuggugcccacgccuucagcccgcccccgcccccgccccggccgcagccgccccgccgccucugcccgcccucggcccacccggccccuguccucuccucaccccgcggcgccuccgucccgacccucaccgccccccggagcccgcggcggccccuccaccuccucacgccggaaccagcuuccagucuccuucccucgagcacccggccggcuccaccuccugcgucucccucagcacgcgacggacucgcaggccgcgagacccaggcuccccuguugccgccgccgccgccgagauuggaggcccggcagccgccggccucgccccucccggaaau

SEQ ID NO: 192960 - RNA, 65229 nt, Homo sapiens
auuuccgggaggggcgaggccggcggcugccgggccuccaaucucggcggcggcggcggcaacaggggagccugggucucgcggccugcgaguccgucgcgugcugagggagacgcaggagguggagccggccgggugcucgagggaaggagacuggaagcugguuccggcgugaggagguggaggggccgccgcgggcuccggggggcggugagggucgggacggaggcgccgcggggugaggagaggacaggggccgggugggccgagggcgggcagaggcggcggggcggcugcggccggggcgggggcgggggcgggcugaaggcgugggcaccagccgcugagguccaagcaaguggacggcgggcgggcgcggggccgcgguggggcgggucuggagcccacgccugccgcgggguaggcaugggcggccaggauuugcugguccuccgacgggaggggugacaacgagagcgaggccgugcugauucugaagggagugcggaggaggcaggacccugguagccucggcaccuucagcccggguuagguggccugggcugggcuccccaccccgaucgcgcgcagacggggcguuuccccuaguuuccaccuggguggaaugcuuugugggagucugggucuggauuaguuucaucagcugugggagggaaaccuaguugcagcaggauuuugauucgcuggucuggggugcuagggguggacugugauaucugggaaugaaaucugagccuucaaaggagggagagaaccauaacuuggcugcucuggcgaaucuaggcgggcuggcgagacaguuuaaagcucuagaaguaaacaaaccugguucccuuuuacagagucugaaaaaggggagcgcggagaggaggcuggaagaggaagaugccuagcacagaccuucugauguuggugagccuuuugcagacauccuccugguuccaaggcauuugucuccguuuuuuuaguccaaaggaucccaguguguagauuucaccucugaugcuugcuuuugguagcugagcguuuugccaccuuuuauuuuguuuuguuuuguuuuguuuuuuuggagacggagucucacucuguugcccagacuggggugcaguggcaugaucucggcucaccgccaccucugccuccuggguucaagcgauucuccugccucagccuccugaguagcugggauuacaggcgcacgccaccacgcccggcuaauuuuuguauuuuuaguagagacgggguucuccauguuggccaggcuggccuugaacuccugaccuguggugauccacccgccuuggccucccgaagugcugggauuccaggcgugagccaccgcgccuggccaaccaccuuuuauuuuggaugaaugaucaggaugaauaaauagcugaauuaaauacaucaauacaguauauguagaacuuaaauuauugaagaaucuuuuucaaaauuauuauuauuuuuuuuaaaugagacaaggucuugcuauguuccucagaccggagugcaguggcuauuuacaggcauaaucauagcucacuguagccuggaacucccacuucaagugauccucuugcuucagccucuggaguagcuaggacuaggagcacaggucaccucuccuggcuuucuuuuucauaauucuugcaguuuuaaucccucccuucccguacuaccagagcaguuuugaaaccucuauuauuacguuuuaucagggucugccauauacuaguuuaucugaguguuugucuuccagauuagaguuaugguuccucgacaggcagauaaucaugucuucuuuguuuagagaugaauaaacaccuagcauggugcucugaauauaguaugugcuuaacaaaugcuuguuggauugaaccaguaugaauuuaaguucuuuuguuggacagagagguaugccugcuuuagagcuguuuccucuccuccugagaucuuucugugcuguuuuacugagcagggaagaauagcguugcuaaaugcauguuuaccaaaaugacauuuuauuuuugggacuuuuaugauuccuuauggacuucuuagugugagaauuauggagaguuuauagcuuugaaauggugguauagaaaaaguguccggguuuaguuuuuuuuguuucguuuuguuuuguuuuguuuguuuguuuuugagauggaguuuagcucuugucucccaggcuggagugcaauggcacaaucucagcucauugcaaccuuugccucccggguucaagcgauucuccugccucagccucccggguagcugggauuauaggugcacaccaccaugccuggguaauuuuuguuuuuuaauagagaugggguuucgccguguuagccaggcuggucucaaacuccuaaccucaggugauccaccugccuuggucucccaaagugcugggauuacuuacaggcgugagccgccguguccagccaaguuuguuuguuuguuuguuuuugucacuucucugagugcaaaaucagugcuuuaaaaacaauucauuucucucucuuuaucucacuaucccagaggguggguuggcgucacugggaaacuggcaaaaacugguagugagauuuccuuauacugggugcugacaucguaguggcauaaccuguaaggucugcaggggggcuaaagaagagagaaacuaaguuuugauccauugugauuugaggcagggaucuaggauaauuuuagguuguaugugagagacauagaugaauacuuagguuauccgcagaucccaaugaaaaguucaucuaaaauaguaucuugccccaaauuucauggauuuuucaguuuuaauuaauacccuuauauaacuuaaaauucuuauucaaagaccauuauguuagaaauacuggaaacuauaaguaagcaaaaggaaaggggauuuguuaaucuccccuaucuccuacauccccuucauucgccucuaccccgugcaguaauuuaucacccagaaauaaccgcugugagcaucuuggaugguuaaugcagagugacuuguagcaauugacaguuucuguuuauccucuuacagaaggauauguuuauguaaauuauagguucuuauauguaagauauuuccccaugcacagagauaugguuauuacuuauagggccuaugcauuuacuuuaacagaacaaugacugcuuuuacucggaauauuaacuuuggaaucaguuuucuuuugagguauuucucuagcuguugccaccaccuuucaccuccucaccuguuaauuuagaauguuuaggaguguugcuuugcuuguugcuguaaggaauuaauccacauagaugcgaguggcccuaggcagucaucacuuucugaagacaacauacauguugcaugaagugcuuucacuggaaaaguugucauucauuccuugacuguaauguauaaugcuauuuggaacuaacugguaaagaaccaauaaccauggcuggguuuucaguggcacacuaacccaucauucuaugagguguuucucaagcuacuuuauaugauauguaaaacauguucuuggcccuccaccugggaagaaaggaccuaagugaauaaaaaaauaaccucagugcagugcagcaucucagaauuagaaauagucuuagaagucaugggaugcagcuuuuuuuuuuuuuuuuuuuuugagacaaggucucacucugaugcccaggcuggagugcaguggcaugaucucagcuuacugcauccucaaucucugaggcucagaugauccuuccaccucagccuccugaguagcugggacgacaggcacaugccaccaugcccggcugauuuuuguauuuauuuuuuguagagaugguaguuugccauguuacccaggcugguaucuaacuccugggcucaagggauccaaccgccugccuuggccucccaaagugcuggauuacaggcaugagccacuguaccuggccugugaugcagcuuauauuauacaugaaucuguugaagaguaucucugguaaauggauauccagucucccgucuuuucugcuaauggaauaagugagcaaaagcuaggaaacaauacaagguggauucaggaauaguaauguuaacucugauagcuaacauuuauugagcauguauuacauguuaaguguaggaauacuguacuuauuuaauuuucacaaaaaccuuuugguauccuucuuuuacagaugaaaaacgaggcuuauagagaguaacuacagcaguugagugguggagccaaguuugaccucaguuggucugacuucagaucccucccucuugccuacuuuguguccuuaccccugguaaggguagagguugcugaccauugugacugaugggagagggucuguguggagcagaugggauaggauagcuccacccucuagggggcacuuuggcaaugggggacugggggaggagggagucuuuuuucuucuaguguagucugaaaauacauguuuuauuauuaaauuauuauuaaaucuuguuuauugggucaggcgugguggcucaugccuguaauuccagcacuuugggaggcucaggcgggcagaguacuugaggccagguguucuagaccagccuggucaacauggcgaaacucugucucuacuaaaaauacaaaaauuagcugggcaugguggcguacacuuguauucccggcuauuuaggaggcugaggcaagagaguugcuugaacccgggagguggagguugcagugagcugaagcugcaccauuacacuccagccugggcgacagagcgagacugucucaaaaaaaaaaaaauuuguguuuuauuuucuuuuacgucgcauuuaaugaauuauauugaaauuuuaaaacuuguaucugcaggcauaguguuauaaucuuuaaaugccaugucagaguagcaaaagggauuacagaauauuuguuauaaaaagagggcauugggucauagaguugaagacuacuuguguggacaguaugcugugagagaaaaccuggagaugaccuggaguccacauauaacaagccuugaauccagacugacaggcucgggcuaucagcccucaguguguuccugcccucaauuuuguuaucauuugauuaggauaguuugcuugccuuuuuccauuugcucguaugugaugugucauagacugcaguacuuuccaccugugucucauagagaauaaaaugaguauguucaucugcugagaguugugaugaugucagagggaauucaagucagacagcuuuguagcagccuuucucccccuuggcaaccauucuuuuuauucauacucuccuccuuggugcuagagggugguaucacuuugcaaguugccaaauauuuguaguuuuuaagaaaaagguauuuuauaaagccagucuaccccuuagguggcuuuuuucuuuucucaucagaaaaugaugacuaaauuagcugauauucauagaugaaucaagguuagcgugugcacccugguagugcuaggugggguuugagugauaauugcuuaucuagggcagugguucuugaccaggggcaauuuugcccucugggugacauuugacaaugccuagagacauuuuggguuguuacaccugaaggguucugcuggcaucuaguggguagaggcuagggaugcaaccaaacaccuuacaacgcacaguuuccugcaaacaagaauuaucuggccuagaaugucaauaguggugagguugagaaacugguaugaaguuucuuaccauagauaccuggauaucuguguagucuaugcuuucauaugggugggggagugauucccuucuuggagguuaacgugucuguuauugucucacuugggguuauuuugcccaugggucaagccuugcugcucaggaauauauauuggagauggugcagcugaucuuuuauagcaaugcagaauucuuaagaaaugcuguccuuugcaacauuucugcaccacucuuuucuugauuugcaaacagcaagcuucccucaguuuuguuuuuuggguucaaaaauugaaucuuuccagguccuugagcgucuuuaucugugacccuugacucuuuuucagggaugcuuucuuucugaaucucaagugggauuuaagcaauaaacugaaagauugaccuuaggagcucuguucuauuauuugagccuugugucuuguuuguaggauuugcuagaagaaagggaaaauucauugggauuguugauaggacauuaaaaaauuuguugacauuugaguggccauugcaggaugaacacuguauuuggcaaucucccaguguuauagaugaaacagagcuguaauaauuuccacagccuuugguuuaaaggaaaagaggguuauaaacagauagaauccaaaucccaguauuugacuuagcuuuucagucuaugugucaggaauuuuuaguaauauuuaccuucuuaauuagguuuuacccaaucuaauauuauauacaguuugugcacauugguggcagaauugagaaucagccuggguuuaagaauuuccauagggaauugaugugaaucagucuguauguguaaauguacagaacccaauuacugagauaaaaaccaugcugugggggaaggggagauaggggcccucugagaagauggaauggugaaggcugcgaguaguuuguggauauaucagucauaucuuggcauaauccaacagcguacuaagggaucaagggacuauuuucaaggcugagcagguuuaaggaaaacaucuaggugaaacaucuaagggcuagcuagcaauaggagagccauuaucacucuuuuuuuuuuuuuuuugucauggcaauuucacugaagcuuuuauugccucuauugguaauaugacagggacuguaagaaacacaauugaacuuacagagauaugcagaugauauucacuaaagauaaucuucaucucaaguauuuuuuauaugugggcacuucuaauuuuauacauuuuucuauuuaaaaagcauuacauuuuaaaauuuguaccuguuuugacauuuggcaaaaaggaaacuguaccuaugguucaguuuaaaacaaagaaucagcauggggaguuuaccggaaugaggacugaaacacuuaggaguuaaagcaauucaaggggcgugugugugucucucccuuucuccgucaaucucucucacucucucuggcucucucacagacacagacucaaacacacacagccauauguguaaucauuuuuuaguacaaaauauucccuguagccagacauuuaucuucagaauaaucacaccacauuaaaucagucuucucuuuucagcccuaguaaaaguuuuguuuaauucuaagaugccaucauagugaacaaccuuaacuuuuauccuacauaauuauauucaaagcuuuauguauuuuuguuuauaauuacacaguaauuauaaauguuuaguaccaaccugaugacaaacacuauuuuguugaaaagguuuugcauuuaaaaagaaaaauauguaaaauccaaggcacuaggccacgaaccaauaucagacuuuuaaagaaaacacuuuauauugaaaaaaaaaaaaaaaaaaagcuaaugggaucucauuucaaaacacagcauaugugaauuaaucaaucugaaaccaauaaccauaacucaaaaucuucaagacaggaaacaaaacaguacauauauauagauauauagauauauauaucuuuuaaaaauuuuucauaauugaaguuccucuuuauauuuacaaaaaaaucaggaaauacugaaagcagcaagauucuucuuuuuccuuuuucuuuuaauaaccaauuccaguagccugaauagaaauuuucagauuuuucuuuugguaaaacugcauucuugaauuaaaguuaugauuggaauauugauaugucuauagggaaagcuuucuagucuauuucaaaaucauguaaauaaaaagcaguuuugauaugucauuguuucuuaaaauaauuuccauauuugcauaaaauguacugcuauucuaaguacauuccuuuguuaauaucaacccuagaccuuagagagugccuggauauauaucccaagcagaaucuguuccuaucaaaagaccauaaucaucgaacauuugaagcauuacauuucuagccugccuuacggaaauguuuaagaaagcaagaaacccuucuucacaugucaguaagugaacagggaaaugaccauuuucagcauaaaagcagcucaugggucuuguaaugaaaaaaauacauacaagauagcauucugcuuugaugagaaaacugagcuaaucugagugaaacaaaaacaguaaagagacuagaagccagauugguauuuugcaucauguaugcuuguuugaaaaucuuugcuccugaaguaaauauuuggcaaccaagugauuagcgaccacaauuucaacaaaauaauaagucauugaaaauggacuauuugucugaaagagcaauaccuauauuacaaagauugaacuucauggcucauuacaaccauuuucaaaauuuaacugcaacuaucuucuuauaaauuaagagaguuuaauuuguguuccauagugcgaugacaaaaaaaaaguaaaaacaaaacaaaaaaacccucaugccuaaauuuagaauauuguauuauguagcaauccaaaacauucaaaacaaauuaaauaguuuaacuuaugugacaggcagauaagcauuucaaaagcauaaugaaguccaauuauguagugcuuaauguagacaggagaagaaucuaacauuaugcagacauuuucuaaauaaaagcucccuguaggacagcuauauauaaacauggguaagguaagcgcagacuaguucuguggaaccuuuugaaaucaagagucuaaaacacaauacauuuuucagguaggcaccaaguuauccuaaaaaauuuucauguugguuauucugacguuguuuuuucucuuuuuuuuuuuuuuugagacaagucuugcucugucgcccaggcuagagugcaguggcucgaucucggcucacugcaaccuccgccuccuggguucaagugauucuccugccucagccucccaaguagcugggauuacacucuuaagccugugagagggcaaggaagggaguaguuucuggaacuuugagagaguugagaugaaggagaagguaaccuguaggaaugccagccagugacccaguaggaaaggcaucaaggggaauaaauacuucaaacucuuuugcuacccucugaucuccugcuguagccucccauuggucuaauacaacuggaaaccagagguuaaggagucugguugauuuaauucagaggguggaauccggaggcacauagccgagcuggaaaaugcuggauggaggaucuggaggaggagaucaucuggaggggagaacauccagcaugcuggaguugagaggucuaguuugucuuaaaaggcacaaaugaggagauaauucuugaacagaaucuugaagguggauagcauauggauuauagaaagggaauguucccacugauuuuaacaggauagauucagaggcacacaguugccacagcuuuggcaagcccaaagcugcuuuguuccaguaguagccuuagaaucuuaauugccuggagggccuuuaaaaguacugcaguccagcuuucuugcugccuaggaaucccucuacaaugcccugucaggagugagugcuacauacuuucucaggggguucuuuccacuguuggacagcuuuaauuuuuagaaaauuuuucauguguccagaucacugaaugcaucagcuagaauuagguuugaguguauauaacagaaaaaccuaaaguaauagagauuuuuuaaaagacauaaauauauuucuuuaagagaaaacuggccuggcgcgguggcucacgccuguaaucccaacacuuugggaggccgaaaugggcggaucacuugaagccagaagucaagaucagccugggcaauguggugaaaccccgucuuuacuaaaaauacaaaaauuagccgggugugguggugggugccuguaaucaaucccagcuacucaggaggcugaggcaugagaaucgcuugaacgcgggagguggagguugcagugagccaaggucacacuaccgcacuccagccuggacgacagagugagacucucucaaaaaaauuacaacacaguacaauacaauacaacacaacacaacaauacaauacaauacaguacuacaguacaauacaauacaaugcaaugccaguacaauuccauuccauuccauucauucccauuccauuccaugccgauaaggccauuccugagucuuugaggugccaggcugcuucugucugucauuccgcuaucaguagugcauccccuccugggccaggguagcugccugggguucuaccugucagguucauguuucauucaugaagaggaagaggaaacggaaaaagaagggcuugcccuccauuuuaauuaaaaauuauuuuggaauuuauuauacgugcagaagaguauagaaagcacauaucuacauuuuaaugaacaauaauaaaacaacgauaccagauuaggauauaaaccauuuaucucuaacucuacgcuucacccuguuacaaauauuuccuuucuuccccucuauggauaaccccauccugacuuuuauaauuauucccuugccuuuuuaaaaauaguuuuaaccaccuguguaugcauccuaaguuuaguuuguuuuuuuuuaaacuugauguaaauggaugcauauguauuuuuauuuuugugauuuuccuguguugcucaguauucaugcgauccauguuauugcauguaguuuaaguucauucauuuuuauugcuguauauauaguauuuuauugugugacuaaacugcaguuauuuauccauuugacuuauaauucacauuuggguuguuuccaauuugaggcuuuuucaaacauugcuguuaugagcguucuuauauaacaagugaucacaagugcaagaguuuuucugggauuugugccuaggaguggaauugcugauuguaaaggcauacaugccuaacuucacuagauauugcuaaacuuuucugaagaggccaauacaauuuauaccacuaucaacaauauaugagaguuauuuccacccaacuuggcaaaccugauauuuauaaagcuuauuuuuugacaaucugguaagcagauaaauguaauuguaauuuccguaugcauuuccugauaacugaugugguuaaguacccuuuucaauguuuaccaaccacuuggauuuucuguuuuguggcugccucuucaagucauaugccuuaucaguuauuucuccuuuuuaguucuauuauuaauagauuuugcuguauauuugcugagauuuuguuacuaggugcauucagauuuaaaauuguuacaucuuguaaguugagcuuuucauauaauuugcuuuuugacauaauauagcuacaucagcuuuuugucaugaaauaggaaacuucaaauguaugauaaaugaaugaguugccuguuaguauaggcagaaacugcagaacaauccuagcccauuauucaggcuuuauguaucagcgauuuguucuguuaucccauaaagugaaugagucauuuuugaguuuaaaaaaaucauagggcuuuuuuuuugagguccaauuugcauacaguaaagggcacaaaucuuaauuauccaggucaguaaauauuuauguaugaauauacuuccagaucaagauauuaaacauuuccagcacuccagccagcuucuuaaugucccucccaguugauaccuaccaaagguuuugcuuaguuuugcugauuuugaacuuuacauaaaguggaaacauacaguauauucucuuuugugaguggccuuuuugcucaacauuguguuugugagauucagucauguucuuagguagcauuaguuuuucuuucuuauugcuguguaguguuacaauguauaacuauauuauaacuaauuuguucuguaguuguagaacauuuauguuucuaguuuuuuggcuauugugaaugacacugcugccuucuugaacaugucuugguaaacauaaaauguagaguugcugugugguaacguguacugccaaacagauuuccaaagugguuguacuaauuuacgcuaccagaguuuuaauauauaacuucuugauuuagcuuugggcagcaaauguuaaauuucugucaucugcauaccacacauggagaagagcacugagaacucuuuccugaaguuguauaggcacuuuuauuuuauuuuuuauuuuuauuuuuuucggagacaggguuucacccuguugcccaggcaggagugcgguggugcgaucauggcuuccugcagccuugaacucugggucucuaaccauccucauugagaagccucggcuuccuaaagugcugcgauuaugggugugagccacuguacccagccuguacaagcaauucuaaaaugugaaaugcccuuccuuuucuguaauuuccccagagaguaaagccuacugcauucuuguuuaucuagucuguaaauguuaauacacaauugaugggaacaaagcaaccuuaguucuuuuugaguaugaaaaggacccuguuaagggcagaauuuaaaauauuuguaguaguuaauucucagguuaaaaucauaaucuucuagaaugcuuuagauucuaaguggcuauuguaguaacacuuuauacucaauauugggggaccauguuuuuuggaggcuuucacugaagcauuuaauuccauucuuuugaauucguuuugacagaugggucuaaaaaggaauagaucaauucuguauugaauuccagucuuaauggcaccgagucuuugagacaauugaggcaaauuggaaauucuguuuucacauucuucugaaaggggaugccuuucagaaguguccugaagggcgcuggggagggcaaauaugaggaugccaggguaagucugcucccugucuggcuguguugggccagaguggaagaaagccuaagacucuguuacccagcccuuucugaaaauguuuucaaaugcuuucccaacaaucacgaccacaagagucaacagucuguuuggaugacugaaaacacacagguuuacgaucuguaaagauaguagguaagugauuuaaucuuguuguauagguaggccagagggcacucgcagccuucugauugauuuaauagauuguugaagauuaagaguugacuuaacaucucucuuagaaaacugagaaauagcucauuacuaagguguguuuuauuaccaccgucuguaagaaaauacaacauaggcaugggaaucaaacuacuuaaagccucuuccagcuccuuugugacugggaagguuacuuuuccuuguugcuuauugaagagaaaaggaaaauguuuaucauuggauaauucagguucacugaauauuuaaugaguguuuauuaucugcagucauuuucuuauuaccuuaucucauuuaauauucacaacaacccugugaguggacgaugguaucuuuuuuuuuucuccugaacguuuuguugaauuaucccaauggcuucuauuuuugcagaugagcagaguccaguugcauagagguuuaguguugugccacacaucacacagcuucuaagugagagcuaaaauuagagccgaagguuuugauuaccaguccagacuuucuaggacaccacagcugccuuucuguagaacagauuaacaugacucucagaguccgcaagaguaguggugaggugucaguucaggggaauacucaaaggucacuguccuuuucagauaucuggguaguugcuacaguaugugcuuaggaauugcuggauaaaaaaauauucuuuaaaaucucaucauuuuagucguuaauaauuuauuauuauaacucguaaaaauauaccuuuaggcaaguuauucuuagguaguuaugguugcuuucauuuggaguccagagcuuuacucucuauuucuggaguugcaauuucugcuguccuuggcccauuuaaaaacuuuuucagaaggccuuuuaaauuuuauuuuuuuauuaaaagaaagccugugaauccaaagaaucuuaggugguuucuuagcugaagggacauuuggugaacacaaauggaacuguuaggucaugaugcuuuuuuaaguguacaacucugguguuuuguauauucacaguugugcagccauccccacgaucaauuuuaggacauuuuccaaagaaacccaguacucagcagucacuuccuuauuuccuucucaccgguccucagcaacuaccagucuacuuuguguagauuugcuuagucaggacacuucauauaaauacaaucauacaguaaauauguggucuuuccugauugacuuccugauuaaccauucguuuaaugguuucaagguucauccauguuguagcauggaucagaacugcacuccuuuuuauugcaguuacagggcuuuuccuacagaauuuuaaguaauggauauaucuaacaaugucucuuguucucaccuacaggagacacaggaucuugggcuuacuuuacuuauauaggaccuuuuguaauaucgaggcuauuucuaugcuuuauuguagaacagaaguuauuaacuggggaauauggaccuuuaugacuggccuuuaggauguccugaauucuuuguaauuauauaagauuuuauguucacaagcauuuucugggcgucggaggagucuggaacagcaaagaucucuagcuuuuguuaaaagauaauuuucgaaaguaauauccugacucuuauacagauauaaaaugaacauauguugaagauuuuauuuuacuccaaaagaggaaaccaggcagauguuauaacugguucaaaggagagguccaaaaagcugcucauuuauggaucaggaauaucaaaugaaugugcaaauggaggcaaaacaacucucugucauagggguaggaaagucaggugaaacuucaccugacggcagaauuugcauauuuagggaucuagauuacuuugcacugcuaucaguuaucuacaacuuucagagccguaaacagccuccucauaaucagaaucugguaacccggaggggcgucccagauaaugcauaauuuuucauuggaagccguagggaaaaacucucuccucuacucucacaccacaacaaucaacaccgaagacuuccgugaccaaacgugugggauuuuuuuccccacacuccaagaagcagacaucacugggugucgccuaauucaauucugacacugucuaccuggagauagcaucagaucuauggguugagggcucagucccaacccauaccugucucccccaaccccaaccugucacaagucugguccuucaaaaugucugacugacugucuucaaggugagguucccaugaccuccucuuggauuggauuaauuugcuggaacagcucacagaacucagggaaacauuuacuuagguuuacagguuuauuuuaagggauacugcaaagguuacaaaugaagagaugcauggggcaagguauaggggaagggguguggagccuccaugccucccugggugcaccacccuccaggaaccuccauguguucagcuauccagaggcucucugaacccuguccuuuuggguuuuuauggaggcuuaguuacauaggcaugauugacaaccauguagaaaugugacuggacacaggaggcaugaucucauacuaauagacugaccggaaacccagcaaggccugucuguucagguugucgcuggccuuucugugcagccuuccuuccuccagaauauggggcacaacccucccaggaaugaggguuuuuuggcccacaguuggacuagagucuugcuuugaggcagguaaaagaggacaggagaagguugagagagauucuguuuccugaggcccaaagugccccagcauuauaauagaagacuauaacaagggcuauggggguuaugaaccaggaaccauggaugcaaaccaauauauacguauaacaucacagaagcacacuuuccugcucacuuucaauagauaccacaaaguuugaaacucuuccaaguauuaauuuuaaauuaaauuuacucagcugcuuacuucagcuuuuaaaaguagguucuugguaauuucgaagaugcacuuuccaaaggguguuuauauaguugaaggucagucagagaccuagggauaggucccugcuuauucuuuugagcaggcuuacguguuggaaaucucuagagaaauagcuuuaguuagguuacacuucucagcaaauauucaguauuccucaucucuaauagcagcaugacuguuguagggaaggaauuuccacaaaugguuaugaaaagucuaagugucuuaacucccagacaaagauagagaauucuguuaguaagauaaguaugggacuggagaagucagcuaaccucugcccuuccccaaucgugauaugcucagagaaguuaagacuucuuucugugugagaaauacgggaucuuuuccacuagaucuugcuuauuauccaagaaauuaucauuucuaguuuuagagaaugaugaaacucauuugugcuuugaaauauaaccuguauacaugugcacaguaagucauuuagcuauuuauugucagacucugagaguucauagcaaacuuagcaacauuccaugugcaaauuugcauauuuuuccccccauaucuuaccuacuugccuuaggcugggagucuauuuuccuacaaaacugguaauugcucuuaucucuguguccuucaguguguuccucugcuuauugaauucaguuuuaugcauuuagucuucucuccuaguauaagcugcuccugauacuuuuaaauauguauuucagaagagaggugcucagaauuguuacuuaacagaaucagcaucucccuuuacuugaugccuuguccugaccacaaguacauuaauaaagugaccauuuagcaguguuucggguucagcuuuuaggaacuuagaagcugugguuuuccaugagugcacuucugaugacuugggaacauuucauauguguguucuuucuguggccaagaugguuuuguuauuucagggauggaaagaugcuuugccugaauacucccaugcuaaguguauagcaguuggugcuuggggaaugguaccaaguguacauaucuggcaaggccaggcuagaagggaaaauguagacucuuaagcuuuuugagacgaacuucucagauacuggaucucuugacucacauaguggaauuuugggggaaguaugugguuugcuuuuugucuccuaagaaaugaugauucaguuuccucaaacguuucucacagucacuacugguugcuuggaauggcugucugguuuuguugcucaguucuuacuucuuuaaugacccaagaggauuuucccuuugggguugugauguguuuuugaugauaaacuuuaaugcuuuuggaggcuauaaagacaauaguauuuucuuaccuguuuaccuugcacuuugaaguucuguagacuguaauaugaaagaaaaucagauuaaauuagcuuugcuuucuggcuuuucuuuuuuuggugggggggcagaagcugauaagaauaaauauacuaacugagucucuucuguauuuuaacuucacucccuaggcugaggcuuaguccuuagaguaacauuugaacuggguagaacagauuuuucuuuuccucaacagcccauuccugcuguaaagcucagauuuaugguccuucuggaaaaaguauugagcguugaauaguucaggaaaacaaauaacaaauucugucuucuuugcaggauugugggguagaagauuuugauuuuuauuaguaucuggccaaagaauaaauauuaggcaggaacaaugaauugauaucuaguagagugacgugacugggcccugacuuuuaacacuucccaggaaagcuucguggaugucuuuucccugcugcgugaauaccggguagccauuaaguuuggugauugggugucaguaauauguuaagucagcuacugggucaucuuuuaauaaaagaaaaggauggggaagagaauggauucuuaagcaguguugccugucagaaucaccggagggagguuuacaaaauacacauucuguacucugacccugugggugggguauucugacccaagaagaugauucguuccaggaaucaugcuucuuggaugauauugauguacccccacuggcuuuauggaaagaauauugaagaagaagauagauucucuugggggcugugccucuaguuugaaaccagggaaggcacauuuugguauuagucuguggccucaguuucuucaucacugcaaugagauuggacuauagguggucucuaagguuccuucagacaguagcauuuuaugauuuugaagacaacuuuucugaaguacuuuucaaacuaauuucuuuccgucuuucuuuuguaagcaaauaaguaguaugaguguaagucucuagcucagagaagaaugaaguuugcaguucgaaaaggccaugcaauagcaguucacuuccccaaaaugcucagcccuuguaggaugccguuaggucaucuggaaguucuguaugccuucacugggagcguagugaagaugagagccuuuccuuuggcucuuggaguaaacuagcugacaggacuuugagaacuguuggucuccugauuugugccacugauaguuuggcucuggaaaacuaggcaguggaaaaaacaaugcauuuuaaaccagaagauuugaguccuggcuccgcuauuuccgagcuuugugaccuguaggccucaaugucuucaucugugaaggacagguucagcucugauggccuaugaugugaugaaccuugugaacuuguaggcagagugccacggugugcagaguccaguuacagauaaccagccauucuccucugcagauucaacccacugccacugugucuuguuaagcuuaaauaggagagaugugggagagaggaggcagaaacauccuaggaucuugcaaaacaaaacugucaaaaguauaggcaauaucauaauuacuuuauuugaauaaacguugaguuccugcuguguugaagaugcuguuuuaggcaguguaggagauagaagacuuauauccuccuccuaauuuguauucuuaucagcaccugguaccauagagaguucauauauuaaaauuauuugguuguucucccuaaccagaguugaauucuuuccuucuaggacaaauuaacucauaaugcaauaggcuaaugcaguuuggcccugagugacucuugagaaauacccugaguugaggcacacuggaaacguggcacauuagaaaugccaagaagaggccgggugcgguggcucaugccuguaaucccagcucuuugggaggccgaggcggguggaucacgaggcaggagaucgagaccauccuggcuaacacggugaaacccugucucuacuaaaaauacaaaaaauuagcugggagugguggcgggugccuguagucccagcuacuugggaggcugaggcaggagaauggcuugaacccgggagguggaguuugcagugaaccaagauugcaccacugcacuccagccugggugacagagcaagacuccgucucaaaaaaaaaaaaaaaaaagaaaugccaagaagacauuguacaggagaaugaagggaaacuuucuguagggaaguagcuuucccagaaacuugacucuauaaugaagcuauagagaucaguaaaaucauuagggcauuacuguuuugaacauuuccuugagugaauaacagacuuacacucaggggcccuaggucucuguuguggcccagcaagcugcauucagacaaggaggcaguuugagagguacgaguuguuauggaagccugagaaaacugguuugugugcacuucaguuuugaccauacaaccuucacucacuuagcacugugcaguaauccacugagcaaaauugccacauuuuccuuggcagggaaucugugugccuguggcaguucagaaauuauuuguagagugggucagccugucagcaggaauguuuuucuuugaucuucagccuguuuuucuuuaaugugagcagaacaguaaagagagaauacauuggaauaucuuguugguuccccuguuuggcuuuaccuacagcucuuugguuuucuucuuuuaggucauacuuucccaauuaguauguagguauuuaugauguuuugaagcccagagcgaugguuccaauaucuuguggaauucagcucugagugugaaguccugacuuugccucuuucuaucaguuugacugagcaagucacuuaaccuuucuugacuucaguuuuccccaucuauagagugauacugcacacugguuucuuuucuuuucuuuuuccccuuccuuuccuuuuccuuuuucuuuuccuucccucucccucuccucccuuugccuuugccuuucccuuucccuuuccugagauagagucucacucugccgcccaaguuguauuggagugcaguagcaugcucauagcucaaugcagcaucaaaugccugggcucaagugauccuccuaccuuagccugccaaguagcugggacuacaggagugugccaccaugccuacugcuuuuuuguuuguuuguuuuuuaaauuuuuuuguagggaugggaacuuguuauguugcucaggcuggucuugaacuccuggccucaggggauccuccugccuuagccucccaaagugcugggauuacaaguacuuuauaauguguaaauggccuguacauucuuaaucuaauagccucaugagguuauaaaauacaaauaaaauaacaugaaagccauuuagaguuuuaagguguauaauaccauguauucucauuaauuaaauuuuaauaaauuuaaaagauaaaauuauuuuuauaaaauaaauuuauuuuuaaaauuuuaauuacguuaaaaaguuaaugcuuuuuuuuuuugagacagagucuugcucugucacccaggcuggaguacagugguacgaucuuggcucacugcaacccccgccucccagguucaagcgauucucaugcuucagccuccuggguagcugggacuacagguguacgccaccaugccuggcuaauuuuucuauuuuuaguagagacaggguuuccccauguuagccaggcuggucucaaacuccugaccucaggugaucuacccaccucggccucccagagugcugggauuacaggugugagccaccaugccuggccaaauuaaaaaguuaauacuuuuuaagugcuucacucuuuccugugcauguugucuuggccucuuuuucuaaauuaguuuuauucccucuguaaucagagggucaccaaaucuuugaguuuuagagggaagagaaaguuuuuagugaaacaagugggugaacucugaucccuguaaaauagugccuucauacaguaggcacuccaaaaauaauuguugaaugacugaaacucuuaaacagcaguaagcauacguauagcagagacaacauuacagaguagagcucuuucuagguuggcaugguagauagcucugagggacuaccugaauggagaugccauugcuuuugaauaaaacaaauauacauggugucuuaguccauuuucugcugugauagcagaauaccacagauuggguaauuauaaacaauagaaguuuauuuggcucgugguucuagaggcugggaaguccaagagcauggcacugauaucuggugagggccuucuucuugcugaauaauaacaugucagaagggcaagugagcacgcgagcuagaggggaugggccaagaugucauccuuuaucaggagcccacucccaagauaauggcauuaauauacucaugagggcagaacccuccugaucuaaaucaccucuuaaagaucccaccucucaacacuguuacaauggcaauuaaauuucaacgugaguuuuaggggggacauucaaaucauaacagguaguuagcccuguugaguaauggagaaaggauuguauuaguuccaaggaaagaugcaucauccagugugggucuggaaauauuugccagauggcuuuucucuuuuaguaauauucauuuguggaauguuucuuuagguauaaauuggugcugaaguaauuugauaaggaaaaaauaucacugccuaauugguauuuggucacgagcaguaccaguucguaagauuuuuuuggagguagcaagggguggauagugcuacuauuggaaguuugcuuauggaaucuuuugcucucuugaagugauuuggagauuaaaagaguuuaguaucauuggggauagcuguggucuacugucaguuaggaaguaacucaugacuagauauccugggcuuauuacuucagcucauauuccugaccucacaaaaauguuaagagaauaaaucguaaguauaaaaagcacugagauuguguagaguggaaaauaacauuaguguuagcucccucacuguauuacacaaccacauucuaaauuuaaggaagccagaaguaaaaucacucugaagcacugcuuuugaaacugcagauuaugauccauuuagagggacacaaaaucaguuuaguauaucaagcguuaaagaaggaagaaauagaaaugugaguacauuacaaguaauaaggugcuaaguauuauuuuggaaacuuuugguuuuauauguuucuguuucuacauguauuagauuguguuguaaaagacauuucuuugggacuguauuuuacaacacagucucauacacguagacucuaauacacauauugaaacaguuugaaacucaguggucuaacaaguagcauaccccaaauuuacaauauuuguagccuucugcuguuggguacauucaugaaaaggucuugcauccuuaaagugaaggcugaaagaguuuuaugucauuggggcgagugggcuaccaagcucccauaaauucuaggagcugccuuuugucuaacgauuaggauuauugaguacuauuuugaugccuuuuggguaucaucugaaauguaaucauugaauuggaaauggaauaaacaagagaaaggcuaguuuacucauuauuugacaauagcucuuuaaaguaguuaauauuaugaauauuccuacuacuaagguuuauaagaguuuguuuuuuucuuuaauguuauacuuuaaaaaguauuauucauucacugggcaaauaauuuuuuuuucuagaggaauaccuuuccaauuuuauaacagugaaggaaggaauguuuuacuuauagaaacuguacugaaacuacuguucuauuaagcaaggguuggagauaagcaccccugucccccuucccugcccaggcacacacauauacagauacagcuuauuuuaugacuguauuguucuuguguuucuucuucuagauaaagacauaaagauugaugaaauaauuuaccuggaguugcacaguaagcuaguggccuuuguggaugaccauucauaguucauauauuuccagagacacaauacauugauaaaauugaaauaaacagaagccuaagaauuauaaguauauauucagagauauauagacaaaaaaguacuguuauaaguaaaaagacauagugggaauaguaauuauaaucacaugaacuucugugccaucucuaucuagaucagggguguccagucuuuuggcuguccugggccacauuggaagaagaauaauugucuugggccacacauaaaauauacuaaugauagcugaugagcuuaaaaaaaaauaaaaauugcaaaaaaaaaaagucucaugauguuuuaagaaaguuuacaaauuuguuuugggcuacauucagagcuguccuggacugcauguuggacaagguugaucuagauguuuaucuguagucaugaccuaacuauauaauuuuaguauguuauacaugguaccauguauccaggguagauccugccaagaacauaaauugugaaaagaaaacucuugggaugcugcuggauuguaauguguuacuccucugcccaugaauacugaaaaucaagauuugaaaggguacugaauacugagucaaaaggcaugcguuccuagacuucacuuaaucacaagcaugucuguaugagcguagucaugucauuucacuuuggggucucugcuuguaaaaugaaaauguuagacuugaucuuccagguucccuucagcucuuacauucugugcuucccaagggcuagaguauugcaucaggacccagccugggguuugugcuguuuucaagguccuaaggaacugcaucauccuuuaguccaaggagauaggauaccuuaugccacagagcccaauaauucagugagcugugaguguugugaguugcaucuacauuggggacugagccuagguuguuuguaguaacacuaggaggaccuuagaaugaugccaggagauguaauuucugugaucaacuaguugacuacucaaaaagcuugucaggacccauccaacuacagugucauucugucuuugguguuaaagaauuuagauuuaucuccuuuuaaaggaccuccuuugaauuuaagaauugccauuaucuucauaagaaucaaaacaaauacaaagaaaauauauucuugcugaauguaauuuuuaaauguuagugaggaaugucuuuauaucuuaauuuuaaggcuuuuaaaaauuaguuugcauuugcugguucuuugcugucacccuaauacugguuauguuacuuuuuugcucagugcugugaauuguucauaauaucuauagucaucuuuugacauugguaacuucuguuuucugggugaauuaggaauuaguaucaccagaagaaaagcuaaucugaauaauuguucuuucaucaucucguucaugcacaguauuuaaccaucugguuugaccacaacuuucacacuagacgagucuuuauaaugauagaaaucaugacauacuuuugaugauagacuccucuggucuuucccagguuuuggcugguauugccauugcuuuggauugagguuguugaugcaacagugggcucuggggaauggccaccaagaacuguuggggaauugcagauaaacugucuccauggguagcccuccagggaacuuaguaguugucuaauguuaauuaccuuauaccacagucuaauuacuaagaguauugucugaguccauucaggcugcuauaacaaaaugccauaaacgugguggcauauaaacaaaaguccauuucucucaguucuggaggccaggaagcccaagagcaaggcaacagcagauauggugccugaugaggcccacuuccuggaagguggccuucauaaaagugguucauagaaaaugucuucucacuguaucuucacaugguagaaggggcaaauuugcucucugggggucucuuuuauaaagucacuaaucuuauucacgaggccucugccuucaugaucuaaugaccccccaaaggcucccucuuccuccuaccaucagcuugaggguuagauuucaacauaugaauuuuugggggauguaaacauucaguccauugcagguauaaauguuuucaacaagcauuuguugaguaucuguccuuuuucuaagcuuucauguuccuacuagaacacuggauguggauauccaauaggaauauauuuaagucaguaucauuaucuuuuucucaaaacaucuucuaccuuuuuuaccuucccuuccucuucuagucuuaccauaguuaauacugauauuaacuguuaacaucauaguuaaccagucugucgaacuugaacuugaaaauuuugaaugaucuauacccacacccgaaaaaauuacucacauacuuaaaaauccaugccuuuuguuuuguuuuauugcuguuguuuguaauuuacuuauuuuuaccugauacuauguucuggaaauuuuucuacguaguucauguagaucugucuucuucuuaauguuucaugguauggguacauaaaaugcacguauuauaguuuauuuaaccauucuucuguggguggacauuuacauuauuuuuucccuuuuguuagagaauacugaaaugaauauccuugaacauguuuauuuguauacaugugcaaaguaugcagaugccaaaaagugagauugcuaggucaaaacgaacaugcguuuaaaauguugauagauaccaacaaauugcuuuacaaaaguuccuaucaguuuguauaucaguuuuucuaaguccuuuuuaaacauggacuggauuagcccguucuugcauuguuguuaagaaauaccugagucuggguaauuuauaaagaaaagaggguuaauuggcucaugguucugcauauuuguacaaacauggcuucaacaucugcuuccggugagaccucaggaagcuuacaaucauggcggaaggcaaaacuugagcaggcacgucacauggcaagagugagagcaagaaagagaguggggggagguccuaggcuuauaaacaaccggaucucaccugaacuaacugagcaagaacucauucaugaaagaugcacccccgugauccagucaucucccaccagaccucaucuccaaugucgggaaucacauuucaacaugagauuuggaggauaggcauccaaaccauaucauggaccuagcauacuucucccagccucacgucucugauuuaaguguucacucauuuacuugggcacuguuacuugggcacugucagccccuguccauguuuguauucaguauaaauugugugccgggcacucugccacauguuggggauuuaguacuggaugagacagaaauggucccugccaucauguagcuuacacuuugccacauagaacuuuugccauaugcagacucuuuuuaugcauuugcagcuacuauccucucuuucugguaugacuuuuuuccuuuuaacuuuucuaccuagagaauuuucuuucauccuuuuaaccagcuuaaauuuugcccucugucauuaucuuuaucccuucagaguuagauaguccuuccucagugcuccaucuuggcacucauaugcuuuuuguggcuauuccccugagaaguuuucgugauuuguuuguauauguaugugccuguguguguguguguguguggacacacaucuacaucuugcauauuagauuguaaacucaguauagacuuggaacuaugauauguaccugaacacuuccccagcuuacugccuucaacccuggagaugcuuaaucaauguugauuaagugaaugaauaguaaacuauaaaaugaccuuaguuuguacagggcauuguaggggauuguagauaugaauagaacuggucugucuucaagaacuuaaccauauagucagggagauaagaaacagaugaguagacugcaaggcagguugugauaagcucuguauaggacuuaucaaaaaugaguacuggaggagaauuuaaagggagagaggaauucucgugaaugagauacucugguaaguuuacagaggacagguuuuuucuugcucguaccagguguugugaggaauacacaugaugguaagauaugguugcugacugagagauuauagucaaguaaggccuuagagcaggcauugguaaauuguggccugcaagccaaaucuggcucuugccugcuuuuauaugguccuugugcuaagaaugauuuuuacauuuuaaaaauuguuaaagaauauuuuaugaacaugaaaauuauaugaaauucaaguuuuggugucuguaauuacauuguguuggaacacagccauguuccuuuguuuacacaauaacugacuauauuuguacuccagcagcagagaggaguaguuguaaaggagaauguuugcuuugcaacacuuaaaauauaaaauaauuuaguaucaagcucauuacagaaccaguuugcugacuacugggguagagaauaggaaagauucaaauagagaagagaaaugacauugauauuggggguauuagugugaguuaagagagugggacagugauucuagcagucauauagaaauuuuagggcugaagugacgaucuagcuuaacccucuuacuguauaaaauaggcacaagauugaaaauagucucaaaguccacuagcuguuaaguggcaguggagugcugcuggagugacugguacagaagccuugagggcuguagaugauaauaagauuauugcugaagaagggcaagauccggaaugaccuugcccuugaaaaaugagaguugaaguacaaacuaagaacagacuucuuuucucucucuaaauguaauguuuuuauuuuucacuuguauuucuagaaggccuuugagcccuacuuagagauuuuggaaguauacuccacaaaagccaagaauuauguaaauggacauugcaccaaguaugagcccuggcagcuaauugcauggagugucguguggacccugcugauagucuggggauaugaguuugucuuccagccagagaguaaguaugcugucuccucuguaaagguauaguggugugucacuagccucaaacuaauugcugagagauaggacuaauuuauugccuuuugguuguuuuuuuguuuguuuguuuguuuuugagacggagucuccaucuguugcuaggcuggagugcacuggccugaucuuggcucacugcaaccucugccucccagguucaagugauucuccuaccucggccucccgaguagcugggacuacaggcacacgccaccacgcccagcuaauuuuuguauuuuuaguggagaugggguuucaccauguuggucaggauggucuugaucucuugaccucgugauccacccaccucggccucccaaagugcugggauuacaagcgugagccaccgugcccggcccugguuugguucuuauuuuuaaaaucuguuuaaauguaaagcaguacuuugucuucugauuggucaaguuauaacaggacucuuguauaacuaauacuccuuacauugauuuuuuuuggauuuguaguucacguaaaaacgccucagaauuagucauuguaaggauccacagaaaucucaguaugguuuaaaccuuugguaccaguuucuucccuagaacauaauuaugucaccuggaguucccagagcaggaauuuauugcuuucauuuugugcuauccuuuucaguaaagauuaggugaaauuggaacagcacuuacauggugaccauuugagugcuugcuaugugccaggcacugccaucaggcuguggggauaucugcacaaguaguacaggaucucucuccucuuggaguugaacugguaucaggggaucguauacuuugagcuuccuagaagugacucagugccagaucaacauggggaagaagaggccacuucucagggugcagaagaugagcagucucagugaucugcuucugaaucuuccaccuuugcuuaggauuaagccccucuccugcccacccaccuuuuucccgccuagaaaccugguuguguguuaccuucuuaugaguuauuuuccucugcagucugugcuuggugaguguuguuaguaccuaaacacaaguaguggauuuggugcuggauguucuauaacacuccccugcaccuuuuccccacucuuaguaggguaugggaguuaacuuccuugggauaagaaaacaguaacauugaagauaaucauuagcuguuucucauuugcuugaaauuuccccaccacuuugcuucccugauaacaccuguuuaaaagggcucuuuaauguguuuuuucugcuuuucuucucuuguucaaggaaagucaauuuagaagccagauuccauuuuuaucucuuuacccugcaaauagcuucuuagccauuuauggcgcaguaaacauugcaaaaccugacaaccaagaagcaaguuccaacugcuuagaguuuuuaaauuaaaguggaaaugagaccugacucuccuguguaaaucuguagcucacuccagcuuuaaaaaccuuguccucaguugcugcuccuaguccuugcaagauuuucugauaaacucuaagaaauuagacuggccggcccuuccgcugcaucugcucaaugguuuggauauggauguagcuuguguccuucugcucuugcuuauuccuuuccuaggaaguauucaauucagugaguaaggggcccauuucagaggauucugagggguagcaagaaauauacuuucuuuuuauuuuuuaacuuuucauuaaaaaaaaaaucagucucugcuuauccuucuauuauaauaaaauauauacaacauaaaauuuaccacuuuaaccauuuuuaaguguacaguuaguccuguggcaguaaguacguucacauuauuguacaggcaucacuauuaccagaacuuuuucaucaccccacuggaacuccauuuuaauaaacaucaaauaauaacugcccauuacucucucccgcauccccuggaaaccaccauuuauuguaucgccuuguuuuacaaauguacuacaauucaaaggugguacauuuaugaaauaaggcuaagcuuagagaucugagauuuauauuuuacuugcuaugauuaauauuaauuuuagguauucuuuuuaaaacaaauuuuaaaauuaauuggcaaauaaacauuguuuauauuuaucauguacaacauauguuuugaaauauguauacauugugaaauggguaaauugagcuaauuaacaugcauuaccucccauauuuuucuuuuuuugugguuagguauuuacuucuguuuucaguucugcagcucacuaugccauacauuuugcuuagcuaauaguagagacacagccaucuuagguucugauacuuaucugcuuuuaguggucaaaaaggaauaugcuggccucugagaggccaauuuuccaugagaaaauuguuagucguaguauacugaugagauaugccaucuaaauccuugugggcugaacuccaagccauuugagguuuuuuuuuuguuuuuuguuuuuuguuuuugagacggagucucacucugucacccaggcuggaguucaguggcaugaucuuggcucacugcaaccucugccucccggguucaagcaauucucccugccucagccucaugaguagcugggauuauaggugcccacuaucacgccugccuaauuuuuguauuuuuaguagagaugggguuucgccauguuggccaggcugguuuugaacuccugaccucaggugauccgcccaccucaaccucccaaagugcugagauuacaggccugagccaccaugcccagcugaguuauuuuguuucuaaagauacaaaacaaaagcaguacauauucacuauggaaaaguuggacaauauggguauauaauaagaacaaaauuaaaaucuuacuacugaaggauaccacuauuguauuucucuguuucuauaucugaauccaguuugaaccauacaaaauguaauuuuguaaaaaaaaaaucgucaaauguugacaauuuuauacaauuuagcacauacacacacagcacacuuucauuugguaauuuccaacuugaauuuuagacacagauaagaaugucuucccuccagagaucagggauaauuuugauagaauauucauuuuuuuuagcacuugcucacuugccauguguugcugaacaaucaaguuauuuuuaguuacacugcacuaaaggagucugaagucuggacuagugaugaauuuugcugaucuuccaacacugaaucccucuugagggaagagaguauuucuggaacaaaggauggagccugggguagaggagaagugggcagcggcaugaacugugcugggguuagcagccucuuccuuaauucugccucugugauuaucagcucacaguuuauuacuuuuacuuuaaugcugauuuuaacuguggguuguccauaauucaucaacagaaaucagcuuuaugucauggaggaaaugauaaacucucaguuucuuguugugucaccuugggugacacccuuaagcucucuuagcccauuuccuugcaauaaaauggacaucauaauagcugcuuuaccuagucauggguaauaugaggacugaauggcaucuuuugcaugaguggaauuuguaaacuguuaagaaccaugcauuguucuuacacuggcauuuucuauuuuguuaaacuuaaaauucuuuuuuuaaaguaacaaauaaaaauuguauguuuaugauguacaacaugaaguuuucaaauguguaaguuguggaauggcucaaucaaacuaacgugauuaccucacguacuuuuuuuuuuuuuuuuuuuuuuuuuuuugagauggaguuuugcucugucacccaggcuggagugcaguggcacgaucucggcucacugcaaccuccgccuccuggguucaagcgauucacuugcuucagccucccgaguagcugggauuacaggcgcgugccaucacgcccagcuaauuuuuguauuuuuaguagagacaggguuucaccauguuggucaggcuggucuugaacucugaucuccugauccgccugccuuggccucccaaagugcugggauaacaggcgugaaccaccacaccuggccucauguaccuuuuuuaauggugagaacacuuaaaaucuacuuucuuagcaaucuugacguaugcaacacauuuuuauuuacuaugucaccaugaucucuugaacuuauugcuuccgucuaacuggaauuuucuauccuuuugaccaucucccagucuuccuucuuccccuuacucucaaucccacuaaaaaauucuaauuacuuuucauucuguaccuucuggggacuuuugagauaaucuuuuuaggucagggccaugggaucuuuuuauuuuuaguuucuucaucucugaugcuguauuccguucuuuuuacccuguaccauuuuuucucacaacuuccacaaaauuaguuuauucuuuuauccuccaccuagucacauuacuauacuucuggacagcugguccaguuugcugauuuuuagacuucuuuuuaccucauuaauuacuucaucaaauaaggaagcauuucugaaucuguacagcuuuaacaguuagaaauaguugaauaacaagaagcuaaaauauccaauauuagauuauagucauuugaugaacuauuauaacauuaaaaauauguuuagaaagaauuguuaauaauguagaaagugcuaucagugaggaggauacaguuauuuuacauuauacagaaucucagguauguauuacaguguguagaacauagggcuagaaggaaauacuccaaaauuuaaacaaaaaguaaccacaaacaagugguuucagucucuuugucuucuuauucagucugugucuuaguuaccugguuuugucccagguguuuacagaauguggacucuagggagaguuagaaagagagggaugcagcugaagcaaaaacagcuagcagagaugcaaggcaugaugugauagauacaaaaagggggugcagacacaucccgugguuguugagugaagagggagcuccuucuggccaggaaagugggaauuuccagaucuccuaggaaugcaguagaaguucauauucaguucacaccuuggauaaaagccaggcuuagauucuuauagacucaaacagaaaauuccuguggugcauuugaagcaguauagaauccugggaauccuggacugaaaauacaaagacuucaguuaaaucuuugcucuaucacugauuuuaucuguggccuugagcaaguuuugaugcuuugaucuugcauugccuuuuaugucacucguagaugguauauaaugccuucugugccagccucagaaugcuguugucagagucagucgagauacauugauugugaaugcaucagaaggucuauuagucuauuuagaugccauguauuuaugauuauuaugaucgacaggauuuguauucccuauuuguucuauguacugccugacagaguggacucuggcaucugugauuuuucaaacuuuuuuuucuuuuuguugagacagggucucacuguguugcccaggcuggucucacccuccugugcucaagcaguccucccaccucggccucccacagugcugggauuagaggugugagccacugugccuggccagcauccacaauuuugagggcauuuguagguccagaaaauguuagaaucuguguuggaugagaggcuggacauagauccaagaaaaacaaaacuaaaaacaggcugcccauuagucuugggggaaggaagagaaauguugaacaucuagaaaccuuaggaaggucaagaauucuggaacacguauaucauuugaccuaguaguucugcuucugggaguuuauccuguagguguacuuguaguuuauccuguaggugugcaguaugguguguguuacaagguuauuucagcaugauuuguaauagcaaauauuagaagcaaccuauauauccaucauuaaggggcagguuaaauaaauuuuggcacauccauaaaauggaauacucugcagcuauaaaaaugaaugaggaugcacugaucuuuaagauaauacuccuaaguggaaaaacaaggucuacuacagugcuagagugugcuacuuuuugugcaaaaaaagggagacaaauaagaauauagcuuuacuguugcacguguaugcauaaggaaacucagggggguagcaugaggguuggggggauacguuugagagagggaagcuucacugcuuuacuguguguguuauguguuuguauuuuuaaaauuuugaaccauguaaauauaguacuuauucacaaacuuaaauuuaaaaguuuuuuuaaaauuuuuuaaacgaaagaaacucuuugcaauuggaaggcaagugagguggaagacacauugaaugguugcuauaugccaggucauauccauggaaauuuauuugaauaagagaaccauuuguuucuuuuagguuuauggucaagguuuaaaaagaaauguuuuaagcucaccaggaagaugcccauuauuggucguaagguaaguagaaucuguguaugucauuuuuuccccucuugauaaucauaccucuuucuuucuauuuacuaaaccuaauauucucaaaguggaggggugauuuugucucuuaccuccaggggacacuuggcagcauuuggagacauuuuugguggucacagcuuggauggaggggugcucuuggcauguaauggaucguguccagaaaugcugcuaaacacuaaacauccuacaguguacagggcagcccccccccacccaccaaacacagaauuaucuggcuggaaaugucaaaauggccaagguugagaacccugacuuaacccuuucuccaauguaacuggccaaaggagagaugagaagccuguuaaggaaguaagaauuugagaaaaccugacuguauuguuaggugcuuuggaacaacaugcagcuggcugacuuuagguauuuaucuaggaguugggugcuuacaugguuuaggucaggggucggcaaauguuuucuauaaagggcuagauaugaaacauuuugggcucuguaggccauaucauuucuguugcaacuccucaccucugcccuugcagagggacagcagcaagagguucaggaaugagccuggcuauauuccagugaaacuuucuuuacgaauucagguaggccuuuguugguuccuggcuguaguuugcugaucccaaguugcacagcgcugucucuugcuguuugcaauuuucuguauuguaguauguccccuuuguuauguccucuuggcccucauccauguugaggauaagguagucaccucugugcgucucccacagguuaucccagaugaagauaaacagggcaggccacuuggcaagcucuaaggaaggcauaugaguccuuggaaucuucaucuccuccagugcccuccccugaccccccuuuggucuuucccaacuuuaccugccuuuaaguuuucuucuacuuuuggcuuucaguucccuuuccuggcuauaccaggguuuguuugccaaccccugaccuaaaguuggccaguuaucuuuaaccuuuggcugaaauccauucagaucgcugugcuaacucucccagagauagguaucuucagguucauuuccuguaggagagugggagcaauaacagguggugaagggaaaugugagcauauaggcuucuguuugcucuccaaauuauauuaaucccuaaaaguaaaucuaguccuuacagaguauaagggguggggacagggaagguauuguagaagauggacuguagcacaaaggagauuaggauuuccccuuaucuccugaauuuuuuuuucuucuuuucguucaguuuucagacuuugagacaaauaaaugcuaggguuccagaacccacucuuaaacuuagaaaguaacagaauuggaagauccuuagcuugccaaggacuauccaaucacucuccauuuuucagaaacagauucugaggcuuagauacaaaaaauuacauguguguaugugugugugugugugugugugcgcgcgcacgcguguguguauaccucugucauuuauucacuuaacacaugcuuauugagccaccugcucagugucaaguacuuuucugggugcuggggauaugguggugaacaagaccaaauccuuccucucauggaacuuacauuuuaauaggaaagacagaaaauaaagaaguaaacaaauauguggaauuuuauuuugaaauaaaugcuuugaagaaauuaaaauuggguaacguaauacaggcuuugaggcaagaauuggggguaaggaaguacuugugcuuucuaauauaccucucugucacuuuuugucuguuuuauggcaauagcauacucuauguauggaagcucagcuuucauagccuguucuguugcaugagucgccauuuaugugaauuaauuuuuuaauuuacaacuuaaaaaaugucuucacauccauagcaugcccaggcauugcccaggaguguagccucugcucccugccagugugggccucuuagacuauugcagacaugcucgaaaggaguggcuuucccugugguuucacugagggccauaucuaagaagaucuucuuguauucuaauuauccuuggcuagagaugagaaaaucuuaguguggagugaguucuggcguucuuuaacaaauauauugcugaaacaauagcacugugacaaaucgugacauguagcuucucuccccaaaccuacuacccaagagccuuuugcuauaagcagcagccccugcccuucugccuccuuacucugcuauuuuuuuucccucagcacuuuuuguuaccugucuuacuauuuucugucucuccugcugaaaauaaacuucaugaggacaggagguuuuuuuuccugugugcuccauugccuaaguuuguuuuguucacuaugugucccuggccugcauauuugugaauaugcagugaauaugaaugugaauauguaagugaauaaaagaaaacagcucagaagcuguggcuuugaggauggaaaagaagggaaccauaguugauaaacuaccuagcagaaaggaccuuaguuccuuuuaauauuuuggggucagacagugcaagcugucgacagcagcuuaaggagauacauuagagucuuccuggcaguucuuagaaugccuugugcuaguguugaaugggaccuccaaauuccuagugugcugcguguaugucuguugaaggagcucaucacuugcacaaggaccagaaucacuuuuacugcagcauggccaguuuucuggccacuguuccuaguuauaccuuugauucuuuuacacacacacuguagcugcugccaaggcaggaucaaaguccaaauacugcccucaaggaugugcugacuuuagcaaugccaaccaagugaagcagcagugaugucaauguggcagagaaaaggguuauggggaaauugggugcaacuuuuuuuuuuuuuuuuuugagacagagucuugcucuguugcccaggcugaauggaguacaguggugugaucuuggcucacugcaaccuccaccuccuggguucaagugauucucaugccucagccucccaaguagcugggauuacaaaugccugcuaccaugccuggcuaauuuuuguauuuuuaguagagaugggguuucaccauguuggccaggcuggucucgaacuccugaccuguaaugaucugcccaccucggcuuccugaagagcugugauaauagguguaagccaccgcgaccggcugagugcaucuugaccuuuagagagaagcuucgcuuuucaaauuuuuaagaggcuauuguacaugccagaaaguagcugaucagucagaauaucaccauauaucuuuaggaaaaauguuaguuuaguuacuugugcggugccuagcauugagcaguugcuugacugucauaauaauucugcugucucuacuguacucuugcaucuggauaacuuugucuuucuuaccuuuggagauucaagacaaguugaacaagaccaaggaugauauuagcaagaacaugucauuccugaaaguggacaaagaguaugugaaagcuuuacccucccagggucugagcucaucugcuguuuuggagaaacuuaaggaguacagcucuauggguaugaugcuuggcauauacaugcucucuacuuccuuaaagagacagguuuugucauuguuuaauguucacauagguuaagaauaacucaucauugguuaauacauguuuaggagggccuacucucuguuucacagguugaauuuccuauuuuuaaaauuauguuuagauucauccuucauccauaaagcaagcaaaucucagagacaguggaacuuggcuuuuauuuccuuuuguaagcaugaauaaaacaaauauauuuguguuuaagaagagagaauauaagauauguaauacaaaugaaauacagauccauguaaaaaugugaaaucugcauaaaggcacaaaagaaaauaagucacuauaauuccacuaucaaagauaaacagauggugucuaucuuuaugcauguagcuauagguagagcugucuauauaguuuacaucuaucuauauauguauaucugucuguuucugagaaugcuaauaguguuugucuguguguauacacauguaugcaugagcacauaugggauggauaaauagaccaaauagcuuggugcuuaagagcguaacccuggaaccagccuggauucauaccuugguuugccacuuaaaguaugccuuuggcgaguuacuucuguaugucacaguuccuguaucucuacaauggggauaguaauaguaguacaguacuuaccugaaaagaugauuauggggauuaaaugagaucauacauguauaaauguuuuauagugccuggcauauaguaaggauucaguaaauguuaaacauuauugcuauuauuaacucaaacagauuuauguuuguuacugauuaagaucauauuacaaguacuuuuuaaaaagaagcuuuuuaguuugauauauuuacagaaaaguagcaaagaugauagagauuucccuauacccagcuucuccugauguuaacauccucuauaaccaugguacguuuaucaaaacuaaaaaauuaacauugguacagugcuauuaacuacacuacaaauucuauuucuaguucaucaggguuuuuuuuuguuuugcuauguuuuguuuuaaacuaauguucuuuuuucuauucuaggagccaaccaggagccauguugcauuuugacaaauacccuuauuuuuuauuuuuugagacagagucucacuguguugcccaggcuggaaugcaguggugugaucucagcucacugcaacuuccaccuuccaggcuuaagcaauucucgugccucagccucccaaguagcugagauuacaggcgugcggcaccauacccagcuaauuuuuuguguuuuuaguagagauaagauuucaccauguugcccagguuggucucgaacuccugaacucaggugaucugcccaccuuggccucccaaagugcuaggauuacaggugugagccacugugcucggccuugacaaauacccuuacaauuucuaagugacauguguugaggucuugacauugaauaguacaaaauuugauauagucuaggauguagaugaauaaagcagugguuagcacucuaaaaccugguguuaaagauuuccaugauuaugagaccugguugccgccaucauauugccuucucuuuaauguuuaagucacuguccauugcuguauucucuagcaucaguaaaagaacaggaaaugaaaccaguuaucuuauuuuugaaaggcuggugaccacuggucugaagcuguguauaguacagagcaguguccucuaaggaaagagugaaagucaaacgggcagcaagccagagcuuggcagauugcuguaagaaugaguuugucuguauauuuaccacuuaguuuucuguucucaagagcugaagaucuuugcuuuggagagcccuuggcuccaugcaguuuuuaguugguguguuuccguaauagcuuucucacuacccacuuucaauagggcacagcugcauuguagcacaaggaccugagacacccauaucaacaaauuuguggguaaaaugaagaaugucucggggagagaggaaaguggaaagucagaucuuauauucuacucaggaacuuuacuuuucuuuccacacugggauaaaggagguuuaucccaauguugacuguguuccugaucuugaauaugcuacagcgugugcugcuggaagcagguaacuaguuuuauguggguuuccaggcuuggcuuaagggagccggcgucugagaccggggugcucaugguuuauaccucauugugguuuguuugcugguuucaucucugaugauagugugcugaaauuucacacuuuucauuuugcuuucuucugccaacucugcucauaauaguucucaaaauuccuaggacuggauaggaaaggagagaagaaggaagcuauugcagaaaaaggccacuccaaagccauauagagaacaaaaaauaaguauagacaaaggcaaauguuccugcuguuagaaggcaguugaggaugaggacaacauuauuaucagauugccuuuauuguagcuaaaugcuauuaauaucuuuuucacauugcugauaauaaugauuuuucaucuuuauuuuauugugcuaacucuauugaacuuuuuucuugauuugcuauaagaaugcuguuggguuuccacucaacauuuuuuucuuuuguauccagaggaguuucuuccuguuucuucuuuaucagaaccugucuucccagagauucuugcuuacugaccagugaccuuaccuuucucugcagacgccuucuggcaagaggggagagccucuggaacaguguacaguggggaggagaagcucacugagcuccuugugaaggugaguguccaguucuugagggaagccugugaggucugugccaguuuacaugaccuccuuuuuuucccuuacuuuuguaauuagaaaaauuacuuaaggaaagcuuauugguacaauaaaaccauaaaaguuucucuucacccaaacauaggcgaauauguauaauauuaucaaagacaucuucagucuguaaaauaguaaaauguuauuuauguuuucagucuuugcagauguccugucuagaaggcagauuacuagggaagguaguccugucagaugagauuuuuguggugagacagauuuuguuugauaagaagagauaagauagggaaacucuuucauaauuuucucaaaucaugugacccaagaugagcaguggucucauguauacuucaaauaauucucauucuuagcuucuuccauuucuaaucaaauuuauuuuuauuuuauuuuauuauuuuuacagacaaagucucacucugucacacaggcuggaguggagugguguaaucauggcucacuucagccuugaccucuuuggcucaagugauccucccaccucagccuccugaguaguugggacuacaggcgugcaucaugacacccagcuaauuuuuguauuuuuuuguuggagauggggucucacucuguugcccagguuggucuucaacucccagccucaagugauccuccugccuuggccucugaaaguguugagauuacagcugugaaccacugcacucggcccucauauuuauuuuugaaacuccacuucaucauauaaaauugggguuguacugaugaucucuaaggucuuuguguuugauuauuauaaauaugaaacugucccuuacuaaauaaauauggcagguuuugcauaaguugguguaaugcucugaucuucugugcuuaaaaucuuucaguagcuucccauuaucuacaggaugaaacucagguucuuaugcagcagagaauacaaguuucuucaugagccagcucccacuuauuuuuucuuaacuacuucucuucauuucccacauaaacacuaauccugccuuuucucuuuacuaaaugugucaugcuuuuacguuguuuuccuucccuuccaucauuccucuuguuccaaaugaugauuccuacucaucucucaaaguuccacucagcagacaccucuagaucacucaggauguuaguuguucccucuucagggucccuuagcacucuguacacacaccugauauugcagucgauaacaacagcugcuuugugccagacacucuacuaagugcuucacaugcauuauguuauuuaauuauugcuagaacacuagaagauagcuaccauaacaacuucugcguaugaagaaacaaccuuagauuaugugaccuacacagcugaaaguaauaggcaaagcuuagacuuccuccugggucgguuugguguuauagucugcgcuuuuaaccauauuuauacuucuuuccucaucacauuguaaaauuauuuauuuacaugucugucuccucugcuauguuuugaucuuuugguugaggaauauaucuuaucuuuuuuuccaguuuauauuguugugccuaauacuuagaaacuguuguuuagugcaugauucuuuguccuguauaguguaauaguuuugauuucacaucugcuugcauuuuuuugcaggcuuauggagauuuugcauggaguaacccccugcauccagauaucuucccaggacuacgcaagauagaggcagaaaucgugaggauagcuuguucccuguucaaugggggaccagauucguguggauguguaaguauaugcaaggggcauccaauagccuuauuuuuuagguuaaaauagaagaguuuuuaauaaauauuaauuauauuuuaaaaaauaaaaaauauuaaaaauauuuuacuacacaagaaauauuugaucauuguagaaaggucauuuuacuacacaaggaauauuugaucauuguagaaagauccuaauuaacugcaguuuuaaauguuacuuguaauuuuguaaccuagacaaugucaacauuuugguauauauucuucuagauauuuuuauuuucaccuuuuuauuuugaaaaacuuugaaccuacauugaguugcuaggauggcuuaaagaacaccuuagauucacuaaauguaaauauguugccauaucugcucucuacacucuuucccucccuacccgcuucuucccucaucccccaccugcauaccuaccauuccccuauuuaucuguguauacuuuuguuguuccauccagcaguguuuuuaguguacuucugguuuuaccugagccaaaguuuaauuuauuauuuugcuguaaacugaaccucauuuaguugcuauuaggcauaaagaaagggggaggacaucauuauauuuaaagaaacacaugaggauucuuuguuuuaccuguucuuucaaguagaugguuguuaguuuucguaaacuaugauagauaaacuucuguuuagaucuguugucuuuagaaaaaacgaaaucucagguuauguaggauagauagauuuaacucaauaugcugcaaugguguccuagaggugcuaauccuaucagauacucaucauauuugcagucauuauaaagacugcagauuuaauuauugaagggcccauucgaagagcaccuaauuuaguuucuuuuuuuuuuuccaggaagcauuguuuuuguuuuguuuuucuaauauguuggcgccaugaaaaucaucauguucaaauauuaguaguaauaaaggugauaugccuggcauucauuuucaaagcaaaauacugaaacuguuaaaaacagaaccacccauaauacagcagcaguuucccuuagaguacugaggugaacagggugacuuucagagggaagaugauaauguacuuacaguauauucuccuaugccauuagacucuugaagaacuuguaagaggccagagugaauagccacagaacaguuuggccuuaucugguaaauuugaagauacauauaucuuaugacccagaaauucugcuacuaggacauacucuagaaaaauuaguacacauauauaucaggauauauggacauuaauauucauagcaauguuauucaugauagcuaaaaacuggaaguaauucaaaugccuauccacaggacacagaugaauaaauuguggaaugcugugugugccucaauccauuguagcucuuauucagauugauguacaaauugccucauccaucuuuggccaguggaaacaucauauuggcuccuagguccauuuacaugacccaaguaaucuuugaaagccuuuuuucucuuucuuuccuuuuuuuuuuuuuuuugacgaaauauuccagguucagguucacuuuguccauuuccugcuccaggccuucaaucagccauuuauccaaggagcccugguucauuuaaaacuagguaaaauaauuacauaguuccaaaaucacauuuauggaacaagacagauuaaaaaaaaaaaguuaaccagaaugcaguccagagagacaaagaaauagaagguaugaaagagaggcuaagagaugcaaaggauaggaugagaaggcuaacacacaucuaacugguguuugagagcagccagagaaaauagauuaccuacaaaggcauaacuguuaggacaacugauacucaauagcaacgauggcuggggcaguuggggguagaugaaagauuggcuguaaauugaaaauugcuggagccuggugauaaguagugagaggucacagcgugcuggcaguccucacagcccucgcucgcucucggcgccuccucugccugggcucccacuuuggcggcacuugaggagcucuucagcccaccgcugcacuguaggagccccuuucugggcuggccaaggucggagccggcucccucagcuugcagggagguguggagggagaggcgugagccggaaccagggcugcgcgcagcgcuugcgggccagcuagaguucccggugagcaugggcuuggcgggccccgcacucggagcagccggccggcccugccggccccgggcaaugaggggcuuagcacccagccagcagcugcggaggggguucuaggucccccaguagugccggccuaccggcacugcgcucgauuucucgcugggccuuagcugccuuccccuggggcagggcucgggaccugcagcccgccaugccugagccucccacccccuccgugggcuccuguguggccccagccuccuugacgagcgccacucccugcuccacggcgcccagucccaucgaccacccaagggcugaggagugcaggcgcacagcgcaggacuggcaggcagcuccaguccugcaggcagcuccacccgcagccccggugcgggauccacugggugaagccagcugggcuccugagucugguggagccuuggagaaccuuuauguguagcucagggauuguaaauacaccaaucggcacucuguaucuagcucaagguuuguaaacacaccaaucagcacccugugucuagcucaggguuucugagugcaccaaucgacacucuguaucucgcugcucuggugggggcuuggagaaccuuuguguggauacucuguaucuaacuaaucugauggggacguggagaaccuuugugucuagcucagggauuguaaacgcaccaaucagcgcccugacaaaacagaccacuuggcucuaccaaucagcaggauguggguggggccagauaagagaauaaaagcaggcugccagagcaagcaguggcaacacgcucggguccccuuccacacuguggaagcuuuguucuuucgcucuuugcaauaaaucuugcuacugcucacucuuuggguccacgcugcuuuuaugagcugugacacucaccacgaaggucugcagcuucacuccugaagccagugagaccacgagcccaccgggaggaacgaacaacuccggacgcgcugccuuaagagcuguaacacucacugugaaggucugcagcuucacuccugagccagcgagaccacgaacgcaccagaaggaagaaauuccggacacauccgaacaucagaaggaacaaacuccagacgugcuaccuuaagagcuguaacacucaccgcgaggguccgcggcuucauucuugaagucagugagaccaagaacccaccaauuccggacacaguagaagcccauugggcuuuucaauuuuauuuacucuaauuucauucuaaagaauucuguuuuguaguucuccuuuuauuuuauuauuauuuuuugagacagggugucacucuguugcucaggccagaguguaguggugccaucucagcucacugcagccuugaccucucugggcucaagcgacccucccaccucagcccccuugaguagcugggacuacaggcaugcaccaccaugccucgcuaauuuuuguauuuuuaguagagaugggguuucaccauguugcccaggcugguguugaacucccaagcugaagugaucugccugccuuggcuucucaaagugcugggauuacaggcguaagccaccacgcuuggccgucuuuuuuuuuuuuuuuuuuuuuuaaucugcuugguuguuuuuuauaguccuuuuccuuggcuuaacuuuuguuuacuuaaauauauuacacauaaauauguuguauucugugucugauaauuccaauauccaugagccuuaccugauucugcuggcuucagucaugguuccuuguuuccuuauauuugugauuuuauuuuauuuauuuauuuuuuuaugagccacucauuuuucugggaaccuagggauucuuugaggccuagauugaaguuaagucuggaaguucucuucuuccagagaagauuugucauaccuuuuugaguugcuggggauugccaccacacuggaaccaaauuaagucaaauccuuagcuugucauuuuguaccacagagguagugugaauucugaccacaaacucacauaaaggcuuccuuguuacacauucuugaaagauugcuauuuuucuuuacuugaacaucaggguugagaaaaacaguuuuucuuuucucuuuugcaguagugggauuuauuucuuguacacuguagaguguggucuuuuuccagccaucuccuguuggacuccuuaucuugggcagucucuaauguaucuucugguccauccuuugcucaucugucaguguaggaguuugaagucugaagggucuggugccaccucagggugaaagcuaguuuugccacucacuuaucuugcaggauucuugauuuugcuuuguuuggggguuuagcaaguuucuuuauguuagguuagugauagguuuaaauuuuuuuuuuuugauguuuuaucaaguuuuuuaguuauuucaguuaggaagguugcucaagguauauaauauugcuagaaauagaaguuccauaauuguuuuuuccauguuacagaccuucgucuauuugaaagccccuuucucccugaaucuucucugccccacauuuuucuggguuacuccgcuuuucauaugauuucacagacuuccaaccaucgcagucauucucuguaugacuuuugguugccucuggccagauugaacacaguucuccacauuuggaguggcauugaucuuucaaucucugucuuuuuuaaaucuggguucaauaaacuuauuucagaccuuuuccuugaagucagcauuuuuauucuuggcaauguuuauuuuauuccuugcuguuccuaaugucuuuguuaguucuguauggaugcuacuggcuuuguuuuuuuaggucuguagcucauucuuuuuguuucauggucuagguuuugaacucuuuguuuucuuaaauucauguucuuaugauauuuuccuauagugagaaaguuauaagggguuuccuucaucccuuagcuuguuuccuucuguguuggguuuuuauuuugcaugcuacauacuaccuuuuccccugccuuuuaguuuguuugcauaguuuccuugccauuuucucucaucuugggguggcauucuccagacauuguucuuaugcacugugggugcuuccugucugagaccauuuggcuggggacaaagcucagccaaagcuuuguucuaucuguauuagaauaaccaggucuauucugagauucucuucaaaguuaccuaucagaguucacucucuuauuuggaagagauaauauacccuuugagcucugauuauuuaauucacugaagucuucacucuaaagagccaauccugauguucucucuucauuuugcucauuucucccuagcagccauguuuaccacucacucaugagaagaagaagaaaauaaggaaacccccucagcuugccucugcagauuuggggguauaaaggaaaauucucaggauuuugcugacuuugcgguacaguuucaagggcugauuagaaacuaguguuuugcuuacuucugcucucugcuguuucacuguuucuuuuuuuuuuuugauugccaauauuugaaguuuauugccuagauuaucucucuuuccuuguuugguuguuguuauuguagauuuugacucuuuucucucccugcacucacccuuuuuuuuuuucuucccaucuuacuccugaaguccaggccuagggguuuuuugcauugcugcaauuaaaccauaucucuauuauuuugaucuucagcacgugugagggaucagaagaaggauagagucugauucccaggcucuucuaauauuuagacuuuuauaaaauaacuaaucagcacugguauugucuuuuucccucucccacucugucucccccacuccucccuuagcuucuuacuucucucucuggaugagcugcuucuagugaagaaagaguucacuguucagaggugggaagccagaagauaaaaccaaauggcugggcagucuuuagguuauuccuagcuaagaguuaagaguuguaagcucucucauucuuuguucuucagccuuaaacuaucuuuccuucuauuaacuuuauuugucucaguuacaaugauagagguaacuucacauacuaaaagaaauuagguuaccaugugaaacauucuucuuggcuugugcuaauguuaucagauccaaacagcaucugaaagaaaauuuuccaaguagauguuguucucuuguuuucugaaauacauaucauauguuaaagugagaguuuuuauacauguugaaagaaguugaaugacauaacaaauaguuacugaggccuccauuuucuuacuucacaguuaaaauuccuguuucucuuuggguauaggagguagaaagaagugggagaguaauagcauuuuaaaacacagaaucaaaaauacauauuaaaaguagaacuuaggcccaggcacagugacucacgccuguagucccagcaccaugggaggcugaggcaaguggaucgcucgagcccaggaauucgagaccagccugggcaacuaggugaaacccugucucuacaaaaaauacaaaaguuagccaggcaugguggggugugccuguagucccagcuacuuugggggaugaggugggaggaucucuuaggccugggagguggagauugcagugagccgagaucacgccauggcacuccagucuaggugaaagauugagaccccaucucaaaaaaaaacaaaaaagaaaaaaguagaauuuagguauuccuacuuuuacagucaaaaguccacugguguuugcauaacaaugauguuuugacuaguuauuggacuaaaaguaggacacaugaagcaggugacuaggaauuuggaaauauuauugcuuaggucauuacuggaccuuacgaagagauuguugcacuggugacuuggacuuugcuggucccuccccgacucuucacagcuggcuugacgacucuugugacauucugagguuuuaugcuaaaccacaggacaugcugcugauuugcagagcugaccucagcuguaagcacuuugucuucugcagcguagaaauguagugaccuacaagugucccaugcccaaguugggugcauuauuuuuuggugauggucacauguuucauaaagacuuccugagucaaaaaaugacuuuucucaguucaucuuccauauaacuccuggccacagggauuuuguauccaaugguauuuuuguucuauguguggauauuauuuuagcaaaguucaguggucacuuucucugauuccaucuuguauuaagcuacacuaaauaugaaaacguagaaaguuuuacuucuuaucaacagaugcuaauguaugacauugagugaaacacuuuaauuccucaagggcucaguuuucucaccuguaaauugaaaaaaccuuucaaagauuguaugaaucuucagagaugguaagucuaagaaguuguccaacuaguuuaguauuguggcuuuuuguuuguuuuggaaugauucauucucauauauuauuuuuuaaaaaaauagccagguggcuaugacaugccuguguuggucaagguuuacugagagucaagucaggcauuaagaaaugugaaggccaggugcaguggcucacaccuguaaucccagcucuuugggaggcugaggugggcagaucacuugaggccaggagcuugagaccagccuggccaacauggugaaaccccgucucugcuaaaaauacaaaaauuaggugggcaugguggugggcgccuguaauccgagcuacucggguaacuauggcaggagaaucgcuugaaccaggaggcaaaggcugcagugagccgagaucaugccauggcacuccagccugggcaacagagugagacucugucucaaaaaaaaaaaaaaaauggauugaggguuuguuaggugucagccacuaugucaggugcuaggaauuugucaugaacagacuggucccuacuuucaugaauuuauaguccagugagggaaauaagaugaauaaaaagaccccuacgucuuuuuguuugaacucugguaaagaaauguguuuaucagaggggcuaggccaaacuuuaggaaaacauuucacuucacuuaaaaaaaauuaggauuuuuguuuuauuucagauaaggcaacaaacuuccaucaaguagaaacuucugcuuuucucugucuuucaaacuugucaaaaucagcaguuuacuuuguuaaaucugaaugucucuuuuuaguguauugcacaguuuacuagaauuguaaucacaauuucacauucuuuaacagguauugaaaauuuaaauuaaaauucugauauuuuugaauggcauaaaaugcccuaucuuaucugaaaauugaaaaauuaauacagaaauguaaauggauugugaauaggugggaucuggccaagugugcauuugucuaggcagugcugaguuucugcucauuauuuaguagcuuucauucuucaccugagccaaaauuaggcuuagccaauaaagccaaauuuuccuucuggaagacauggcagugucugccuugcagcaugcauccaagaccuuaucuguuucuguaucaaacauugucaagaucagggcaugaagagccggggcauuccugacucccccaacagauggcaucucuucuuuauuauaggugacuucugggggaacagaaagcauacugauggccugcaaagcauaucgggaucuggccuuugagaaggggaucaaaacuccagaaauguauguauguguggcuguuuuguccccuuuuggauuugucugucuggaguacagcuuuaugaaacuaaagcagauaauccauuuuccugcugcuucucuuccucugguaauucugguccccuuucccccuguccuagccccucugcccuuauccuuuuacauucaguaaaauucuaaauggaucagccaguuauuuuuaaagaucauucccaucccgccccacccccagaucaugcauaguauauacuacaagcaaaaauaagauccuuuuuccaaaagugagaguuugaggacuacaucuuugaauccugugauauuugcaaauuauuuggagccuaaagaaaccucucuagguacuuuaguucugcuuaccuuagaaaguuacuuaauauuauaggcugccucaggguacucucugggaaaacuuuagugugagggcuguuuucugggaggaagaauaaaaauaucuuuuugagauuuacccacauugccuuccuuggacauaaauuugauguuuaguuacauuauuuuuuccuagacuguccccuuguacaguauguuuauccuacaucuuaauauuuuuacugcaaguauuacuugacaauggggauuuauugcauauggucucaugcugugguucauauguagcauaagagaauaaaccaggcugccauucuuucuucauaugucgaucuuuggugcuugguacuuccucaguaguagagauuuuucuccuuagagggaacagauucguuguaugaauggaguaguugaggaaagucuaaagcaaauacccgugaccucauuuucucuuucaacacuauuugaaauacuauuuccaaauguguaggagaaauggggauuuuaguuucuucagguuuguugucuuucagaguuggaaggggccacugagcugaugcuuggccgcugugugaacauuucugcuugaacauguguugugccgggaagccuucuucucauucucacugaggugccugucuuugguaggcaaccguuagccagcucugccuuguguugcucucauccaaagucucugucccccagcuuuccgccugccagccuagcuuuaugcuuuggaucccucacugugggaucacuucugaguccucuuccuauugccagaaugauuuccuaaauaggagggaaguuucugcagaaaaucaguuggccucuuuuugggugugcuuaaaaagaaaaguagagcagucuaaacacuuaaauuuuuaauuuggggaaaaauaaucagaacuuacucccgguaauuuagauuagcugcuaaugguguuuucuauuauuuuggccugaguuacauuauucuccucuucccugucauuuaguguggcuccccaaagugcccaugcugcauuuaacaaagcagccaguuacuuugggaugaagauugugcgggucccauugacgaagaugauggagguggaugugcgggugagucccucuggagggcccacugucugugcugggcccugacagcagaagggcccuccuguugacuagccguuuccagucagaugggucugacugccuuugauuguggcagccagaauaugaaaaacugcauugauaguggugauugacugcagcuucagucuuuucauagguucaugaauucugaaagggaggugaucuagucacuaacuugggacuugagagacacugguuuugcggucagcgccaucacuuuuucuuucuuuucucuauuuguaaaaugaacauggacucacuuccccuaagacucuuaccauggcccgggcaugguggcucacaucuguaaucccagcacuuugggaagccgaggagggaggauuacuugaacccuugagcccaggaguuugcgaccagucugagcaacauagugagaccccaucucuacacaaaauuuaaaaaaguagcuggacaugguggcaugcaccuguaguccuagcuacucgggaggcuggggugggaggaucacuugagccccaggagguugaugcugcagugagcuguguucacaccacuguacuccagcuugggugacagagcaagacccugucucaaaaaaaaaaaaaagacucucacugugguuuagauuggcuuaaauuaauaccauugucauuaugauagugauuauuuuuaugccucacauuuguguagaggaguuuucuaguuucaguguucugucagaaucccauuugagcuuuaugacauuccagagagguugaugaagcuguuauauuauuguaguucacagauaaggaacagacugaaguagcauacucaggguuucacugcugguacguuguggggcuggggcucacauuuggcucuuuggccucuuagcucaauauuauuuucgcccccacagcgauucuguucuuauuuugugcucucagacuauucuccaaauggacuuaccuggagucaccuguguccugucaccguggugggaugcagucuucucccaguuggaguggugaaggaggggguacugguggaacuggaacucuaagcuagcagcccaaauugcucuuggcagcagaagagaagaguaauugugacauagauucucauuuuccuuuaaacuuuaaaucccuaggcaaugagaagagcuaucuccaggaacacugccaugcucgucuguucuaccccacaguuuccucaugguguaauagauccugucccugaaguggccaagguauaugagagaaaugggcugcuaaggcaggcaaauggauauuuuaaaacaaagccuaauggggcaguacuuggcaaauagaagcgauuuuuuuuuuguuuuugaccacaguagugauaaguagcucucaucagcccuaggggaagcccugcagcucaguugcaagccuuuaaaaguugcuagucucugcugugggggaagauaguacaaggcugaggccuuuuaaacuggaaauucugaaauaggauugccuucuagauugagaucuggaaauaaucugcauguaggaaugugcccaccaaaagggugauauuccacaugcugccccucagcgccucccuuucccucacgccucauccugcagugacugaggcaggaccuuucccuugugcgagaggcagccuaaaucagagcucuacucauuuccugcuugauaccgcagagcguuugaggucaugcauauuuaaauauaaaauugauaccauauuucagaugaauuauuuugaagggaaaauacauuugaaagauaaauuuuguugggaauguuaaaaauagccauuuuuuaaaaacaugggaggcauaauacaaaauagccuuguguuuauagcccaucuuuccacccaugucuugcaguuuuuauuauagggcuauaaaggaaauucucuuauguucuuuguuuuuuggaacaagcuggcugucaaauacaaaauaccccuucaugucgacgcuugucugggaggcuuccucaucgucuuuauggagaaagcaggauacccacuggagcacccauuugauuuccgggugaaagguguaaccagcauuucagcugacacccauaaggugagcuaaggaggagaucaaguguuaccaguugauuauuuugacuauuauugauaaaauaaauugguagcuuccccgcaaaguauaaaauuaacuauagaauucucaucagaugcuuguuuuaaacucucucuuugccgucaccagaucagcugguucaggugaugggguauagugguagaggugacaagcaguagugaaaaugaaccuguuaccuuuaucucaaauuggcuaagagaauuucuguauccacugacuguguguaacuagaacaugcuaguguaguggcccuuguuaaaaaagcucccugaagccuugagcugauuugagguggaggguagaggagugugaggguugguaguggaguucccaugcugguagauaacauuagagcugcugugcaacugggcuccugagcguacaugacgggaaaauguugacggaagaguccuuuggaaaaugggaagaaccugugugcucaggaacauucagcauuugagauggccacgccugccacccuugguggacugagacaaagucuagaucaguugauaacgcuauugaauauacauccagauguggaagaaguauuagcagccucaggaauguguaccuuguuuugauugcauuuucagagcuuguuuuaaacucaaguauauuaaagacuuguuuuucaaaaucggugugaucugcagccgauuuucagucagcaucuguuuuuuccuuaccauccagauagcuccuguguccuuuucccauaaccauccauuucuggaugguucagguaaugaaauuaguuccacguuaguuuuaauaagaguuaauuagggggucagauguucuauaaggaaaccaguuacauaguuaauuuuaaagcuggauuaaguagcuuuuaguuucugagcaccauuauguucucauaagcauaauauucuuaguaauacuaagcaaaaaaagaugggaagggggucagauggugauuuuaacuugaagugacaaauuccauccuuuccuggcuuccauugcaaacuuacccuugcuuucauccugacauauggucuccagagaaauauuuuaaauaagguaaaccacaugcugggcaagagagggaguaaaccgauuaacugggcgcuguucuucccugggucucagauuccucauuccuaacagagagaauuuaaacuccaucccuuaaguuccuacuauccuuuagcauuuuaaguuugaauccuuaaugugagugggaaacauaacagagaaacugagaaauaaauaggauuuccuuugcaugaugagaguucugggacaaggucugccagacagaacuauacucucacuuuucuugucugcuacuucuuccacaguauggcuaugccccaaaaggcucaucauugguguuguauagugacaagaaguacaggaacuaucaguucuucgucgauacagauuggcaggguggcaucuaugcuuccccaaccaucgcaggcucacggccugguggcauuagcgcagccuguugggcugccuugaugcacuucggugagaacggcuauguugaagcuaccaaacagaucaucaaaacugcucgcuuccucaagucagaguauguguggaagacugggguucugccuugucuauugcuuuuuuguccuaguaggcucaaggcaccugccuggcuaaguauccauagcccuagcccaccuguugucuccugcgauauagagggcuuagggcagcagcuuagggcuuaggccagaccagcuggccugggagaagaagcucccuuucucugcccugacuuuuggagggucuuugagacgggggccucauuuguaguuuaucucaucucuauggaugucuuaauaacuggcagcucuuacccuaaggcuaauguacaauuuaaugguuaggacagugauucccaaacuugagcaugcauucuaaucaccugaaggacuuguuaaaacacagguagcugggcccaccccuagaguuucugauucaguggaacugggaugggcucuaaaaauuuccauuucuggagauacugaugcuacugcuccaggaaucauacuugaagaaucauuggaauaagaaaauaauuggaaaugggccagaaggaaugaggaaaggagggcaaugaaaucuuggguuaagccaaggccagaacaggcugcaugcuuugucuaauguaucuguuaacaucuuaucugcccaucucucuaugugucacuuggauuggggaggcucuuuaaguauauugagggggaaggaaagcugccugcaggcauuucucauuugagaaagauccuuggccaggcacgguggcuccggccuguaaucccagcacuuugggaggccaaggcaaaaggaucgcuucagcucaggaauuaaagaccaaccggagcaacauagugagacauuaucucuacaacaaauuuaaaaauuagccaugaggccgggcgcggugacucaucccuguaaucccagcacuuugggaggcugaggcggguggaucaccugagguccagaguucaagaccagccugaccaacagggagaaccccgucucuacuaaaaauacaaaauuagccgggcgugguggcgcaugccuguaaucccagcuacucaggaggcugaggcaggagaauugcuugaacccgggaggcagagguugcggugaguugagauggcaccauugcacucaagccugggcaacaagaacgaaacuccaucucaaaaauaaaaaauaaauaaaaauaaaaauuagccacaugugguggugugcaccuuuggucccagcuacacaggaggcuuaaggcaagaggacugcuugaacagcccaggaauuugagguuacagugagcuaugaucacaccacugcacucuagccugggugacagagcaagacccugucucaaauaaauaagcaaacaaauaaauaaaaauuagauauauauaaaagguccuccuauagcucugauagggccauuuauuaagaccugcuauaccauuucuugcuuuagggauuacauaugacuuuuuagaacuguggagaugggcagauuacuuuuccagaaauuuuuuuaguacaucuuucaugccucagaagcaucuaggggaauauaauugggaguuggguagacagguucgaagucagugauugagucauuagaucuagaugggguuugggccuuggaauuccauuuuuauuguuccaucuaugauucugaucucaguaagaaccacugauccaguguagcccucuucuuuuuugaagaugagaagacuaaagcccaaaggguuagauugcauucauuauaaggaagacuuugaaugauuaaagagauagugaccaggggauuguaugugacugaauuuacuuuuucuuccuucauuuauuuuuuuguuuuaagacuggaaaauaucaaaggcaucuuuguuuuugggaauccccaauugucagucauugcucugggaucccgugauuuugacaucuaccgacuaucaaaccugaugacugcuaagggguggaacuugaaccaguugcaguucccacccagguaagcuugaagaagccucuuucccuuauuuugcuccaugauuuuggaagaacuugggugguacaguaaccugaaguauagaguuugacugcuagaggcuagcacguuaguagcaacuguaguauauaaaggauuucucucuugccaccuggaauuauuagauacaaagaacaagaccauuagcuuuaaacucuggcagaauuaggugacagccuccuagaccagugguuggucaugagguuuuucucucagucucuagccuuucuacucuccaauccaucuuguacacagccaucaaauugcucuuauaaaauacuuguuaccuggcuaauauuuaguucaagaucuuccugggggucucuaaucauucaggccugcuacugccuucuuuauuagacuuuucuaaccuaaucuuccaugaugccuuugaguaaaugcaccacuccaacugaguacaggucuguucauguccucuguguacagcuuagccuuccacacguuggugcauugccagucccaucuggacuaucuuuuucccucuucacaauuccaguaaaccccacuaaauuccuccagggcgagguagaauuucuucugugcccugaaguccuuuaagaccccagccauguggcccuguccccaugagagcacaugggggcugauuaucuaagauaaaagugucucauugauggugacgugguugaaggaauggugguggaauuugugaggggaugggugggacaaagcagccaacacuguucauccucuuagcaugguucucagucaugccgagaagcucugaggccagcccaugccugacaccccaagcaugagagagccgagauucccaggacuaggaacaacuuggaugacuacacuugucagaaauauugugaaagggcaaccaggaaauucccguauuuggggcugcaucauuuuagaacauuuuuucuuucuucaagguucaucucucucugucucuucuuuccuaguauucauuucugcaucacauuacuacacgcccggaaacgaguagcuauacaauuccuaaaggacauucgagaaucugucacucaaaucaugaagaauccuaaagcgaagaccacaggaaugguagggacacuuggaguuuuuuuucuucucuuggaaauuuagguguugguggagaguuugaaggaaucauaugacccggagucuguuccugccucugccccuuugccacagacaucuuuuauuuguugacuggagcugaugaucucugcaucacccaccccuuaggguugcugaagucucaaaugagauacacuauaaaguaccuuguaaguuagagacuucuguauaaaagcagcuggugguaguguccauuugaaaagaaaauuuugucacaggaaagauaguaaacauguuuuuucuggaauuuucuuaggcuagucccuuuaugcagaaaggcagacuggaaagucccugugaaaaauugacuaugccagcuguuuuucugauagaaugaugggaugccuuagguggaaaugggguagggcagugcacaugcgaagcuaggacucggggagaaggggcucauugcugcaguuuuauucuugcuuuuggaccuggccucacuaauaaugucucuuucuuuggauuuguagggugccaucuauggcauggcccagacaacuguugacaggaauaugguugcagaauuguccucagucuucuuggacagcuuguacagcaccgacacugucacccagggcagccagaugaaugguucuccaaaaccccacugaacuuggacccuuucuagucucaaggggauuccagccuucagaagguucuugggauauggaacaggccgugcacaacuuugacaucuggucuugcuccauagagcacaacucaagauagaccaugagacagcuugagccucaggauucuuguucuuccucuuaucuuccuuuugugguuuuuaauuugaagaccccagagaauuccauuacauaaugauuuugcccuuguuauaaauguuacccuaggaauuguuuuaaccauuuccuuuucuaaacucucuagcuuucaacuuuacuuaaacauugugugguagcucugaccuguccugauucuuuagagaagcugggguacaguuuaugagauagcuagagcuucuuuguuaucucaggcaggaggcguuuacauaacagauguuuccucagcugggugugagguauacucuaagcaggaggcuuuuucagccuucucucucuuuuuuuuuuuuuuuuuuuuuuuugagauggaauuuugcucuuuugcccagucuggagugcaguggcaugaucucagcucacugcaaccuccacccacuggguucaagcgauucuucugccucagccucccgaguagcugggauuaccggcacccaccaccacgccuggcuaauuuuucaauuuucuuuuucaguagagacggguucaccguguuggccaggcuggucuugaacuccugaccucaggugauacccgcccccccgccucagccucccaaagugcugggauuacaggcgugagccaccgugccuggcccugucucucuuaagaguagguucauugucugucuuagagucacuucuauugcaacucauuuucuuuuuccagggcacagaucgaccaagcugccguucccuauucugcaggacaggacuauucuagcauaccugcuucguccacccaggcaggguuugggguggucucuucugugccugcaguccccauuugacacuugguugccaccaucuuuggagauuauuguuuggaaugaugcuuccauuggcuuuuucuuguuaccauggacuaggaagaaaacaugguuuccaaauaaucugggagcuuuuggccauggugccgccuuccugaauuggcaguggucagagcacaccugaacccuauccugggcuggugaugagcagaaaucagaccuuuuucuaugcuuuuuugaauaucagaguaggaugaacacccagauucaaauaugucaccaaaguugguggugguccuucccugcacccuugcguuaagccauuauguaaugaaaauguguuugcuugaaggaacagcucaaagcaccuucacaaguugccuugacuuacccuaggugggugugaaagagcacccguagcaaggaaaauuuucucuauuaguguguucuucugccucuucccccuugauucagcuuucagagguacuauggcaguuuugccucaggugcugaacauuucucagcccuggcuaaaagggagcagcacagggagagaaacaggauaggaaagcagaauggcgagcagccuauggcccagggccuguaaucccuucccaagacuagcugcucaggguggugcagggacaggaccagacccugcgccuauuuccugccuucuuuccccuauagggaacucuguaggcugagccacuguccugcucuuaugacauuauaucuugugccuuucuccucagcagugagcagugagcuacuccuggcccaggcccuaggggaaauggaucagucuuugagguuucuauuuggggaggggaguacuuaagaugagucaaaagacacuuuccucuguuccauuccccaucucagggacuccugaauauucagccucuccaggcuggugucuucuaguuucccccacugggaaugcuggcugggagagccaugacuaccagacuuuuccucaggcuccuuggcauguuagucugaauuguucuugagcacuguacuacugacccaacaacugugacuagcuggccacgccauucagggcugguguggcauuuauguguguguguguguguguguguguuuuuccuguuugcccagcagugcauuguggguuccaagaguggguaguguguguaugugugugugucagagggagaccuggcaggcaccucuuugagaguagcuguggucagagcuguuuggucagugcauuauguugaaugagguccaggaacccagagccacccagcagacaccacuguggcuugccagcugccaagauggagaagcaugugccccuguagagcgucuccccagaaccagaccccgagccacucgcuuccucugugcugugacaacauuggugccaggggagaugguguuuuucaaagggaccuacuguagccacuuuaauuuacaauuaagagccuuaguuugacuuaacacuuuuguaggcuuuucauuguguauuuuuguguaugugugcauauagcagcuacucuguagcagagguggguagagacacuuaauaguaucaugucgcaugcagaugucacaucggccucugcaaaaacuguacugucuuguuucugcauuagacuuaaguagucaugugaauauacugcuaugucacuuuuaauauuacgaguuuuauacuuggaaaaugguacuugcuucuuuuaaaucucugucuucucuaaccucccccuucccauuucaaugcucccuuccuaauuucagcaauaaucucaaaaagcaauuaaauaguuaaaugacccuaauuguaauuacuguggaugguugcauucauuugauuacuugggcacacacgagaugacaaauggggcaguggccaugcuugaaugggcuccuggugagagauugcccccugguggugaaacaaucgugugugcccacugauaccaagaccaaugaaagagacacaguuaagcagcaauccaucucauuuccaggcacuucaauaggucgcugauugguccuugcaccagcagugguagucguaccuauuucagagaggucugaaauucagguucuuaguuugccagggacaggcccuaucuuauauuuuuuuccaucuucaucauccacuucugcuuacaguuugcugcuuacaauaacuuaaugauggauugaguuaucuggguggucucuagccaucugggcagugugguucugucuaaccaaagggcauuggccucaaacccugcauuugguuuaggggcuaacagagcuccucagauaaucuucacacacauguaacugcuggagaucuuauucuauuaugaauaagaaacgagaaguuuuuccaaaguguuagucaggaucugaaggcugucauucagauaacccagcuuuuccuuuuggcuuuuagcccauucagacuuugccagagucaagccaaggauugcuuuuuugcuacaguuuucugccaaauggccuaguuccugaguaccuggaaaccagagagaaagaggauccaggauguacuuggaugaggaggccuggcuuaucuaggaagucgugucuggggugcuuauugcugcuccauacagcuguacgucagccccuuggccuucucuguagguucuuggcagcaaugagcagcuuucacucagugacacaaguaauuacugaguccuaauuugauagccaccaacuguaccuggguaggcaaagucagauuuuugagaaccuuuuuccugauuugaaguuuuaauuaccuuauuuucuuuuaugcuuuccucugucuuguaaucuuuucucuucuuaauauccuucccuauaauuucaauuauuuggauuaauuuuagaauaaaccuauuuauuucuaa

SEQ ID NO: 192961 - RNA, 78791 nt, Homo sapiens
uuaaaauguuuuuaaaaagccaagacacauaaaaaaaaacuaauaaauuuuuaauuagaauuuuuuccuuuuuuuaacaggacaaguaacagauuacaucaaacuucagaacuucucaaauaccuaguuauuauacacauucccaucugucuugcagggagggaucuuggucggcuuaacaguuucagguaaaauaagcugcauaauaguauauauuacaauaauaaauguacaauguuuacaugaaauauguuuuagaagcaagaaaaagaugcaucugcaucaaaggcgaccuuuuaaaaugccacaacuauuuuuuacauucacucuugcaacagguuacaagaugggggucacuaagcucagauaaaucacuaugaugcacauaaaauacaggaagacugguuacuuuauauauuauauauauuuauauuuucacacguuagcaucugagacauaaacugagaauuuaaaauuuauucucuucagauaacaaaucauuuuuuauucuucauaaacaaggugcccacaaaagcacacagguaaggcacaauagggcuuucuguuacagaauagugugcaucauguuuacuuaaccagaaaacgugcauuaucugugcaaguucaugcugcaaacccaacgcauacaauaaaacaaaaaggaaacugagcuuuaaauacaaccaaaauuuguacaauuccagcuguuucacauauucauuuggacugacaauuauauaucaacagguuauuuuuaaaaagccaauuguagauuacaaguaaaauuuacucagcaacuauuuuuaucugaaaucauaaacaguaauaaaguaaguuuacugaaacaaauuaaauacugaggcacaaagcaacagucaaucgugcauuuacuauauugcaaacuuucaugacccaaaauugcaaguauaauuugucaaauacacauuuugcugcaacaaugugcccugcuuuaaacuugacauauaacagaggcacuaacauaucauuaaauuauaaauagauugggaaaaugacuuaaccccaaugguacuaugucauggcccuaguauuuauaauaaauacagcuuuucacaaaauauuuuuccaauaucugccaauuucuucuuuauugcucacauaaauuugacucuauuacaacugguaucagaacuuucacacaaaaucauacucagacauuuuuauauaaaaccuauaaaagauauuuuaaacuuguaucuaauacuuccagguguuuggcuguuugaucuaugcaaaaguacagccauauguauauaucucuguguguguauauauauacaucuauauauacacacacauacacacauacauauauacacacacauuagauuaugaauaaaauggaaagcuuauuuuacugcuuuaaugcagacauccucauaaaacaagacuacuuucaccaccaccagcauuuauacauauauacaaagccaguuuaaguacauauacauccacuuacacauauuuguaaccacuaagcccaaauuaauuuucccauauuccagccguagcaaaugaaucgcuuauaagcaacagaaaccuaagguuaaauugggaaaucaacaguuuuaccacauuagccuguaggaacuaugcaggugacuguauacaaaaauucacaacauuaguucacaagaaauuaugggacuacaagaagccuuuucaucaugcuuuugugugguuauccaaacacuucuuggggcaaaaauacaaccaccacaucugaaaaugcuuaauaaagucaguguuccucaugcaaaacuuuaaauguauuggcuuaacugagcuccaaaaacugaaugaaauaauuauccuaccuacucagcauugcugccucacugcuaaaucccuuuggaaccuuaagacuucuggaacguucagagauguauucaucaauaaaaauauuacauacaaaaagcauuuaaaaaggaagacaaaaagccaaacaggaauuuuccuauuguaaauaacagucuuagaaauggaagaaaaucuuuucaggaacuuccuugagaauugguuaggccaguccgaagacgaagaugagacauggaguucauauguuuauuugauggcuucaauggaguguuggaagugagagccuggggaaagcgauggugguaucuaucuagucguaaauauuuuacuguaaccaauuucccuguuguaagauaaaaauaauauuuuagaucaguaaaacuguuuaauauuugcagaaaauuaacugugguaaaagacauaugagcacaaaacauaaauaaagucaucuaaaauuauuacucaaaaaaaugcuaaccuaaauucuuuuauuugaaaucugguauaguuuaaaauuaaacuauaacuaucuuuucaaaauguuuguaguacucaaauuucuuaccaucaaaccaagagccaugcaaugcuuuaaaagccuuuccagcauauucuggagacagacauuuaacauauacacaacccugugauauuaaaaaagaaagaaaauagucuuaguuuaauagcaacaaauccaaaacaugaaauucaauaccaaaaguuacuuuaccucacgugaauuuuugucuacugcaaugugaacaaugccaucauuaucacugcauuuuucuaaaauugcuucuugaauugccaaaugccacugauccccuauuucccuaaaaguuaaugaaaacaaaaaucaacaaccauauuccuacucgguaaaaauucuucacugucucuuacaacauauauauauuacuagaauugguauaguuuuaaaaccacauacgauuuuaauugguauuaaguaaaugcuuguugacuaacaggagguagauuuaaaaauuacaauucagaagucucagcccuccucccacuuuccaguaaaagagugcagagcgcuggccaggcgcgguggcucaugccuguaaucccagcacuuugagaggccgaggcaggcggaucaugaggucaggagaucgagaccauccugacuaacacggugaaaccccgucucuacuaaaaauacaaaaaaaaaaaaaaauuagccaggcgugguggcaggugucuguagucccagcuacucgggaggcugaggcaggagaauggcgugaaccugggaggcagagcuugcagugagccgagaucacgccacugcacucaacccugggcaacagagugagacuccgucucaaaaaaaaaaaaaaaagagugcagagagcugaggcaaugaaagacuagcccaccgcugcagaauaaauggauugggucauuccuauguuuaaaaauccuguguacuuacaguaauuucuguuuucuuucuauuguuaauaaguacuuuaaaugaguugugaacuuauuaaaguuguaaaaguuaaauguuaguuauuugagacagggucucgcuuugucacccaggcuggagugcaguggcgugaucucggcucacugcaauaugugccucccaggcucaaaccauucucccaccucagccucccagauagcugggacuacaggcacacaccaccaauucuggcuaauuucuuuuguauuuuuuguagagacgggguuuugccacauugcccaggcuggucucgaacuccugaguucaagugauccacccaccucggcuucccaaagcacugggauuauaggugugagccacugugcccagccgaauguuauuuucuuuaauuguaaugauagguucaaauuccuaaagaaaauucuuaguaaauacuacauuugagcuucucuuuuccaaaauaauugauacaggacuaacauuuuguacagucaccuuacuauaaugacaguuuuaagguguuucugcuguaguaagggacauuugucuugcuugugagacaaagauggcaggagagagaggaaagugacuucacuucaaaucacaaauuuucaucuuagguaauaaaauaguggacuugccaauuccuaaggcaugagguaagauucccaacagagguaucaucacacuacuaauuguuucuaucucugcaaaauagaggcgguguuugucucuguguguguggggggggugugugugugugugugugcgcgugcccacgugcaaacacgugugcauacugcuuccucacauuuccaauuuugcugucacuuauuuggaauuucaucaaugagugauuagaugagacuuuggggguauuguauacauauuguaauugccacuguugggacuuuuaaaacaaacagaauuugaucuguacuaucacuggauagauaagcagugcccucaggaagcuaauucuaagaacuauuacagcuuauauaugaaauacugugaauucuaaggcagucacuuuugacugugcuauucucuggaagcauauguuguuggaauuauaaagucugaaaaguucuucaaauauuauauugacaaguggagacaggacuuuguagagaagcagguauauacaucuuuguaggaaacuuuuuacaauuugagauuugaaauuuguaagcagcagugauuguaucuauauuuucuacugaggcaaaaauauugacagucauguauaaugacuuacacauuuaauaaaggguacucuuugucauugugagucauuaauuugccucaagcauuuaucuaucugcuaugacgauucauaaggaauacaaagauuuauaaaaguuuuacaaaucuuuauacauuaguguccuuuggccaaaucuuugcuuggaauuuaaugaaagagaaaaacauaacauuucugugguagagauucagaagaaaaacauuuucaauuacagacacaccauuauaagaauaucaugcauuuuccagccaaauauucagaauaagaguuacauguaccccugaucauaauacuuacauaacgggaucaaacauauuccgaaucuuuagacacggugucaaacuauuugguggugaauuucuucuaucuaaaugaaaugcuacaaaaaacaaguuaguuuuacuauuugacauuguucuaguuuguugaaagguauucaaucauucaguucauucaaaaaauauucacugcaugcuuuuacuaggagccagaccccugguuagauguuaaggugaguaagacagucauugcuaucaaagaguuuacaguuuaaugggagagacagaugauaaagagugucauguaagaaaguacaacugugauuaaguccuuaaaaaaaaaaguacaaaaagcuuuuuaaaaguaacuuaaccucauaugagaaaauaaaacuucccugaaaaagugaaauuuaugugggaacugaagaauaaaaauuagcagggugaagagagguguguaaaggaagauuucaagcagaggugauugcuuguacacagcuccuggggcacgaaggagcaaauguggcuggaguagaaagaauagagauaaaccuacagaagaugucagauuauuuaagaugauguaggcuacaaaaaaguauuugggcauuaugguaagaguaauagccacucaacuguuuuaaggaguagaauaggaugagaucugucuuuuaaaacuacauauuuuaaaaauacauuguuauguggagacucagguaaaagcagaagugaaugcaagaugaccaguuagaagguuauuauuauauuauaguugucuaagaaggagaggauaaugauguggguaagacaggccaacagugcaagugacaagcggauagaaucaggacauauuauggaguagauaugacaugaccuguugaaagguuggacaaagagggauaaaggagagauuaagaauuaucccuaaguuuauggcagaaucaacucaggaaagguaucauuaacuagacuaggaacacugaagaggaucaggcugguguacauguugaaucuguggugcccaccuccuaguacagaaauauauaguuggguacaaaaaucugaaaaccagacuucauucaaaauaaaaaauuugggaguuaucccaauaugguaaauuaagucacagcaagacgauuaucuagggagaaauggcagagugggaaaaaaaagauggccuugagaaacucuaacaccuagaggugaagaaaaagaggauaaucuagaaaaggacugaagaaaaagucugagguaggagaaaaaaaacagaagaagguggcauccccaaaucccagugaagaaaguuucaaggagggcugaacugucaaacacuguuaagaggucaaguaaaauaaggaauucucuauuuucaguuuauagggaaacugaaaugcaugcaucauuuagaggaaauaguauaaucauuggcaacaugaaagcaucauuuuuuuaauuuaaguucugggauacauguacaggacaugcagauuuguuacauagguaaacgugugucauagugguuugcugcaccuaucaacucaaacccaucacccagguauuaagcccugccugcuuuagcuguuuacccugacagagcaucacuuuuaugccauguuuaaagaagccucuuauucaagcuuuuucaaagugaaaauuaauuggagaauaaaaaaggagugacuggacuuuguauugcauguccaaaacaacuuaccuuuuccacaaauacuauguuuagcaaauacugacauacuuuuauagggaaaaagucauaauuuucugaugcauuguuuucugcuuuucuguguaguaaagguuuggguacauaugacagccaaucuucaaaacccccuauaaacuuaccccuuucuuauuuauacauguuuuugaaacuauguaggcauuaagaaaaauauggaaagauacccacaaaaguuacuuggcaggaggaauauauaaauagaaaggucuuaguaagaggaggcaggcaaaaacuggaaaaaaaagagcaguuaaaaaguuaugacuucacuuauauacauauauaguuuauauauauuuuauuguauauauaacauaaauuaugugucuuauuuacauaaagaaauuagaugaaaagaaugcaguuaauauauauaauacuaaguugcuucauuaagugaaaaaggcaagauucaaggaauauucaucuuuauuaaagauaaaccauuuauguuugcauuagcaaagauaaaaguguggaaggauacauaagaagcuaacacugauuccuucuacgaaacagaacgagagaguuuugccuucauacaucuuugaauuguacuguuucacuuaacacauauuugucauuuugaaaaauuagaagaaaauuacuuuuuugauguuuaaaaauacauaccuugaccuugccauacuuuagaagguauaacuaauauuuugucacaggaugcagaaggcuggauccaccgccaaaccagaaaaucugcaccaccuauucuucguguuuccgugcgaacucuagacucauuagcagcaaggaagucaacagcucuaucccagacuuucuucauuuuuuuccuaucaugugaacaaaauggcaaauuuacuaucaucuuggcuugucaucuuuuugaaauauuaguaucugagguaauaguuaacucuagcuguucuuaccacuacucauggaguuuguucaaagaagauuuagaugccuauaucucaucucagauuuucugaguuucaauuuccagagcuagagcacaaacaucuguauuuuuuuuccccaaaagcuccacuggcuuuauguguugcuagggucaagaugcugcuucaggauauggaauuaucuuuuauuuucaaaaaguugcauuuuaguuuuuacuuuaaaagcuucauuaauaauaaaguuaguacuuaaaaaacauuaguaaaacaccagccacuggcugucaucuauuucuuuaucaagaugaaauuaaaggaaauaagauggagacuaacaacaaagaaucaagaaugccuaggaaugagaaugacuuagaaauccaggugucacucaaaaucaggagaauggaagagaauuuagaaagagaguauaaaguacaaaaacaaagcaaaaccaaaaaaaaccugugcaguaagcaagucuaguugagaagggucacagcucucaauauaauuuucaauacugcagaaagcacuuaaauuuucugauuuacuugaacucauaaugcuuugaacacaccugucaugaggcuguauuaaggaaucgcguacauguggaauaggcauguaagguuguaaaucuuuguuuuccuggcaggcuucauuaugacuucguaaaacaucuaaaaauaaauaaaauuuacaaaugaaucaaucacuugacauaauguaguuuaaucaugcaaugacucuucuagaaauaguugagauucuuacaaauaucauaccuauaaucuuuaccaccauaucauacaucugccuuguuuccuccucuucuuuuguccaucgauauuucauguaacgcagaacgacacaaaccaucacuacaccuguaauauuaauauacuuuguauuuuaaaaauuguggucaauaucauucaauaauauuucagugauuauuuuaacugccacaacggaaugaaccuucaagacagauggcugaauuagcuauauaauuaaaacuacauaaaaaaauuuaauacugaacauuuuccaaagauucacuuucuagaaaaaagcauuucuuccauuacacugauaagugaacauuuaaauucuaacuacuauuuaaaaauauauauauauaacuauguuucacaaacuuuuuuccuuugaagcauaaaacgacuagaaaagugaaccucaugagauuaaacauacuaaaucuuacuuuaaguaaaaugaauuuuucuuuuguuguuguuguuuuugagauagggucuuacucugucauccaggcuggagggcaguagugcaaucauggcuaacugcagccuccaacuccugggcucaagaaauccuccuaccucagcuucccaaguagcugggacuacaggcacgugccacuaugccugucuaauuuuaaaaauuuuuuuguagagguagggucuaugcuucccaggcuggucuuaaacuccugagugcaagcaauccuccugccucccaaagugcugggauuacaggugugagccacuaaagcuggccaaaaugaauuauuuuuaaagaagaaagaaagaaugaaaaaacaacucucaccuaaaucccuauuaucaauuaaaaaaugauaaaaauuuuaaauguagguaaauuacauuuuaaaaacuaaauuuuaauaaacuuuauaacacuuuauuauuuaaaaauaagcucaauuuuuguauuuuucaauucuacuuucuaaaguagauuucuauguauauacugaccacacuuguuuuucugugacagucuuauaacaaaguuuuauuucuaccucuccuuauauuacugcuuucuaagccuuuagaaugauucugacauuauuuuuauuauauuuagugaagacaucuagcugugacuuauguggcaaccaucacaaaaaugaauucucaacucuggcauuuagugaaauacacacaaaaauucaggcugcaauuuaucucauuucuuaucuuuacaacuuaccuaagcauaacaacaauaaucugugaguuacaguaacaaaagcacgucgaaaacgacaccaaaaagacaucaguggucuuguggacuguaaaaacugcacaucaguuauauuugucaauucuuccucagggccaaaaccaacacaccuauuuaaaaauaaguaagguagaauuuaaagucaaaaaccauuucucccaguacagaauggucaaaguggaaaucagauccuuuaccuuauuccaacaucuuuuccauuuucuaagauccacugcaaugaaguguuaaauauaccuucauauucaggaccuaaauccuaacaagaaaaauagagaaaaauaacuauucuuaaucuacauucgacucucuguaaaguauccuuuauaacacacucuauauaacauuuuuauuuuaacuacauaacauaaaauauucauuacagaaaauuuuaaaaagaaugagaaaaaagaaaaaaaaaguuagcauuuucccacuacuccaauauaaucaguguuaauauuuugcuuuuuuauauuuuacauauuugggaacugagucucucucacucaggcuggagugcagugggacaauuuuggcucacugcagcccccgccuccuggguucaagcaauucuccugccucagccucccaaguaguugggauuacaagcaucagcuaccaggcccagcuaauuuucuuuuuucguacuuuuagagagacgagguuucaccaugcuggccaggcuggacuuaaacuccugaccucaagugauccgccagccuuggacucccaaagugcugggauuacagucaugagccacugcgccuggcuuggaaguucuuuuuuuaucauuaguuuaucagugccaucauaagagugaauuuaccacuuuuaaaaaugcaauauuauuuauagaugaacaaauaaauggcaaacucuuccagauuuggauguuucacagacaaguauucucaacacauaaaagcaguaagccuaucaacuaaagaaaaacugaccggguuaccaauuauaagauuugagcauucaaguaaaaaguagaauuuugaaaaacuagcauucaucuuugugaccuggacaacuucacaauacuugaagaccuuuccaaugagauuugugugacauuaacaaaugcaguuuuuugauauggaauaaugaaaugugaccaaugcaucugaaaaugaccaaugcauuugaaaaauucugauuuuuauaaaaaccaaucacgcauagguaaaagauccauucaaaguacaaaauaaaaggauuuuaugagacaagaguacaaaaaguucacuggcacagucugacauuccacauugcaacuaacauuuaagaaacuacuacuuauagagguuugguaugguaucaaagaaaauaucuaucuacaauuaccugaaaaggcaacuaaaauacuuuccaauguuuugacuacauaucaaugugaggcuggauuuucaugacauacuucaacuaaaacaucaugacagauugaauaaagaagcagauaagaauccagucaccuuuuauuaagcuacacauuuaagagauuuauaaaauauauaacaaugccacuguucucauugaauguuuucauucuggaaaaguuauuuuucauaaaaauacauuacguuaacauauaauagauucauuuuucuuauucuaaauacauaaauuuuuuucaguuuuaauuuuuaauauaaacauguauuuguaauacauauuuaccauuagaaaguaaauauaucuuucuaauagaaacaaaaacauauaaauguauaucucccacaaacaaaagccagaguccucaguaauuauagggaaccaaaaagcuuaagaacugcuauguguggguagaguauuuuuaaauuaaaauaguaaaaauaaaugugguaucauauuacacauacuacuguucuacuuguuuucuucauggaacaaaauauugugucaaugucaguuuacauggaaaaaacccuauuuuuuucaacaaaauaguauuccauuguaugauuauucuauacuuuuaaucaacaccuuauuaaugaacauuuagaauauguccaauuuuuaaaaauuuaucaaauauaauacuguuauaaacaccuuuaccaugugccaaguacuauuuuagaaacuagaggugcagcauaaacaacacagugaaaaauucccuguguucauggagcuuguauuauuaguaugucuuuaugucccuuuugagcaaaaaaugaauuuuuuuuuuuuuugagacagagucuugcucugucacccaggcuggagugcaguggugcgaacucgccucacugcaaccuccaucuccagggcucaagcacagucuugugccucagccucccaaguaacugugauacuacaggcgugugccaccacacccagcuaaucacuguauuuuuaguaguaguagagaugggguuucgccauguuggccaggcuggugucgaacugcuggccucaagugauccgccugccuuggccucccaaagugcuaggauuacaggcaugagccacugugccuggcucguagaggaaaaaaugaauuucuaaaaacagaaauaaaaagucauuucaaauucucucuaaaaaaaagauuuuucuaagaaguguccuauuguauuuuaucaacagauucuucaacagcauuggaaauuauaagguuuucauuugaucaguauaguuuacuuccuaauauaaaacugguaaguuauucuaauguaucaaauuugcaaauguaauaaaaaguuuuauaaagcagaacuaaucuuguuaggcaucauuacaugaaacuacuauuaggauuuuuaagauggugaagauaacuauaggccaucuguuuuuuuaagcuuggguguuuauuauagcauuuacaaacaucaaaaaaauugcagacaauguauuuaaugauugaaaaaagguuuauauaugagaucauuucaauggauauuaugaacuuagaaauaaucaugaugagagcuaaacagcuaucugcuuaaaaaaauaaaacuacaacauuuaauuuauauauacagucauaccucaguauucacagaggauugguuccaggaugccccauggauaccaaaauccacagauguucaagucccugauauaaaauugcauaguauuugcauauaaccuaugcacaucauucuuuauacuuuaaaucauuucuagauuacuuauaacaccuaauauaaaugaauauagauagcuguauuuuuaaaaucuguauuuuuuccauuguacuuuuuuucuuuuuauugccacuaagauuuuugauccacgguugguuaaauccauggaugcaaaacccauguauacguagggccaacuguauuuauaauuauaaaauauauguacucauaugaguagcacaagaaugaggauacaagugauuuuuauuugcuuuaauauuguuuuaaaauauuaugcaauaaaguuacacaaaauaauuucaggcaauuaguuucaauuguuauaaauauacuacuagaaaucacuuuguauauaaaugaaaaucuacaaagcaagauuaauauagguuaucaguguagcugaagacaacauuauugcauuuagucuucuuuguaauguugucacuaccauacauuuuuaaaaaggauuuuguacucauuuaguucuucaaagacacagaugccacauaguacccuucaaauacaugcauauauuaaaaaucaaugaaauaaauguuguauuuacuuguacuuauauacaugcuguucagcuuguauugcuaugauuugccuaguaucauggcaugcuuugcauuacuacauauaauacuggacaaguauaaucuagucuuugaagaccagacuauaaacauaaguuucagauaacauaaaaacaaacucccaagguuauuagugcaaauuuuaaauauacaaauuuuaggaggcugacauuauaaauauuacuguucucaucaaauauccuuaaaaaauguacacaaugguucaaauuaacaaagacaccuacagaucuaaaaagcuaaguacgaggaggaaugaaggccuuaaaucucuuaguuauaaaauaguaaggguaagaaaagaggaucuguuguuauuuucccuuuuucuguuuuccuuuccuuuauuaauaucacuugacauccacucauuaucuggaauacaagaaaaccauggaauguucauuuuauggguacacauucucaauaaacaauugauuauuuaaaaccucauuaaggacuuaaugggguguugaggucuaaaauaugccacuauuuccacaaauauauauacggcauucuagaguauuagaaaauggaauuuuuauaaaagcaaaaauugaauuauuugcuugugccaaauaguugaugcuaauacuguagcauacauagcauauaccugauuuuaacaguuuaaacuguuuuauuauucacuuuuuguagccaccuggaaagcugugggcacggcagggguuggucagcuuuuucuuuuguccguaaagggccagagaguaaacacuuuaagcugugcagccauauaaauuucuuucuuucuuuuuuaaaagcaagcuuuaaaacuguuguaaaaccacagcucacaagccauacaaaaacaggcaggcuggaucuggcccauaagccauggcuugcuaaccucuaagguaaggcauuccagcaucauaaaacaaacauuuuccaauaacugaugacaaaaaucaggaagaaacuaaguuuuuaauuuuuaaggcacaacuuuuauuacuauuguuuauuacuauuuacuuauaggcaagagcucagucaguauaccacugacugcuucauguaaaucuuucuaaauuugaaguauauuuucccaaaucuuaaaucuaacacauuauguguguacucacgcauacccccaugaacucucccaaauguucuuuauuuucaaaaucgugggucaaaaauguguacuuuaaaacccacaucagaugcucugaacuuggauuacaguuuccaaguacaaaaauaauacuguuucauuaaauaaggcaacaaaacuuuaguuaguaagaagggaaaaaggcacugguauagggagaaaucaagcaaggacuaaaaaccuaauauggauaguuuaugaaacugauaauuuacacaguaauagccaugcagccuuccagcuggugaauauucuagugaacugugagaugaucuacacuaugcaucagauggcaccuuuuaaaauuaauuaaaauauaacacacagaaauccacaaugcugaacaggauguaacuccugauucaguaagaauuguaugaucuuucaccugcuagaauaacagaaaaaaacauagucuuuagaaucaaguagacccagaaccagaugcuggcuccauuacagauuagcuauauguacaaccuuaaaugggacaagugaaaaauaugccaccuauccagauguaucuacuuugaccacuuuuucagauccuaacccuuaauagcaccagucccuugcccacucaauagcuggagcuaaggauuaugaauccacuccauccacuuaagaggcagaacaauauauagaaaagagcaaguacuuugguucuauucccaguuccaucacauaguagcuggauacucuaguuauuagccccucuaugguuuaguuucuuuaugaaaugggucuaauaccaccuaucuuguuggaucauucugaaauuagaauuaacauauagaaaguaccacacuguacuuuauaaaccuuaauuauuaucauaaaauuucccccucacuccacuucucagaacacucauuuuuccacacagacuuuuauuaacaguaauuagcauucuaggccauaaaagucuauccagccccauaauuugacacauuugcagcugucuacuuuccuauuauuuucuucacaaaucuuaaacauauucauuguguuaaagguuaagaagguuuugaaagcaaccuaggaacguaaacccauucauuacauuauuccauaaaaaguuauacaaagucacuaccaucuaacuuaaaaaccaaucauguauuuucacggaaauauaaacuauguauuucuucaauguuccaccagagggaccucuuaacuuuucacaaauuaaaauaagcuuucaauaucaaaaacaacgaguuuuuuaaaaagcucaagaagagcacuggaguaguuagaaaaauaguguuuaaauuauuuaaauuaguuauuaaguuuauuuaaauuuccuuugaaggagaaaacuggauaaagaauuaaacauaaauaauuaaauucaagaaaacaaaaauauguuacugaggcuuauucacucauuuuacuccaucaaacauuuacuauacucacugugcuuaaaauguacuagaaguugugaaaaaauuagcuuacacuuguaggggcucuacacauucuuugguuuauuuauuccucaaucuaaaaacuuaaauguguugcuggugaaacuauagugcaaauacaugaaaauauguaauagaucucuuucucauaagcagaaggcccuccauauagauauuauaauccuuguuugauaucaacuuuguagugaguuuccuccauauuuaugccagaauauggauaaaauaacauagagaauuuuggcuagauugugcuaaagcagucauuuuaaauugggaauuaauauagcaacauauaucaaaagcauuuuuaaaaguucaugcucuuugaacaaguaauuuccuuuuuaggauuauuuccuaagaaauauuagaaaauuaaauacuauaugcaaagauuagagugauuucauaauauugaaaaaccacaaaccaauaaaauaaaaucauaccaugaaauauuauucagugauagaaaacauuuucaaaaaucauucaacgguuuuugaaauacacacaauaauuucaagggaaagacacaugaauauuuauaguauaaaauauuuauaauaaaguaauauuagcuuuagaaaaaaauauuuauaauacuaauuagaggaaaauggaccaaaauuuuaccaguuguuauccuuagguagugaauuugaagcuuuuuuuccuuucauuuuccauaugaauuaaauaaugaguguuauuuaauuuauuuacuuauuuuugagacaggcucucacucugucauccaggcuggaguguagugguacaaucaagguaauccucccaucucagccucccgaggagcugggacuacagagggucuacagagccaugugccaccacaccuagcuauuuaaaauuuuuuuuuuguagagacaagaucucacuauguuccccagucuggucuccaccaccugggcucacaugauccuccugcccuggccucccaaagugcugagauuauagguaugagccacugugccuagccaauauuauuuaauuuuauguugaaaaaauaagcauuauuaaaaauaguacuuuaagacuuuuauauagaccuuaaaauuacauuuuugggggaaaaaaauccuguuuaaagcucucucuguuuugcuuuugacaguacaaacugcgucuaugguggugacaaaccacggcagguuuuauagcauuugaaaaacaugaaaaaugagauuccaaaaagaaaagguaacaaaaacacacauacauaaaccuaacuauaaaaaaagaguauuaacauuuuacauaauucuuuaagaaugaaauuaaauuaauccauaaucuuauaaaaauaugccacagaaauucuacuaaauuaagacaaaaccgaauaugaaacauaaaauaacucaagauaaaaaaaucuucuaaaggcuacagaguucacugcagaaaaagcauuuaauacaauguaacaucucuucaugauaacucucaacaaacuagguacugaaggacacaauaaaggccauauauggcaaacccacagccaacagcauacugaaugagaaaaagcugaaagcuuucccuauaggaaauggaacaagacaacagugcccauucucaccauucuuauuuaacauaguauuagaaguccuagccagagcaauuaggcaagaaaaagaaauaaagggcauccaaauuggaaaggagaaaaauuguuccuaugugcagaugacaugauguuaauguggaacacucuaaaaguuccaccaaaaaccucuuagaacugauaaauaaauuaaauaaacuugcaggacagaaaaucaauacucaaaaucaguaacauauaccaacaaaaaacuagcagagaaagaaauuaagaaagcaguucuacuuacaauagcuacaaaaauaaauaaaugaauaaaauaccuacaauuaaauuuaaccaagaagguaaaagauaucuaaaaaaaaaccauaaaacaccauaaaaagacaucccauguucacaauuagaagauuaugaaaacuacacuaccaaaaauaaucuauguauagauucaaugcaaucccuauuacaauaccacugacauucuucacauaaguagaagaaaacaauucuaaaguucauauggaacuaugaacagucaaagcaauccugagcaaaaggacaaagcuggaugcaucacacuauaaaaccucaaaauacacuacaaagcuauaguaaccaaaacagcaugguacuggcauaaaagcagacacacagaccacuggaacagaauaaagaccccagaaauaaauccacguauuuacagccaacugauuuucgacauaggugcaaagaccauucacuggggagaggacagucucuucacuaaauggugcugugaaaacaggcagaaugaaacgagcccccuuauuucucaccauacacaaaaaucaacucaaaauggauuaaauaauuaaauguaagaccuaaaauuauuaaaguacuaaaagauaauacaggaggaacgcuucaggacauuagucuggacaaagguuuuuauggagaagacacaaaugcaaaaauaaaugguguuauagcaaaauaaaagauucugcacagcaaaggcagcaacagagugaagagaugacuaguagaaugggggacauuugcaaacuauucaucugacaagggauugauauccagaacacacaaggaacucaaagggcaaaugagcuuagcagacaucucuuaaaagaagacauacaaacaaccaacaggcauauggaaaaaugcccaacauaugaaucaucagggaaauacaaaucaaaaccacaaugagauauucacucaccccaguuagaauugcuaguaucaaaaggacaaaaaauaacaaaugcuggcgaggaugcagagaaaggggaacucuuauccacuguuggugggaauguaaaucaguacaggcauugcagaacauaguaugguggauccucaaaaaauuaaaaauagaaccaccauaugauccagcaaucucacuacuggguauauauccaaaggaaagaaaaucaguaagugaaaagagguaucuguacucucauuuauugccgcauuauuaacaauaauauggaaucaaccuaagugcucauuaacagaugaauaaagaaaaugugguauauauacaauggaauacuauucagccauaauaaagaauaaaauuaugugauucacaucaacaccgaugcacuugaagaacauuauguuaagugaaauaagccaaccacagaaagacaaauaccauauauucucacuuguggaagacaaaugaguuagaaguccaaguuaaggacuacuaagaacuuggcuuauuuuaccuuuggggaaacuaaaaaguugaucucauggagguagaagagaauagugguuacuagaggcuagaaaguggcaaaguggcagguggagggucuguagccagagguugguuaaaugaaauuauaacuagguaggaggaauaaauucuaguguucuauaacacugcaaggcaacuauaauuaacaauuuauuauauauuuucaaauagcuaaaagagcaaauuuugaauguucccaacacaaagaaaugauaaauguuugaggugauggcucauuuauccugacuguaucauuacacauuguauacauguaucaaaauaucacacuauaccccauaaauauguacaauuaugucaauuaaaaauaauaaaaguggccaggcacgguggcucacgccuguaaucccagcacccugggaggcugaggcgggcagaugacgaggucaggagaucgagaccauccuggcuaacauggugaaacccugucucuacuaaacauacaaaaaaauuagccaggcgugguggcaggugccugcagucccagcuauuugggaggcugaggcaggagaauggcaugaaccugggaaggagagcuugcggugagccgagaucucgccacugcacuccagccugggcaacagagcaagacuccaccucaaaaaaaaaaauaaauaaauaaauaaauaauaacaauaauaauaauaaaacacaaaaagcuacaguucauuaauaucuuuuuuuaaguagauauaagcaguuuccaauuuaacucaugcaagagugcuucuaguaacuuuuuugcugcuagucuucaguagaauuaaucuuauacucuauugcugccuggcuuagacuuugacuuaccccaaccccgcaucugugucccuucuuuuuaacuuguaccauugcugacccacagcuacaagaaaaugguuggaagaagugaaagagagguuaauaauuccacaccaaccccugccucuuccucagcuccaccuuaauuacuggucagguccuaucuuguccccagucccuaucccauuucuucaguccuucaaacacaguacagucaguccuuuuauccauggguuccaccuccauggacugaaauacugaauagagucaauauagucuaucaugaaucaaaaauaucugggaaaaaaacagaugauuaugucggcauuaaauuuguacagucuuuuuuuuuuuccuuauuauacccuaaaccaggaguguccaaucuuuuggcuucccuuggccccacuggaagaacugucuugggccacacaaaaaauacauuaacaacagcugaugagccaaaaaaaaaaaaaaaaaucgcaaaaauucuuauguuuuaagaaaguuuacaaauuuguguugggccgcauucaaagccauccugggcugcaaguuggacaaguuugcacuaaaugauacaguauaauaauaacuauuuacauacaauuuacauuguauuaucaguaaucuagagaagauuuaagguauauagcaggauaugcauagguuauauguaaauacuacaguauuuuauauaaagaacuugagcaucuacaaauuuuuguguccaugggggucccggaaguaauccccagauaccaaggaagaauuaauccuauuucauaugcuuuaagagucucagcauucuucugaaaagcaaugaaacuugcuccaggaauuuaugaccaaucauaacacagaucuacgguauuaccucucagagaucaaaucucagagguuuaacuaccuaacaaaaagaaaacaggaaagaaacacugaaugggauaagauaguccuacuacuagaagugaaaacccauucaauuauuuuauaaggaauaguuugcuugcuuuggauucucacuaugccuuucuucauggaauauuuuauucuaugucuccuuuagccucaauccaaucccuuuuuuugccugcacccugacauucguccaucccauaacacugagcccuauaaucauaacuccuccuuagucaagaucuuuuugaauucugauccuuuaacuguccagucuauuagcuauuacacuauccauaaauuuuacugucauuaauguucucaucuaggucaaaauugaaaauaaagacaauaaacaaccuuaaacaaaauuucuguggcauguuauuagagauuacucgcuagaguggcacugauuuaauuagaaaacacagaaauugaauuuauugggaagcuacuauaaucaucaggcacugagcuaggcauuuuauauacucaagucucccaacaacuuugacagguauuaacggcagucccacauucacagagaaacauguucagaaaaguuagagacuuuaccaaaauguaauagcuucuacuggcaguaccagaauuugacuccagauauaaucuccuuauuauacugucuuaggaucuuuuugguaccuacauauaagucaugcauuaaguuaaaaacucagucaauauuucucuuuguugacaagcauaaucacaggagacuauuaccaaaacuuugcugaaagccuuaaaacauauacuacauucuuaauuuuuaaaaaguggaggagugacaucagcagaauaggaagccccagacccuccuucccucaaugagacaccgauucaacaaaaauacauggaccaauuccauuugugaaaaauccagaaauuaguuaaaagguuccugcaccuaggcaagcacaaaaccaccuguaucaaagcuguuaggaaaauucauaucacucacuucccagacacucucaucaccccacagggcagugcaauagagaggaaacucccaacucguggcuuccuccucagaaggaaaacagaagacuagaacauacaucuaaugaucugacuuuucggggcaacugguuucugucaugucugaaucuaauaguugaaagacaccaaauuaaggacuacuaagaacaaaggcaacagcacucacucaccauugucccuacccccagcucggcaugaagaaaguugagaaaaaccccaacucuuggcuucucccuggggaggaaaaaaguuagacaugcauccaaaguucugacuucacaggggcaaggaguguugccucgcuggcuucugccucaccugauucaaaaugcggauaggacucaguauacuccagaugccugggggccacuaagaagaaaaaagagcugggccaggagcaguggcucaugccuguaaucgcugcacuuugggaggccaagauagguggaucacaaggucaggagaucgagaccauccuggcuaacauggugaaaccccgucucuccuaaaaauacaaaaaauuagcugggcaugguggcgggcaccuguaguuccagcuacuugggaggcugaggcaggagaaucgcuugaacuagggaggcagagguugcagugagcugagaucgugccacugcacuccagccugggcaacagagcaagacucugucucaaaacaaacaaacaaaagaguuggauagcuuauggcagcuccagauaaucuacagacaccagggauaaccuacagauaccagggaucaaaagauuauaaacuaugagaaaauaaaccagcaaaacuucucuaauuggaaauucacaggcaaaaauccagagaggucacaaccacaaccacagaaaagauaucuaagaaauccagaaugucuacacagacauauugguaaaagacuuuccccacacaaagucuacaaagguggcuguuuuuuuuauuucuguuguuguuaaaugcacgaaucccaacacaaaguaacaaggcacaugaagaaccaugaaaacauggucaaucaaagaaacaaaauacacuuccaaaacauauccuaaagaaguagaagucuaagaauuacaugacaaagaauucagaaaaagccaucauaaagauacucaacaagaucaggaaaacaaugcaugaaucaaguaagaauaucaacaaagagacagaaaauauuuuuaaaacccagaaauuuuggagcuaaagaauaacugaauuuaagaauucauuagagggguucaaaagcagacuggaucaaacagaagaaagaaucagcaaacucaaaagaaggucauuuggaauuauucugucagacaagcaaaaugaagaaaggauaaagacaaguaaagaaagucuaaggaccuuaaugggacaccauuaagccaaccaauauaaguaauauggaaguuucagaaagagaagaaagaaacaggcaaaacaaaacaaaacaaaaacaaaaacaccauguuauuuggggcccaaaacuccccaaaccuggggaagaaaauggguauucagacucaaggaagccaaugaauccuaaugaggauagaccaaaauaaguccauauucagacauguuauguucaaauuguugaaaaccaaggagaagaaagcagccaagacgcaagcuacucaucacauacaagggaguccccaaaauacuuuacaaagcaggagagagugaaauaacauauucaaaguacugaaagaaaacaacugccaaccaagaauacugugugugugugugguaggggggaggggggagcaguacaucguacuauuaaaaaugguauacaauuuuuuauuucuggaauuuuccauuuaauauuuucagaccauaguugacuagguguuacugaaacuguggaaagcaaaaccauggauaaaggggacuacuacauauccagaaaaaccauccuucaaaaaugaauaaagauuuuuucagaauaaaagccaagggaguuaaucaucacuagaacugccucacaagaaaugcuaaagugacuccaaguuaaaugaaaggaugcuaccuagcaaugcaaaagcauaugaaaauauaaagcuugcugauaaagguaaauauauagacaaaaucagaauacuguaacacuguaauggugguguguaaaucacuuaauugugauauacaauuuaaaagacaaaaguauaaaaaacuuuauaaaaauauguugaugauacacaauaugaaaagauguaaucugugacaucaauaauauaaaggaugaagagagauauaaaaaaguagacacuuuccaugugacuaaaguuaagguguuaucagguuaaaauauuacugugaauauaagauaauuuauauaagccccaauaguaaccacaaaugccuaaaaaacacacguaaaagaaaaugagaaagaaaucacagcuugucacuacaaaaaaaaaaaaaagacacaaaaaagaguaagauauggaaaaggggacaaaaaagcuacaacacggagagaaaauauucaacaaaaaaggcaauauaaguccuuuccuauuaguaauuacuuuaaauguaaauggacuaaacucccaaaucaaagcacacugaguggcugaaugaauaauuaaaaaaaaaagcuccaauuuuaucauguguacaccuuagauuuaaggacacacacaggcugacagccaaaagauggaaaaagauauuccaugcagauaauaaugaauaaagaguagggguagccauacucauauuagacaaauuuuugacuuaaaggcaacguagugagauccugucucuacaaaaacuuuaaaaauuagccgggugugguggcaugugucuguagccccagcuacuugggaggcugaggcaggaggaucacuugagcccaggaguuugagauugcaguaagcuaugaucucaccacugcacucaagcgugggugacaggccuagacucugucucaaaaaaaaaaaaaaaaaaaaaaucaucacaugagacaaggaaggauauuuauuauauaaaugacaaagggaucaauucaucuggaagauuuaacaauucuaaauauguauguaucccacauuagaagaucaauaagggagcagaggacuugaacaacaauuauagaucaaauggaucuaacagaaauauacagaaaauuccacccaacaggaguagaauacacauucuuaugaagugcacauggaacauucuccaaaucagaucauauguuaggccacaaaaaucuuaacacauuaaagacgaccgaaaucauaccaaguaacuuuucacaccacaaugaaaugaaacuaaaaaucaaaagcagagaaaaacugagaaauucacaaauauguguaaauuaaacaacauucuccuagaacaagcauuggaucaaagcagaaaucaaaagaaaaauuauaaauguauuaaaauaaaaaaauaaaaaacacaaccuaacaaaauuuaugagaagcaguaaaagcaauacaagagagagguuuacagugguaagccuauguuaagaaaaaaaaaucucaaaugagaaaucuaacuuuacaucucaaagaacuaaaaaaagaacauacuaagccuaagauuagcagaagggaggaaauaauaaagauuggagcaaaaauaaauuaaauagagaauuuaaugaaucaauaaaacugagaguugauuuuuugaaaagaucaaaauugacaaacccuuaacuagacuaagaaaaaaaucagaauucauuucugaguuuauuaucuauuuuauuaaagaagaauuaaugccaauccuauucaaauucuucugaaaaauugaaaaggaugaaacaauuccaaacucauuuuaugaggccagcauuacucugacaccaaagacaaugauacuauaagaaaauuacagacuaaaaucccugagauacaaaaauccucaaaaaaacacuagcaaacugaauucaaaagcacaugaaaaggaucacacaccaggaucauauaccucagacacaaagaugguucaacauacaaaaaucaaaacugaguaugccacauuaauagaacaaaggauuaaaaucacaugaucaucucaauagaugcagaaaaagcauuugacaaaauuaaauauccuuucaugauaaaaccauucaauaaagaggaauagaaggaaauuaucucaacauauuaaaggccauacauggaaacccuuagcuaauaucauacucaauggugacaaacugaaagauuuuccuggccaggcaugguggcucacacuuauaaucccagcacuuugggaggccgagguggguggaucacgugaggucaggaguucgagaccagccuggccaacauggugaaaccccaucucuacuaacaauacaaaaaaauuagccaggugugguggcacacaccuguaaucccaucuacucaggaagcugagacaugugaaucgcuugagcccaggagguggagguuguauugagcagagaucacaccacugcacuccagccugggcgacagagugagacucugucucaaggaaaaaaaaaaaaaaaaaagagagauuuuccucuaagaucaggaagaaggccaggguggcuauuuuucccaucucuaucucucauagcacuagacauccuagccaaagcaauuagauaagaaaaagaaauaaaaaacauccaaaucagaaagaaguaaauuuaucucucuuagcaagugacauaaucuuauacauagaaagcccuaaagauuucaccaaaaaaaucuuguuauuuggcugggugugguggcucaugcuuguaauccgugcuuuaggaggccaaggcaggaggauaacuugagcccaggaguuugagaccagccugggcaacauagcaaggccccuaucucuacuaaaaagaaucuuguuagaauaaacaaauucagcuaaguuggaagauauaaaaucaauauacaaaaaucaguuacauuucuauacacuaacaacaaucugaaaaggagguuaagaaaauaaucccauuuauaauagcauuagaaagauuuagauacuuaggaauaaacuuaaccagggaggugaaagacuuauacacugaaaacuacaaaaaaaaaaaaaaaagcugaaugaaauaaaagacacaaauaaauagaaagacaucucauguucgugaauuggaagacuuaauauuacucaaauuacuauaccaccgaaggcaauacagcaauacaaaaucccaauagcauuuuuugcagaaauagaagacauaauccuaauauccauauggaaccacaaaggccucacacugacuuuaaaacauaugacaaaacuauaguaaucaaaacaguauaguacuagcauaauaauagacauaaauggaccaguggaacaaaauagagaaccagaaauaaagccacugauguaugauccaacaaucuucuacaagggugccagacuacacaauggagaaaugacaaucucuucaauaaauggugcuaggaaaacuggauuuccacaugcaacagaaucaaacuggaccuuuaucuuauaccguacacaaaaaucaacuccaaauggauuaaagacuuaaauguaagaccugaaacuauauaacuucuugaagaaaacauagaagaaaagcuucuugacguugauaugggcaauaauuucuuggacaugacaccaaaagcauaggcaacaaaagcaaaaacagaaaagugggacuacaucaaacuaaaaagcauaugugcaguaaaaaaaaacagugaauacagugaaaaaguaaccuacagaaugggagaaaauauuugcaaaccauauaucugacaagggguuaauaugcaaaaugcauaagaaacccccacaauucaauaacaaaauaaauaacccaacuuaaaaaucagcaaagaacuugaauagcacuucuccaaagaagauauacaaauggccaacagauaagguauuauauauaugcuguauacaugcuauauauacacacagauguauauguauauaaaugguauaugaaaagaugcucaacaucaguaaucaucagggaaacacaaauaaaaacacagugagcuauaaggcaaauaaguguuaaggauaggcagaaacuggaauccuacuauacuauuggaaagaauguaaaaugguacagucaauaugaaaacaguauggagguuccucaaaaaauaaaaaguugaacuaccauauuaucuaucaaucccacuucuagguauuugucuaacagaauuaaaaguagagucucaaagaaguacuugcauugccauguucauugaugaauuauucacaauagccaagagguggaaacaaucuaaaagcccaucaacaugacuggauaaagaaaauauauguauacauacaaugaaauucuacucagccuuaaaaaaugaaggaaguacugucauguuacaauauggaugaaacuugaagauauuaugcuaggugaaauaagccagucacaggacaaaaauugcaggauucaacuuauaugagguaucuguuaaucacacugauggaggaagaaaguaaaauggugguugccagggauauggagcagaggaaaacgggggccugcugugcaauggcuauagaguuucagucauacaagaugaagaaguucuagagauuugcuguauaagaaugcacauauaguuguacgguauacuuaaaaauauguuaacagauuucacguuauauauuuuuuaccacaauuuuaacaaggggaugggaggcaugaaauuuguauggcaugacuuguccacguucaaaugccagccaccuuccagggaucaacguuuccauuugcaagaacucagaucuuuaugaaauuaucuuuauggaacuggaccgacaacaagcuuuccuguaugguuuucaaaugccacuuuccacuucugagaaaucagaaugacauuuauccaucuuuaaucuuuuacuaccuuucauuaagauuuuccagaaauuauuuacaguaguuuagaaaauucaacagcaaguucucuuaguauuuggagaagaaacugaugugggacagaagauuuuaaauaaaugguuagauauuuaccugcucucuuacaugcuacuacucaccuaucucaauuucccuaugaccaauguuucuuuguacccuuuccaaauuaauaugcauucucucauagagaauguucuaaaacaaacuaaaaaaaauugaacagguggcucacgccuauaaucccagcacuuugggaggccaaggcaugcagaucacuugaggccaggaguuugagaccagccuggccaacauagugaaacuccaucucuacuaaaaauacaaaaaacauuagcugggcgagguggugggugccuguaauuccagcuacucgcgaggcugaggcaggagaaucgcuugaaccccgguugcgaacguugcagugagucgagaucagccauugcacuccagccuggggaacaagagcgaaacugugucucacaaaaaaaaaaaaaaaaaaaaaguugaacaauuuuacuuucucauaacugcucauauuauaccaaacagcaggcccaagcuuuuaacaguacaauuaaaauaaucaaacauaugauucuuacaaguagcaaugauuuauauaauuuuuuaaaauauagcuauuaaaauucuaauuucauugcuuacuuuuaaauacgcagcugccucuugaacagaaagcguucuuugacuagaacugccacauucaugaucuccuggaaagauuagcauauuauuaauuuugaaucaguacucucuuaaacagaagaaaacaaacauaauuaauucaaauauuuuauacauuauacaauuacagguuauauuauuauaaucaguaaagaaagaacaugaacaauauuauuuauaauuucuagaagaaauuccaguaagaauauaaacaaagaaauuccaguaagaauauaaacaaacaacuaccauuacauuaaccacaacuuuuaaaugcauuucaguccaaacaagaacuuaucuuccucuuauauucccaacuaaacuguaagcugguauaggaacuaugucacacugaugccuauccacagaucuuggcacacaagacgcccuccagaaauauguauuauuccuaaaagggaaaaaauucagcauauucauugugcuaacuuaacuuacacaucuauucuuaaagcuaaucauuuaaggguucaaauaaguuugaauuuauuaaugaauuaaaguaugugcauuuucagaguauaacuaauccuaucuuuagcaaggggugugcaugccuuaaaaacuguuauaacauaaccaggugugguaguaugcaucuguugucccaauuauucgggaagcagaggcgagaagacagcuugacuccauaaauuugaagcugcagugagcugugaucacccuacuucacuccagccugagugacagaaaagauccugucucaaaaaaaucuuaaaaaacaaaaauuguuauaacagaccaacagggaaaucagguacaaguuuccaccuaugaucugguuucuacaaagggaugugcucauauaaaucuuuggaaaacuacauuuaucuuuucuuuuaauuguugauaagaagcgaauucagggcuuuuucuuuagacuauaagugguuauuagaaauaaauuauccucauauugaacuccaauugucauguuuucccuucccugugucuuucaaguaguuaaaaagcuuguuaacaugaaaguagaauaauuaaaguaaaauccuugccaaauguuucuaaaauaaaagcagccauguucucauuucaguuuuguucaaguaaucauuuuaaugucaguagcuauaaaaaggggagaaguaccuaucagaugaacaagucuugaaaguuuauuagugcauccucagagauuuagaucccauagauuuagagcagaggucugcaaauuacagcccaugggucaaaucuggccuacucugguuuuuauaaaugaaguuuuacuggaauacagccaagcucauucacuuauguaguauuuauggcugcuuucaugguauaacauaacugagugguugugacagaggcaaacuaaccuacaaagccuaaaauauccacuaucugacccuucacagaaaaaaagcuuguugacccuuacucaaggggaaggaaucuguaucuuuaaaagcacaucagauuaugcugauuuagcuggccaugaaccauacuugauaaaacaaugcuacagagauagcuguagaagcuuguguuagcaauaucccuagcuagcauaacuagcauauacuuaaccuaucucugggugcuacagcauaccaaauaaaugucauuagcuugaagugugugaaugacaaucaaagcaaagaaggcuuuuagcgauauaauacagaauuaaaagcuuaaaaaauugaccagaauuaagaacccaauguacaaaacaaagagagaucagaggaugggaaacugucaggauccuaaauaccuccauucaaccagagaaguuccauauuuaccuauaggcugcuaccaauaaucugguuuacacaaaaguucugcuacauagaaaaguuugaaaacugcauuuuucuuuucuuaugccugcuuacaagaauccaagucucuucuuucagauuauauguuuaaaaaaaaaaaagaacuaaaaaaagguaauagauaagcugcuacugcaguuuacaugugcuaaacuugauacuaauuaaucuauaauaaauuauucccauuucggacaaguugacuaccuuagagcucucaaagaauuacuaagagcagacuaugaggaaaaugcaauuaauccggagagaaaauuacaggagaauaaauuuacuuuaucaaacagaaugauaccuauacaaccaacaaaagaaaaucugcauuuguauauuuaauccaagauuuuaguuaauucacugcuuaccuaauuccucugauacuuaagcuuuccagauuuuuuguuaccacugaugcaauaaagaaauuugaucaacuuuauaacuauauuauauauauauauuaccucuaauacagauggcaggcaggaaaaaagccuucauuaaauacauauguaaaaaucaaaaaucacucuguauagguaaugaaaacuucuaaagaaaaauauuucacaaauauaacacuggacuuggaaaaauauuuucuacuaauaacaugcuacauacauuuuucaaaacauuuuuagcaacuauaaaaguuaaaacaauuaccugcaagcugugccaaucgaucaugaagcuuauauaauguguucaucauaagaguuuuuucacuuuccuaaaauuaagagaaguuauuaugaaauacccaauuacaagaaaaaaaacaccaaauaauucuuaaucaaaaaaaaaaaaacaguaaauuuaaaaucacagaagccacauaaucugaaagacaaauucacauuuaaguaaugggcaccauauuuuuaagaaaccuuaaucuaagacucuaaauuauuacucuaaauauuucacuuucuggagaacgauuuaaaaauuggcauaagguuagugcuaaaaaaaaggucucacagacaauaaacuccaucaaucaccaaagcaauguucccaaucccccucugcacaguguauucuuauguaaacuguucauaugagacuguuuucuucaucaaggcugcccuucaugucuuguuuuaaucuaacucaaccacauaaaacuaagggaaugaguacuggcacguugacugauacucaguccucuccuaggcucccaaggugccccuguauaaacuuaugaacuguuaaaaugaaacaaacauuaaauaaacaucuacuaggaguuaagaacuguucucucagcaaagcgagagacccagugaacaagaugguuccuguacucaagggcaaaaaacauauuaaauguuauacaacugcagaguaauacagaagauucucuucccuccuucuucuguaaauauagaaggagggaaggagggaacagaauuuauggaacagaauauuugaguuugauuuaaaaggaaaaacuaacagaucagcauccuaggcaaugggaaagacccugagcaagggcaugaaggcaugaaagcauugguuauauuucuuacauaaccaguagcccuuguuugauucugcaaacuacuagaaaaguuguuuaguauuaacuaccagacagccuuggauagcaagacagagaguuugacuucauucugaaaauuuagcaggagaguaaaacagacuugugcaucaggaauacuacccgggccagaauguacaauguauaggcuggcucggaagcagaaauaauuguaugaaaagaguccagauagagaauuauugcaaugguacagccuaaguaccugccaaguagucuaaagcaacaagaccuccaauuuaagagcaauuacgaucaggagggaucgacauaaaugauggaggguaggguggggaggggguaauagcuuauugcacuaccuaaaauaaguccaugauuuaucagggggcucugucuuuauuacuuucuuucuuccugaaguuuccaacaaaacagauuuacuggaugaacagaucauggagcaaauugaagcaagauauaaaagacuggaaaaguaacauuuauaugucuaauaacaugcaaccucauccauuuauuuugugguguaugugcagggacagaagagaacauguuugcacacuauggguggcaugcuuuugucauugcagcuuuaaucgguuauacuaagaggaaaacucaucaaaagugccaagauccuaccaccagaauaccugguuuuaugucagacgguugacugagauaaguuacuuauucauucaguuuacuacuugccuuccuacguauauauauauauuuuugccucaauuuuaucuuaaucagauucugaaucaagccaguccuuaucuucacauaagaucaaaaauucaaacugcaaaauuagacaucaaaaaguaacaguaggcugggugugguggcucaugccuguaaucucagcacuuugggaggccgaggaggguggaacaugagcugagcgugguggcaugcaccuguagucccagcuacuugggaggcugaggcaggagaaucacuugaacccaggagguggagguugcagugagcggaggucaugccacuguacuccagccuggugacagagcgagaauccaucucaaaaaaaaaguaagagcagggcugaaacaggauucugaaaccuaagcauuugugauacauuaaaccacaaaaucauuuuuaauaaauaucuucaacauaauaggaugaguagguguuccaaugacaguguagcuuauggaugugacacauaaaaaccaaggugaaucuaguuaaguuuugggauuaaagcaauggaaaguuuuguguuucuuuuccucucaucuggaaaagagacuuauuuucuuuuuguuuuauauguacuaucauacccuuccucacuccccuuucaaaaacaaaacaaaauuugaacauuggcaucuguccucugauuacaucuuuaauaaacauaagagggaccugcgaauaaacuuuagcuuuugauucacagauacuaaacauuggacuagauaaauagaaguaacaacacuuaaccagauggaacugaucucauacuggaugacauacauacuguuacauucucauacaaauaacuuaagaacucagaaagcucaacuauaguuuuuuacaagaauuaucuuuccaaugaaaauuuauuuaaggccgggugcgguggcucacaccugaaaucccaaguuugggaggcugagccaggagaauugcuugagcucaggaauuugagaccagccugggcaauguggcaaaaccccaucucuacaaaaaaauacaaaauuuagcuggguguggugguaugcaccuguagucccagcuccucaggagacugaggugggaggauaacuugagcccaggagguugaggcugcagugagucgugaucaugccacugcacuccagccugggugauaaaaaugagaccuugucucaaaaaaacaaacaaacaaacaaacaguuuaaaugaccgucuauauacuagaagggccucaacugcuauccaaaugaccaacuaaauuauaaucuaaguagguguuuaugagauauacuauuuacuuuaucuaucuaucuaucuaucuaucuaucuuuacagucuugcucugucacucaggcuguggcagagugcaguggcaugaugauacaugcuauuaagugaaugaacacauuuugagaaagaaacaaagguuuugguucaguuaucuuuaguacaaguacacuaaacuagcaguaaaucugaaaaguauacaaaucaacuuuuaaacuuacuuacugguuuacaguuugauuacacucuucuuccauuuugacugcuuuucagauugucuccuaauauuucagcuuaaaugucuaacuacuggcuucccuaauaauucugcaaacuaguuaaaguuccacaaguaaauacauaaaauaagcuuucaaauaaucuuucauuaaauaaaggcaauuuuguaauuugaauuagcuacuuucuaauuguguuuuaguaaggcccagacuauuguuuuucauuuuggagggagaaaaaucuauagggugacucuauccaauuuucucauauauugucaccauuaaauauuucccuccucaauccucagccaauuuucucuucaaggaauuuuuuuuuuuuuuuuuuuugagauggagucucacucuguagcccaggcuggaguacaguggcacaaucuuggcucacugcaagcuccgccucccggguucaggccauucuccugccucagccucccgaguagcugggacuacaggcgccugccaccacgcccggacucuucaaggauauuuuaaacuguuugccuuaugccuuugauuaaauaauaaugaauuuuaacacuugugauaugguuuggcucuguguccccacccaaaucuuaccuugaauuguaauaauccccacguguugugggaggcaguggugggagguaauugaaucaugcaugggguggguuuuuuuccccaugcuauucucgugaugaauagugaauaagucucgugagaucugaugguuuuauaaaguggaguugcccugcauauauucuguugccugccaccagguaagacaugacuuucaccuuccgccacgacugugaggccuccccagccgaacugugagucaauuaaaccucuuuccuuuauaaauuacccagucucgguaugucuuuauuagcagcaugagaacagacuaauacaacuuggcaaggggcccuguacagaaugagcauuuaauauaaguaaacagccacuaucuucauuauaauuguuacuauuauucagaaguucagaauuucaguuucuuccuuggggaaaauuaaacagaagaaaauagucuucuauuucuaauguucaguaaguauacuguaccaaauuuaaauuaugacacuguagcaguguuauacuuaaggcaacugaaaaagccaacuuuguuuuaaacaauuaucacugcaauagaauauuacuaaucauuucagaguuccacuuuaacaacagaaaguaauauucuauggaugugauuacacauuauuacacauccuucaguacaacaaauaauguuuucuauacaggucuauauaacaguuccuauaauaaaaaauuaauaacuaauuacaagcuuaaacaucuuaaucucugaagucccuguaaugauggguaagugaaaaauauuuuuauauaaguaaaauuuagguuaaaauuaguauuauagcacucuuuaaaaaauuaaagaaauagccugaaggauaugcuuccuuucuaaguccuuuugauggucgaauaggcaugccaauaugcagaagauccaaagagguaaaaugagggcaaaacggacaaaaacugcuaagguauccaacaacuacaggcaacaggcauacuucuaaguguaagacaagauccacugaugauaugccacucccauuuuacuuggcaguagucuuuuacaguaaagugauaaacaguucagcucuuaagagaaaaucugugucagauuuaauuauacgacaguuagggaauacucagaauaagaaagccuauuguuuuagacuaaaauaaccuuaaaauuacuauuuuuuuaaguugauaaaaccuauuguuuaagacuaaaauaacuuuaaaauuacuuuuuuuuaguugauagucauucucaugcuuuuaucauauaaaacaugacacaaaauuaucaguauuaugaucguuuacuuacuuguauuuuuccaaauguuucaccaaagggguuuucuacuaucaaggaaggaaaaaaagacaaguauuagcaucacuuacgaauuaaaaucccccaaacaaacucucugaaaugccagcauguacuuugcuaaaacuggauauaaauaugugaaccaaauguaaacaaacuggugauaauaaagguuagggaaguaauuuuucagacuuauacuuaucauucucacuuugaauuagugguuuuccucacaaucauugagaucaggugcucugguaucacagaagcugaguucaagucccagcuccaccucuaccacuuauuaguaaugucucuuugaacuaacaucuaauuagcuacucuaaauuguaguuucuucuuuaaaggaguauggauaacaaugauaccuaccuuauacaguuguugucaggauuaaaugagauaaacaagauaaaauguuugacacagugucaagcacuuaauauguacucaauacacacuauccauuauuauuacugcuaaugacuauaucauuuguuucuaccuuaauuugauuucucuucauaauauagacuaagaagcaguuaacuacugaaagaaaucuacaagaugcuuuaaaacugaauaauucauuuagaauucugacuucuaaugauuuuuuaaaaauccaccuuccuaauccuugccaacaucugaaaaaguggcaagaaaaaaaaauacagaucaaaguaacuaagaauuaagucucaguauuaagcaauuccaaauuuacaauaaaauauuacauaauaaggaaaggauuuaccacuuuccauccaaccccuaugccccuccuucauucaccucuaaauuaagauacaaaaauguuuacggcugaauauguagcaccucucaggguuuuuauucagagucuucuccuuaucauuuuguuuauuuugauauuacauacgaaaauauucaaagcuuucagauaccuguaaacuuuuauauuuuauauagacuauauaucuauauaauccaggccacaacuaagacuaacuaagacuaacugaucuuacaaaguaguucacacugaccagguuuccuuucugagaugcuuuucuauuuuuauuugagaaaacaggaagucccauaggaaccaggaacugccugauucuaagaaaguucaugugagaccagcuuaacaagguacaauaaaagagcaaggaaaaaaaaauguauccuguuaucaucauaagggauuuugcuaauggauuuuuaaacgacauuucucuauacaucaaaaggguuuuaauguugggaaagaaaauguuuugaaagauauuacagaaaaucaaaaguacucaaaaggggaauagggagaagaaauaauauagcuucaagauuaaauaaaauguuaaggaucagaacacauggacuaaaaagauacccuuuuuaauaauauuaauuuuucaauauaaacauugaacagcuauauuuagcucaacguacuaccaaaaaaaugccuugucauuuggccaaacaaaugacaauaaauuagccaaacaauacaaaguguaaaagguguuuuauuugcucuuuauaagaacaauucuuaaaaauauaagugugcaguuccaaaaacaaguuuuaaugucuaugaaaaaaagcuaugcuaguauugcuuuuuugauuauacacaaaauuacuuuuugucaagacuaucaaauggaaaaucagcucugugaguagcuccauaaaagcauaacuguaaauuaucaauguucaccacacugcucuacugugggcuucucaagacagggagcguguguuauacacaugugcaugcccagaaccaagcauaguacuagauauauaguuagugcuugaaaaaugcuuguugugcuaucucggcacucuucuuuauuucacuuuguguguuaacacugaagcaaaaguguucaauuuugcaggaugcuggaggaggguauguucugagcuacuaaaaagggagagggauaggguaacagagaaagcugaagagggggaaaacaauuuugcugaaaauauugcucuaccccuaguauccuucuagauuucugccucuugccuuguagucuaaaauaccuggaguauaacauaccuaaaaaagccaagaguauacuuucugcccaacaaaacuucguuaaaauuuuuuuccccaaaugcucaugauaauugccaccuauuaaaugaacagagaccuauuaacaacagcagaaguaaaacauauccuugggguuaaguuuuuacaagaaaacaccaaccaaaaacagcaacucuaacaaauuaaaagcccucaaaguuuucaaaguaucuuuauacauuuuuucuuuccccaaaucauuucaguauuucuaaaaacacaccaauaucuucuaucacauccaaauuaccuagucuuuaauggaaacaacauauacuguuaccccuagugaaaauauauaacacccucucccaauuagguaaccgaagagaagaaaccuuguuucaaaagcaucccacagcaaaaauuugccacuucauucuuuauucagucacuagaaaacuagggagggaccugagagugaauuacagcucuuaucccuuauccuagagcaaugauaauaccaagacgguacuucaaaauuuacucuuccauccccuaaaggcagagccuugcagccauuuuugaucuguuguccuccuuuaacccuacacucccaacagccucucacuauugcuuuuuuggacauuucuucuucaauacuuuaguucagauuauuucaagccucaaauauaccaagcuuuucuuuguaaagguccuuaauauuuugacuucuuuucccuuuaaacuauucuacuaacuguaaaaaucaaauuccuuaaauguuucauuagaauccucaaaauuuuccaaugguuccuaaucacaccuuguugcaaggaacaaauuaucuugugauaauuucuuauaagacacacaaugcuucuccuccaaaucccucccuuccucuacccccaccaauuccaaaaauguuacuaguuuuacugaucuuuucucaaauguaaacuguuuuccauucucuuacacagaaauaaaguuuaucauguuaugaauucucagauaaaaaggaaaaacuugcaaacacaucuauacguuuauaaacuucaaaguauaugcuuugcuaguuuaagaguccuaagcauuuggagaauaaaggauaugcuauuuaugagucaggaaaacaggcaauaguauauucaggaugcuuuccuacgcuuucuuuggaucaacacagccagcuucagucuaauaugacaauuuuuuguucuguauacauggaaccacugucaauuacagcacacaaaaauauucucucagaagacugagcacuugcucuuucuggucuucuuuaggccugaauguuuuucuucuccaauuugccuugaagguucaguucgcagcuaugcuaccaccaugaaggaugccuaaucacugcaguuuaucgugaccuccuucucagaaucccccuucucagaaucucaguaauguacuaccuuuuaucaugauuucaauauuugguguucuacuccucacccccacccccaacaagacugcaauaucgccacauaucucaaugccuuugcagauacuguguacuaugcacaugcugaacaaauagaaacuugagggcauacuauggucuccuagaauagcagcuucaucaaugccagaaaaaguacuauagucuugauuacuacaacccucuccguugaauaaaaaggaaauuauguuuacugaguuccuaauacgcgccaggaauaaugcugcugccauguacucaagagguaccucauuucauccucauaacacuaccguuuagagugguauuagcccuauuuuugcagacagaaauauugagacauguugagguuaaguugcuuccuugagguaaacaauuuaguaaguugggauuaaaaaauaugagauucaaaccuauuuaugucugacuccaaagcauacauaacucucaucauagaaauaacuacagaaaauaaaauauugguuuuauauaaagaaagcaugcucuaaaacuuuccaauuuugaaucauuaauuugguuauuauauaaugcaucaaaaaugacaaaaauggggauauggagggaaaacacugcuguuggaaaauacauuauuuucucuuagaugaggaaaaaaauucucuucaaaacaaauucuccaauuguagucuagggaaguauuuuccgugauacauaaaaauauaaaguaucccgugauuuccauggacaugauuauucacucuccccuucucucucaggccauggcacucuguucaugacuacuauagaguguaccacauggcaucaguuuaaaaaaauuauaauuucugauuuaguaccauacuaaaagauauuuucauuuggcuucaucuuccaacauaaaauauucgcaaacauauaaagugccuacuuguccagguguuauguuaguuacaagagauuuaaaaauaaauauauauaagcccuguccucaaagacaguucaguccuggagggcagcaauucuacagacaggaguuuuaaaggcagucucuuguaucuaaaacuccaugaccuuaaggcuagugugaccuuaaggacaguuuuaauaaauucaucuaggcaguuacauucagaugccugaaugagcaguuauuucucuguauuacaucuuuauguaaacagacauucaaauucucaaaucccaucuucuaguauuaauggucuaagcacagcauaauuuuaugugaagaaagcaaagggguugugggugagggggaauguuuccaacagcugcaaaacacugcaccuguguggcaaacacuucugcauuucacuaucauccagaccaaucuaaaaauggacagggugaacaaggcaggacauguuuuugcaacauagcauuaugcccauuuguuuucugaaaguucucuaauuguuucauggcuuuauuaaauagauggucauucuagaugacaggaacaguucccuugauguauacuuaacaaauuaugaauauugagauuacauaaucaaaauaggaaaaguuuuauggacaaaauuaucuauuacugucuuccauacaacuugccuaagguaaacucuuguaccaccacccuuguauucauuaauaaccuuucaauuguaaucccaccuauugaucugaauuucgagauacaaaccuagauggggauaaucaguuaaagagaagggaaagggcaagaacacaaaagccucuccacuucugcucuccuacagaacucccaauuuucaccuguccuuguuugagaggcaaaaaucccaugcuguuuucaaauaaacuauucuuuaaaaauaacagaaaguacauacugauuuuguaaaaaauaaaaacuuuaaacauggcuaucaaagcacuaagacuauaaagaaaacugaaaacaaugugucuaaggaaguaaaaggucaaaacucagaaucaaguuuuccauuauccuuauuacuuagcugguucuuauucuuuauauaugauaaaaaaaaauuauggucucuuucaaccuuguaaucaucugaaagucucacacuugcucaccauaaaaauggagauucuugaggggggcagaaaacuguuaucagacugauaugguuaggcucuguguccccaccuaaaucuaaucucaaauuguaauccccauguguugagggagggaccuggugggaggugauuggaucauggaggcaguuucccccaugcuguucucaugauagugaguucucaugagaucugaugguuuuauaaguggcucuuccccauuugcauucucucucuccggccgccucaccuugugaaaaagguacuugcuucugcuucuccuucugccaugauugcaaauuuccugaggccuuccuagccuugcagaacugugagucaauuaaaccucuuuccuuuauaaauuacccagucuuggguauuucuuuauagcagugugaggauggacuaauacagagacuauaacugaaauuacuuauauuuacucaagcacuaauuccacauuauaauuguacccucaguuugagauaucuguaacaaaagcuguaagaaagacuucuaaccacagguuuuucaacaaguccuuaugaaguauauucuggcgagguguggagaaaaaggaaugcuuuuacacuauuggugggaguguaaguuaguucaaccauuugacccaccaaucaauuacugaauauacccaaaggaauauaaaucauucuauuauaaagauauaugcacacauauauucacugcagcacuauucgcaauagcaaagacauggaaucaaccuaaaugcccaucagugauagacuggauaaagaaaaugugguacauauacaccaugcaacacuaucagccauaaaaaggaacuagaucauguccuuugcagggacguggauggggcuggaggccauuauccucagcaaacuaacacgagaacagaaaaccaaauacucuauguucucacuuauaagugggagcugaaugaugagaacacacaggcacauggaggggaaaaacccacacugggaccugucagaggguuggguggggugagggagagcaucaggaaaaacagcuaauggaugcuggccuuaauaccugggugacagaaugaucagcgcagcaaaucaccauggcacacguuuaucuguguaacaaaacugugcauccugcacaaguaccccugaacuuaaaaaaaaaaaaaugaaaaaaaaaagugaguuucuuagaagcuauugaugacauuaagucugacuuugaacaucaacaguuuaaaugcaccaauuaaaacaucaguguggauaacaaaacaagacccaaguauaaguugucuguaagaaauccaccucaaauguaaagacacauauagauuaaaaguaaaaacauggaggaaguuauaccaugcuaacacuaauaaaacaaaguaagaguagcuguauuaauuucagauacugcaaaauugaaagcaagaaaaguuaucagugacaaagaggagcauuacauaaugacaaaggggucaauucucuaagaagacauaacaauaucuaauguuuauguaccuaacaacaaaguaucaaaauaugugaggcaaaaacugauagaaauaaaaggaaaaaaaggaagaauccacuaauauagagacuucaacacugcuguaccagaaauggucagauccagcaggcagaaagucaguaagcauaguugaacucaacaaaucauuaauuaacuggauauaaugaacaaaagacuacuucaucaaacaacaacagaauacacagucuucacaagcuuacauggaauguucaccaagacagaccacauucugggccauaaaacaugccauaacaaauuuaaaauagaagucauauaaugucugcucucaggcugcaacugaauuaagaaaucaacagaaagauaaaugcaaaaaucccaaaauacuuggggauuaaacaacacuucuaaauaacauauggacuuacaaagaaaucuugagacacuuuaaaauauuuugaacuaaaugaaaacaaaauguaccaaaauuugugggacguggcaaaagcagugcuuuugagggaaauuuauuaaugucuaguguuccauuauuggaacgcuaagcaugugggaguuauucauacccuacugcacaagaucauugccaaggccugauugcagaaauucaaaaaauugcaacuuaaggcauaaaugacuuaaugaaugcauaaauuagaaaagaaagaccuaauaucauuuauaagcuuccaccuuggaaaauuaggaagagaauaaauuaaauccaaaguaagcauaagaaagaguaagaauuagagcagaaaucaaugaaauuaaaaaacaggaaaucuauagagaaaaaucaaugaaaccagaagcugguuccuugaaaauauuaaugaaauuaacaagcguuuaggugggcuagcuaagaaagagaggaaacaaauuacuaauaucagaaauaaaaggggacauuacuauggaucccauggauauuaaaaggauaacaaaagaauacugugaacaacucuaugcccacaaauuugacaaccuugaugaaacagaccaauuccucgaaagacacaaucugucaaaacucacagaagacacaaccugaauaggacuauaccuauuaaagaaacggaaucaguaaguaauaaccuuccaaaauauaaagcaccaggcccagauggagaauucuuccaaagauuuaaagaaaaacuuauaccaauucucuacaauaucuuucaggagagagaaguagauaugaguucagcauuacccuaauaccaaaacuagacaaagacauuacacgaaaacuucagaccaauaucucucaugaauacagaugcaaaagucuucagcaaauagcaaauuccauccaacauaguauaacaagaacaguauauuacaaccaagugggauuuauugcaggugugcaaucugaaaauaaauuaauguaguccauaucaacaggcuaaagaaaaaaaaaaucacaugaucuuaucaacaaaugcagaaaaagcaucugacaaaaggucaauacccaggccaggcgcagugguucacgccuguaaucccagcacuuugggaggcugaggcagguggaucaccugaugucaggaguucaagaccagucuggccaacauggugaaaucccaucucuacuaaaaauacaaaauuagccaggugugguggcaaaauuagcagguuggguagcuuguaaucccaacuacucgaagcaggagaauugcuugaaccuggaaggaaaaaguugcagugagccgagauugcaccauugcacuccagccugggcaacaagaacaaaauuccaucucaaaaaaaaaaaaaaaaaguucaauacccacgcaucaaaaaaaacucucaguaaaauaaacuaggaauacaagggaauuuccucaacuuaauaaagaauacaaaacaaaaauagaaacaccuacaguuuacacaugcuuaauggugagaaacucaaagcauucccauuaagaugaacaaugaagcaaggaugucuugucuucucucaccacugcacugcaacaucauacugcaaguccuagcuaaugcaauaagaagagaaagaaaaaguacagagguugaaagaagaaauaaaacuuuguucacagauaauaugacaauauauguagaaaauccaaaagaacugaucaaaaaaaacuccuggaacuaauaagcaagguugcaagaugcaagguuaauagacaaaagucaacuacuuugcuauaugccaguaaggaacaaguggaauuuaaaauuuaaaacacaauaccauuuacauuagcauccucccaaaaugaaauagguaaaucuaacaaaacauguacaaaaucuacaugagcaaaacuacaaaacucugaucaaagauaucaaaaagaacuaauuaaacugaaagauaguucauguccauggauaagaaagcucaauauuuucuagaugucaguucuucucaacuugaucuauagauucaaugcaauaccaaucaaaaucccagcagauuauuuucgggauacuguuaaacugauucuaagguuuauuuauauggaaaggcaauagacccagaauaaccaacacaauauugaagaacaaaggugggagacugacagugucugacuucaagacuuaucuaaaguuacaauaaucuagacagugugguauugguaaaagaacagacaaaaagaucagugaaacagaacagagagcccagaaauagacccauauaaauacagucaacugaucuuugauaaaggaacaaaggcaauauaauggagcaaagauaguuuuuucaacaaauaauucugaaacaccuggauacucacaugcaaaaaaauuaaucuaggcacagauuuuauacccgucccaaaacuuaagucaaaauggaucacacaccuacauaucaaacacaaaacuauaaaacuccuagaagauaaaagagaaucuagaugacccaggguuuggcaaugacuuuuuagauacaacagcaaacacauaauccaugaaagaagugauaagcugacauucacauuaaaaaauuucugcuccauaaaagacacuguuaagagaauaaaaagagaagccauagacugucaggaaauauuugcaagacauaucugauaaaguacugcuauucaaaauagaugaaaaaaauucaagaaaacaaauccuauuaaaaaaugggccaaagaacuuaacagacaucucaccaaagaaaguauacagaaaagaugauccacaucauacguuaucagggaaaugcaaauuaaaauaaugagauaccauuacauaccuaucagaauggcuaaaaaccagaacacugacaucacgaaugcagugaggauguagaacuauuacugguggaaggucuugacuaugagucauccugguucuugguguuuugaacaaagaauuggacaaaacacacaaagcaacaaaagaaugaagcaacgaaagcacagauuuauugaaccagaaguacacucaacagaaugggagcaggcucgagcaaguggcucaagagcacugguuacagaauuuucugggguguaaauacccacuaaagguuucccacugguuaccugguuacacccuauguaaaugaaguagugggucacaaccagucugauugaugguggaaagugaccaaucagaggcuuaagucacaaaguuacaucuuuaugcaaaugaagacuaggccggugaccagucugaucaguugcaggagcggaccaaucaaagguacuuuccauuucucaucugcaaugcagaagguggcagagggguugggggugcagggguugcacccccaaccccucuguucccuuguuaccugggcauggaaaguugggguuuuccuuuugauucaguucuaggaagucagcgucaaucagccuuagguucccugccuccagacgcuauucuccugccucagaacucucauucauuacugguaggaaugcaaaaugguacagccaacuuuggaagacaguuugguggcuucuuacaaaacuaaacauaaucuucccacaugauccauuaaucaugcucuuugguauuuacucaaaggaggugacaacuuuauguccauaaaaaaaacuugcacauggauguuuacagcagcuuuauucauaauucaaucuaaacucuuuauaaauugaaaacugaaaaagaaaaguucccucucuuuugcaaagaccuagaagauucauuguaauguaacaauuuuuuuuugguuuuagaaugauguuuaauauagccuuauuuuuagaaauucauauaauuuacauuagaaauaagauuuuauuuuuccuaaaauugucagaaacauagcauaucgaaaaauagcuaaaauauaagaucuugugucuagaaauuuuuaaaauaugugucugaaaauauucauaaauuuucuaaaaugcuuaaccuauugaguuggaggugauucaucugucaaugauuucauaagcaugguuucauuuaucuaaauaaaauauuacuaaauuagaaaguuagaucauuagcaaauccagaaaauaccaaaauagacauuuaagacuuuaaugacagucuguuccuuccaaagaugaauuccgauaucuuuauagagcauccacaacucaaaaaagaauguuugauagaauuauucuuccugaaucugaucaguaacuaaaacugaaguccucauucaaaaaaaguuuaaucuaagagaagacucuuagauguuaaguaaauaucaacaauuuacucuaagauaaacuauaaaguuaauaaugaauugccugcuucacccgucccacaaagacaaaaguaagucccggcagcucaaaacuccagagggaaacaauuaaggugcugccucuaucuaauuugucagcuaaagacaccccuguaguuuaccacaauguugggaagaaagguaguggugauagcccucuguauccguguguucugcauucaagaacucaaccaacuucagaucaaagauacgugggaggaaaaaaacaaaacaaaugcuaacaauauaacaauacaaaauaauacaaauuuuaaaaacaauacaguauaacaaccacuuacauagcauuaacaucauauuagguauuauaaguaaucuaaagaugauuuaaauuauacaggaagaugugcauggguuauaugcaaauucuacacaauuuuauaugagggacuugagcaucuguggauuuuaguaucuguggggguucuggaauaaaucccccacggauaccgaggcacuaauauacaaggaucagauucaaauaaagacaacgcaauaugucuacuuaaaauaugggagcuuuaucuuacuauauugcucaagguagaaaaguuugagcaaccuaacucuuagaaguuucaacagaucucuuccugaaaauuauuuuuguaauuuuuauuacuuaaauaauuaugcuacugccuacugcauggugacaagugaacagaaaaacaaaagcaagucaacuuguaaagguuagauacaaaucuauaaauaauacaaagcaucugugcaauagcuaacuuggcacccaaaguaauuuaugcuaaugaauacuauaauuuauuaaacauggugacagcucacuguaggaagaaauuuuaaacauuaacuguuacacacuggagacuauaacaguuccucuaaauuuacacuaaaagauacaaguaaaacuuuauuauaacaaagucaauucugaaggaauagugcuaaacaagaauuuggagauccaaaagggauuugugaugugcacaaaugugcacaucauuuggagaugugcaaugcaauaaauauaaauuucacauacaauuaaauacaauaggucuucuacuuuguaacauucaaaauuacaauauauguauuuaacaucuucaaugauuaucuccaguuuuaguuuugaguggcauaaaaacaguaugcaaauaagaaaacuggagagagcaaacgcacagagaaauaaaaugaguaagacuuaaauaguaguaguuuccccuccauucacugaaugggaauaaagagcagaggucugauaaaaaaggaaaagggcauuauacauacagacaacauauagagguggaagaaugaccagaacaaacauauaaacugaauuuaaagaaguucccgucauugacuuuaugagaaaugugcuuaaaacugauauauauguuugguuuuaccucuggaagaaaacagacacagaugaaaagucauucaggaaacagagacacuuaaguaugucaucaagucaaaaacaaaacuacuugguaaaauaacaauuuaaguaguuacauuaugugguaaaguaggcuaaagacauuuuuauuuauuauaauauauggaaccuugagaguaaaaaccaugcuuccccaugaacacaauggacagaauguucagcauauacuguagucauaucagauucucacuuaacaucuacucuaacuucuacaacuucuacuuguaguggagugagagaauauacacgaauaugugugagugaaugcuaaaacaaugauaccuacaauuucccacaaccauucuacuuggcuauuacagacaauaaacaugugcuucagccacaccuugagaugggaaauaugacuacuauuaaaacaaaucagauagaagccauuagccugagcucuguaaaauggagcuccuacguuaagcaaaucaaaacccaauucaauguaaacaggauaaugaaacuuaaccucaaccacucagaaaccaucaacuaaccucuagcuaggaucuugccacucuaaccaaauauauuuucuucaucuuacuucuguguucaggcuauaaaaguacacugcccacaugcuucagagcagaacucucucaaccucuucugguucugagugcugcccaauucauaaaucauucuuugcuuaaauaaacucugcuaaauuucuuuugucuaaaguuuuucuuuuaauaguucuaguguuagaaaugagggucugaaggagaucccaccaaugauaacccacaggagcaaugaguaacaggcauaagugcccccacugagccccuugaguucaucacuuuuugcugcgcauuuggaggucaccauugguaggucccucucagguacaagcuuaacuacuuguuuugaauucucuugacuaugagcauuuccgauccacacugggccuguaagucaugacagagacuauauugggucuagcaggaggcccaauauagucuuauauaagguaaguuagguaaguuugagaaggcugugaaucauggguucaucugcagacaaggacucuagaacuccaaccaucuggaacgucagccaauuuuauguuuaagaacuaagggcucagaaccugugauuuuuuuagagaaaugagugaaccuuaccaaagguaacucaagaguuacaggggccacagugauaaaauuucauuugcaaggcacauuagaaaaacaggauccaaaauaccucagaaacaagaguucuguuugggguuuuuuuuggugugcagaagaagcuccuaaaagacucaaaaauugccucucaaagacucccuacaaaaggcaaaugaaaagcuuaagcaguugauuuuuuuuuuaauuacauguugacugacuuaacucugaccccaccaccccaccccauccucugccuauucuuuaucuacuaagcuuuuagcucaguuaucuucccaacccaaagaugaaaagcuagacaaaugcuuuauaaaguuaggcccacacaucaaccaggucuguaucuuuaaccaccuuuaugccuuggucaaaaucuugagcucagaucaagcaaaauuuucucugucccaaaggaaaacccccagaaauuugcugaggaauucagaauucucauuggaggacaagauccaggacuucuugauccuucuagccaaauuagucuccaaaaucugcccuacuggcauaaggacuauuuuuaaccaguuauuuuuagacuguuuuguaagggaaauuuacaucuauaaaagaaaucauuugucucucucucugcaccagagagagaaggacugaaucacuaggaauucuuagaauggagaaggcaaugacuuaaaccuauauaacuagcuuuacccaagcauuuaagaagcuuuuccuggccaucuuguuguaacuggggcuuuaccuacacucgucuuuccuuguuucaguaaaugacaguauugaagccugaagccuuagcucugugccuuugagauauaaaugcucuaccuagucuaaccuaagagcaaucccuuuagacaugcaaauuuagggaagaugacucaucagaagaggaaaacagggguacaacuauuuggaaauuggcaaauaaaaaaucuucagucuuuuucauaaacaucaauaagaagcguagccaucuggccagauacacaacuugaaucuagcuauuuuuuuuuuuaauaaacaagugaguuuuguauuuagaccuggcacacgacuaaaauuuuagaaugagagcuauaugauguuuauaucugccuauauauuuacguacauguguuacauuuuugugauauuuuucgacauccggaugguauugccaaagacaauuuauaaaagagcuccauuuaaucggcuuaaagaaaaguaagugcuuauguaaauuaaguauagcuggcccaccauaaccacagguucugcaucugcagauucaaccaaccaugggucaaaaauacaguauuugcagguugcagaacccaagaaugaaaccaccuuugcaaaaacuauaacaguaagaaaauuaugacauugaaagggaucugaucuaaccaacucccaucuugccuucaaccuccaaaaugucuacuuagucauuccuggggcuugggccaagcuaacuuugggagaaauuuagauuacaauucaauaauuuagauuauaauaauuuaauaauuauuuuauuuuaauuuuauaaauuauaaucuaaauuauaauuuauaaauuauaaucuaaauuauaauuuauaaauuauaaucuaaaguauaauuaagauaauaguuuaaauacuaaccauuccccaaaacuaaacugccuauguaaaacuaaugaaagaccacaaaauuaggaagaugagaggagcccaaauucugcuaagguauagauaucaauuaccagacauuauccuggcgaucacaagauuuacaaucuccccaauuacuccuacaucaguauuguagagccuaagacuagccuuuugauacgucuuuucaagcuuuuauguuucggaccaccaacagccccauccagacccacgacccuugacucaacagguccuuguagccccuaccuagaagcagacucagcacacagggaccauuuccacaccgcuaugauugcauccacaaccaauuagcagcacccauucccuuguccaccaaacuauccuugaaaaacccuagccuccaaauuuucagggagguggauacgagaaguaauaaaacuccagucucccauucagcuggcucuccaugaauuaaaaucuuucucuauggcaauuccccucucuugauaaaucagcucuaucugggcaacaggcaaaaugaacccacuggaugguuacaagaauacagugggcuaacuuuuuguauguacaaggccaacuguggaacuugagcaucuucagauuuugguuuccacagggggucauggaaccuugacagaaggaagacuguauuacuuaaacucuuaaagacaauggaacuaacccaaaauguuuuuaaaguucacauaacuuggguaaaucuuggguaaauaagacuagcucaauauuguugguuuaauacaaacagcugugucuucugaguuaccagcuuuaaguauaauacgagcauaacauuuuauuuuaccugcuuuuacuagucaaauaaguuuguuaucuuuacuagauguuuaagauuauagaacuauggguucaaccuaagaacaaaugugcaagugaaagugcaacguccaguuuccaagugccuuguuacaguagguagcuagucagguauaagcagggcaggagaggcccccucccccaacacacacacacacacacacacacacacacacacacacacacagccaguuauguuaggcgaccaucaggagauggccaggcaguuguuaacugucucucuaauaauugguugcagccagagccagggauccgcagucucccaguaaacagaaacaccugaaauuggugaucagcagcuuuccaauaagaugucaggagucgggcgagugggcuccagcauaugcauuaagaagcaacauggaggauuuuaacugauauaugaccuuccagggacaugugagugguaagggaaaaacaccucaaaagagcaugcauacaacuccaguaaacacacugcauaggcuggccccuuccaagugcuagcaggccacugcacauacaaacagcccaccccaagggaagaaucaugggaaaagggaugcaagaccccagaagcaugccaccauauaaaaccccaagucaaaaggucaaaccgcacacuuaaucucucaagucacccacuuggcccucuuccaaguauacuuuacuuccuuucauuccugcuuuaaagcuuucacuccugcuuuaaaacuugccucaaucucuccuucugccuuaugccucucagucgaauucuuucugcugagaaggcaagaacugagguugcugcagagccguaugaauucgccgacaguaacauacuuuggugccgugucucugauacguuccgcugcuaacagcaucauguauuauacagcacagcaguaaaacaaacaaacaaaaaaaacauguauuuaacuuaagauucuugcuuucacgaugacuaccuaacaugcacaugcuguaaaaauagcuaacaaggaaauaacuugauaauggcuagcuuuguuuuauguuauaauacaucuacuuaaaaccaguuuccaaaaucuguuaacuuacacuauuggaguuuugcuaaguuaaauuaaaugacagauauucauugaauaucuagaucauuuccacauagauaaaauacugaaacauuaagugcucaacuuaaguuauccacuuuuggcuuauuucagaacgaaagauauucaggucuguuaguaaucauguccugugucccacugaaaaacuguaccaugaagaagcacaugcuucuaaaaauuaaauuuacaaauuccaauuacuauaugguaauuaaaacuagaaauaauaagguaaacaacucuguauggaggaaaguaagacauguuuuugguuaaaaaaaaagcuauuaagguauaaaagauguguuuuuguuaagggaaaaaguaacuuccauccuaaagaagaaugacugguugugcacaaugggaaggaagacggguauagggcaaaaccuauacccacacaggcaaaaccuauacagguauaggacaaaacccgugcccuauagggcauucauaugaaugcauaugagaaaacuguagacauguagaaaagcaaccgugaaaaaggaauuuuauguauggucaagguggcuaggacgugaaugaauuuuauauuuaaaaguuacuuuaaaaaugaugacccuuaauaucaaaaguacagugguaacaaacuuuucuugaaguauuggucuguucuugcuuuauuaggucuuugcuuaagaaaaccgaauucuucauauuaaaagagcuaaggugcuuuuuuuuuuuuuuaagcaacuguguaacuuucuauauuugucucuaaauuaccacucugguuaaaucaguagguauuacuucaagugaucugugaucuacuuuaaucaaguauuuuuaaaccucugauauuuuugacaaacuuucccaaaauucuauuccauuauuccgucuuuuuuuuuuuuuuuuuuuuuuugagacggagucuggcucuguugcccaggcuugaaugcaauggugcgauuucgguucacuacaaccuccaucucccagguucgagcgauuuuccugccucagccuucugaguaaccgggaccacaggcaugcaccaccacguccagcuaauuuuuuaauuuaguagagacaggguuucaccauguuggucaggcugcuuccugccucagcaaacaucugccugccuuggccucccaaaaugcugggauuacagguaugagccaccaugcccagccuccauuaggucuuucucaccuugaacuaacuucgguaguuuccaggggauuccuagaauaucucaaaagaaucuguucucucuccucauaaaaagagagauguuaaacuaccuuauucaguauguuaaauuuacacgguaagcacugucaaauaagcaaugauguuuaacuuuccuugaguuauauuugccuggguauguuacugaguguucuagaaaugguaugaaauuccuacaaaucugauauguccuguuaugauguuaccagucauaauuuugauuuuuauguuaaaauacugaugucacaaaaaauaaaauuuccuugucgauugcauaauaaauucuuaucauagccauuuuaaguccugucauccagagauaauuuuuacucugaugcuuuccugaaagcuuuugcaagcaacuauaauccuaaaguguuucgucuucaaggagauucauggaagagacucugaacaaguacagguuucuuauaacuuuaagauuauaccauugcucuggcuaagaguuuccacaacacuauuaaagaaacugguucauaaaauuguuaaacugacaucaagcagaacaggaauuacaugagacugaacgacugaugaagaaaaauuauagguuauuuuuauggccuuuuuguuuaaaacacugcugauucugcaauguugugcuuugcagauuuaaggaaacuuuuuucuuuucucuuaagcuaucucuacaacuuucaacaauuugguaaacuauaccuuugugaaugaagaugaaacaccuuuucucaacuaucugaucccuccagaauucagaaaccguaaccaaguauuucuauuuuuauggcaauacaauguagaccaaaaaguaacugagacaagucucaaucaauuuugaaaguuuauuucgccaagguuaaggacccacccaugacacagccucaggagguccugucaacaugugccuaugguguuugggguacagcuugcuuuuauacauuuuagggagacauaauacaucaaucgaaacauguaagauuuacacugguucgaucuggaagauggggaaaacucaaagcaggggcuuccaggucauagguagguuuaaacauauucugauuggcaauugguugaaagaguuaugauguauagaaaggaagggguugcagagaccuagguuuuuaucaugcagaugaagccuccaaguagcaagcuuuagagagaauagacuguauauguuuccuaucagaccuagggucuguguugacauuaauacuagagagguauaaaugagacguguccaaccccaacauaaaugaggcauguucaacccccacuucccaucauggccugaagcagucuuucagguuaaauguuagggugcccuagccaaggaggaaguccauucagaugguugcagggggccuucgaauuuuauuuuugguuugcaguaaguuacuugcauaaguucaauaaaaaucuguucucuuuguaacaaguuauaacuggaaacacugguuauaauaccaaggcuuuugaccggaaagucauauuugaaaauguacauagagcuggauauggccaguuuuaaagaacuaagguuuacuuuaugaagccaugaaagccccuuggaaaaaacuagugugguacgaggcuuuaaggguuuccuggccuuaagaguugaguaaggcaggcccaguaacuuuaaaaauauuuugaggaccuugagaagagaggaauucauccaaaucuauagguauuacgggcaaagucuacugguaagucuucagcauggcuucauagccuagagaggcuuuuaaaagucuaaucugagaugccuuuaaaaauuccagcaaagcagauuuaaagagagccuauaugguccaucacuacucucgcugcacguaugugaacuaucaagccaaguuuaaugagacuagaccuauuuugcaaacaaauuagucuuauugugauuaucuuugauagaaaugggagcagcuguagagagaaaaauuauguuucaguagaaaacuacagggcacccuugugcauaucagauucuaguccuguucauuguccuugacauuguaucuauaaacugcuugguuucugacgcccuacaggcggguacugggcaacacucaucccugcugaugaaugggccacucagggaguucaccaaaaugcccauugccauaaccagaaacauucaaacugcaaaccagggaaauaugcuuugagcucaaaucuagaaaccuugaccaacugcccuccggacacagagagugaguuuaugguuuguucuagccaucaaccuuuuuauuuuacuugguucuguucauggaggccuuggcuaaagagcauacaccaguccuuugaugacaguagucccuccucccuccuuauggcaguuucacuuucugcaguuucaguuaccccuggucaaccauggaccaaaaauagaugaguacaguaaauaagauauuuugagagagaccauauucgcauaacuuuuauuaguauauugcuacaauucuaucauuggguuauuguuuuaaucucuuaacugugccuaauuuauaaauuaaacuuuaucauaaguauguauuacaggaaaaacauaguauauauaggguuugauaguauccauuuucaggcauccacugcaggaguaaugggagucuugaaacauacugccuguggguaagaaagaacuacuauuauccuccugauagugcccauugucaucucccuggugcacuguauucuuucuagugucuuaaaugaauguuugcagccaucagcaauaugccaaauggucucacugcaauuagagcaacaaaaauaagaugaacaagaaaggaauacuucuuccaugagccugacaucaugacuuuuguauuccauacugagaccaaguaagucacuauaauggugacagaaagugucaacaaugcucaaaguuuuagucaagcacucaagauggagaggcugacaaaaggagaaaauuguuaaagcaaguaaggaggaagccauuagccugaagauuuucucugugaacagaacuccucuguaagcaaaccaaaacccaaucccguguaaacaguaaaacaaaacuuaagcauacccaaucagaaaccaccaacuaacuucuaacuagggccuuuccacuuauguuuugucuuacuuccacauucagccuauaaaagcucacugcccaucacugcuuuggagaggaguucucuggaucccuuccgguucuaaguauugcccaauucauaaaucauccuuugcucaaauaaacuguuuaauuuauucugccuaaaguuuacuaggcuaucucuccccgccuucagcugcucucaguuuccauguagcuuauauaguguacuucaacccugcaguaugauuuuaauguuuaaaauguauaauguucccuaauccuuuauccaauauuaaaagagucuuuauacuauacuggagggggaaaaaaaacuggccuuuuuuagacacccuacuguagacucuaaaugcugaauuuugcuuuauucucugauuucaaaaaccuaacuucaaaaaacuugauucauaaaauuugaaucugccagaaaacaguuuucuggaccaagucaguaagauugauccuuaacaccauuuuaaauaaacagugaaagcaucuucaaauuccagauuaggacuaaauucaaacuuauuuuccuacauaccaucucuauuuguuaaggucuguucaacaaauauuuauugaguaaccaaaaaccaggugcuagggaauacaaagauaagaacucagaaccuucccuagagcugcugauaguacagugacucuuacuacuuugaaggacagagauccuuuugagaauuuaauaaaauuuaugaacccucacccugcaaaaaugcauacauauucaaaaauguacauauaauuucaaggagcuacugcuuaccuggaguccauuuaucucuuccuuaagauugauggaccacuguuuaagaacuccuagucuaguagaaugugagauuuuuuuuuuuaaaggggggaagugggaauaauuccaaaggaaauuuaaaaaacaaauacaugaaauacaaaauugugcagauaguacaguacagggacaaagaucccauagugggagucagauuaucugcacucaaaucugguucugccacuuacugacuuuggaugaguuucuuaaccucccuaggccucaauuuuaagaauuaagugaaacaacccaagaaaaacuuagcacaguacugagagacagaggcacacacacaagcacagaccuggaaucccuugaauugaauuguuaaagucucuacaguugaagucuacacauauccucauaguaaacacucacuuucuuaaaacuauccuuauaaccaaaagagcccaacuaaaacauuaucucccucaaaccccugaaguagcuaaaguagcuaauauugccuaaaguagcuaauggcuucuaaaacccuuuuaaauccuaagaugaucuuauauggcaaaaccauugauuuuaaguuuaucugcuuuuauucauucaguguauccucccuuccugcagaacaaggauuaggaaaaauaaaaguauggcaacaacccuguaauaaauugguaaagcugauuguguaagaacauauguaaaaguccuugcaaauuaaagcauaaguaacuuauuuauauucauaucaugucuguucuagcuagcauauggucuuagcagaauuuugacuugccacuuuaaguuguuuuuuuccccaaauuucccaacauacuacuauagccuauuuaaucuugcauuuuaaacaucaaaacccauacacuaugcuuauauauuuuuacuuacuuaacuccuguguuuguacuaugguucuucaucacuacacacuuacugauguaauaccagugucuuuuauuauuuuaacccuuaaauaauuuauuagccaaaaggaauuuuaaagaaaacaggugucgaaaaaaaaaaaaaaaaaaagcaaucuaaaccaaccuugcagcauaguauacuccuauuuuuuuaaaugcauuuggacugauauucugcccaaaacaaaacucaggaaaagacucuccuaaaucauccuaguuucucauuuccuaacccaaauauuagaauuuuuuaaaagguacugaauauuuucaaaguaaaugaguaauauuuuuauccuuuuucauucuuggauaagauggcauuaauauaauuuauagcuauuuuguauuaaguucaaccuuguacaauuuuuuaaaaauuaaagaauuuaaguuguuaaaauuuaaguaaaauacaaauuuuguuuuaaguaaugcuugcuccgcaaguuauaucauuuagaugaauaaguaucucuucacaauaaaaagcaacgggcaaaauguaaaagaaaaaaaaaaucucuugaggcaagaaauacuagcuccaaaguuuaugacuuagaaucucaggcaaguuacccucugugggacucuaguuccucauuguaaaauaggauguuuuguaacuaugcccagcagcauggagagagauaaccuaauauaucuuagauagauuaauaaguuaucuuuucccaaucucagcaugaaauaaaaaauagcacguuuauaaaauaacacaauauacugcuacuccaaccuucaucugucucuaccauagagcuacugggauaaaaugacaguucuuagagagauagaaaacuccaaggcaaggcuccccaagucuuuuauaaugccugaauuuuucacuuacugccaaaaauguuuuaccaaucaaagauauuaauagaaucugaguuaaucaagaucuuguacaaucaccucugagauuaagggguuaccagcugguaagucagucagucauuucaacacuacaacugauucugugacauuaaguaugaaugucuugaaaauaaaugcuauauauauuauauauaaaauuuauauauaauuuccuuguaacauucuuuaaguaaugauucuccacucuuaaagcaaaaggacuucauuuauaucaagauauucagauuccccauaacaguacuuuugauauccacuuauauuaagaaaauaugaccaaauucuaccaugcauauaauauuuuauauuuuaaucacagcaguauugaaauaccauugaaaaauaauagcacaguaugaaaggcaaauuauuuauuaggucuucagacaaacuuuauaaugggcacaguucccaaaauguucucaguccacaguugaaaacuacugccauaaauucuaacagaaaauuguagaauuguaggcaauccagcuacuacacauuuaaggauaaagaacaauuuagagaggcagggcuaaacucugauuccauauuggcucaauccucacuaaagauaaucacauuaccaaauuuuaucauaaaaucauacaauuuuuaugaacagagcucuacaacauuauauuaugaauucauucaaucaaauggcuuacccuaacauuuaguuuaaaguagaugacugccagacuugguggugugugccuguagaccagcugcucaggaaacugaggugggaggauuacuugagcccaaggcccgaguaauuacuugaggcuagccugggcaacagagcaagacacaucucuuucaaaaagaaaaaaaaaguaucugaauugagggaauagggggaguuggaacuuaguaaagagagaaaggagaagaggauaugugaaaaaggaaaacaguauguccaaugguuaguggaugagcuuucaagucauguugcuaagguuuuuacccaacaacguuaacuccauaacuccucucccugcccuauaaacuuggacaaagugauuaaccuaauccucagauuccucauuaaugauggaaaacuagccccuaccucauaaaacucuuaaaacuaaaugagauacgaaugagcauaaaacguuuauuugccaagcacucaacaaguaaaccuauuccauacagaaaauuuugaaguuauugagcacuuagaaguuauugaaucuuuuaaaguuauugagccaagauuauaguaaaagagcagaaagcuuaggccaguauaaguuggaaaacagaaauuaaagagaugaaaaaguauaagagaaaacacuaaaagccaaaaauaaacuuacuuucuccuccaacucccacagaacacgauccaaugcucugauucccuaaacuuaaaccaacaguauauuagugcuaaaauaggaugugguuuuaaauaggcuucugugggcuagcccaggaacuuaaaaccaguguaguaaaacaugcuccaaguucaaacaacuguuuuacacacaaucuggaagacaacguauucaaaaauuagggacugccuguuuuuccuuuugaaaugaaaaaguuugugagaaaauauucucuaggaauccaaauguaauucaaagaaauuauucaaauuaaauagaacaugcugcuaaguauuaauccacaauauaaaauccuguaaaauaacugaaaaaauauuuacaauucaaagagcaugaugaauaagaacuucucaauucuuucucagaaugaaguacugaaacccuuagaaaacuucuucauccagacaaaaguuuuacuagacauuaguuuucacuuuugccaauaggagcugagcuuucccuuaucugccgccacgguccuguaacagacucaaagagccaucucuccauucuacauguuuaaagaauuguagaaagcaguuuaaugaaugggaaaugaggaacaaguauaaaggaacauucccaaucaggaauaugagcaaggacuuagaagauaccacuuccacucuaagcuaagaaguccuuugugccuaaaaauaaggaaaaauuaaaucacaagucacuggcugagcagugccaaaacuacaccucacccaccuaccugcccaaacgcuaguggcagugcuuuaaaacagugcaacagaaacaaaaaacaggacagcgguuuuagggucagauuuagcuuuaaauccugcuccucuacagacuaccuguuuaaucuuagacaaauuaauaucuccauaccucacugucuaugucuaaaaugauaacaaaacugacaucauagaguuauuacaaagaucuucugaaaauauuauagagaacacuauacauggcacauuacaggcauuguaaugcuugacugucauuaggucucauuaaaccaauaauauaacuccauaacucagagcgguccagacuugcacuacccaacaggguagucaacuagccaaauguggcuacugagcacuugaaauauggcuagucugaauugagauacaccaugaaugcaaaauacauaucggauucuaaagccuuaauucaaaaaagagcauaaaauaucuaucucaucaaaaacuuuuauauugauuauaugucaaaauaauauucuagguauaccagauuaaauaaaaucaauuauuaaaauuaaucucaacuuuuuuauguuuuaacguggcuacuguguggcuuauauuucuacuggacgguucuggucuaaaccaucacugguaacaguuucaaaugcaaaaugggauggaaauuucauuaugugcuucguaugacuuaucuaagagacugaagauccuaauguacuuuaaauaccuucuaauuuaaguacuauuaauauucaccuauugccuauucauggggacacaugucaucuucccacuuugauaauaacaguacucaugguaucuuacaaacuagcugaagaacggcaugugacaagccaccuuucuguaucaacuguaugcauugucuguucuucacacaguauuaacagaagcuuacuccaagacccauccucauucuuaaaaaauguuuuuccgucucaaauucaguacuacauuuuggauuaaagcaauguaacccauuuacacugacuuuccuaucagcaaaucuaccuuuuagugaucagcaaggcuacaauccaguuucaaguugugucaucaccuguuuaauauagcugcaaaaaaaaaccacauuauuuuucaguccuggagauaaggaaggcacuaauuauguaacgugaaaagauaacucccuuuuaucugcucagacagcuugaaagguuuaaauacugauaaggacuauaaauuuagccaacucuauuacuuauuaacauuacugacaggacaugucauaaugcugaacauguguugcuuaaacuacuauagcuguuaaguccuaucuuauaauauuaaaauuacaguuauauaucacuccaaauuucuccaaagcauuucuacagacauuaucacagcaguucccuacaaaaaucacuggcuggaaguaaaguugauuuuacuauacccucauuuaacagacacaaaaagcaaggcccagagguuguguuuaucuugcuugcccaaauaaagccuguagcuaacgauaagauaaaguauaaaaaaauucuacugcugccugguaguuaauacugugaacucuaaaguuagaucuuggguucaaaugcuggcuccaacaccuaguagcugugggaccuuggacaaaucacuuguaaccuuauucccucuaucuuuccguuuucucacagacauaguaugaguaguuacccucaugaaaauuaaaauaaaaugcucacacacauugaaaauucucaauaaauguuugcucuucucaccuaaggcuuuaaaaucugaaagacgggacauuuagagaugaaauuaaaaaaaaaaaacaaaacacuucugucaaaaggauaagaauauuucuagaacaucuugaaccauaaucauaaauguucagauuuuauaacauuuucauuuuuggcaaauucauucuucaugucucuuccuuuuuuaaaaauuacuccuaaaaaccugcaaaaaauaaaaccuacauuuauuaaaauugugugguuuuuaaagguagaauucccaauugagaaaaugguaauacagaaaaggugaaaggaaugaucaacacacauuacuucaauuagccaacuauuucuuuuguguauauauacacugugauaagcuuuaccagaugguauacucaaauuuacagaaacuaauuuuuaaaguauguuucccaagucacaauauauaaaucugauacacuguugcaugguaacaaaaucccaauucugaaggcuagcuagugcagaaauauuuaggaaaaagaagagaaugccagccaaagcguggggagagugucacuccuauaguucuaaaagguaugauauauacuuaucuucugccauuaccugguacauaguauaggugcucaauaaauaaucugggugaaugcgugacugaaugaauaaaugaguaggagaaacuuaauguuucuucaaaugaacuaaaucaaacaagaaagcauuugugaucccaugggagauacacuuauaaacuaaggaaguccuuaauaaggcugaccaagguuccaagccauagcucagaggcuagaagaaguagauaucccaagauuccccucaccuccuaauuaauuucaacaauccucuucauaugcuuugaaaauuuuaccuuggugaauuccuacagagcaaaagcauccuuuguaaguacagcaugcuuucaggaauuagccauagucagaaaauuguguguguguguguguguguuuguguacauacucagauauauaugagcuaacugagaaacaaaauuaauuuucugcuaugugcuaaaauauccauuugcuacuaaaggguuuuuucuauucaugucauauucagggcagaacagcaauuggugcauacuuacuacccaauuaguucaggagagcugaacuacacucuugcauaguuuuacaaccaagccuuguuuuuaaacuuuagcuugccauuugauaguaacauagcuguaaagaugaauucagaagucaucuugcaaaagcauuuuaaguaaaaagcugugcaaaagcacagagcaauaaaucuagcacccaggaaaaauucagugguauaauuuuaaacuauaccuugacauaaaagaaaaugaagacauaugaaaaguaauucaugauggcuuccauaugauagaugcauuauucuauuuuuagagauuaccucuguuacuauaacuuuuauaaccuuuuugaagagcuaauuuccuaagaaauauauuuuuuaaauaaugauauuaaacaugcaaaauaaauuauuaaaaccuaacuuauuuucuuccugguaaacucuuguuuaaaaaaauuuuggcaauauuguuaauaaagaauauuauuaacuauauauauaauauauaauauauaaacugaugcaguuuaaagcauagauuauuaaaacagugaaauccaaagguuacugcucaacuauacuguuacugguucacuuuaaaaucuauguuagggcagggcacgguggcgcacaccuguaaccccagcacuuugagaggccgaggcagguggauuaccugaggucaggaguuuaagaccagccuggccaacauggugaaaccucaucucuacuaaaaaauacaaaaauuagccgggcguggugccaugugccuguaaucccagauacuugggagguggaggcaggaaaaucacuugaaccuaggagauggaggcugcagugagccgauauugcaccacugcacuccagccugggcgagagaacaagauccugucuccaaaaaaauaaaaaauaaauaaaaucuauguuaaaaauaaaucuaaauaugaaaaucaaaauccaaaguuauaagcaaauaacuguuauaacaauuuccacaauuaguauuaagcuauguucccauauuaaauggcagcaauuuuuaauguauaaucaauacaagauuaaaauacaucuuuuuuaaaauguuauuuuaaguucugggauacaugugcaggaugugcagguuuguuacauagguaaacgcgugccauggcaguuugcugcaccuaucaacccaucaccuagguauuaagcccagcaugcauuagcuauuuuuccugauauucuccccaccccuagaauauaucuucauucgaauuuagauuauaucauuaguaauaaaauuuucacaaacaaguuaguaguacuuauuuauuaacaaauacauuuuggagaguuccaacaguuuaagguguccuucucuuuuaaacaacuuacaaacuauauaauuaucuuugcacugaggcuauaaauuuccauuuauauaacauauuuuucagauagggaaaguuaauauugaauaaucaaugagcaaggagaagcaagcuuuaagaacuucccaacucuuaggaaucaugaaaauaauuuuucaugauuauuuuagugucccugaaauuaucaaaugcaucauuuccauuaaaacauauaugaguauaaagggaaaauaugaaguuuauucaaaaggagcaaaaaagggagaucaaauguaugaaaaguucuuuauauccuaaaaaugaacaacagaaagaacaaguuguaauugguaauacaaaucaaaagaucacuuucccuaccaguuuugagacugcaaauauuuuaaaaauuagaaauaguuuuaauauuguauuauuguucuauguauuauauauuauaguuugcuucauagcagaugcccccucccccuuaauuaaucuaaaaccuuaaggauaaauaguuccaugugauucauaauuguugaaugaauacaacuuuuccuaaaguuguuagguuucauagauuauuccugccacuucuaggauuuuaugaaucuauacuugucacaguuuucugaaaauaaagacaauaauaguagagaacauauaucaaguccuuauuuauacauauuaaaaggcaaucuagaagaacaguuaagagccacugucugaguucaaauacugccgcuucacuuacuagcuacaugacccugggcgaguuacuucucagugucuccauuuacuuauaaaaugggauaaguaccuaccucauaaggauuaaauaauaauuguuuagcucagugccuggaacacaguuaaugcuacguaaggguuaguuauuauuauuacuaugugccauguaugaguuuuacuuuacacacauuacuucauucucauuuaaccuauuuuucauaugaggauauugagguuuacaauggcuaagcaacuugccuuagugaaaaaaagcuaguaaguggaagggccaauauugaagcccagguucucugauagcuaugccaguguauccucaaacuagucuccguggauauaucuguagagauucacaaguuuuuccucauuauuuuuaauuuaaaucauucuagggaaaauuuucaaaugaaaaacauuuucauagaguagacuuuaauuucugaaaucaucaaacugguauaugcaaaucccuggcauucacgggaauauucucauagaucuaggauuuuuuuuuuuuucuuacaaagcagucaacucguaaaacuucaaacauaacauggagcuuucauucuucaagaaugagagaauaggccggcugcuauggcugacaccuguaaucucagcacuuugggaggcgaaggugacaggaucgcuugagcccaggaguucaagaccagccuggacaacaaagugagauccugucucaacaaaaaauacaaaaaauuugccagauguggugaugcagaucuauagucccagcuacucaggaggcugagcugugaggauugcuugaguccugggagguugaggcugcaguaagccaugaucacaccacugcaauccaaccugggugacacagcaagacccugucucauauugaaaaaaaaaaaaaaagaaugagagcaacagcuauuuuucaaaauccuuauuccccauauucauuuuagauaccaaguucgggaccuuuuggcuagucuacuuuaagaaguaaaaauauuuuuuaaacgacaaugacauuaaaacauguuacuucuuuguaacaacuggucuugauuuuaaagaaaacaacaacacauuaaaaaaacaaacauuuaaaaguauucccuuaguaaacaguacuaguacucacauucagcaccagucucucaucuuuacuccaauucuguaucuacaagagccuacaagaauuuuucacuugaacaacucaaauaauaagccccaaguaaacucauuuucccuagaccacuuuuccccaaacaagaucccucuuccacaucucuaauuccuccaaugauauuaucauucucucagucauccaggcucauggccagaauaaucuuugacuccuaucugucucuuauucucuauacucaaaaccauaugucuuucuucaaaugaauuucauucauaggcccaacuccauucccacuuauccaccuccuucaggugucaucacccuacuccuucccuccaacccuaucacugucuaaaccaucaccuguuuauccuucuuaaaggaccaauucgaucaugcuuguccucugcuuuauaaccuccaugaauugccauuacucaaccuacagaauaaaauccaaauguugaauuuagaacuuuugaucauguaagacugaucauuugagaauuuacagugaauucuccccuuuuauaaaaguguguaaccacauaauauccuguauguuucuuagccauuuccuauuacuguuauuagugguguggaggcuucuacagaaauaagauuucuuuuauauauccuuaccagauacuaaguagauaaccaauuaccgaguuagauacuaccaguuaacagugcauauauccugaguaccugauaugugaucauuuauucaacagauauuugcugaauaaugaaucugugcugaagauacuaaugugacuuccaucuacuaagagauuuccaugugccagacaacacuaguuuagaugcauuaucucacuuaauacaagucauccucagauaguauuaucaaucucauuuuuaguaugaggcaauuauaucucuaguauagucuacuuuaaaaaguagagccaaaaucagaacugaguaaaaaguuuguacucuuuaacacuguauucuacuccuauagaaauauuacucuaaagaaaggagcugucaucuauuuggcaugguggacacacaaauauaauacuuuguccuaaauacuaugaaggaugcaauuaaugucuuauuugagcacaaaaugaugggccaaacucuaggguaaaaagauggagagucagagauaucuggagaugacauguuuaagaaugaaucacaguuacaaaauaaagaaacauucccaaaaaaggggauaaccugugcaaagguagaaaagcacaaauuucaugacuuacucagaaaacagcaaacaguucaguuuucuagaaaguaagugugauaagggagacugguagaaagggcaagcauagucagaucaugaacaguuuagccaacgaguuuagauuuuggccaauaacuaagagaaagccauuguguaauuuuaagcaagagggaaugaucacauuugugcuuuagaaacgcugcucuguacugacaaauggacuggaagagcuacagccuagaagcagggacaccauuuuagguuacugaaagaguucaggcaagagacuaaccuagaacaguggcgagggacagaaaaagauugauucaaaagauauagaggaaacagaacuacaggacuugguauccaauuagguuggggguuuguaggaaggugagggaaaggaaagaaucuagguaaauccaagguuucucucuugagcucugucuggguggauggaagcaccauuaacuaaacagggaggaggagcaaaaacaagguaaauauaaagaaaaugucagaugguauugguacauacuucuaguauacccaaaagaugucuaguaaacaaauagguauaccuagaucucaggagaaauccaagguaaaaauacaaaacuggaagauaaugacaaggagagugaaugaaacuuccuagagaaaugugugcaaaaggagacagccaaagaucaaguuguggagaccaccaauauuuaaaacaggcagacagaaguaugaaaacuaggagagaguagugauacagaagcuuagaaaggagaaaguuucaugaagaagggaguugucaaugcacuaaauguaccaaagagaugaggauuugaaaauugaguaacuggugacuugaagaagagagguagcagaggaauggcugguaaagaaagcuaaacuagacaggguugagugaauggcagggaagaaaauagaggcagaaaguuugagaagaguaacaacuagagaagaaaagagcacagaagagcaacauuuuuagaaugguagagauuuuaguauuuuuauaggaugagaaagggacuaguggaaaaugagauuuuaaaauuauaccucuguacuuaaaauuaguauauggaaaaguuacccaugauacaaaaaacaaguugcagaauauguaugcuauaauaucacuuaaaauucugacuccuuucaacggcccucaaggcguuuaggucuuuaugaucuggcccauaccuaccuuuaacuucaugguaugccauuuuccccuucauucauuaugucccagcaacacuggccauucuuuuugguccuucaacacacaagccuguuuuugccucaggaauucugcacuugcugauacuucugccagaaugcucuucuccugaucaaaggcuaguucccucaagucauucauaucucaguucaaacauccuuccucagagaggucugccuaccuuuauguaauauugcauaucucuucaccucagcccccaaaaguuaccagcaauaccuuguguuagcaacuaccauuaugugaaauucuuauuuacuuguccauuccccuccuagaaauguaagcucuguaacagagauuucaucuuccacauaugcaacauauuguucaccacauaucccugcugcuuaaaauaauaccgggcacauaguagacacucugcuguugaaugaaaaucuguacacacacacauacacacacacacacagagauguauuuacaugaaaaauacuaagaaaggucagaaaggaucuaauacuugaacuuauuuauaugggggcagcaugaggcuaggaagagaggcauacaauaaccauucacuguuuccuucaucucuauucaaacuuucugcagaagucaugucuuuuguaauugaaaaaaaaauuaauaaugaucauacgagccuaggacagucaaucuauucugcuucucuauuuucguuuggugggcuauaaugaucuaaucaccuguggaacaagcgacuacucugauugcagguugauccuugaguuguuuugguauggcaguucaaaguuaaaaucuuaaaucuuggagcuggaaagagcuuagggaucaucuaauccaacccccuaguuuuauagaugaggaagaagagacuuauagcaauuuaauuaauaaaaaaauagggcauugaugaaaaaguuucaaagacuauaugauuaagaacaauuuaaaagacuaaucuacuauauguuauauguaauuuaaauaauaaaagccuccuaaaaguuacucucacauauaaccuacaaucuucuggugaaaacuauuacucaaaguaaacguauuucccuaagcauacuauuugaccaaugaacucuacaguuaaagcaucauaauauaacaaaggauauggaauacguguauguauguguguguauauauauauggagugaaaauauuauucacucuugauacccuaacacuguuaggugugcagacuaacugaaguuagcaggcacuucuuuccacaggguagacauacaauacaucaaguguaucauacauuuaaggauucauuauacuuugauucaaauuucuguauuaauuucuauaauguauauuuaaugggauaaaaaucaaauguuagguuaagaaaugcacuauacuaugucauuuauagaaaugucuuaacuauuuaucucucuagauauacuguaguuuaccaggaauacaacaaauuuuguccaaauuucugaauaauaccaccuuauguuuaacacacugucucaccugacccucacaaacaaacccagagacagcagauauuauuacuuccauuuaguauauaaaaaugaggcucagagauuaaggagcuugaccacagucauucagacaaguccuagaaccuagauccucuacuucuuagccauuguucuuuccaacgcccagauuacuucacauuuaccauuuacuaaaauguaaauauaauuuccuuccuuccuuaucagugaaggugaagaguaccaaaauccuagcauuccuauccuauucuaccugaacuuuuaguacaccacauuagucauucaucuuaacacugaugagaaagaugugaaagucaccuuaacugagaauugugcuuaucaauaauucuguaugaaauccuaccaaauagucaauuacuuucuuaaucauaauaaagguacccacuuauuuagaaagcucucuacaaacaauaaccaaaacaguguuaaaauggucuuucuaguuggaaauaaaaucugaaaccaaaucuuagcccuacuacuaacuguucaacacucagugcauuucuuaacuuaguaucauccucauccaaaaaugaggauaccaccaccugcuucugugaguugcugggaagauuagaugguacaauagguguaaagcaauuagcucuuagaaaauggccagaucugcuaacauggugaaacccugucucuacuaaaaauacaaaaaaaauuuagccagguguggcggcacgcgcauguagucccagcuacuugggaggcugaggcaggagaaucacuugaacccaggaggcggagguugcagugaccagagauugugccacugcacuccagccuagcgacagagcuagacucugucuaaaaaaaaaaaaaaagaaaagaaaaaggccagaucuuauaguuguuagagacacagaugcagauagcuacugcugauagguaaugucauuuaauuuaugugaacuuuuacuuguuuaacuucuagugugcccuuauuuuuuuucucccaaauauuuggggcaggacacaauacacucaugcucccagggaauaaacuaaagugagagcugaauuucauucuuguuucaaccccuguaauuaagcaacagaguaaaaaucuauuauuugacugucucggaauuggcuauaucuaaaucuaagcuuacauuauuuugacuccuacucuuuaucugaguuggcuaacugcaucuuucacucuauuuugaaauaaaacuaauaagccaauuuuauaaauacaaauaaaaauacagugaauucaucuugggugaaaagaguaggaagccuucagggagaaugcagagagggaccuaacacugagaaauuauguauucagaaguccauuuuguccuaauuuacuuucucuuuuaaucuucacaaacauucuagucaauagaggccucaucuuauagauuaggaaaguucagaagcuuuaacucugacucucuccccuuugcucaaggugcuuaaccacucuaaccuacaagaaggcucuugcucaacucaaggccuuaaucucugcucagaauggucuacuguuucuccacaaggcugucuccuucugcuucaggucucaccucaaauaguaccuccuccguucaaucuaaaguaguguacaccuacgucaguguagucugguaaauuuuuuuaaaaaaggaaaaaaaauaaaguuguguacgccaauuacucaucuuuauuuccuucagagaacacaaaauggucuguauucaucuucuuuuuguguuuaagggcagagauacuuugauuaugacaaugaacacaccugccuacagucauuuagcaaguaaauaguaggaccuggaaaccaauccaaggaaaucugacugcaagcuccugcacugcccuaccacuacuuuuuguacagaugauagggaaagugcuuugggcugggaaauaaauuaagaggugugccuugcugcuuuuuuauauucauucacuauaaagaaauuauacauacaguuaauaccacaaaauauuuaauccgaauuuaugcauacaguuaauauuauaaaauaauucgaauuucaagagcuauuacauugccuauuagaaucacaacucaauuuggaaaaacacuacauuuauaaugugccuuauccuaauacuucaaauuuguuaaguaacuggcaucugcgcaaauagucuuucagggcuaaaagagaauugucacauauacaaaugaguuuuacuaacaagcuuauaauauucuuuuaaaaauuguuuugaauuucacaauacaucaugcagaaaacuuuuaaaaccagccauaugacaucauuucgauaaugguguucuuuaagaaagaugacacaugcacgcacuguugcguuuuugcuguuaaaccauauucuugcagguaagucacuucauguaaaacgcuaagcgcggcuaaagcggaccacuaacaacauucucuuuguuaccuuacccacaggauuuaauacuuacugcugaguucuccauccucagauacuccugucccucucauuccuagguaagucagucccaguauuaggaaaaauaagcaggcagcaguuaagagaaacaucgacaaguagugggcacugaaacucccuguuggggacaccuccucccguuuaaauugcuggagaaguuccucuucggguucggaaagcuucgguuuguuguauguguuuuucagguagguaugauuggagcccguaugauuggcgugauugauccugagugaacuagaggcggccaccgccgcacugggagggagacuguuagaauaaauccugggggaguccacacugaaggccccaccgccaauaugauuauugguuuucagaagggagccuguugacgaauccaagguugaguccaugucaguaaguggcgggggcaggagaggggucaguuucuuagcguuaacacgguaucuaggaacggggcuggaguccacuugaucacacccuccucccugcuccgcggccgccgccucuucgagguuucggcuccugucuagacucccggcagccgccgcccugucauucaucgcgaguccucccccucccugaacugaagucuccagccugccgccggccgauuuagcagucagcggggggagaggcuuacuauggguucgucugggccgaugccgggaaagggagucguccuuuaauaccugucugcuggaggccacgucgucgucguccucuuccucugaguccgaauaguuuucccggcagcuguaggggacaagccggcugccauucacgguccggcucgcccagagcggcuccucggucuccgggucccucuccucaccguccucucccuccccuuccucguccuccacugcuccaucuuuccccggcggggucugcagcucggggcccgccggccuccuggccccccaccacgaguggggcuuccuucgcucugcagaguugcuguuagucaccucgcuggcggccaggggcgccggcggcgcuuugagcccgcgguacuggagcgaagcccggucuuuccucccgccgccgccggccuggucccggggacuggccuccacguccgacucguccgagcugaagcccagcagcacuuugcugccagccgcgggggcggcggaggcgcccccgggcccucccaggaggcucucugggccagaggccgagauucggcacaggcccccaggaguccguaaguaggagaggucgcccgagaccggccggacccccauccccgcggccgccgccgccgcuggucccgcggcugcgaccguggcggcugccguguuauuguuauuacuguuccgcgucuuguugccgcggcccccugaccggugcuguugcugcucuuccucucgaagcuucuucagcuucuugagguagaccgggcgggugcucuccgucacugguccgggagacaggccguaacggcggagcugagagaaaagcuccucauccgagagcugcugaggcgccgaagcugcugccgccgccauuuucucuccaggguguuuuacaagcu

SEQ ID NO: 192962 - RNA, 78791 nt, Homo sapiens
agcuuguaaaacacccuggagagaaaauggcggcggcagcagcuucggcgccucagcagcucucggaugaggagcuuuucucucagcuccgccguuacggccugucucccggaccagugacggagagcacccgcccggucuaccucaagaagcugaagaagcuucgagaggaagagcagcaacagcaccggucagggggccgcggcaacaagacgcggaacaguaauaacaauaacacggcagccgccacggucgcagccgcgggaccagcggcggcggcggccgcggggauggggguccggccggucucgggcgaccucuccuacuuacggacuccugggggccugugccgaaucucggccucuggcccagagagccuccugggagggcccgggggcgccuccgccgcccccgcggcuggcagcaaagugcugcugggcuucagcucggacgagucggacguggaggccaguccccgggaccaggccggcggcggcgggaggaaagaccgggcuucgcuccaguaccgcgggcucaaagcgccgccggcgccccuggccgccagcgaggugacuaacagcaacucugcagagcgaaggaagccccacucgugguggggggccaggaggccggcgggccccgagcugcagaccccgccggggaaagauggagcaguggaggacgaggaaggggagggagaggacggugaggagagggacccggagaccgaggagccgcucugggcgagccggaccgugaauggcagccggcuuguccccuacagcugccgggaaaacuauucggacucagaggaagaggacgacgacgacguggccuccagcagacagguauuaaaggacgacucccuuucccggcaucggcccagacgaacccauaguaagccucuccccccgcugacugcuaaaucggccggcggcaggcuggagacuucaguucagggagggggaggacucgcgaugaaugacagggcggcggcugccgggagucuagacaggagccgaaaccucgaagaggcggcggccgcggagcagggaggagggugugaucaaguggacuccagccccguuccuagauaccguguuaacgcuaagaaacugaccccucuccugcccccgccacuuacugacauggacucaaccuuggauucgucaacaggcucccuucugaaaaccaauaaucauauuggcgguggggccuucaguguggacucccccaggauuuauucuaacagucucccucccagugcggcgguggccgccucuaguucacucaggaucaaucacgccaaucauacgggcuccaaucauaccuaccugaaaaacacauacaacaaaccgaagcuuuccgaacccgaagaggaacuucuccagcaauuuaaacgggaggagguguccccaacagggaguuucagugcccacuacuugucgauguuucucuuaacugcugccugcuuauuuuuccuaauacugggacugacuuaccuaggaaugagagggacaggaguaucugaggauggagaacucagcaguaaguauuaaauccuguggguaagguaacaaagagaauguuguuagugguccgcuuuagccgcgcuuagcguuuuacaugaagugacuuaccugcaagaauaugguuuaacagcaaaaacgcaacagugcgugcaugugucaucuuucuuaaagaacaccauuaucgaaaugaugucauauggcugguuuuaaaaguuuucugcaugauguauugugaaauucaaaacaauuuuuaaaagaauauuauaagcuuguuaguaaaacucauuuguauaugugacaauucucuuuuagcccugaaagacuauuugcgcagaugccaguuacuuaacaaauuugaaguauuaggauaaggcacauuauaaauguaguguuuuuccaaauugaguugugauucuaauaggcaauguaauagcucuugaaauucgaauuauuuuauaauauuaacuguaugcauaaauucggauuaaauauuuugugguauuaacuguauguauaauuucuuuauagugaaugaauauaaaaaagcagcaaggcacaccucuuaauuuauuucccagcccaaagcacuuucccuaucaucuguacaaaaaguagugguagggcagugcaggagcuugcagucagauuuccuuggauugguuuccagguccuacuauuuacuugcuaaaugacuguaggcagguguguucauugucauaaucaaaguaucucugcccuuaaacacaaaaagaagaugaauacagaccauuuuguguucucugaaggaaauaaagaugaguaauuggcguacacaacuuuauuuuuuuuccuuuuuuaaaaaaauuuaccagacuacacugacguagguguacacuacuuuagauugaacggaggagguacuauuugaggugagaccugaagcagaaggagacagccuuguggagaaacaguagaccauucugagcagagauuaaggccuugaguugagcaagagccuucuuguagguuagagugguuaagcaccuugagcaaaggggagagagucagaguuaaagcuucugaacuuuccuaaucuauaagaugaggccucuauugacuagaauguuugugaagauuaaaagagaaaguaaauuaggacaaaauggacuucugaauacauaauuucucaguguuaggucccucucugcauucucccugaaggcuuccuacucuuuucacccaagaugaauucacuguauuuuuauuuguauuuauaaaauuggcuuauuaguuuuauuucaaaauagagugaaagaugcaguuagccaacucagauaaagaguaggagucaaaauaauguaagcuuagauuuagauauagccaauuccgagacagucaaauaauagauuuuuacucuguugcuuaauuacagggguugaaacaagaaugaaauucagcucucacuuuaguuuauucccugggagcaugaguguauuguguccugccccaaauauuugggagaaaaaaaauaagggcacacuagaaguuaaacaaguaaaaguucacauaaauuaaaugacauuaccuaucagcaguagcuaucugcaucugugucucuaacaacuauaagaucuggccuuuuucuuuucuuuuuuuuuuuuuuuagacagagucuagcucugucgcuaggcuggagugcaguggcacaaucucuggucacugcaaccuccgccuccuggguucaagugauucuccugccucagccucccaaguagcugggacuacaugcgcgugccgccacaccuggcuaaauuuuuuuuguauuuuuaguagagacaggguuucaccauguuagcagaucuggccauuuucuaagagcuaauugcuuuacaccuauuguaccaucuaaucuucccagcaacucacagaagcagguggugguauccucauuuuuggaugaggaugauacuaaguuaagaaaugcacugaguguugaacaguuaguaguagggcuaagauuugguuucagauuuuauuuccaacuagaaagaccauuuuaacacuguuuugguuauuguuuguagagagcuuucuaaauaaguggguaccuuuauuaugauuaagaaaguaauugacuauuugguaggauuucauacagaauuauugauaagcacaauucucaguuaaggugacuuucacaucuuucucaucaguguuaagaugaaugacuaaugugguguacuaaaaguucagguagaauaggauaggaaugcuaggauuuugguacucuucaccuucacugauaaggaaggaaggaaauuauauuuacauuuuaguaaaugguaaaugugaaguaaucugggcguuggaaagaacaauggcuaagaaguagaggaucuagguucuaggacuugucugaaugacuguggucaagcuccuuaaucucugagccucauuuuuauauacuaaauggaaguaauaauaucugcugucucuggguuuguuugugagggucaggugagacaguguguuaaacauaaggugguauuauucagaaauuuggacaaaauuuguuguauuccugguaaacuacaguauaucuagagagauaaauaguuaagacauuucuauaaaugacauaguauagugcauuucuuaaccuaacauuugauuuuuaucccauuaaauauacauuauagaaauuaauacagaaauuugaaucaaaguauaaugaauccuuaaauguaugauacacuugauguauuguaugucuacccuguggaaagaagugccugcuaacuucaguuagucugcacaccuaacaguguuaggguaucaagagugaauaauauuuucacuccauauauauauacacacacauacauacacguauuccauauccuuuguuauauuaugaugcuuuaacuguagaguucauuggucaaauaguaugcuuagggaaauacguuuacuuugaguaauaguuuucaccagaagauuguagguuauaugugagaguaacuuuuaggaggcuuuuauuauuuaaauuacauauaacauauaguagauuagucuuuuaaauuguucuuaaucauauagucuuugaaacuuuuucaucaaugcccuauuuuuuuauuaauuaaauugcuauaagucucuucuuccucaucuauaaaacuaggggguuggauuagaugaucccuaagcucuuuccagcuccaagauuuaagauuuuaacuuugaacugccauaccaaaacaacucaaggaucaaccugcaaucagaguagucgcuuguuccacaggugauuagaucauuauagcccaccaaacgaaaauagagaagcagaauagauugacuguccuaggcucguaugaucauuauuaauuuuuuuuucaauuacaaaagacaugacuucugcagaaaguuugaauagagaugaaggaaacagugaaugguuauuguaugccucucuuccuagccucaugcugcccccauauaaauaaguucaaguauuagauccuuucugaccuuucuuaguauuuuucauguaaauacaucucuguguguguguguguauguguguguguacagauuuucauucaacagcagagugucuacuaugugcccgguauuauuuuaagcagcagggauauguggugaacaauauguugcauauguggaagaugaaaucucuguuacagagcuuacauuucuaggaggggaauggacaaguaaauaagaauuucacauaaugguaguugcuaacacaagguauugcugguaacuuuugggggcugaggugaagagauaugcaauauuacauaaagguaggcagaccucucugaggaaggauguuugaacugagauaugaaugacuugagggaacuagccuuugaucaggagaagagcauucuggcagaaguaucagcaagugcagaauuccugaggcaaaaacaggcuuguguguugaaggaccaaaaagaauggccaguguugcugggacauaaugaaugaaggggaaaauggcauaccaugaaguuaaagguagguaugggccagaucauaaagaccuaaacgccuugagggccguugaaaggagucagaauuuuaagugauauuauagcauacauauucugcaacuuguuuuuuguaucauggguaacuuuuccauauacuaauuuuaaguacagagguauaauuuuaaaaucucauuuuccacuagucccuuucucauccuauaaaaauacuaaaaucucuaccauucuaaaaauguugcucuucugugcucuuuucuucucuaguuguuacucuucucaaacuuucugccucuauuuucuucccugccauucacucaacccugucuaguuuagcuuucuuuaccagccauuccucugcuaccucucuucuucaagucaccaguuacucaauuuucaaauccucaucucuuugguacauuuagugcauugacaacucccuucuucaugaaacuuucuccuuucuaagcuucuguaucacuacucucuccuaguuuucauacuucugucugccuguuuuaaauauugguggucuccacaacuugaucuuuggcugucuccuuuugcacacauuucucuaggaaguuucauucacucuccuugucauuaucuuccaguuuuguauuuuuaccuuggauuucuccugagaucuagguauaccuauuuguuuacuagacaucuuuuggguauacuagaaguauguaccaauaccaucugacauuuucuuuauauuuaccuuguuuuugcuccuccucccuguuuaguuaauggugcuuccauccacccagacagagcucaagagagaaaccuuggauuuaccuagauucuuuccuuucccucaccuuccuacaaacccccaaccuaauuggauaccaaguccuguaguucuguuuccucuauaucuuuugaaucaaucuuuuucugucccucgccacuguucuagguuagucucuugccugaacucuuucaguaaccuaaaauggugucccugcuucuaggcuguagcucuuccaguccauuugucaguacagagcagcguuucuaaagcacaaaugugaucauucccucuugcuuaaaauuacacaauggcuuucucuuaguuauuggccaaaaucuaaacucguuggcuaaacuguucaugaucugacuaugcuugcccuuucuaccagucucccuuaucacacuuacuuucuagaaaacugaacuguuugcuguuuucugaguaagucaugaaauuugugcuuuucuaccuuugcacagguuauccccuuuuuugggaauguuucuuuauuuuguaacugugauucauucuuaaacaugucaucuccagauaucucugacucuccaucuuuuuacccuagaguuuggcccaucauuuugugcucaaauaagacauuaauugcauccuucauaguauuuaggacaaaguauuauauuuguguguccaccaugccaaauagaugacagcuccuuucuuuagaguaauauuucuauaggaguagaauacaguguuaaagaguacaaacuuuuuacucaguucugauuuuggcucuacuuuuuaaaguagacuauacuagagauauaauugccucauacuaaaaaugagauugauaauacuaucugaggaugacuuguauuaagugagauaaugcaucuaaacuaguguugucuggcacauggaaaucucuuaguagauggaagucacauuaguaucuucagcacagauucauuauucagcaaauaucuguugaauaaaugaucacauaucagguacucaggauauaugcacuguuaacugguaguaucuaacucgguaauugguuaucuacuuaguaucugguaaggauauauaaaagaaaucuuauuucuguagaagccuccacaccacuaauaacaguaauaggaaauggcuaagaaacauacaggauauuaugugguuacacacuuuuauaaaaggggagaauucacuguaaauucucaaaugaucagucuuacaugaucaaaaguucuaaauucaacauuuggauuuuauucuguagguugaguaauggcaauucauggagguuauaaagcagaggacaagcaugaucgaauugguccuuuaagaaggauaaacaggugaugguuuagacagugauaggguuggagggaaggaguagggugaugacaccugaaggagguggauaagugggaauggaguugggccuaugaaugaaauucauuugaagaaagacauaugguuuugaguauagagaauaagagacagauaggagucaaagauuauucuggccaugagccuggaugacugagagaaugauaauaucauuggaggaauuagagauguggaagagggaucuuguuuggggaaaaguggucuagggaaaaugaguuuacuuggggcuuauuauuugaguuguucaagugaaaaauucuuguaggcucuuguagauacagaauuggaguaaagaugagagacuggugcugaaugugaguacuaguacuguuuacuaagggaauacuuuuaaauguuuguuuuuuuaauguguuguuguuuucuuuaaaaucaagaccaguuguuacaaagaaguaacauguuuuaaugucauugucguuuaaaaaauauuuuuacuucuuaaaguagacuagccaaaaggucccgaacuugguaucuaaaaugaauauggggaauaaggauuuugaaaaauagcuguugcucucauucuuuuuuuuuuuuuuucaauaugagacagggucuugcugugucacccagguuggauugcaguggugugaucauggcuuacugcagccucaaccucccaggacucaagcaauccucacagcucagccuccugaguagcugggacuauagaucugcaucaccacaucuggcaaauuuuuuguauuuuuuguugagacaggaucucacuuuguuguccaggcuggucuugaacuccugggcucaagcgauccugucaccuucgccucccaaagugcugagauuacaggugucagccauagcagccggccuauucucucauucuugaagaaugaaagcuccauguuauguuugaaguuuuacgaguugacugcuuuguaagaaaaaaaaaaaaauccuagaucuaugagaauauucccgugaaugccagggauuugcauauaccaguuugaugauuucagaaauuaaagucuacucuaugaaaauguuuuucauuugaaaauuuucccuagaaugauuuaaauuaaaaauaaugaggaaaaacuugugaaucucuacagauauauccacggagacuaguuugaggauacacuggcauagcuaucagagaaccugggcuucaauauuggcccuuccacuuacuagcuuuuuuucacuaaggcaaguugcuuagccauuguaaaccucaauauccucauaugaaaaauagguuaaaugagaaugaaguaauguguguaaaguaaaacucauacauggcacauaguaauaauaauaacuaacccuuacguagcauuaacuguguuccaggcacugagcuaaacaauuauuauuuaauccuuaugagguagguacuuaucccauuuuauaaguaaauggagacacugagaaguaacucgcccagggucauguagcuaguaagugaagcggcaguauuugaacucagacaguggcucuuaacuguucuucuagauugccuuuuaauauguauaaauaaggacuugauauauguucucuacuauuauugucuuuauuuucagaaaacugugacaaguauagauucauaaaauccuagaaguggcaggaauaaucuaugaaaccuaacaacuuuaggaaaaguuguauucauucaacaauuaugaaucacauggaacuauuuauccuuaagguuuuagauuaauuaagggggagggggcaucugcuaugaagcaaacuauaauauauaauacauagaacaauaauacaauauuaaaacuauuucuaauuuuuaaaauauuugcagucucaaaacugguagggaaagugaucuuuugauuuguauuaccaauuacaacuuguucuuucuguuguucauuuuuaggauauaaagaacuuuucauacauuugaucucccuuuuuugcuccuuuugaauaaacuucauauuuucccuuuauacucauauauguuuuaauggaaaugaugcauuugauaauuucagggacacuaaaauaaucaugaaaaauuauuuucaugauuccuaagaguugggaaguucuuaaagcuugcuucuccuugcucauugauuauucaauauuaacuuucccuaucugaaaaauauguuauauaaauggaaauuuauagccucagugcaaagauaauuauauaguuuguaaguuguuuaaaagagaaggacaccuuaaacuguuggaacucuccaaaauguauuuguuaauaaauaaguacuacuaacuuguuugugaaaauuuuauuacuaaugauauaaucuaaauucgaaugaagauauauucuagggguggggagaauaucaggaaaaauagcuaaugcaugcugggcuuaauaccuaggugauggguugauaggugcagcaaacugccauggcacgcguuuaccuauguaacaaaccugcacauccugcacauguaucccagaacuuaaaauaacauuuuaaaaaagauguauuuuaaucuuguauugauuauacauuaaaaauugcugccauuuaauaugggaacauagcuuaauacuaauuguggaaauuguuauaacaguuauuugcuuauaacuuuggauuuugauuuucauauuuagauuuauuuuuaacauagauuuuauuuauuuuuuauuuuuuuggagacaggaucuuguucucucgcccaggcuggagugcaguggugcaauaucggcucacugcagccuccaucuccuagguucaagugauuuuccugccuccaccucccaaguaucugggauuacaggcacauggcaccacgcccggcuaauuuuuguauuuuuuaguagagaugagguuucaccauguuggccaggcuggucuuaaacuccugaccucagguaauccaccugccucggccucucaaagugcugggguuacaggugugcgccaccgugcccugcccuaacauagauuuuaaagugaaccaguaacaguauaguugagcaguaaccuuuggauuucacuguuuuaauaaucuaugcuuuaaacugcaucaguuuauauauuauauauuauauauauaguuaauaauauucuuuauuaacaauauugccaaaauuuuuuuaaacaagaguuuaccaggaagaaaauaaguuagguuuuaauaauuuauuuugcauguuuaauaucauuauuuaaaaaauauauuucuuaggaaauuagcucuucaaaaagguuauaaaaguuauaguaacagagguaaucucuaaaaauagaauaaugcaucuaucauauggaagccaucaugaauuacuuuucauaugucuucauuuucuuuuaugucaagguauaguuuaaaauuauaccacugaauuuuuccugggugcuagauuuauugcucugugcuuuugcacagcuuuuuacuuaaaaugcuuuugcaagaugacuucugaauucaucuuuacagcuauguuacuaucaaauggcaagcuaaaguuuaaaaacaaggcuugguuguaaaacuaugcaagaguguaguucagcucuccugaacuaauuggguaguaaguaugcaccaauugcuguucugcccugaauaugacaugaauagaaaaaacccuuuaguagcaaauggauauuuuagcacauagcagaaaauuaauuuuguuucucaguuagcucauauauaucugaguauguacacaaacacacacacacacacacacaauuuucugacuauggcuaauuccugaaagcaugcuguacuuacaaaggaugcuuuugcucuguaggaauucaccaagguaaaauuuucaaagcauaugaagaggauuguugaaauuaauuaggaggugaggggaaucuugggauaucuacuucuucuagccucugagcuauggcuuggaaccuuggucagccuuauuaaggacuuccuuaguuuauaaguguaucucccaugggaucacaaaugcuuucuuguuugauuuaguucauuugaagaaacauuaaguuucuccuacucauuuauucauucagucacgcauucacccagauuauuuauugagcaccuauacuauguaccagguaauggcagaagauaaguauauaucauaccuuuuagaacuauaggagugacacucuccccacgcuuuggcuggcauucucuucuuuuuccuaaauauuucugcacuagcuagccuucagaauugggauuuuguuaccaugcaacaguguaucagauuuauauauugugacuugggaaacauacuuuaaaaauuaguuucuguaaauuugaguauaccaucugguaaagcuuaucacaguguauauauacacaaaagaaauaguuggcuaauugaaguaauguguguugaucauuccuuucaccuuuucuguauuaccauuuucucaauugggaauucuaccuuuaaaaaccacacaauuuuaauaaauguagguuuuauuuuuugcagguuuuuaggaguaauuuuuaaaaaaggaagagacaugaagaaugaauuugccaaaaaugaaaauguuauaaaaucugaacauuuaugauuaugguucaagauguucuagaaauauucuuauccuuuugacagaaguguuuuguuuuuuuuuuuuaauuucaucucuaaaugucccgucuuucagauuuuaaagccuuaggugagaagagcaaacauuuauugagaauuuucaaugugugugagcauuuuauuuuaauuuucaugaggguaacuacucauacuaugucugugagaaaacggaaagauagagggaauaagguuacaagugauuuguccaaggucccacagcuacuagguguuggagccagcauuugaacccaagaucuaacuuuagaguucacaguauuaacuaccaggcagcaguagaauuuuuuuauacuuuaucuuaucguuagcuacaggcuuuauuugggcaagcaagauaaacacaaccucugggccuugcuuuuugugucuguuaaaugaggguauaguaaaaucaacuuuacuuccagccagugauuuuuguagggaacugcugugauaaugucuguagaaaugcuuuggagaaauuuggagugauauauaacuguaauuuuaauauuauaagauaggacuuaacagcuauaguaguuuaagcaacacauguucagcauuaugacauguccugucaguaauguuaauaaguaauagaguuggcuaaauuuauaguccuuaucaguauuuaaaccuuucaagcugucugagcagauaaaagggaguuaucuuuucacguuacauaauuagugccuuccuuaucuccaggacugaaaaauaaugugguuuuuuuuugcagcuauauuaaacaggugaugacacaacuugaaacuggauuguagccuugcugaucacuaaaagguagauuugcugauaggaaagucaguguaaauggguuacauugcuuuaauccaaaauguaguacugaauuugagacggaaaaacauuuuuuaagaaugaggaugggucuuggaguaagcuucuguuaauacugugugaagaacagacaaugcauacaguugauacagaaagguggcuugucacaugccguucuucagcuaguuuguaagauaccaugaguacuguuauuaucaaagugggaagaugacauguguccccaugaauaggcaauaggugaauauuaauaguacuuaaauuagaagguauuuaaaguacauuaggaucuucagucucuuagauaagucauacgaagcacauaaugaaauuuccaucccauuuugcauuugaaacuguuaccagugaugguuuagaccagaaccguccaguagaaauauaagccacacaguagccacguuaaaacauaaaaaaguugagauuaauuuuaauaauugauuuuauuuaaucugguauaccuagaauauuauuuugacauauaaucaauauaaaaguuuuugaugagauagauauuuuaugcucuuuuuugaauuaaggcuuuagaauccgauauguauuuugcauucaugguguaucucaauucagacuagccauauuucaagugcucaguagccacauuuggcuaguugacuacccuguuggguagugcaagucuggaccgcucugaguuauggaguuauauuauugguuuaaugagaccuaaugacagucaagcauuacaaugccuguaaugugccauguauaguguucucuauaauauuuucagaagaucuuuguaauaacucuaugaugucaguuuuguuaucauuuuagacauagacagugagguauggagauauuaauuugucuaagauuaaacagguagucuguagaggagcaggauuuaaagcuaaaucugacccuaaaaccgcuguccuguuuuuuguuucuguugcacuguuuuaaagcacugccacuagcguuugggcagguaggugggugagguguaguuuuggcacugcucagccagugacuugugauuuaauuuuuccuuauuuuuaggcacaaaggacuucuuagcuuagaguggaagugguaucuucuaaguccuugcucauauuccugauugggaauguuccuuuauacuuguuccucauuucccauucauuaaacugcuuucuacaauucuuuaaacauguagaauggagagauggcucuuugagucuguuacaggaccguggcggcagauaagggaaagcucagcuccuauuggcaaaagugaaaacuaaugucuaguaaaacuuuugucuggaugaagaaguuuucuaaggguuucaguacuucauucugagaaagaauugagaaguucuuauucaucaugcucuuugaauuguaaauauuuuuucaguuauuuuacaggauuuuauauuguggauuaauacuuagcagcauguucuauuuaauuugaauaauuucuuugaauuacauuuggauuccuagagaauauuuucucacaaacuuuuucauuucaaaaggaaaaacaggcagucccuaauuuuugaauacguugucuuccagauuguguguaaaacaguuguuugaacuuggagcauguuuuacuacacugguuuuaaguuccugggcuagcccacagaagccuauuuaaaaccacauccuauuuuagcacuaauauacuguugguuuaaguuuagggaaucagagcauuggaucguguucugugggaguuggaggagaaaguaaguuuauuuuuggcuuuuaguguuuucucuuauacuuuuucaucucuuuaauuucuguuuuccaacuuauacuggccuaagcuuucugcucuuuuacuauaaucuuggcucaauaacuuuaaaagauucaauaacuucuaagugcucaauaacuucaaaauuuucuguauggaauagguuuacuuguugagugcuuggcaaauaaacguuuuaugcucauucguaucucauuuaguuuuaagaguuuuaugagguaggggcuaguuuuccaucauuaaugaggaaucugaggauuagguuaaucacuuuguccaaguuuauagggcagggagaggaguuauggaguuaacguuguuggguaaaaaccuuagcaacaugacuugaaagcucauccacuaaccauuggacauacuguuuuccuuuuucacauauccucuucuccuuucucucuuuacuaaguuccaacucccccuauucccucaauucagauacuuuuuuuuucuuuuugaaagagaugugucuugcucuguugcccaggcuagccucaaguaauuacucgggccuugggcucaaguaauccucccaccucaguuuccugagcagcuggucuacaggcacacaccaccaagucuggcagucaucuacuuuaaacuaaauguuaggguaagccauuugauugaaugaauucauaauauaauguuguagagcucuguucauaaaaauuguaugauuuuaugauaaaauuugguaaugugauuaucuuuagugaggauugagccaauauggaaucagaguuuagcccugccucucuaaauuguucuuuauccuuaaauguguaguagcuggauugccuacaauucuacaauuuucuguuagaauuuauggcaguaguuuucaacuguggacugagaacauuuugggaacugugcccauuauaaaguuugucugaagaccuaauaaauaauuugccuuucauacugugcuauuauuuuucaaugguauuucaauacugcugugauuaaaauauaaaauauuauaugcaugguagaauuuggucauauuuucuuaauauaaguggauaucaaaaguacuguuauggggaaucugaauaucuugauauaaaugaaguccuuuugcuuuaagaguggagaaucauuacuuaaagaauguuacaaggaaauuauauauaaauuuuauauauaauauauauagcauuuauuuucaagacauucauacuuaaugucacagaaucaguuguaguguugaaaugacugacugacuuaccagcugguaaccccuuaaucucagaggugauuguacaagaucuugauuaacucagauucuauuaauaucuuugauugguaaaacauuuuuggcaguaagugaaaaauucaggcauuauaaaagacuuggggagccuugccuuggaguuuucuaucucucuaagaacugucauuuuaucccaguagcucuaugguagagacagaugaagguuggaguagcaguauauuguguuauuuuauaaacgugcuauuuuuuauuucaugcugagauugggaaaagauaacuuauuaaucuaucuaagauauauuagguuaucucucuccaugcugcugggcauaguuacaaaacauccuauuuuacaaugaggaacuagagucccacagaggguaacuugccugagauucuaagucauaaacuuuggagcuaguauuucuugccucaagagauuuuuuuuuucuuuuacauuuugcccguugcuuuuuauugugaagagauacuuauucaucuaaaugauauaacuugcggagcaagcauuacuuaaaacaaaauuuguauuuuacuuaaauuuuaacaacuuaaauucuuuaauuuuuaaaaaauuguacaagguugaacuuaauacaaaauagcuauaaauuauauuaaugccaucuuauccaagaaugaaaaaggauaaaaauauuacucauuuacuuugaaaauauucaguaccuuuuaaaaaauucuaauauuuggguuaggaaaugagaaacuaggaugauuuaggagagucuuuuccugaguuuuguuuugggcagaauaucaguccaaaugcauuuaaaaaaauaggaguauacuaugcugcaagguugguuuagauugcuuuuuuuuuuuuuuuuuuucgacaccuguuuucuuuaaaauuccuuuuggcuaauaaauuauuuaaggguuaaaauaauaaaagacacugguauuacaucaguaaguguguagugaugaagaaccauaguacaaacacaggaguuaaguaaguaaaaauauauaagcauaguguauggguuuugauguuuaaaaugcaagauuaaauaggcuauaguaguauguugggaaauuuggggaaaaaaacaacuuaaaguggcaagucaaaauucugcuaagaccauaugcuagcuagaacagacaugauaugaauauaaauaaguuacuuaugcuuuaauuugcaaggacuuuuacauauguucuuacacaaucagcuuuaccaauuuauuacaggguuguugccauacuuuuauuuuuccuaauccuuguucugcaggaagggaggauacacugaaugaauaaaagcagauaaacuuaaaaucaaugguuuugccauauaagaucaucuuaggauuuaaaaggguuuuagaagccauuagcuacuuuaggcaauauuagcuacuuuagcuacuucagggguuugagggagauaauguuuuaguugggcucuuuugguuauaaggauaguuuuaagaaagugaguguuuacuaugaggauauguguagacuucaacuguagagacuuuaacaauucaauucaagggauuccaggucugugcuugugugugugccucugucucucaguacugugcuaaguuuuucuuggguuguuucacuuaauucuuaaaauugaggccuagggagguuaagaaacucauccaaagucaguaaguggcagaaccagauuugagugcagauaaucugacucccacuaugggaucuuugucccuguacuguacuaucugcacaauuuuguauuucauguauuuguuuuuuaaauuuccuuuggaauuauucccacuuccccccuuuaaaaaaaaaaaucucacauucuacuagacuaggaguucuuaaacagugguccaucaaucuuaaggaagagauaaauggacuccagguaagcaguagcuccuugaaauuauauguacauuuuugaauauguaugcauuuuugcagggugaggguucauaaauuuuauuaaauucucaaaaggaucucuguccuucaaaguaguaagagucacuguacuaucagcagcucuagggaagguucugaguucuuaucuuuguauucccuagcaccugguuuuugguuacucaauaaauauuuguugaacagaccuuaacaaauagagaugguauguaggaaaauaaguuugaauuuaguccuaaucuggaauuugaagaugcuuucacuguuuauuuaaaaugguguuaaggaucaaucuuacugacuugguccagaaaacuguuuucuggcagauucaaauuuuaugaaucaaguuuuuugaaguuagguuuuugaaaucagagaauaaagcaaaauucagcauuuagagucuacaguagggugucuaaaaaaggccaguuuuuuuucccccuccaguauaguauaaagacucuuuuaauauuggauaaaggauuagggaacauuauacauuuuaaacauuaaaaucauacugcaggguugaaguacacuauauaagcuacauggaaacugagagcagcugaaggcggggagagauagccuaguaaacuuuaggcagaauaaauuaaacaguuuauuugagcaaaggaugauuuaugaauugggcaauacuuagaaccggaagggauccagagaacuccucuccaaagcagugaugggcagugagcuuuuauaggcugaauguggaaguaagacaaaacauaaguggaaaggcccuaguuagaaguuaguuggugguuucugauuggguaugcuuaaguuuuguuuuacuguuuacacgggauuggguuuugguuugcuuacagaggaguucuguucacagagaaaaucuucaggcuaauggcuuccuccuuacuugcuuuaacaauuuucuccuuuugucagccucuccaucuugagugcuugacuaaaacuuugagcauuguugacacuuucugucaccauuauagugacuuacuuggucucaguauggaauacaaaagucaugaugucaggcucauggaagaaguauuccuuucuuguucaucuuauuuuuguugcucuaauugcagugagaccauuuggcauauugcugauggcugcaaacauucauuuaagacacuagaaagaauacagugcaccagggagaugacaaugggcacuaucaggaggauaauaguaguucuuucuuacccacaggcaguauguuucaagacucccauuacuccugcaguggaugccugaaaauggauacuaucaaacccuauauauacuauguuuuuccuguaauacauacuuaugauaaaguuuaauuuauaaauuaggcacaguuaagagauuaaaacaauaacccaaugauagaauuguagcaauauacuaauaaaaguuaugcgaauauggucucucucaaaauaucuuauuuacuguacucaucuauuuuugguccaugguugaccagggguaacugaaacugcagaaagugaaacugccauaaggagggaggagggacuacugucaucaaaggacugguguaugcucuuuagccaaggccuccaugaacagaaccaaguaaaauaaaaagguugauggcuagaacaaaccauaaacucacucucuguguccggagggcaguuggucaagguuucuagauuugagcucaaagcauauuucccugguuugcaguuugaauguuucugguuauggcaaugggcauuuuggugaacucccugaguggcccauucaucagcagggaugaguguugcccaguacccgccuguagggcgucagaaaccaagcaguuuauagauacaaugucaaggacaaugaacaggacuagaaucugauaugcacaagggugcccuguaguuuucuacugaaacauaauuuuucucucuacagcugcucccauuucuaucaaagauaaucacaauaagacuaauuuguuugcaaaauaggucuagucucauuaaacuuggcuugauaguucacauacgugcagcgagaguagugauggaccauauaggcucucuuuaaaucugcuuugcuggaauuuuuaaaggcaucucagauuagacuuuuaaaagccucucuaggcuaugaagccaugcugaagacuuaccaguagacuuugcccguaauaccuauagauuuggaugaauuccucucuucucaagguccucaaaauauuuuuaaaguuacugggccugccuuacucaacucuuaaggccaggaaacccuuaaagccucguaccacacuaguuuuuuccaaggggcuuucauggcuucauaaaguaaaccuuaguucuuuaaaacuggccauauccagcucuauguacauuuucaaauaugacuuuccggucaaaagccuugguauuauaaccaguguuuccaguuauaacuuguuacaaagagaacagauuuuuauugaacuuaugcaaguaacuuacugcaaaccaaaaauaaaauucgaaggcccccugcaaccaucugaauggacuuccuccuuggcuagggcacccuaacauuuaaccugaaagacugcuucaggccaugaugggaaguggggguugaacaugccucauuuauguugggguuggacacgucucauuuauaccucucuaguauuaaugucaacacagacccuaggucugauaggaaacauauacagucuauucucucuaaagcuugcuacuuggaggcuucaucugcaugauaaaaaccuaggucucugcaaccccuuccuuucuauacaucauaacucuuucaaccaauugccaaucagaauauguuuaaaccuaccuaugaccuggaagccccugcuuugaguuuuccccaucuuccagaucgaaccaguguaaaucuuacauguuucgauugauguauuaugucucccuaaaauguauaaaagcaagcuguaccccaaacaccauaggcacauguugacaggaccuccugaggcugugucauggguggguccuuaaccuuggcgaaauaaacuuucaaaauugauugagacuugucucaguuacuuuuuggucuacauuguauugccauaaaaauagaaauacuugguuacgguuucugaauucuggagggaucagauaguugagaaaagguguuucaucuucauucacaaagguauaguuuaccaaauuguugaaaguuguagagauagcuuaagagaaaagaaaaaaguuuccuuaaaucugcaaagcacaacauugcagaaucagcaguguuuuaaacaaaaaggccauaaaaauaaccuauaauuuuucuucaucagucguucagucucauguaauuccuguucugcuugaugucaguuuaacaauuuuaugaaccaguuucuuuaauaguguuguggaaacucuuagccagagcaaugguauaaucuuaaaguuauaagaaaccuguacuuguucagagucucuuccaugaaucuccuugaagacgaaacacuuuaggauuauaguugcuugcaaaagcuuucaggaaagcaucagaguaaaaauuaucucuggaugacaggacuuaaaauggcuaugauaagaauuuauuaugcaaucgacaaggaaauuuuauuuuuugugacaucaguauuuuaacauaaaaaucaaaauuaugacugguaacaucauaacaggacauaucagauuuguaggaauuucauaccauuucuagaacacucaguaacauacccaggcaaauauaacucaaggaaaguuaaacaucauugcuuauuugacagugcuuaccguguaaauuuaacauacugaauaagguaguuuaacaucucucuuuuuaugaggagagagaacagauucuuuugagauauucuaggaauccccuggaaacuaccgaaguuaguucaaggugagaaagaccuaauggaggcugggcaugguggcucauaccuguaaucccagcauuuugggaggccaaggcaggcagauguuugcugaggcaggaagcagccugaccaacauggugaaacccugucucuacuaaauuaaaaaauuagcuggacgugguggugcaugccuguggucccgguuacucagaaggcugaggcaggaaaaucgcucgaaccugggagauggagguuguagugaaccgaaaucgcaccauugcauucaagccugggcaacagagccagacuccgucucaaaaaaaaaaaaaaaaaaaaaaagacggaauaauggaauagaauuuugggaaaguuugucaaaaauaucagagguuuaaaaauacuugauuaaaguagaucacagaucacuugaaguaauaccuacugauuuaaccagagugguaauuuagagacaaauauagaaaguuacacaguugcuuaaaaaaaaaaaaaagcaccuuagcucuuuuaauaugaagaauucgguuuucuuaagcaaagaccuaauaaagcaagaacagaccaauacuucaagaaaaguuuguuaccacuguacuuuugauauuaagggucaucauuuuuaaaguaacuuuuaaauauaaaauucauucacguccuagccaccuugaccauacauaaaauuccuuuuucacgguugcuuuucuacaugucuacaguuuucucauaugcauucauaugaaugcccuauagggcacggguuuuguccuauaccuguauagguuuugccuguguggguauagguuuugcccuauacccgucuuccuucccauugugcacaaccagucauucuucuuuaggauggaaguuacuuuuucccuuaacaaaaacacaucuuuuauaccuuaauagcuuuuuuuuuaaccaaaaacaugucuuacuuuccuccauacagaguuguuuaccuuauuauuucuaguuuuaauuaccauauaguaauuggaauuuguaaauuuaauuuuuagaagcaugugcuucuucaugguacaguuuuucagugggacacaggacaugauuacuaacagaccugaauaucuuucguucugaaauaagccaaaaguggauaacuuaaguugagcacuuaauguuucaguauuuuaucuauguggaaaugaucuagauauucaaugaauaucugucauuuaauuuaacuuagcaaaacuccaauaguguaaguuaacagauuuuggaaacugguuuuaaguagauguauuauaacauaaaacaaagcuagccauuaucaaguuauuuccuuguuagcuauuuuuacagcaugugcauguuagguagucaucgugaaagcaagaaucuuaaguuaaauacauguuuuuuuuguuuguuuguuuuacugcugugcuguauaauacaugaugcuguuagcagcggaacguaucagagacacggcaccaaaguauguuacugucggcgaauucauacggcucugcagcaaccucaguucuugccuucucagcagaaagaauucgacugagaggcauaaggcagaaggagagauugaggcaaguuuuaaagcaggagugaaagcuuuaaagcaggaaugaaaggaaguaaaguauacuuggaagagggccaagugggugacuugagagauuaagugugcgguuugaccuuuugacuugggguuuuauaugguggcaugcuucuggggucuugcaucccuuuucccaugauucuucccuuggggugggcuguuuguaugugcaguggccugcuagcacuuggaaggggccagccuaugcaguguguuuacuggaguuguaugcaugcucuuuugagguguuuuucccuuaccacucacaugucccuggaaggucauauaucaguuaaaauccuccauguugcuucuuaaugcauaugcuggagcccacucgcccgacuccugacaucuuauuggaaagcugcugaucaccaauuucagguguuucuguuuacugggagacugcggaucccuggcucuggcugcaaccaauuauuagagagacaguuaacaacugccuggccaucuccugauggucgccuaacauaacuggcuguguguguguguguguguguguguguguguguguguguguguugggggagggggccucuccugcccugcuuauaccugacuagcuaccuacuguaacaaggcacuuggaaacuggacguugcacuuucacuugcacauuuguucuuagguugaacccauaguucuauaaucuuaaacaucuaguaaagauaacaaacuuauuugacuaguaaaagcagguaaaauaaaauguuaugcucguauuauacuuaaagcugguaacucagaagacacagcuguuuguauuaaaccaacaauauugagcuagucuuauuuacccaagauuuacccaaguuaugugaacuuuaaaaacauuuuggguuaguuccauugucuuuaagaguuuaaguaauacagucuuccuucugucaagguuccaugacccccuguggaaaccaaaaucugaagaugcucaaguuccacaguuggccuuguacauacaaaaaguuagcccacuguauucuuguaaccauccaguggguucauuuugccuguugcccagauagagcugauuuaucaagagaggggaauugccauagagaaagauuuuaauucauggagagccagcugaaugggagacuggaguuuuauuacuucucguauccaccucccugaaaauuuggaggcuaggguuuuucaaggauaguuugguggacaagggaaugggugcugcuaauugguuguggaugcaaucauagcgguguggaaauggucccugugugcugagucugcuucuagguaggggcuacaaggaccuguugagucaagggucgugggucuggauggggcuguuggugguccgaaacauaaaagcuugaaaagacguaucaaaaggcuagucuuaggcucuacaauacugauguaggaguaauuggggagauuguaaaucuugugaucgccaggauaaugucugguaauugauaucuauaccuuagcagaauuugggcuccucucaucuuccuaauuuuguggucuuucauuaguuuuacauaggcaguuuaguuuuggggaaugguuaguauuuaaacuauuaucuuaauuauacuuuagauuauaauuuauaaauuauaauuuagauuauaauuuauaaauuauaauuuagauuauaauuuauaaaauuaaaauaaaauaauuauuaaauuauuauaaucuaaauuauugaauuguaaucuaaauuucucccaaaguuagcuuggcccaagccccaggaaugacuaaguagacauuuuggagguugaaggcaagaugggaguugguuagaucagaucccuuucaaugucauaauuuucuuacuguuauaguuuuugcaaaggugguuucauucuuggguucugcaaccugcaaauacuguauuuuugacccaugguugguugaaucugcagaugcagaaccugugguuauggugggccagcuauacuuaauuuacauaagcacuuacuuuucuuuaagccgauuaaauggagcucuuuuauaaauugucuuuggcaauaccauccggaugucgaaaaauaucacaaaaauguaacacauguacguaaauauauaggcagauauaaacaucauauagcucucauucuaaaauuuuagucgugugccaggucuaaauacaaaacucacuuguuuauuaaaaaaaaaaauagcuagauucaaguuguguaucuggccagauggcuacgcuucuuauugauguuuaugaaaaagacugaagauuuuuuauuugccaauuuccaaauaguuguaccccuguuuuccucuucugaugagucaucuucccuaaauuugcaugucuaaagggauugcucuuagguuagacuagguagagcauuuauaucucaaaggcacagagcuaaggcuucaggcuucaauacugucauuuacugaaacaaggaaagacgaguguagguaaagccccaguuacaacaagauggccaggaaaagcuucuuaaaugcuuggguaaagcuaguuauauagguuuaagucauugccuucuccauucuaagaauuccuagugauucaguccuucucucucuggugcagagagagagacaaaugauuucuuuuauagauguaaauuucccuuacaaaacagucuaaaaauaacugguuaaaaauaguccuuaugccaguagggcagauuuuggagacuaauuuggcuagaaggaucaagaaguccuggaucuuguccuccaaugagaauucugaauuccucagcaaauuucuggggguuuuccuuugggacagagaaaauuuugcuugaucugagcucaagauuuugaccaaggcauaaaggugguuaaagauacagaccugguugaugugugggccuaacuuuauaaagcauuugucuagcuuuucaucuuuggguugggaagauaacugagcuaaaagcuuaguagauaaagaauaggcagaggaugggguggggugguggggucagaguuaagucagucaacauguaauuaaaaaaaaaaucaacugcuuaagcuuuucauuugccuuuuguagggagucuuugagaggcaauuuuugagucuuuuaggagcuucuucugcacaccaaaaaaaaccccaaacagaacucuuguuucugagguauuuuggauccuguuuuucuaaugugccuugcaaaugaaauuuuaucacuguggccccuguaacucuugaguuaccuuugguaagguucacucauuucucuaaaaaaaucacagguucugagcccuuaguucuuaaacauaaaauuggcugacguuccagaugguuggaguucuagaguccuugucugcagaugaacccaugauucacagccuucucaaacuuaccuaacuuaccuuauauaagacuauauugggccuccugcuagacccaauauagucucugucaugacuuacaggcccaguguggaucggaaaugcucauagucaagagaauucaaaacaaguaguuaagcuuguaccugagagggaccuaccaauggugaccuccaaaugcgcagcaaaaagugaugaacucaaggggcucagugggggcacuuaugccuguuacucauugcuccuguggguuaucauuggugggaucuccuucagacccucauuucuaacacuagaacuauuaaaagaaaaacuuuagacaaaagaaauuuagcagaguuuauuuaagcaaagaaugauuuaugaauugggcagcacucagaaccagaagagguugagagaguucugcucugaagcaugugggcaguguacuuuuauagccugaacacagaaguaagaugaagaaaauauauuugguuagaguggcaagauccuagcuagagguuaguugaugguuucugagugguugagguuaaguuucauuauccuguuuacauugaauuggguuuugauuugcuuaacguaggagcuccauuuuacagagcucaggcuaauggcuucuaucugauuuguuuuaauaguagucauauuucccaucucaagguguggcugaagcacauguuuauugucuguaauagccaaguagaaugguugugggaaauuguagguaucauuguuuuagcauucacucacacauauucguguauauucucucacuccacuacaaguagaaguuguagaaguuagaguagauguuaagugagaaucugauaugacuacaguauaugcugaacauucuguccauuguguucauggggaagcaugguuuuuacucucaagguuccauauauuauaauaaauaaaaaugucuuuagccuacuuuaccacauaauguaacuacuuaaauuguuauuuuaccaaguaguuuuguuuuugacuugaugacauacuuaagugucucuguuuccugaaugacuuuucaucugugucuguuuucuuccagagguaaaaccaaacauauauaucaguuuuaagcacauuucucauaaagucaaugacgggaacuucuuuaaauucaguuuauauguuuguucuggucauucuuccaccucuauauguugucuguauguauaaugcccuuuuccuuuuuuaucagaccucugcucuuuauucccauucagugaauggaggggaaacuacuacuauuuaagucuuacucauuuuauuucucugugcguuugcucucuccaguuuucuuauuugcauacuguuuuuaugccacucaaaacuaaaacuggagauaaucauugaagauguuaaauacauauauuguaauuuugaauguuacaaaguagaagaccuauuguauuuaauuguaugugaaauuuauauuuauugcauugcacaucuccaaaugaugugcacauuugugcacaucacaaaucccuuuuggaucuccaaauucuuguuuagcacuauuccuucagaauugacuuuguuauaauaaaguuuuacuuguaucuuuuaguguaaauuuagaggaacuguuauagucuccaguguguaacaguuaauguuuaaaauuucuuccuacagugagcugucaccauguuuaauaaauuauaguauucauuagcauaaauuacuuugggugccaaguuagcuauugcacagaugcuuuguauuauuuauagauuuguaucuaaccuuuacaaguugacuugcuuuuguuuuucuguucacuugucaccaugcaguaggcaguagcauaauuauuuaaguaauaaaaauuacaaaaauaauuuucaggaagagaucuguugaaacuucuaagaguuagguugcucaaacuuuucuaccuugagcaauauaguaagauaaagcucccauauuuuaaguagacauauugcguugucuuuauuugaaucugauccuuguauauuagugccucgguauccgugggggauuuauuccagaacccccacagauacuaaaauccacagaugcucaagucccucauauaaaauuguguagaauuugcauauaacccaugcacaucuuccuguauaauuuaaaucaucuuuagauuacuuauaauaccuaauaugauguuaaugcuauguaagugguuguuauacuguauuguuuuuaaaauuuguauuauuuuguauuguuauauuguuagcauuuguuuuguuuuuuuccucccacguaucuuugaucugaaguugguugaguucuugaaugcagaacacacggauacagagggcuaucaccacuaccuuucuucccaacauugugguaaacuacaggggugucuuuagcugacaaauuagauagaggcagcaccuuaauuguuucccucuggaguuuugagcugccgggacuuacuuuugucuuugugggacgggugaagcaggcaauucauuauuaacuuuauaguuuaucuuagaguaaauuguugauauuuacuuaacaucuaagagucuucucuuagauuaaacuuuuuuugaaugaggacuucaguuuuaguuacugaucagauucaggaagaauaauucuaucaaacauucuuuuuugaguuguggaugcucuauaaagauaucggaauucaucuuuggaaggaacagacugucauuaaagucuuaaaugucuauuuugguauuuucuggauuugcuaaugaucuaacuuucuaauuuaguaauauuuuauuuagauaaaugaaaccaugcuuaugaaaucauugacagaugaaucaccuccaacucaauagguuaagcauuuuagaaaauuuaugaauauuuucagacacauauuuuaaaaauuucuagacacaagaucuuauauuuuagcuauuuuucgauaugcuauguuucugacaauuuuaggaaaaauaaaaucuuauuucuaauguaaauuauaugaauuucuaaaaauaaggcuauauuaaacaucauucuaaaaccaaaaaaaaauuguuacauuacaaugaaucuucuaggucuuugcaaaagagagggaacuuuucuuuuucaguuuucaauuuauaaagaguuuagauugaauuaugaauaaagcugcuguaaacauccaugugcaaguuuuuuuuauggacauaaaguugucaccuccuuugaguaaauaccaaagagcaugauuaauggaucaugugggaagauuauguuuaguuuuguaagaagccaccaaacugucuuccaaaguuggcuguaccauuuugcauuccuaccaguaaugaaugagaguucugaggcaggagaauagcgucuggaggcagggaaccuaaggcugauugacgcugacuuccuagaacugaaucaaaaggaaaaccccaacuuuccaugcccagguaacaagggaacagagggguugggggugcaaccccugcacccccaaccccucugccaccuucugcauugcagaugagaaauggaaaguaccuuugauugguccgcuccugcaacugaucagacuggucaccggccuagucuucauuugcauaaagauguaacuuugugacuuaagccucugauuggucacuuuccaccaucaaucagacugguugugacccacuacuucauuuacauaggguguaaccagguaaccagugggaaaccuuuaguggguauuuacaccccagaaaauucuguaaccagugcucuugagccacuugcucgagccugcucccauucuguugaguguacuucugguucaauaaaucugugcuuucguugcuucauucuuuuguugcuuuguguguuuuguccaauucuuuguucaaaacaccaagaaccaggaugacucauagucaagaccuuccaccaguaauaguucuacauccucacugcauucgugaugucaguguucugguuuuuagccauucugauagguauguaaugguaucucauuauuuuaauuugcauuucccugauaacguaugauguggaucaucuuuucuguauacuuucuuuggugagaugucuguuaaguucuuuggcccauuuuuuaauaggauuuguuuucuugaauuuuuuucaucuauuuugaauagcaguacuuuaucagauaugucuugcaaauauuuccugacagucuauggcuucucuuuuuauucucuuaacagugucuuuuauggagcagaaauuuuuuaaugugaaugucagcuuaucacuucuuucauggauuauguguuugcuguuguaucuaaaaagucauugccaaacccugggucaucuagauucucuuuuaucuucuaggaguuuuauaguuuuguguuugauauguaggugugugauccauuuugacuuaaguuuugggacggguauaaaaucugugccuagauuaauuuuuuugcaugugaguauccagguguuucagaauuauuuguugaaaaaacuaucuuugcuccauuauauugccuuuguuccuuuaucaaagaucaguugacuguauuuauaugggucuauuucugggcucucuguucuguuucacugaucuuuuugucuguucuuuuaccaauaccacacugucuagauuauuguaacuuuagauaagucuugaagucagacacugucagucucccaccuuuguucuucaauauuguguugguuauucugggucuauugccuuuccauauaaauaaaccuuagaaucaguuuaacaguaucccgaaaauaaucugcugggauuuugauugguauugcauugaaucuauagaucaaguugagaagaacugacaucuagaaaauauugagcuuucuuauccauggacaugaacuaucuuucaguuuaauuaguucuuuuugauaucuuugaucagaguuuuguaguuuugcucauguagauuuuguacauguuuuguuagauuuaccuauuucauuuugggaggaugcuaauguaaaugguauuguguuuuaaauuuuaaauuccacuuguuccuuacuggcauauagcaaaguaguugacuuuugucuauuaaccuugcaucuugcaaccuugcuuauuaguuccaggaguuuuuuuugaucaguucuuuuggauuuucuacauauauugucauauuaucugugaacaaaguuuuauuucuucuuucaaccucuguacuuuuucuuucucuucuuauugcauuagcuaggacuugcaguaugauguugcagugcaguggugagagaagacaagacauccuugcuucauuguucaucuuaaugggaaugcuuugaguuucucaccauuaagcauguguaaacuguagguguuucuauuuuuguuuuguauucuuuauuaaguugaggaaauucccuuguauuccuaguuuauuuuacugagaguuuuuuuugaugcguggguauugaacuuuuuuuuuuuuuuuuugagauggaauuuuguucuuguugcccaggcuggagugcaauggugcaaucucggcucacugcaacuuuuuccuuccagguucaagcaauucuccugcuucgaguaguugggauuacaagcuacccaaccugcuaauuuugccaccacaccuggcuaauuuuguauuuuuaguagagaugggauuucaccauguuggccagacuggucuugaacuccugacaucaggugauccaccugccucagccucccaaagugcugggauuacaggcgugaaccacugcgccuggccuggguauugaccuuuugucagaugcuuuuucugcauuuguugauaagaucaugugauuuuuuuuuucuuuagccuguugauauggacuacauuaauuuauuuucagauugcacaccugcaauaaaucccacuugguuguaauauacuguucuuguuauacuauguuggauggaauuugcuauuugcugaagacuuuugcaucuguauucaugagagauauuggucugaaguuuucguguaaugucuuugucuaguuuugguauuaggguaaugcugaacucauaucuacuucucucuccugaaagauauuguagagaauugguauaaguuuuucuuuaaaucuuuggaagaauucuccaucugggccuggugcuuuauauuuuggaagguuauuacuuacugauuccguuucuuuaauagguauaguccuauucagguugugucuucugugaguuuugacagauugugucuuucgaggaauuggucuguuucaucaagguugucaaauuugugggcauagaguuguucacaguauucuuuuguuauccuuuuaauauccaugggauccauaguaauguccccuuuuauuucugauauuaguaauuuguuuccucucuuucuuagcuagcccaccuaaacgcuuguuaauuucauuaauauuuucaaggaaccagcuucugguuucauugauuuuucucuauagauuuccuguuuuuuaauuucauugauuucugcucuaauucuuacucuuucuuaugcuuacuuuggauuuaauuuauucucuuccuaauuuuccaagguggaagcuuauaaaugauauuaggucuuucuuuucuaauuuaugcauucauuaagucauuuaugccuuaaguugcaauuuuuugaauuucugcaaucaggccuuggcaaugaucuugugcaguaggguaugaauaacucccacaugcuuagcguuccaauaauggaacacuagacauuaauaaauuucccucaaaagcacugcuuuugccacgucccacaaauuuugguacauuuuguuuucauuuaguucaaaauauuuuaaagugucucaagauuucuuuguaaguccauauguuauuuagaaguguuguuuaauccccaaguauuuugggauuuuugcauuuaucuuucuguugauuucuuaauucaguugcagccugagagcagacauuauaugacuucuauuuuaaauuuguuauggcauguuuuauggcccagaauguggucugucuuggugaacauuccauguaagcuugugaagacuguguauucuguuguuguuugaugaaguagucuuuuguucauuauauccaguuaauuaaugauuuguugaguucaacuaugcuuacugacuuucugccugcuggaucugaccauuucugguacagcaguguugaagucucuauauuaguggauucuuccuuuuuuuccuuuuauuucuaucaguuuuugccucacauauuuugauacuuuguuguuagguacauaaacauuagauauuguuaugucuucuuagagaauugaccccuuugucauuauguaaugcuccucuuugucacugauaacuuuucuugcuuucaauuuugcaguaucugaaauuaauacagcuacucuuacuuuguuuuauuaguguuagcaugguauaacuuccuccauguuuuuacuuuuaaucuauaugugucuuuacauuugagguggauuucuuacagacaacuuauacuugggucuuguuuuguuauccacacugauguuuuaauuggugcauuuaaacuguugauguucaaagucagacuuaaugucaucaauagcuucuaagaaacucacuuuuuuuuuucauuuuuuuuuuuuuaaguucagggguacuugugcaggaugcacaguuuuguuacacagauaaacgugugccauggugauuugcugcgcugaucauucugucacccagguauuaaggccagcauccauuagcuguuuuuccugaugcucucccucaccccacccaacccucugacaggucccaguguggguuuuuccccuccaugugccuguguguucucaucauucagcucccacuuauaagugagaacauagaguauuugguuuucuguucucguguuaguuugcugaggauaauggccuccagccccauccacgucccugcaaaggacaugaucuaguuccuuuuuauggcugauaguguugcaugguguauauguaccacauuuucuuuauccagucuaucacugaugggcauuuagguugauuccaugucuuugcuauugcgaauagugcugcagugaauauaugugugcauauaucuuuauaauagaaugauuuauauuccuuuggguauauucaguaauugauuggugggucaaaugguugaacuaacuuacacucccaccaauaguguaaaagcauuccuuuuucuccacaccucgccagaauauacuucauaaggacuuguugaaaaaccugugguuagaagucuuucuuacagcuuuuguuacagauaucucaaacugaggguacaauuauaauguggaauuagugcuugaguaaauauaaguaauuucaguuauagucucuguauuaguccauccucacacugcuauaaagaaauacccaagacuggguaauuuauaaaggaaagagguuuaauugacucacaguucugcaaggcuaggaaggccucaggaaauuugcaaucauggcagaaggagaagcagaagcaaguaccuuuuucacaaggugaggcggccggagagagagaaugcaaauggggaagagccacuuauaaaaccaucagaucucaugagaacucacuaucaugagaacagcaugggggaaacugccuccaugauccaaucaccucccaccaggucccucccucaacacauggggauuacaauuugagauuagauuuagguggggacacagagccuaaccauaucagucugauaacaguuuucugccccccucaagaaucuccauuuuuauggugagcaagugugagacuuucagaugauuacaagguugaaagagaccauaauuuuuuuuuaucauauauaaagaauaagaaccagcuaaguaauaaggauaauggaaaacuugauucugaguuuugaccuuuuacuuccuuagacacauuguuuucaguuuucuuuauagucuuagugcuuugauagccauguuuaaaguuuuuauuuuuuacaaaaucaguauguacuuucuguuauuuuuaaagaauaguuuauuugaaaacagcaugggauuuuugccucucaaacaaggacaggugaaaauugggaguucuguaggagagcagaaguggagaggcuuuuguguucuugcccuuucccuucucuuuaacugauuauccccaucuagguuuguaucucgaaauucagaucaauaggugggauuacaauugaaagguuauuaaugaauacaaggguggugguacaagaguuuaccuuaggcaaguuguauggaagacaguaauagauaauuuuguccauaaaacuuuuccuauuuugauuauguaaucucaauauucauaauuuguuaaguauacaucaagggaacuguuccugucaucuagaaugaccaucuauuuaauaaagccaugaaacaauuagagaacuuucagaaaacaaaugggcauaaugcuauguugcaaaaacauguccugccuuguucacccuguccauuuuuagauuggucuggaugauagugaaaugcagaaguguuugccacacaggugcaguguuuugcagcuguuggaaacauucccccucacccacaaccccuuugcuuucuucacauaaaauuaugcugugcuuagaccauuaauacuagaagaugggauuugagaauuugaaugucuguuuacauaaagauguaauacagagaaauaacugcucauucaggcaucugaauguaacugccuagaugaauuuauuaaaacuguccuuaaggucacacuagccuuaaggucauggaguuuuagauacaagagacugccuuuaaaacuccugucuguagaauugcugcccuccaggacugaacugucuuugaggacagggcuuauauauauuuauuuuuaaaucucuuguaacuaacauaacaccuggacaaguaggcacuuuauauguuugcgaauauuuuauguuggaagaugaagccaaaugaaaauaucuuuuaguaugguacuaaaucagaaauuauaauuuuuuuaaacugaugccaugugguacacucuauaguagucaugaacagagugccauggccugagagagaaggggagagugaauaaucauguccauggaaaucacgggauacuuuauauuuuuauguaucacggaaaauacuucccuagacuacaauuggagaauuuguuuugaagagaauuuuuuuccucaucuaagagaaaauaauguauuuuccaacagcaguguuuucccuccauauccccauuuuugucauuuuugaugcauuauauaauaaccaaauuaaugauucaaaauuggaaaguuuuagagcaugcuuucuuuauauaaaaccaauauuuuauuuucuguaguuauuucuaugaugagaguuauguaugcuuuggagucagacauaaauagguuugaaucucauauuuuuuaaucccaacuuacuaaauuguuuaccucaaggaagcaacuuaaccucaacaugucucaauauuucugucugcaaaaauagggcuaauaccacucuaaacgguaguguuaugaggaugaaaugagguaccucuugaguacauggcagcagcauuauuccuggcgcguauuaggaacucaguaaacauaauuuccuuuuuauucaacggagaggguuguaguaaucaagacuauaguacuuuuucuggcauugaugaagcugcuauucuaggagaccauaguaugcccucaaguuucuauuuguucagcaugugcauaguacacaguaucugcaaaggcauugagauauguggcgauauugcagucuuguugggggugggggugaggaguagaacaccaaauauugaaaucaugauaaaagguaguacauuacugagauucugagaagggggauucugagaaggaggucacgauaaacugcagugauuaggcauccuucauggugguagcauagcugcgaacugaaccuucaaggcaaauuggagaagaaaaacauucaggccuaaagaagaccagaaagagcaagugcucagucuucugagagaauauuuuugugugcuguaauugacagugguuccauguauacagaacaaaaaauugucauauuagacugaagcuggcuguguugauccaaagaaagcguaggaaagcauccugaauauacuauugccuguuuuccugacucauaaauagcauauccuuuauucuccaaaugcuuaggacucuuaaacuagcaaagcauauacuuugaaguuuauaaacguauagauguguuugcaaguuuuuccuuuuuaucugagaauucauaacaugauaaacuuuauuucuguguaagagaauggaaaacaguuuacauuugagaaaagaucaguaaaacuaguaacauuuuuggaauugguggggguagaggaagggagggauuuggaggagaagcauugugugucuuauaagaaauuaucacaagauaauuuguuccuugcaacaaggugugauuaggaaccauuggaaaauuuugaggauucuaaugaaacauuuaaggaauuugauuuuuacaguuaguagaauaguuuaaagggaaaagaagucaaaauauuaaggaccuuuacaaagaaaagcuugguauauuugaggcuugaaauaaucugaacuaaaguauugaagaagaaauguccaaaaaagcaauagugagaggcuguugggaguguaggguuaaaggaggacaacagaucaaaaauggcugcaaggcucugccuuuaggggauggaagaguaaauuuugaaguaccgucuugguauuaucauugcucuaggauaagggauaagagcuguaauucacucucaggucccucccuaguuuucuagugacugaauaaagaaugaaguggcaaauuuuugcugugggaugcuuuugaaacaagguuucuucucuucgguuaccuaauugggagaggguguuauauauuuucacuagggguaacaguauauguuguuuccauuaaagacuagguaauuuggaugugauagaagauauugguguguuuuuagaaauacugaaaugauuuggggaaagaaaaaauguauaaagauacuuugaaaacuuugagggcuuuuaauuuguuagaguugcuguuuuugguugguguuuucuuguaaaaacuuaaccccaaggauauguuuuacuucugcuguuguuaauaggucucuguucauuuaauagguggcaauuaucaugagcauuuggggaaaaaaauuuuaacgaaguuuuguugggcagaaaguauacucuuggcuuuuuuagguauguuauacuccagguauuuuagacuacaaggcaagaggcagaaaucuagaaggauacuagggguagagcaauauuuucagcaaaauuguuuucccccucuucagcuuucucuguuacccuaucccucucccuuuuuaguagcucagaacauacccuccuccagcauccugcaaaauugaacacuuuugcuucaguguuaacacacaaagugaaauaaagaagagugccgagauagcacaacaagcauuuuucaagcacuaacuauauaucuaguacuaugcuugguucugggcaugcacauguguauaacacacgcucccugucuugagaagcccacaguagagcaguguggugaacauugauaauuuacaguuaugcuuuuauggagcuacucacagagcugauuuuccauuugauagucuugacaaaaaguaauuuuguguauaaucaaaaaagcaauacuagcauagcuuuuuuucauagacauuaaaacuuguuuuuggaacugcacacuuauauuuuuaagaauuguucuuauaaagagcaaauaaaacaccuuuuacacuuuguauuguuuggcuaauuuauugucauuuguuuggccaaaugacaaggcauuuuuuugguaguacguugagcuaaauauagcuguucaauguuuauauugaaaaauuaauauuauuaaaaaggguaucuuuuuaguccauguguucugauccuuaacauuuuauuuaaucuugaagcuauauuauuucuucucccuauuccccuuuugaguacuuuugauuuucuguaauaucuuucaaaacauuuucuuucccaacauuaaaacccuuuugauguauagagaaaugucguuuaaaaauccauuagcaaaaucccuuaugaugauaacaggauacauuuuuuuuuccuugcucuuuuauuguaccuuguuaagcuggucucacaugaacuuucuuagaaucaggcaguuccugguuccuaugggacuuccuguuuucucaaauaaaaauagaaaagcaucucagaaaggaaaccuggucagugugaacuacuuuguaagaucaguuagucuuaguuagucuuaguuguggccuggauuauauagauauauagucuauauaaaauauaaaaguuuacagguaucugaaagcuuugaauauuuucguauguaauaucaaaauaaacaaaaugauaaggagaagacucugaauaaaaacccugagaggugcuacauauucagccguaaacauuuuuguaucuuaauuuagaggugaaugaaggaggggcauagggguuggauggaaagugguaaauccuuuccuuauuauguaauauuuuauuguaaauuuggaauugcuuaauacugagacuuaauucuuaguuacuuugaucuguauuuuuuuuucuugccacuuuuucagauguuggcaaggauuaggaagguggauuuuuaaaaaaucauuagaagucagaauucuaaaugaauuauucaguuuuaaagcaucuuguagauuucuuucaguaguuaacugcuucuuagucuauauuaugaagagaaaucaaauuaagguagaaacaaaugauauagucauuagcaguaauaauaauggauaguguguauugaguacauauuaagugcuugacacugugucaaacauuuuaucuuguuuaucucauuuaauccugacaacaacuguauaagguagguaucauuguuauccauacuccuuuaaagaagaaacuacaauuuagaguagcuaauuagauguuaguucaaagagacauuacuaauaagugguagagguggagcugggacuugaacucagcuucugugauaccagagcaccugaucucaaugauugugaggaaaaccacuaauucaaagugagaaugauaaguauaagucugaaaaauuacuucccuaaccuuuauuaucaccaguuuguuuacauuugguucacauauuuauauccaguuuuagcaaaguacaugcuggcauuucagagaguuuguuugggggauuuuaauucguaagugaugcuaauacuugucuuuuuuuccuuccuugauaguagaaaaccccuuuggugaaacauuuggaaaaauacaaguaaguaaacgaucauaauacugauaauuuugugucauguuuuauaugauaaaagcaugagaaugacuaucaacuaaaaaaaaguaauuuuaaaguuauuuuagucuuaaacaauagguuuuaucaacuuaaaaaaauaguaauuuuaagguuauuuuagucuaaaacaauaggcuuucuuauucugaguauucccuaacugucguauaauuaaaucugacacagauuuucucuuaagagcugaacuguuuaucacuuuacuguaaaagacuacugccaaguaaaaugggaguggcauaucaucaguggaucuugucuuacacuuagaaguaugccuguugccuguaguuguuggauaccuuagcaguuuuuguccguuuugcccucauuuuaccucuuuggaucuucugcauauuggcaugccuauucgaccaucaaaaggacuuagaaaggaagcauauccuucaggcuauuucuuuaauuuuuuaaagagugcuauaauacuaauuuuaaccuaaauuuuacuuauauaaaaauauuuuucacuuacccaucauuacagggacuucagagauuaagauguuuaagcuuguaauuaguuauuaauuuuuuauuauaggaacuguuauauagaccuguauagaaaacauuauuuguuguacugaaggauguguaauaauguguaaucacauccauagaauauuacuuucuguuguuaaaguggaacucugaaaugauuaguaauauucuauugcagugauaauuguuuaaaacaaaguuggcuuuuucaguugccuuaaguauaacacugcuacagugucauaauuuaaauuugguacaguauacuuacugaacauuagaaauagaagacuauuuucuucuguuuaauuuuccccaaggaagaaacugaaauucugaacuucugaauaauaguaacaauuauaaugaagauaguggcuguuuacuuauauuaaaugcucauucuguacagggccccuugccaaguuguauuagucuguucucaugcugcuaauaaagacauaccgagacuggguaauuuauaaaggaaagagguuuaauugacucacaguucggcuggggaggccucacagucguggcggaaggugaaagucaugucuuaccugguggcaggcaacagaauauaugcagggcaacuccacuuuauaaaaccaucagaucucacgagacuuauucacuauucaucacgagaauagcauggggaaaaaaacccaccccaugcaugauucaauuaccucccaccacugccucccacaacacguggggauuauuacaauucaagguaagauuuggguggggacacagagccaaaccauaucacaaguguuaaaauucauuauuauuuaaucaaaggcauaaggcaaacaguuuaaaauauccuugaagaguccgggcgugguggcaggcgccuguagucccagcuacucgggaggcugaggcaggagaauggccugaacccgggaggcggagcuugcagugagccaagauugugccacuguacuccagccugggcuacagagugagacuccaucucaaaaaaaaaaaaaaaaaaaauuccuugaagagaaaauuggcugaggauugaggagggaaauauuuaauggugacaauauaugagaaaauuggauagagucacccuauagauuuuucucccuccaaaaugaaaaacaauagucugggccuuacuaaaacacaauuagaaaguagcuaauucaaauuacaaaauugccuuuauuuaaugaaagauuauuugaaagcuuauuuuauguauuuacuuguggaacuuuaacuaguuugcagaauuauuagggaagccaguaguuagacauuuaagcugaaauauuaggagacaaucugaaaagcagucaaaauggaagaagaguguaaucaaacuguaaaccaguaaguaaguuuaaaaguugauuuguauacuuuucagauuuacugcuaguuuaguguacuuguacuaaagauaacugaaccaaaaccuuuguuucuuucucaaaauguguucauucacuuaauagcauguaucaucaugccacugcacucugccacagccugagugacagagcaagacuguaaagauagauagauagauagauagauagauaaaguaaauaguauaucucauaaacaccuacuuagauuauaauuuaguuggucauuuggauagcaguugaggcccuucuaguauauagacggucauuuaaacuguuuguuuguuuguuuguuuuuuugagacaaggucucauuuuuaucacccaggcuggagugcaguggcaugaucacgacucacugcagccucaaccuccugggcucaaguuauccucccaccucagucuccugaggagcugggacuacaggugcauaccaccacacccagcuaaauuuuguauuuuuuuguagagaugggguuuugccacauugcccaggcuggucucaaauuccugagcucaagcaauucuccuggcucagccucccaaacuugggauuucaggugugagccaccgcacccggccuuaaauaaauuuucauuggaaagauaauucuuguaaaaaacuauaguugagcuuucugaguucuuaaguuauuuguaugagaauguaacaguauguaugucauccaguaugagaucaguuccaucugguuaaguguuguuacuucuauuuaucuaguccaauguuuaguaucugugaaucaaaagcuaaaguuuauucgcaggucccucuuauguuuauuaaagauguaaucagaggacagaugccaauguucaaauuuuguuuuguuuuugaaaggggagugaggaaggguaugauaguacauauaaaacaaaaagaaaauaagucucuuuuccagaugagaggaaaagaaacacaaaacuuuccauugcuuuaaucccaaaacuuaacuagauucaccuugguuuuuaugugucacauccauaagcuacacugucauuggaacaccuacucauccuauuauguugaagauauuuauuaaaaaugauuuugugguuuaauguaucacaaaugcuuagguuucagaauccuguuucagcccugcucuuacuuuuuuuuugagauggauucucgcucugucaccaggcuggaguacaguggcaugaccuccgcucacugcaaccuccaccuccuggguucaagugauucuccugccucagccucccaaguagcugggacuacaggugcaugccaccacgcucagcucauguuccacccuccucggccucccaaagugcugagauuacaggcaugagccaccacacccagccuacuguuacuuuuugaugucuaauuuugcaguuugaauuuuugaucuuaugugaagauaaggacuggcuugauucagaaucugauuaagauaaaauugaggcaaaaauauauauauauacguaggaaggcaaguaguaaacugaaugaauaaguaacuuaucucagucaaccgucugacauaaaaccagguauucuggugguaggaucuuggcacuuuugaugaguuuuccucuuaguauaaccgauuaaagcugcaaugacaaaagcaugccacccauagugugcaaacauguucucuucugucccugcacauacaccacaaaauaaauggaugagguugcauguuauuagacauauaaauguuacuuuuccagucuuuuauaucuugcuucaauuugcuccaugaucuguucauccaguaaaucuguuuuguuggaaacuucaggaagaaagaaaguaauaaagacagagcccccugauaaaucauggacuuauuuuagguagugcaauaagcuauuacccccuccccacccuacccuccaucauuuaugucgaucccuccugaucguaauugcucuuaaauuggaggucuuguugcuuuagacuacuuggcagguacuuaggcuguaccauugcaauaauucucuaucuggacucuuuucauacaauuauuucugcuuccgagccagccuauacauuguacauucuggcccggguaguauuccugaugcacaagucuguuuuacucuccugcuaaauuuucagaaugaagucaaacucucugucuugcuauccaaggcugucugguaguuaauacuaaacaacuuuucuaguaguuugcagaaucaaacaagggcuacugguuauguaagaaauauaaccaaugcuuucaugccuucaugcccuugcucagggucuuucccauugccuaggaugcugaucuguuaguuuuuccuuuuaaaucaaacucaaauauucuguuccauaaauucuguucccuccuucccuccuucuauauuuacagaagaaggagggaagagaaucuucuguauuacucugcaguuguauaacauuuaauauguuuuuugcccuugaguacaggaaccaucuuguucacugggucucucgcuuugcugagagaacaguucuuaacuccuaguagauguuuauuuaauguuuguuucauuuuaacaguucauaaguuuauacaggggcaccuugggagccuaggagaggacugaguaucagucaacgugccaguacucauucccuuaguuuuaugugguugaguuagauuaaaacaagacaugaagggcagccuugaugaagaaaacagucucauaugaacaguuuacauaagaauacacugugcagagggggauugggaacauugcuuuggugauugauggaguuuauugucugugagaccuuuuuuuuagcacuaaccuuaugccaauuuuuaaaucguucuccagaaagugaaauauuuagaguaauaauuuagagucuuagauuaagguuucuuaaaaauauggugcccauuacuuaaaugugaauuugucuuucagauuauguggcuucugugauuuuaaauuuacuguuuuuuuuuuuuugauuaagaauuauuugguguuuuuuuucuuguaauuggguauuucauaauaacuucucuuaauuuuaggaaagugaaaaaacucuuaugaugaacacauuauauaagcuucaugaucgauuggcacagcuugcagguaauuguuuuaacuuuuauaguugcuaaaaauguuuugaaaaauguauguagcauguuauuaguagaaaauauuuuuccaaguccaguguuauauuugugaaauauuuuucuuuagaaguuuucauuaccuauacagagugauuuuugauuuuuacauauguauuuaaugaaggcuuuuuuccugccugccaucuguauuagagguaauauauauauauaauauaguuauaaaguugaucaaauuucuuuauugcaucagugguaacaaaaaaucuggaaagcuuaaguaucagaggaauuagguaagcagugaauuaacuaaaaucuuggauuaaauauacaaaugcagauuuucuuuuguugguuguauagguaucauucuguuugauaaaguaaauuuauucuccuguaauuuucucuccggauuaauugcauuuuccucauagucugcucuuaguaauucuuugagagcucuaagguagucaacuuguccgaaaugggaauaauuuauuauagauuaauuaguaucaaguuuagcacauguaaacugcaguagcagcuuaucuauuaccuuuuuuuaguucuuuuuuuuuuuuaaacauauaaucugaaagaagagacuuggauucuuguaagcaggcauaagaaaagaaaaaugcaguuuucaaacuuuucuauguagcagaacuuuuguguaaaccagauuauugguagcagccuauagguaaauauggaacuucucugguugaauggagguauuuaggauccugacaguuucccauccucugaucucucuuuguuuuguacauuggguucuuaauucuggucaauuuuuuaagcuuuuaauucuguauuauaucgcuaaaagccuucuuugcuuugauugucauucacacacuucaagcuaaugacauuuauuugguaugcuguagcacccagagauagguuaaguauaugcuaguuaugcuagcuagggauauugcuaacacaagcuucuacagcuaucucuguagcauuguuuuaucaaguaugguucauggccagcuaaaucagcauaaucugaugugcuuuuaaagauacagauuccuuccccuugaguaagggucaacaagcuuuuuuucugugaagggucagauaguggauauuuuaggcuuuguagguuaguuugccucugucacaaccacucaguuauguuauaccaugaaagcagccauaaauacuacauaagugaaugagcuuggcuguauuccaguaaaacuucauuuauaaaaaccagaguaggccagauuugacccaugggcuguaauuugcagaccucugcucuaaaucuaugggaucuaaaucucugaggaugcacuaauaaacuuucaagacuuguucaucugauagguacuucuccccuuuuuauagcuacugacauuaaaaugauuacuugaacaaaacugaaaugagaacauggcugcuuuuauuuuagaaacauuuggcaaggauuuuacuuuaauuauucuacuuucauguuaacaagcuuuuuaacuacuugaaagacacagggaagggaaaacaugacaauuggaguucaauaugaggauaauuuauuucuaauaaccacuuauagucuaaagaaaaagcccugaauucgcuucuuaucaacaauuaaaagaaaagauaaauguaguuuuccaaagauuuauaugagcacaucccuuuguagaaaccagaucauagguggaaacuuguaccugauuucccuguuggucuguuauaacaauuuuuguuuuuuaagauuuuuuugagacaggaucuuuucugucacucaggcuggagugaaguagggugaucacagcucacugcagcuucaaauuuauggagucaagcugucuucucgccucugcuucccgaauaauugggacaacagaugcauacuaccacaccugguuauguuauaacaguuuuuaaggcaugcacaccccuugcuaaagauaggauuaguuauacucugaaaaugcacauacuuuaauucauuaauaaauucaaacuuauuugaacccuuaaaugauuagcuuuaagaauagauguguaaguuaaguuagcacaaugaauaugcugaauuuuuucccuuuuaggaauaauacauauuucuggagggcgucuugugugccaagaucuguggauaggcaucagugugacauaguuccuauaccagcuuacaguuuaguugggaauauaagaggaagauaaguucuuguuuggacugaaaugcauuuaaaaguugugguuaauguaaugguaguuguuuguuuauauucuuacuggaauuucuuuguuuauauucuuacuggaauuucuucuagaaauuauaaauaauauuguucauguucuuucuuuacugauuauaauaauauaaccuguaauuguauaauguauaaaauauuugaauuaauuauguuuguuuucuucuguuuaagagaguacugauucaaaauuaauaauaugcuaaucuuuccaggagaucaugaauguggcaguucuagucaaagaacgcuuucuguucaagaggcagcugcguauuuaaaaguaagcaaugaaauuagaauuuuaauagcuauauuuuaaaaaauuauauaaaucauugcuacuuguaagaaucauauguuugauuauuuuaauuguacuguuaaaagcuugggccugcuguuugguauaauaugagcaguuaugagaaaguaaaauuguucaacuuuuuuuuuuuuuuuuuuuuugugagacacaguuucgcucuuguuccccaggcuggagugcaauggcugaucucgacucacugcaacguucgcaaccgggguucaagcgauucuccugccucagccucgcgaguagcuggaauuacaggcacccaccaccucgcccagcuaauguuuuuuguauuuuuaguagagauggaguuucacuauguuggccaggcuggucucaaacuccuggccucaagugaucugcaugccuuggccucccaaagugcugggauuauaggcgugagccaccuguucaauuuuuuuuaguuuguuuuagaacauucucuaugagagaaugcauauuaauuuggaaaggguacaaagaaacauuggucauagggaaauugagauaggugaguaguagcauguaagagagcagguaaauaucuaaccauuuauuuaaaaucuucugucccacaucaguuucuucuccaaauacuaagagaacuugcuguugaauuuucuaaacuacuguaaauaauuucuggaaaaucuuaaugaaagguaguaaaagauuaaagauggauaaaugucauucugauuucucagaaguggaaaguggcauuugaaaaccauacaggaaagcuuguugucgguccaguuccauaaagauaauuucauaaagaucugaguucuugcaaauggaaacguugaucccuggaagguggcuggcauuugaacguggacaagucaugccauacaaauuucaugccucccauccccuuguuaaaauugugguaaaaaauauauaacgugaaaucuguuaacauauuuuuaaguauaccguacaacuauaugugcauucuuauacagcaaaucucuagaacuucuucaucuuguaugacugaaacucuauagccauugcacagcaggcccccguuuuccucugcuccauaucccuggcaaccaccauuuuacuuucuuccuccaucagugugauuaacagauaccucauauaaguugaauccugcaauuuuuguccugugacuggcuuauuucaccuagcauaauaucuucaaguuucauccauauuguaacaugacaguacuuccuucauuuuuuaaggcugaguagaauuucauuguauguauacauauauuuucuuuauccagucauguugaugggcuuuuagauuguuuccaccucuuggcuauugugaauaauucaucaaugaacauggcaaugcaaguacuucuuugagacucuacuuuuaauucuguuagacaaauaccuagaagugggauugauagauaauaugguaguucaacuuuuuauuuuuugaggaaccuccauacuguuuucauauugacuguaccauuuuacauucuuuccaauaguauaguaggauuccaguuucugccuauccuuaacacuuauuugccuuauagcucacuguguuuuuauuuguguuucccugaugauuacugauguugagcaucuuuucauauaccauuuauauacauauacaucuguguguauauauagcauguauacagcauauauauaauaccuuaucuguuggccauuuguauaucuucuuuggagaagugcuauucaaguucuuugcugauuuuuaaguuggguuauuuauuuuguuauugaauuguggggguuucuuaugcauuuugcauauuaaccccuugucagauauaugguuugcaaauauuuucucccauucuguagguuacuuuuucacuguauucacuguuuuuuuuuacugcacauaugcuuuuuaguuugauguagucccacuuuucuguuuuugcuuuuguugccuaugcuuuuggugucauguccaagaaauuauugcccauaucaacgucaagaagcuuuucuucuauguuuucuucaagaaguuauauaguuucaggucuuacauuuaagucuuuaauccauuuggaguugauuuuuguguacgguauaagauaaagguccaguuugauucuguugcauguggaaauccaguuuuccuagcaccauuuauugaagagauugucauuucuccauuguguagucuggcacccuuguagaagauuguuggaucauacaucaguggcuuuauuucugguucucuauuuuguuccacugguccauuuaugucuauuauuaugcuaguacuauacuguuuugauuacuauaguuuugucauauguuuuaaagucagugugaggccuuugugguuccauauggauauuaggauuaugucuucuauuucugcaaaaaaugcuauugggauuuuguauugcuguauugccuucggugguauaguaauuugaguaauauuaagucuuccaauucacgaacaugagaugucuuucuauuuauuugugucuuuuauuucauucagcuuuuuuuuuuuuuuuuguaguuuucaguguauaagucuuucaccucccugguuaaguuuauuccuaaguaucuaaaucuuucuaaugcuauuauaaaugggauuauuuucuuaaccuccuuuucagauuguuguuaguguauagaaauguaacugauuuuuguauauugauuuuauaucuuccaacuuagcugaauuuguuuauucuaacaagauucuuuuuaguagagauaggggccuugcuauguugcccaggcuggucucaaacuccugggcucaaguuauccuccugccuuggccuccuaaagcacggauuacaagcaugagccaccacacccagccaaauaacaagauuuuuuuggugaaaucuuuagggcuuucuauguauaagauuaugucacuugcuaagagagauaaauuuacuucuuucugauuuggauguuuuuuauuucuuuuucuuaucuaauugcuuuggcuaggaugucuagugcuaugagagauagagaugggaaaaauagccacccuggccuucuuccugaucuuagaggaaaaucucucuuuuuuuuuuuuuuuuuuccuugagacagagucucacucugucgcccaggcuggagugcaguggugugaucucugcucaauacaaccuccaccuccugggcucaagcgauucacaugucucagcuuccugaguagaugggauuacaggugugugccaccacaccuggcuaauuuuuuuguauuguuaguagagaugggguuucaccauguuggccaggcuggucucgaacuccugaccucacgugauccacccaccucggccucccaaagugcugggauuauaagugugagccaccaugccuggccaggaaaaucuuucaguuugucaccauugaguaugauauuagcuaaggguuuccauguauggccuuuaauauguugagauaauuuccuucuauuccucuuuauugaaugguuuuaucaugaaaggauauuuaauuuugucaaaugcuuuuucugcaucuauugagaugaucaugugauuuuaauccuuuguucuauuaauguggcauacucaguuuugauuuuuguauguugaaccaucuuugugucugagguauaugauccuggugugugauccuuuucaugugcuuuugaauucaguuugcuaguguuuuuuugaggauuuuuguaucucagggauuuuagucuguaauuuucuuauaguaucauugucuuuggugucagaguaaugcuggccucauaaaaugaguuuggaauuguuucauccuuuucaauuuuucagaagaauuugaauaggauuggcauuaauucuucuuuaauaaaauagauaauaaacucagaaaugaauucugauuuuuuucuuagucuaguuaaggguuugucaauuuugaucuuuucaaaaaaucaacucucaguuuuauugauucauuaaauucucuauuuaauuuauuuuugcuccaaucuuuauuauuuccucccuucugcuaaucuuaggcuuaguauguucuuuuuuuaguucuuugagauguaaaguuagauuucucauuugagauuuuuuuuucuuaacauaggcuuaccacuguaaaccucucucuuguauugcuuuuacugcuucucauaaauuuuguuagguuguguuuuuuauuuuuuuauuuuaauacauuuauaauuuuucuuuugauuucugcuuugauccaaugcuuguucuaggagaauguuguuuaauuuacacauauuugugaauuucucaguuuuucucugcuuuugauuuuuaguuucauuucauuguggugugaaaaguuacuugguaugauuucggucgucuuuaauguguuaagauuuuuguggccuaacauaugaucugauuuggagaauguuccaugugcacuucauaagaauguguauucuacuccuguuggguggaauuuucuguauauuucuguuagauccauuugaucuauaauuguuguucaaguccucugcucccuuauugaucuucuaaugugggauacauacauauuuagaauuguuaaaucuuccagaugaauugaucccuuugucauuuauauaauaaauauccuuccuugucucaugugaugauuuuuuuuuuuuuuuuuuuuuugagacagagucuaggccugucacccacgcuugagugcaguggugagaucauagcuuacugcaaucucaaacuccugggcucaagugauccuccugccucagccucccaaguagcuggggcuacagacacaugccaccacacccggcuaauuuuuaaaguuuuuguagagacaggaucucacuacguugccuuuaagucaaaaauuugucuaauaugaguauggcuaccccuacucuuuauucauuauuaucugcauggaauaucuuuuuccaucuuuuggcugucagccuguguguguccuuaaaucuaagguguacacaugauaaaauuggagcuuuuuuuuuuaauuauucauucagccacucagugugcuuugauuugggaguuuaguccauuuacauuuaaaguaauuacuaauaggaaaggacuuauauugccuuuuuuguugaauauuuucucuccguguuguagcuuuuuuguccccuuuuccauaucuuacucuuuuuugugucuuuuuuuuuuuuuuguagugacaagcugugauuucuuucucauuuucuuuuacguguguuuuuuaggcauuugugguuacuauuggggcuuauauaaauuaucuuauauucacaguaauauuuuaaccugauaacaccuuaacuuuagucacauggaaagugucuacuuuuuuauaucucucuucauccuuuauauuauugaugucacagauuacaucuuuucauauuguguaucaucaacauauuuuuauaaaguuuuuuauacuuuugucuuuuaaauuguauaucacaauuaagugauuuacacaccaccauuacaguguuacaguauucugauuuugucuauauauuuaccuuuaucagcaagcuuuauauuuucauaugcuuuugcauugcuagguagcauccuuucauuuaacuuggagucacuuuagcauuucuugugaggcaguucuagugaugauuaacucccuuggcuuuuauucugaaaaaaucuuuauucauuuuugaaggaugguuuuucuggauauguaguaguccccuuuauccaugguuuugcuuuccacaguuucaguaacaccuagucaacuauggucugaaaauauuaaauggaaaauuccagaaauaaaaaauuguauaccauuuuuaauaguacgauguacugcuccccccuccccccuaccacacacacacacaguauucuugguuggcaguuguuuucuuucaguacuuugaauauguuauuucacucucuccugcuuuguaaaguauuuuggggacucccuuguaugugaugaguagcuugcgucuuggcugcuuucuucuccuugguuuucaacaauuugaacauaacaugucugaauauggacuuauuuuggucuauccucauuaggauucauuggcuuccuugagucugaauacccauuuucuuccccagguuuggggaguuuugggccccaaauaacaugguguuuuuguuuuuguuuuguuuuguuuugccuguuucuuucuucucuuucugaaacuuccauauuacuuauauugguuggcuuaauggugucccauuaagguccuuagacuuucuuuacuugucuuuauccuuucuucauuuugcuugucugacagaauaauuccaaaugaccuucuuuugaguuugcugauucuuucuucuguuugauccagucugcuuuugaaccccucuaaugaauucuuaaauucaguuauucuuuagcuccaaaauuucuggguuuuaaaaauauuuucugucucuuuguugauauucuuacuugauucaugcauuguuuuccugaucuuguugaguaucuuuaugauggcuuuuucugaauucuuugucauguaauucuuagacuucuacuucuuuaggauauguuuuggaaguguauuuuguuucuuugauugaccauguuuucaugguucuucaugugccuuguuacuuuguguugggauucgugcauuuaacaacaacagaaauaaaaaaaacagccaccuuuguagacuuuguguggggaaagucuuuuaccaauaugucuguguagacauucuggauuucuuagauaucuuuucugugguugugguugugaccucucuggauuuuugccugugaauuuccaauuagagaaguuuugcugguuuauuuucucauaguuuauaaucuuuugaucccugguaucuguagguuaucccuggugucuguagauuaucuggagcugccauaagcuauccaacucuuuuguuuguuuguuuugagacagagucuugcucuguugcccaggcuggagugcaguggcacgaucucagcucacugcaaccucugccucccuaguucaagcgauucuccugccucagccucccaaguagcuggaacuacaggugcccgccaccaugcccagcuaauuuuuuguauuuuuaggagagacgggguuucaccauguuagccaggauggucucgaucuccugaccuugugauccaccuaucuuggccucccaaagugcagcgauuacaggcaugagccacugcuccuggcccagcucuuuuuucuucuuaguggcccccaggcaucuggaguauacugaguccuauccgcauuuugaaucaggugaggcagaagccagcgaggcaacacuccuugccccugugaagucagaacuuuggaugcaugucuaacuuuuuuccuccccagggagaagccaagaguugggguuuuucucaacuuucuucaugccgagcuggggguagggacaauggugagugagugcuguugccuuuguucuuaguaguccuuaauuuggugucuuucaacuauuagauucagacaugacagaaaccaguugccccgaaaagucagaucauuagauguauguucuagucuucuguuuuccuucugaggaggaagccacgaguugggaguuuccucucuauugcacugcccuguggggugaugagagugucugggaagugagugauaugaauuuuccuaacagcuuugauacaggugguuuugugcuugccuaggugcaggaaccuuuuaacuaauuucuggauuuuucacaaauggaauugguccauguauuuuuguugaaucggugucucauugagggaaggagggucuggggcuuccuauucugcugaugucacuccuccacuuuuuaaaaauuaagaauguaguauauguuuuaaggcuuucagcaaaguuuugguaauagucuccugugauuaugcuugucaacaaagagaaauauugacugaguuuuuaacuuaaugcaugacuuauauguagguaccaaaaagauccuaagacaguauaauaaggagauuauaucuggagucaaauucugguacugccaguagaagcuauuacauuuugguaaagucucuaacuuuucugaacauguuucucugugaaugugggacugccguuaauaccugucaaaguuguugggagacuugaguauauaaaaugccuagcucagugccugaugauuauaguagcuucccaauaaauucaauuucuguguuuucuaauuaaaucagugccacucuagcgaguaaucucuaauaacaugccacagaaauuuuguuuaagguuguuuauugucuuuauuuucaauuuugaccuagaugagaacauuaaugacaguaaaauuuauggauaguguaauagcuaauagacuggacaguuaaaggaucagaauucaaaaagaucuugacuaaggaggaguuaugauuauagggcucaguguuaugggauggacgaaugucagggugcaggcaaaaaaagggauuggauugaggcuaaaggagacauagaauaaaauauuccaugaagaaaggcauagugagaauccaaagcaagcaaacuauuccuuauaaaauaauugaauggguuuucacuucuaguaguaggacuaucuuaucccauucaguguuucuuuccuguuuucuuuuuguuagguaguuaaaccucugagauuugaucucugagagguaauaccguagaucuguguuaugauuggucauaaauuccuggagcaaguuucauugcuuuucagaagaaugcugagacucuuaaagcauaugaaauaggauuaauucuuccuugguaucuggggauuacuuccgggacccccauggacacaaaaauuuguagaugcucaaguucuuuauauaaaauacuguaguauuuacauauaaccuaugcauauccugcuauauaccuuaaaucuucucuagauuacugauaauacaauguaaauuguauguaaauaguuauuauuauacuguaucauuuagugcaaacuuguccaacuugcagcccaggauggcuuugaaugcggcccaacacaaauuuguaaacuuucuuaaaacauaagaauuuuugcgauuuuuuuuuuuuuuuuuggcucaucagcuguuguuaauguauuuuuuguguggcccaagacaguucuuccaguggggccaagggaagccaaaagauuggacacuccugguuuaggguauaauaaggaaaaaaaaaaagacuguacaaauuuaaugccgacauaaucaucuguuuuuuucccagauauuuuugauucaugauagacuauauugacucuauucaguauuucaguccauggagguggaacccauggauaaaaggacugacuguacuguguuugaaggacugaagaaaugggauagggacuggggacaagauaggaccugaccaguaauuaagguggagcugaggaagaggcagggguugguguggaauuauuaaccucucuuucacuucuuccaaccauuuucuuguagcugugggucagcaaugguacaaguuaaaaagaagggacacagaugcgggguugggguaagucaaagucuaagccaggcagcaauagaguauaagauuaauucuacugaagacuagcagcaaaaaaguuacuagaagcacucuugcaugaguuaaauuggaaacugcuuauaucuacuuaaaaaaagauauuaaugaacuguagcuuuuuguguuuuauuauuauuauuguuauuauuuauuuauuuauuuauuuuuuuuuuugagguggagucuugcucuguugcccaggcuggagugcaguggcgagaucucggcucaccgcaagcucuccuucccagguucaugccauucuccugccucagccucccaaauagcugggacugcaggcaccugccaccacgccuggcuaauuuuuuuguauguuuaguagagacaggguuucaccauguuagccaggauggucucgaucuccugaccucgucaucugcccgccucagccucccagggugcugggauuacaggcgugagccaccgugccuggccacuuuuauuauuuuuaauugacauaauuguacauauuuaugggguauagugugauauuuugauacauguauacaauguguaaugauacagucaggauaaaugagccaucaccucaaacauuuaucauuucuuuguguugggaacauucaaaauuugcucuuuuagcuauuugaaaauauauaauaaauuguuaauuauaguugccuugcaguguuauagaacacuagaauuuauuccuccuaccuaguuauaauuucauuuaaccaaccucuggcuacagacccuccaccugccacuuugccacuuucuagccucuaguaaccacuauucucuucuaccuccaugagaucaacuuuuuaguuuccccaaagguaaaauaagccaaguucuuaguaguccuuaacuuggacuucuaacucauuugucuuccacaagugagaauauaugguauuugucuuucugugguuggcuuauuucacuuaacauaauguucuucaagugcaucgguguugaugugaaucacauaauuuuauucuuuauuauggcugaauaguauuccauuguauauauaccacauuuucuuuauucaucuguuaaugagcacuuagguugauuccauauuauuguuaauaaugcggcaauaaaugagaguacagauaccucuuuucacuuacugauuuucuuuccuuuggauauauacccaguagugagauugcuggaucauauggugguucuauuuuuaauuuuuugaggauccaccauacuauguucugcaaugccuguacugauuuacauucccaccaacaguggauaagaguuccccuuucucugcauccucgccagcauuuguuauuuuuuguccuuuugauacuagcaauucuaacuggggugagugaauaucucauugugguuuugauuuguauuucccugaugauucauauguugggcauuuuuccauaugccuguugguuguuuguaugucuucuuuuaagagaugucugcuaagcucauuugcccuuugaguuccuuguguguucuggauaucaaucccuugucagaugaauaguuugcaaaugucccccauucuacuagucaucucuucacucuguugcugccuuugcugugcagaaucuuuuauuuugcuauaacaccauuuauuuuugcauuugugucuucuccauaaaaaccuuuguccagacuaauguccugaagcguuccuccuguauuaucuuuuaguacuuuaauaauuuuaggucuuacauuuaauuauuuaauccauuuugaguugauuuuuguguauggugagaaauaagggggcucguuucauucugccuguuuucacagcaccauuuagugaagagacuguccucuccccagugaauggucuuugcaccuaugucgaaaaucaguuggcuguaaauacguggauuuauuucuggggucuuuauucuguuccaguggucugugugucugcuuuuaugccaguaccaugcuguuuugguuacuauagcuuuguaguguauuuugagguuuuauagugugaugcauccagcuuuguccuuuugcucaggauugcuuugacuguucauaguuccauaugaacuuuagaauuguuuucuucuacuuaugugaagaaugucagugguauuguaauagggauugcauugaaucuauacauagauuauuuuugguaguguaguuuucauaaucuucuaauugugaacaugggaugucuuuuuaugguguuuuaugguuuuuuuuuagauaucuuuuaccuucuugguuaaauuuaauuguagguauuuuauucauuuauuuauuuuuguagcuauuguaaguagaacugcuuucuuaauuucuuucucugcuaguuuuuuguugguauauguuacugauuuugaguauugauuuucuguccugcaaguuuauuuaauuuauuuaucaguucuaagagguuuuugguggaacuuuuagaguguuccacauuaacaucaugucaucugcacauaggaacaauuuuucuccuuuccaauuuggaugcccuuuauuucuuuuucuugccuaauugcucuggcuaggacuucuaauacuauguuaaauaagaauggugagaaugggcacuguugucuuguuccauuuccuauagggaaagcuuucagcuuuuucucauucaguaugcuguuggcuguggguuugccauauauggccuuuauuguguccuucaguaccuaguuuguugagaguuaucaugaagagauguuacauuguauuaaaugcuuuuucugcagugaacucuguagccuuuagaagauuuuuuuaucuugaguuauuuuauguuucauauucgguuuugucuuaauuuaguagaauuucuguggcauauuuuuauaagauuauggauuaauuuaauuucauucuuaaagaauuauguaaaauguuaauacucuuuuuuuauaguuagguuuauguauguguguuuuuguuaccuuuucuuuuuggaaucucauuuuucauguuuuucaaaugcuauaaaaccugccgugguuugucaccaccauagacgcaguuuguacugucaaaagcaaaacagagagagcuuuaaacaggauuuuuuucccccaaaaauguaauuuuaaggucuauauaaaagucuuaaaguacuauuuuuaauaaugcuuauuuuuucaacauaaaauuaaauaauauuggcuaggcacaguggcucauaccuauaaucucagcacuuugggaggccagggcaggaggaucaugugagcccaggugguggagaccagacuggggaacauagugagaucuugucucuacaaaaaaaaaauuuuaaauagcuaggugugguggcacauggcucuguagacccucuguagucccagcuccucgggaggcugagaugggaggauuaccuugauuguaccacuacacuccagccuggaugacagagugagagccugucucaaaaauaaguaaauaaauuaaauaacacucauuauuuaauucauauggaaaaugaaaggaaaaaaagcuucaaauucacuaccuaaggauaacaacugguaaaauuuugguccauuuuccucuaauuaguauuauaaauauuuuuuucuaaagcuaauauuacuuuauuauaaauauuuuauacuauaaauauucaugugucuuucccuugaaauuauuguguguauuucaaaaaccguugaaugauuuuugaaaauguuuucuaucacugaauaauauuucaugguaugauuuuauuuuauugguuugugguuuuucaauauuaugaaaucacucuaaucuuugcauauaguauuuaauuuucuaauauuucuuaggaaauaauccuaaaaaggaaauuacuuguucaaagagcaugaacuuuuaaaaaugcuuuugauauauguugcuauauuaauucccaauuuaaaaugacugcuuuagcacaaucuagccaaaauucucuauguuauuuuauccauauucuggcauaaauauggaggaaacucacuacaaaguugauaucaaacaaggauuauaauaucuauauggagggccuucugcuuaugagaaagagaucuauuacauauuuucauguauuugcacuauaguuucaccagcaacacauuuaaguuuuuagauugaggaauaaauaaaccaaagaauguguagagccccuacaaguguaagcuaauuuuuucacaacuucuaguacauuuuaagcacagugaguauaguaaauguuugauggaguaaaaugagugaauaagccucaguaacauauuuuuguuuucuugaauuuaauuauuuauguuuaauucuuuauccaguuuucuccuucaaaggaaauuuaaauaaacuuaauaacuaauuuaaauaauuuaaacacuauuuuucuaacuacuccagugcucuucuugagcuuuuuaaaaaacucguuguuuuugauauugaaagcuuauuuuaauuugugaaaaguuaagaggucccucugguggaacauugaagaaauacauaguuuauauuuccgugaaaauacaugauugguuuuuaaguuagaugguagugacuuuguauaacuuuuuauggaauaauguaaugaauggguuuacguuccuagguugcuuucaaaaccuucuuaaccuuuaacacaaugaauauguuuaagauuugugaagaaaauaauaggaaaguagacagcugcaaaugugucaaauuauggggcuggauagacuuuuauggccuagaaugcuaauuacuguuaauaaaagucuguguggaaaaaugaguguucugagaaguggagugagggggaaauuuuaugauaauaauuaagguuuauaaaguacagugugguacuuucuauauguuaauucuaauuucagaaugauccaacaagauaggugguauuagacccauuucauaaagaaacuaaaccauagaggggcuaauaacuagaguauccagcuacuaugugauggaacugggaauagaaccaaaguacuugcucuuuucuauauauuguucugccucuuaaguggauggaguggauucauaauccuuagcuccagcuauugagugggcaagggacuggugcuauuaaggguuaggaucugaaaaaguggucaaaguagauacaucuggauagguggcauauuuuucacuugucccauuuaagguuguacauauagcuaaucuguaauggagccagcaucugguucugggucuacuugauucuaaagacuauguuuuuuucuguuauucuagcaggugaaagaucauacaauucuuacugaaucaggaguuacauccuguucagcauuguggauuucuguguguuauauuuuaauuaauuuuaaaaggugccaucugaugcauaguguagaucaucucacaguucacuagaauauucaccagcuggaaggcugcauggcuauuacuguguaaauuaucaguuucauaaacuauccauauuagguuuuuaguccuugcuugauuucucccuauaccagugccuuuuucccuucuuacuaacuaaaguuuuguugccuuauuuaaugaaacaguauuauuuuuguacuuggaaacuguaauccaaguucagagcaucugauguggguuuuaaaguacacauuuuugacccacgauuuugaaaauaaagaacauuugggagaguucauggggguaugcgugaguacacacauaauguguuagauuuaagauuugggaaaauauacuucaaauuuagaaagauuuacaugaagcagucagugguauacugacugagcucuugccuauaaguaaauaguaauaaacaauaguaauaaaaguugugccuuaaaaauuaaaaacuuaguuucuuccugauuuuugucaucaguuauuggaaaauguuuguuuuaugaugcuggaaugccuuaccuuagagguuagcaagccauggcuuaugggccagauccagccugccuguuuuuguauggcuugugagcugugguuuuacaacaguuuuaaagcuugcuuuuaaaaaagaaagaaagaaauuuauauggcugcacagcuuaaaguguuuacucucuggcccuuuacggacaaaagaaaaagcugaccaaccccugccgugcccacagcuuuccagguggcuacaaaaagugaauaauaaaacaguuuaaacuguuaaaaucagguauaugcuauguaugcuacaguauuagcaucaacuauuuggcacaagcaaauaauucaauuuuugcuuuuauaaaaauuccauuuucuaauacucuagaaugccguauauauauuuguggaaauaguggcauauuuuagaccucaacaccccauuaaguccuuaaugagguuuuaaauaaucaauuguuuauugagaauguguacccauaaaaugaacauuccaugguuuucuuguauuccagauaaugaguggaugucaagugauauuaauaaaggaaaggaaaacagaaaaagggaaaauaacaacagauccucuuuucuuacccuuacuauuuuauaacuaagagauuuaaggccuucauuccuccucguacuuagcuuuuuagaucuguaggugucuuuguuaauuugaaccauuguguacauuuuuuaaggauauuugaugagaacaguaauauuuauaaugucagccuccuaaaauuuguauauuuaaaauuugcacuaauaaccuugggaguuuguuuuuauguuaucugaaacuuauguuuauagucuggucuucaaagacuagauuauacuuguccaguauuauauguaguaaugcaaagcaugccaugauacuaggcaaaucauagcaauacaagcugaacagcauguauauaaguacaaguaaauacaacauuuauuucauugauuuuuaauauaugcauguauuugaaggguacuauguggcaucugugucuuugaagaacuaaaugaguacaaaauccuuuuuaaaaauguaugguagugacaacauuacaaagaagacuaaaugcaauaauguugucuucagcuacacugauaaccuauauuaaucuugcuuuguagauuuucauuuauauacaaagugauuucuaguaguauauuuauaacaauugaaacuaauugccugaaauuauuuuguguaacuuuauugcauaauauuuuaaaacaauauuaaagcaaauaaaaaucacuuguauccucauucuugugcuacucauaugaguacauauauuuuauaauuauaaauacaguuggcccuacguauacauggguuuugcauccauggauuuaaccaaccguggaucaaaaaucuuaguggcaauaaaaagaaaaaaaguacaauggaaaaaauacagauuuuaaaaauacagcuaucuauauucauuuauauuagguguuauaaguaaucuagaaaugauuuaaaguauaaagaaugaugugcauagguuauaugcaaauacuaugcaauuuuauaucagggacuugaacaucuguggauuuugguauccauggggcauccuggaaccaauccucugugaauacugagguaugacuguauauauaaauuaaauguuguaguuuuauuuuuuuaagcagauagcuguuuagcucucaucaugauuauuucuaaguucauaauauccauugaaaugaucucauauauaaaccuuuuuucaaucauuaaauacauugucugcaauuuuuuugauguuuguaaaugcuauaauaaacacccaagcuuaaaaaaacagauggccuauaguuaucuucaccaucuuaaaaauccuaauaguaguuucauguaaugaugccuaacaagauuaguucugcuuuauaaaacuuuuuauuacauuugcaaauuugauacauuagaauaacuuaccaguuuuauauuaggaaguaaacuauacugaucaaaugaaaaccuuauaauuuccaaugcuguugaagaaucuguugauaaaauacaauaggacacuucuuagaaaaaucuuuuuuuuagagagaauuugaaaugacuuuuuauuucuguuuuuagaaauucauuuuuuccucuacgagccaggcacaguggcucaugccuguaauccuagcacuuugggaggccaaggcaggcggaucacuugaggccagcaguucgacaccagccuggccaacauggcgaaaccccaucucuacuacuacuaaaaauacagugauuagcugggugugguggcacacgccuguaguaucacaguuacuugggaggcugaggcacaagacugugcuugagcccuggagauggagguugcagugaggcgaguucgcaccacugcacuccagccugggugacagagcaagacucugucucaaaaaaaaaaaaaauucauuuuuugcucaaaagggacauaaagacauacuaauaauacaagcuccaugaacacagggaauuuuucacuguguuguuuaugcugcaccucuaguuucuaaaauaguacuuggcacaugguaaagguguuuauaacaguauuauauuugauaaauuuuuaaaaauuggacauauucuaaauguucauuaauaagguguugauuaaaaguauagaauaaucauacaauggaauacuauuuuguugaaaaaaauaggguuuuuuccauguaaacugacauugacacaauauuuuguuccaugaagaaaacaaguagaacaguaguauguguaauaugauaccacauuuauuuuuacuauuuuaauuuaaaaauacucuacccacacauagcaguucuuaagcuuuuugguucccuauaauuacugaggacucuggcuuuuguuugugggagauauacauuuauauguuuuuguuucuauuagaaagauauauuuacuuucuaaugguaaauauguauuacaaauacauguuuauauuaaaaauuaaaacugaaaaaaauuuauguauuuagaauaagaaaaaugaaucuauuauauguuaacguaauguauuuuuaugaaaaauaacuuuuccagaaugaaaacauucaaugagaacaguggcauuguuauauauuuuauaaaucucuuaaauguguagcuuaauaaaaggugacuggauucuuaucugcuucuuuauucaaucugucaugauguuuuaguugaaguaugucaugaaaauccagccucacauugauauguagucaaaacauuggaaaguauuuuaguugccuuuucagguaauuguagauagauauuuucuuugauaccauaccaaaccucuauaaguaguaguuucuuaaauguuaguugcaauguggaaugucagacugugccagugaacuuuuuguacucuugucucauaaaauccuuuuauuuuguacuuugaauggaucuuuuaccuaugcgugauugguuuuuauaaaaaucagaauuuuucaaaugcauuggucauuuucagaugcauuggucacauuucauuauuccauaucaaaaaacugcauuuguuaaugucacacaaaucucauuggaaaggucuucaaguauugugaaguuguccaggucacaaagaugaaugcuaguuuuucaaaauucuacuuuuuacuugaaugcucaaaucuuauaauugguaacccggucaguuuuucuuuaguugauaggcuuacugcuuuuauguguugagaauacuugucugugaaacauccaaaucuggaagaguuugccauuuauuuguucaucuauaaauaauauugcauuuuuaaaagugguaaauucacucuuaugauggcacugauaaacuaaugauaaaaaaagaacuuccaagccaggcgcaguggcucaugacuguaaucccagcacuuugggaguccaaggcuggcggaucacuugaggucaggaguuuaaguccagccuggccagcauggugaaaccucgucucucuaaaaguacgaaaaaagaaaauuagcugggccugguagcugaugcuuguaaucccaacuacuugggaggcugaggcaggagaauugcuugaacccaggaggcgggggcugcagugagccaaaauugucccacugcacuccagccugagugagagagacucaguucccaaauauguaaaauauaaaaaagcaaaauauuaacacugauuauauuggaguagugggaaaaugcuaacuuuuuuuuucuuuuuucucauucuuuuuaaaauuuucuguaaugaauauuuuauguuauguaguuaaaauaaaaauguuauauagaguguguuauaaaggauacuuuacagagagucgaauguagauuaagaauaguuauuuuucucuauuuuucuuguuaggauuuagguccugaauaugaagguauauuuaacacuucauugcaguggaucuuagaaaauggaaaagauguuggaauaagguaaaggaucugauuuccacuuugaccauucuguacugggagaaaugguuuuugacuuuaaauucuaccuuacuuauuuuuaaauagguguguugguuuuggcccugaggaagaauugacaaauauaacugaugugcaguuuuuacaguccacaagaccacugaugucuuuuuggugucguuuucgacgugcuuuuguuacuguaacucacagauuauuguuguuaugcuuagguaaguuguaaagauaagaaaugagauaaauugcagccugaauuuuuguguguauuucacuaaaugccagaguugagaauucauuuuugugaugguugccacauaagucacagcuagaugucuucacuaaauauaauaaaaauaaugucagaaucauucuaaaggcuuagaaagcaguaauauaaggagagguagaaauaaaacuuuguuauaagacugucacagaaaaacaaguguggucaguauauacauagaaaucuacuuuagaaaguagaauugaaaaauacaaaaauugagcuuauuuuuaaauaauaaaguguuauaaaguuuauuaaaauuuaguuuuuaaaauguaauuuaccuacauuuaaaauuuuuaucauuuuuuaauugauaauagggauuuaggugagaguuguuuuuucauucuuucuuucuucuuuaaaaauaauucauuuuggccagcuuuaguggcucacaccuguaaucccagcacuuugggaggcaggaggauugcuugcacucaggaguuuaagaccagccugggaagcauagacccuaccucuacaaaaaaauuuuuaaaauuagacaggcauaguggcacgugccuguagucccagcuacuugggaagcugagguaggaggauuucuugagcccaggaguuggaggcugcaguuagccaugauugcacuacugcccuccagccuggaugacagaguaagacccuaucucaaaaacaacaacaacaaaagaaaaauucauuuuacuuaaaguaagauuuaguauguuuaaucucaugagguucacuuuucuagucguuuuaugcuucaaaggaaaaaaguuugugaaacauaguuauauauauauauuuuuaaauaguaguuagaauuuaaauguucacuuaucaguguaauggaagaaaugcuuuuuucuagaaagugaaucuuuggaaaauguucaguauuaaauuuuuuuauguaguuuuaauuauauagcuaauucagccaucugucuugaagguucauuccguuguggcaguuaaaauaaucacugaaauauuauugaaugauauugaccacaauuuuuaaaauacaaaguauauuaauauuacagguguagugaugguuugugucguucugcguuacaugaaauaucgauggacaaaagaagaggaggaaacaaggcagauguaugauauggugguaaagauuauagguaugauauuuguaagaaucucaacuauuucuagaagagucauugcaugauuaaacuacauuaugucaagugauugauucauuuguaaauuuuauuuauuuuuagauguuuuacgaagucauaaugaagccugccaggaaaacaaagauuuacaaccuuacaugccuauuccacauguacgcgauuccuuaauacagccucaugacagguguguucaaagcauuaugaguucaaguaaaucagaaaauuuaagugcuuucugcaguauugaaaauuauauugagagcugugacccuucucaacuagacuugcuuacugcacagguuuuuuuugguuuugcuuuguuuuuguacuuuauacucucuuucuaaauucucuuccauucuccugauuuugagugacaccuggauuucuaagucauucucauuccuaggcauucuugauucuuuguuguuagucuccaucuuauuuccuuuaauuucaucuugauaaagaaauagaugacagccaguggcugguguuuuacuaauguuuuuuaaguacuaacuuuauuauuaaugaagcuuuuaaaguaaaaacuaaaaugcaacuuuuugaaaauaaaagauaauuccauauccugaagcagcaucuugacccuagcaacacauaaagccaguggagcuuuuggggaaaaaaaauacagauguuugugcucuagcucuggaaauugaaacucagaaaaucugagaugagauauaggcaucuaaaucuucuuugaacaaacuccaugaguagugguaagaacagcuagaguuaacuauuaccucagauacuaauauuucaaaaagaugacaagccaagaugauaguaaauuugccauuuuguucacaugauaggaaaaaaaugaagaaagucugggauagagcuguugacuuccuugcugcuaaugagucuagaguucgcacggaaacacgaagaauagguggugcagauuuucugguuuggcgguggauccagccuucugcauccugugacaaaauauuaguuauaccuucuaaaguauggcaaggucaagguauguauuuuuaaacaucaaaaaaguaauuuucuucuaauuuuucaaaaugacaaauauguguuaagugaaacaguacaauucaaagauguaugaaggcaaaacucucucguucuguuucguagaaggaaucaguguuagcuucuuauguauccuuccacacuuuuaucuuugcuaaugcaaacauaaaugguuuaucuuuaauaaagaugaauauuccuugaaucuugccuuuuucacuuaaugaagcaacuuaguauuauauauauuaacugcauucuuuucaucuaauuucuuuauguaaauaagacacauaauuuauguuauauauacaauaaaauauauauaaacuauauauguauauaagugaagucauaacuuuuuaacugcucuuuuuuuuccaguuuuugccugccuccucuuacuaagaccuuucuauuuauauauuccuccugccaaguaacuuuuguggguaucuuuccauauuuuucuuaaugccuacauaguuucaaaaacauguauaaauaagaaagggguaaguuuauaggggguuuugaagauuggcugucauauguacccaaaccuuuacuacacagaaaagcagaaaacaaugcaucagaaaauuaugacuuuuucccuauaaaaguaugucaguauuugcuaaacauaguauuuguggaaaagguaaguuguuuuggacaugcaauacaaaguccagucacuccuuuuuuauucuccaauuaauuuucacuuugaaaaagcuugaauaagaggcuucuuuaaacauggcauaaaagugaugcucugucaggguaaacagcuaaagcaggcagggcuuaauaccugggugauggguuugaguugauaggugcagcaaaccacuaugacacacguuuaccuauguaacaaaucugcauguccuguacauguaucccagaacuuaaauuaaaaaaaugaugcuuucauguugccaaugauuauacuauuuccucuaaaugaugcaugcauuucaguuucccuauaaacugaaaauagagaauuccuuauuuuacuugaccucuuaacaguguuugacaguucagcccuccuugaaacuuucuucacugggauuuggggaugccaccuucuucuguuuuuuuucuccuaccucagacuuuuucuucaguccuuuucuagauuauccucuuuuucuucaccucuagguguuagaguuucucaaggccaucuuuuuuuucccacucugccauuucucccuagauaaucgucuugcugugacuuaauuuaccauauugggauaacucccaaauuuuuuauuuugaaugaagucugguuuucagauuuuuguacccaacuauauauuucuguacuaggaggugggcaccacagauucaacauguacaccagccugauccucuucaguguuccuagucuaguuaaugauaccuuuccugaguugauucugccauaaacuuagggauaauucuuaaucucuccuuuaucccucuuuguccaaccuuucaacaggucaugucauaucuacuccauaauauguccugauucuauccgcuugucacuugcacuguuggccugucuuacccacaucauuauccucuccuucuuagacaacuauaauauaauaauaaccuucuaacuggucaucuugcauucacuucugcuuuuaccugagucuccacauaacaauguauuuuuaaaauauguaguuuuaaaagacagaucucauccuauucuacuccuuaaaacaguugaguggcuauuacucuuaccauaaugcccaaauacuuuuuuguagccuacaucaucuuaaauaaucugacaucuucuguagguuuaucucuauucuuucuacuccagccacauuugcuccuucgugccccaggagcuguguacaagcaaucaccucugcuugaaaucuuccuuuacacaccucucuucacccugcuaauuuuuauucuucaguucccacauaaauuucacuuuuucagggaaguuuuauuuucucauaugagguuaaguuacuuuuaaaaagcuuuuuguacuuuuuuuuuuaaggacuuaaucacaguuguacuuucuuacaugacacucuuuaucaucugucucucccauuaaacuguaaacucuuugauagcaaugacugucuuacucaccuuaacaucuaaccaggggucuggcuccuaguaaaagcaugcagugaauauuuuuugaaugaacugaaugauugaauaccuuucaacaaacuagaacaaugucaaauaguaaaacuaacuuguuuuuuguagcauuucauuuagauagaagaaauucaccaccaaauaguuugacaccgugucuaaagauucggaauauguuugaucccguuauguaaguauuaugaucagggguacauguaacucuuauucugaauauuuggcuggaaaaugcaugauauucuuauaauggugugucuguaauugaaaauguuuuucuucugaaucucuaccacagaaauguuauguuuuucucuuucauuaaauuccaagcaaagauuuggccaaaggacacuaauguauaaagauuuguaaaacuuuuauaaaucuuuguauuccuuaugaaucgucauagcagauagauaaaugcuugaggcaaauuaaugacucacaaugacaaagaguacccuuuauuaaauguguaagucauuauacaugacugucaauauuuuugccucaguagaaaauauagauacaaucacugcugcuuacaaauuucaaaucucaaauuguaaaaaguuuccuacaaagauguauauaccugcuucucuacaaaguccugucuccacuugucaauauaauauuugaagaacuuuucagacuuuauaauuccaacaacauaugcuuccagagaauagcacagucaaaagugacugccuuagaauucacaguauuucauauauaagcuguaauaguucuuagaauuagcuuccugagggcacugcuuaucuauccagugauaguacagaucaaauucuguuuguuuuaaaagucccaacaguggcaauuacaauauguauacaauacccccaaagucucaucuaaucacucauugaugaaauuccaaauaagugacagcaaaauuggaaaugugaggaagcaguaugcacacguguuugcacgugggcacgcgcacacacacacacacacaccccccccacacacacagagacaaacaccgccucuauuuugcagagauagaaacaauuaguagugugaugauaccucuguugggaaucuuaccucaugccuuaggaauuggcaaguccacuauuuuauuaccuaagaugaaaauuugugauuugaagugaagucacuuuccucucucuccugccaucuuugucucacaagcaagacaaaugucccuuacuacagcagaaacaccuuaaaacugucauuauaguaaggugacuguacaaaauguuaguccuguaucaauuauuuuggaaaagagaagcucaaauguaguauuuacuaagaauuuucuuuaggaauuugaaccuaucauuacaauuaaagaaaauaacauucggcugggcacaguggcucacaccuauaaucccagugcuuugggaagccgagguggguggaucacuugaacucaggaguucgagaccagccugggcaauguggcaaaaccccgucucuacaaaaaauacaaaagaaauuagccagaauugguggugugugccuguagucccagcuaucugggaggcugaggugggagaaugguuugagccugggaggcacauauugcagugagccgagaucacgccacugcacuccagccugggugacaaagcgagacccugucucaaauaacuaacauuuaacuuuuacaacuuuaauaaguucacaacucauuuaaaguacuuauuaacaauagaaagaaaacagaaauuacuguaaguacacaggauuuuuaaacauaggaaugacccaauccauuuauucugcagcggugggcuagucuuucauugccucagcucucugcacucuuuuuuuuuuuuuuuugagacggagucucacucuguugcccaggguugagugcaguggcgugaucucggcucacugcaagcucugccucccagguucacgccauucuccugccucagccucccgaguagcugggacuacagacaccugccaccacgccuggcuaauuuuuuuuuuuuuuuguauuuuuaguagagacgggguuucaccguguuagucaggauggucucgaucuccugaccucaugauccgccugccucggccucucaaagugcugggauuacaggcaugagccaccgcgccuggccagcgcucugcacucuuuuacuggaaagugggaggagggcugagacuucugaauuguaauuuuuaaaucuaccuccuguuagucaacaagcauuuacuuaauaccaauuaaaaucguaugugguuuuaaaacuauaccaauucuaguaauauauauauguuguaagagacagugaagaauuuuuaccgaguaggaauaugguuguugauuuuuguuuucauuaacuuuuagggaaauaggggaucaguggcauuuggcaauucaagaagcaauuuuagaaaaaugcagugauaaugauggcauuguucacauugcaguagacaaaaauucacgugagguaaaguaacuuuugguauugaauuucauguuuuggauuuguugcuauuaaacuaagacuauuuucuuucuuuuuuaauaucacaggguuguguauauguuaaaugucugucuccagaauaugcuggaaaggcuuuuaaagcauugcauggcucuugguuugaugguaagaaauuugaguacuacaaacauuuugaaaagauaguuauaguuuaauuuuaaacuauaccagauuucaaauaaaagaauuuagguuagcauuuuuuugaguaauaauuuuagaugacuuuauuuauguuuugugcucauaugucuuuuaccacaguuaauuuucugcaaauauuaaacaguuuuacugaucuaaaauauuauuuuuaucuuacaacagggaaauugguuacaguaaaauauuuacgacuagauagauaccaccaucgcuuuccccaggcucucacuuccaacacuccauugaagccaucaaauaaacauaugaacuccaugucucaucuucgucuucggacuggccuaaccaauucucaaggaaguuccugaaaagauuuucuuccauuucuaagacuguuauuuacaauaggaaaauuccuguuuggcuuuuugucuuccuuuuuaaaugcuuuuuguauguaauauuuuuauugaugaauacaucucugaacguuccagaagucuuaagguuccaaagggauuuagcagugaggcagcaaugcugaguagguaggauaauuauuucauucaguuuuuggagcucaguuaagccaauacauuuaaaguuuugcaugaggaacacugacuuuauuaagcauuuucagauguggugguuguauuuuugccccaagaaguguuuggauaaccacacaaaagcaugaugaaaaggcuucuuguagucccauaauuucuugugaacuaauguugugaauuuuuguauacagucaccugcauaguuccuacaggcuaaugugguaaaacuguugauuucccaauuuaaccuuagguuucuguugcuuauaagcgauucauuugcuacggcuggaauaugggaaaauuaauuugggcuuagugguuacaaauauguguaaguggauguauauguacuuaaacuggcuuuguauauauguauaaaugcuggugguggugaaaguagucuuguuuuaugaggaugucugcauuaaagcaguaaaauaagcuuuccauuuuauucauaaucuaauguguguguauauauguauguguguauguguguguauauauagauguauauauauacacacacagagauauauacauauggcuguacuuuugcauagaucaaacagccaaacaccuggaaguauuagauacaaguuuaaaauaucuuuuauagguuuuauauaaaaaugucugaguaugauuuugugugaaaguucugauaccaguuguaauagagucaaauuuaugugagcaauaaagaagaaauuggcagauauuggaaaaauauuuugugaaaagcuguauuuauuauaaauacuagggccaugacauaguaccauugggguuaagucauuuucccaaucuauuuauaauuuaaugauauguuagugccucuguuauaugucaaguuuaaagcagggcacauuguugcagcaaaauguguauuugacaaauuauacuugcaauuuugggucaugaaaguuugcaauauaguaaaugcacgauugacuguugcuuugugccucaguauuuaauuuguuucaguaaacuuacuuuauuacuguuuaugauuucagauaaaaauaguugcugaguaaauuuuacuuguaaucuacaauuggcuuuuuaaaaauaaccuguugauauauaauugucaguccaaaugaauaugugaaacagcuggaauuguacaaauuuugguuguauuuaaagcucaguuuccuuuuuguuuuauuguaugcguuggguuugcagcaugaacuugcacagauaaugcacguuuucugguuaaguaaacaugaugcacacuauucuguaacagaaagcccuauugugccuuaccugugugcuuuugugggcaccuuguuuaugaagaauaaaaaaugauuuguuaucugaagagaauaaauuuuaaauucucaguuuaugucucagaugcuaacgugugaaaauauaaauauauauaauauauaaaguaaccagucuuccuguauuuuaugugcaucauagugauuuaucugagcuuagugacccccaucuuguaaccuguugcaagagugaauguaaaaaauaguuguggcauuuuaaaaggucgccuuugaugcagaugcaucuuuuucuugcuucuaaaacauauuucauguaaacauuguacauuuauuauuguaauauauacuauuaugcagcuuauuuuaccugaaacuguuaagccgaccaagaucccucccugcaagacagaugggaauguguauaauaacuagguauuugagaaguucugaaguuugauguaaucuguuacuuguccuguuaaaaaaaggaaaaaauucuaauuaaaaauuuauuaguuuuuuuuuaugugucuuggcuuuuuaaaaacauuuuaa

SEQ ID NO: 192963 - RNA, 145712 nt, Homo sapiens
aaggccuugaauagcuuuauugaaaucuauauaaauaaacaugcacauuucaaauguaaacucaagugaacucaagugcagacaaaauuuuaaccucugucaugcaggagguuaguuuacauuaaaaaaaaaaaaaagaaaaaaaaaaccccaaagcagcuuuuaaaauaccaggaugauaaaccagcuuuaauaucaagauauaaagcaaagccaugaucaacauaccucauuuauccuggucaaaugcauuuuuuuuaaacuuuuaaaugcuaacauaaauaaauaauuuaccaaaaugugcacucacagagugaacuuuuauuuacaauacacaauuuauaaucuauuguauuugauuaguucaagugaagaacauuauacuuuuugcuuuaauaacagugggacacaaagcaauuucucagguagucgauaugugaaaugugccccagcauuuagguuuucuauuaaaggcaguauuguaugccaauuuacaauacauucuuucaacuauaucaaagggaaaaagcagcaaauaaaaauguuucaaauguucacacauauuuuuggcauccuggauccuugaauguggugaacuaaaaucaaauucaagguguuuaugcuuuauauacuguacagguucugacucuggaacaugcaaaugccauuucucuuauaacaaguuaccuucugagaaaagcuguaaggcuauggugaauuccaucaggaacacacaaagaaaguuaacagaccuaccuuuauagccaauuguccauuaaugauuuaaaggccaguauaugaaaaaaauuucucaucuaagcuugaugcaauuauuacuauggguacagaauacuauuaugucuguccuuauauuacaauaauugggagagcucaaguugccaaauuaccacaaaaugggguagagaaaaacagacagcaaaaauuuuaauuuuggaccaacacccaauuaaagauaugcauuuuaaagcaaaaaauguuuuugaauaucugaagaauagaucccaauagcaguaaauaauacuuacauguaacugaaaaaugacuuuagauggaguaugaaaucuagaaccuguuuccacaguggcaguaaaaugaauauaauacucuggauuuuuaaagguauuacaaagggaaauaacuuuuccaagguuguuucuuguaucaugauuugguuuuuuaauaggcccacauugauuacggggauaaauuugaaaaugcgguuuucgaagaaugcugccgcaguauuuaugccacauugauacugcagcuaaauaucauaguaguauauacggcagccuaaugcacaugaacuagauuauccaaaaacuaaguucagccauaguuuucuugcaguauuauuagagcaaaauaaaugaccaacauccacaaauuuaacauuugucaucaacucacauccaaaaaauuaaaggaaacauaauuaaucaaaacagcagcaaacuuaaaagggauuuauuugugauuuccuauauauauuuagcuuguaaauacaagacuguaaauguauuaagagacaauuucuguuaaaguuuucauuguguuucacuucaaguacugcacaaguuaaaaucugauaaaggauuuacauucgguuaucugaaacuccccaucucagacuuuuguuuuaaugugguggguaacuucaucauuuccauagauaccaccagcaggaaagugucucuuuuauggcuucuaggacuuucauuaguuagugugcauacaguuuucauuuucuauaucauugucauuaucauugcuaucuucaucacuuucuaaugggaugccaguggcagcugaagcaccuuuaguuucucggucaagaggaaaaaagccaguuccacugaaagugucuugucucugguagaagaguacauaugcugcuuuggacugucaaaacaaaggauguuaaaacaguuaugauucucaaagaucacguuaaauacauuaugaauuuuuagcuggucaccaauuuugguaagagggcauaaaucaaauagaaaaaccaugcauggucaaauggaaguuacuaaaauucauuaaauauaagaugauuucuaauaaagaaucguuauuagaauuacaaauuuuuaugugcuucuaaauuauuuggacaaagaaauaaaugcaacuguaucacaguucuaacugugauacacaaacuguaucacaauucuaacguaaaaauagaauucuaugcuuucuuuccuaccaucucuuaaggaaaagguaaauuccucccuucuaauacuagucacuucaucccauguuugcuguagaguccaacuuuuccuaccaucuuaaggaugcuguuccaucaaucaucacuguguaucuucaaugaguccuuauccacuggacuugucucuuuggcauuaaaaaauaccuaagguuuuuccuaucauaagucccucuccauucuacuuccccuucuagcugccauauaccucucuuccucuuccucauagucagggugauaaacagaguugucaauacucaucauucacucucaugcacacuucucaacucaaaguaaucuagcuuuuccccaaaccauucuagcaaaauggcuuucagcagggucaauaaccuaauaaacaacugaaaugggugaccuuuccaguucuuuuggucaaucucucaguagcauuuaaugcuucacuauuucuuuuccuaucaacaaacaauuuuuugcuucugugacaacacuacucagaucuccuacuaucucuuugguuucuucucaggcucuucuguggacuuauuaaauccugaccuuuaaacauacuauguucuguccucagcccaccauugucucaaccugaauccucucacuaggugacucauuuaaaccuauggcuucaacugcugccugaggcugacaacucaaauguauaaccuaaaucaguucucaccccugaacuccugucuuaugaguccaacaaccuaauggaaauuuccacacagcuaucauacaggcaucucaaacuucaacagcaacuauucuuccuauauucccaaucuuggugaauggugaaguaaaagucaucuuaaacuucuccuucucuggaucucuacaucuauuauccuuauuauaucuuuuaucaaguuauauuaauucuguccaguaaauaucucauaaauccauucuccccuuguuuguauuguucuaacuacuauuuuaauugcuuaaauuaugugacagccuccuguauggcuuuucuguuucuuuacucagugucuccaaucuaucuucuaugauguucucagagaaauguuaagauacaaacugaacaauguuauucucuuguuuaacaaucuaauggcuacucauagucuguaagaaaaugucuaaacaacuagaaugccacuuuucuugaucuaagcgcuaaauuuaucuccagacuaauuucuuccccaugucccuuuaagagcuuuuccuuugagucacauccaauuaugugcuguucccuuaaaaugucacgcuuugucaugccuccuuguuuuuguagauaccguuuucuuugcuuagaacaccuuuuguuuaauuuacucuuauuuuuacuagacucaggucagacaucaucuuuaccacaugaacuucccugugcugguuauuguccccucaaaccccaaaucugaguugagacagaaguucccuuucuaaguggccauaguaagguauuuaauaguacuuaucaugcuguaauuguuaauuuacuuaucuucuuugguuuauaaaucagagauagcuaucuuuuaaacucuggacugagugacagcuaucuuuuuaacucuguuuagaauggagucuuuuguguaucucucucucucuauauauaucauauucaauuuguugacuaaaugaagaaucaucauuguuaaaaugcauggcaaccucaaauuuguauacuauauauaaacaagauaacuguuuauuugaagccaagauuagggcaguguuguuaaaaagacugauggaggaggugggcaauuugaggagaacagaauugauuuucuuuugcagaaaaaaaauuaggaguuuaaauauaaacaaaaaaugugguuaauuaaaacuaacacaauuuuaaaaauuuauaguauucaagucucuuuuugucauagauauagggagagaaauaacaguauauauauauauauauguauauauacauauauauguaugcaucuguguguauauauacauauacacacacacacacaaacccauacugagagucagcgguggaugauaaacugauguaagugugaacagacggaacuuccucauuuuuuuuacuauucagaaaauaucaaaguaguaaguacacaaguauuaaucuuuuauaaaucuguaauuuguuuuaucuaauuaugucauuuugaguuuaguuaauuuucauaaggcaggauaugacuuuaaagaucacagguacgguaagguacuucaaggauuuuuuuucucuuguuuaaacauucuggcuuuaaguacucaaugucuagaaaguuaagagcugaaucuacuuuccaaagcaaaacuuaauuauuuuuauuagaaacuccauguugaaaacuaccaaaaauuuuuucaccuugcaauuuaugcuuuuguuagugggcaaauuuagaagacaaauuuccauuuaggggacaauuugacauuucuuuaaauaagaguuagugucuuuuagcuacucaagcugcuagaauauagacuacaguguuccaugagccccuuuuauuaauuuauauucacuccuuaagacagugaaucccauaguucucaggaaauauaagacaaacuuaccacaauuuggucuucagaugcaguggagacacuacugucaucaaaauaguaccauuuuccaucaucuuuauuuuuugcaaaagcaguaucuaaugaaaaaaauauaaucacugugacgaaaaugaucuugguuuucuggggacuccucaaaacucuauaaucaucuauauaaggaauaucuauuaacacugauaaucaucuaugaggcuuauuuauuacauauucaauugauucaaaugauuucuaauuucuacaauuagaugccaaaaauaauuuucauguaaguugaaacauucuuuuuucaucucaggaaaaaacagauuauuuuuaaauucacauaauaacacuaaugauaauaaaugguaauuaacauucauguagugcuuacuguguaccaggcauaguguuaugcacuuuacauguauugucucauaaagaagguauuaucauuauuauucuccccaccugagagaugggaaauuaaggcaucaaaagaaggauaauuuacucaagguacuauacuguuagcuagcaguuaggauuuaaaccuagaucuguuucugacuucauaguuugaaauuucaacuuauuauuaaauuuucuaugacgauuucuuuucugauaccucuacucauuaugcuauaguguuuuuuuuuuuuuuuaacaccagaaucucuuuuagucuuuaacaaaaguguagucgguccugugcauacauggguucugcgucccugaacccaaccaaccacagaucaaacauauuugaggaaaaaaaaaaauuccacaaaguccugaagaguaaaacuugaauuugccacgugcugaguacuauguucaauuuaugugaaugaagugacgugcaggcauuguauuagguauuauaaauaaucuacacauacaaguauaugagaggaugugguuagguuauaugcaaauacuacaauauuuuacauaaggaauuugaacaucugugguauccacugauacaaagggaugacuguacacagcaagaaaaaggcaaaaagugauucauuaauccacauaauuuuuaaagaucugcuuuaucuuuaaguuaaaaaaaugccccuuuccccaucccaugccuuguauaaacuacucaauaacugaagaaauaaaguugcacaauguuuccaaaauaauuauauguggucauuguuucuaaaaagugacacuuuguaggguacggcuucuaaauaauucuucccauccuaaaguaauuauucuucccauuuguauauaaauaagaaauugagguauuauccuuaauaaggcugaaaucaaagggcaauauucucuuucuauuaaguuaccuguuuggaugauguucagagggaauggcaauacuuugaaaguaagguaagcauuaucuuuggugaaacuccacuggcggucagaagauaauucaaaagacaagccaaucaaccgaccagccaaccaaccaaccaaucacaauaaaauaaugguuuaaacucuaaguuguuugguuaacaauuuuacugaguaacuaccauguggaagaaauguuucauauucuaucuguuguugguucccucuccucaaauaucaaccauggagagaaaccguagaaagagauggaaguuagagucaaaggaacuaacaaaaaaaaauugagaacccuguucucaauauaugaacucaagaauauuugugugcaugcaacauggcugaagaaugcgacagaauggauggaggcagaaaugagaaaacaaucuagaagaaagcguuuaaauuucuugcuucaauuuuugucacagaaaucagcaauacucaggcuaccugaaucagagucuuauugcuguuuaaaaguccuguugggcuaacaaaauauuugacaacuaauaugacuguaccccaugaacucugguuaaaaaucagccuuggugaggaguggaaggaaauagccaugggaugaacagcuuccuuugagcacacuuuucccuauuuucucuccuuccagcuacacaggaccucugcuaagcuguugcugugcaugcuguauuguuucuugaccuguauccuuucuuaaaucuaaguaaaccuggugcugggugaaugcuuuugcgugcugugaguuuguugaucucaacccaagaucagugcagagcagaugcugcacuuagaucugugugaucuauaagagacacauucaacaaaaaggcacagaguuuguaaauuaaaugauaccaaaaagaaagcuagaguaacacuuguaauaccuaaaaaaaaaggggcaaagaaugucaaauccugguguuaaaaggaacagagaaagaagagcuacccauuaugaacauaaguauaauuaugcaaaauauuaauaacaacuaauaaaacugcugggagaagcaggucaaucaacacuuuaguaggaguccugacaaauuccucucaggaauaaaaugaacacaaaaaauaaccagggauaguaaugguuugaauacacuugauaagcuuaaauuaucagagauauaaagaacucuguaucuaaauggggaauguauauuuuuuuccaagcauacacacguuuaaggaacugaccauguauuaagacauguuacaacuuucggacuccuaaagauuaauauagacaaugcucucaacugcuauguaauaaagguaagaaugaagugacaaaacucucuacauuugaaaacuaagcauaugauuaaaugacauugugcuaauuaggaaaucauaaaggaaauuaaaacauacauacaauugaaagauaaugaaaaucugaaguacagcuaaagcaguacuuagcagaaauuuauagccuuuuaauuacagccuucaauauaggagaaacaaugaaaagcaaagcuaagcauucaauucaagaaguuguaagaagaguaacauagaaacccaaaguaacaagaggaaccauacaaugaagggaagggaagaaaucaauuagacagaauaaauacauacaagccaggugucguggcaugcaccuguagucccugauacucaggaggcugagguaggaggaucgcuugagcccaggaguucaagaccagccugggcaccauggugaaaccccacugcuacuaaaaauacaaaaaaauuagcugggugugguggcaugugccuguaguccagcuacucgggaggcaaaggugguaggaucgcuugaacccaggagguggagguugcagugagccaauaucaugcgacugcacuccagccuggugacagagagagagccagucucaaaaaaaaaacguauagauaaaauaaaauauaauaauaauauaaaguauaaauacauacaauaacaaaaauaaaaauuuaauaagaugaaaaguaauucuuugaaaagacuaacaagauagaaaucugggaagacugauacuuuuuuuuuuuuuugagacagagucuugcucuguugccaggcuggagugcaguggugugaucugggcucucugcaaccuccggcucccugguucaagugauucuccuaccucagccucccgaguggcugggauuacaggcacgugccaccacacccaacuaauuuuuguauuuuuaguacagacaggguuucaccauguuggccaggauggucuugaucucauggccucaugauucacccgccuccacuucccaaaguguugggaucacaggcgugagccacugugccuggccaggaagguugauuuaaaaaaaaaagagaaaaagaaugaaaaaaggacaaaaauaguguaauauaagcauuauaaacaacaauucuuaaauaaauugaaaaaccuaaaugaaauggauacauuuuuagaaacagaacaucaaaauauacagaaaaggaaaaagaaaacugaauagaccaauaugcaugacauaaauaaaaacaauuauggcugcaaagccuagauggcuuuacagguuaauucuacuagacuuugaugaacaguuaauuccuauauuguacuagcuguuccaaaaaccagaaaaaggauaaagcaucucagcuuguuuuaugacucuaaucuuuauuccaaacuaagauaaugaaaauauaaaaaacuuacaaaaccauuucacuuaugaaugaaauuguaacaacccuaaauaaaucugacugaauccaacugugugucuaaaaauauauaaugauaaguaggauauauccaaggaauguaaauacuguucaacagaaaaaucaacugcuugcagagugucgaguguuagagccauccugggggguggggggcaaucuggcaacacuuacucacuuaaacucagcaauuucacuuuugggcacgcagcccaaauaaauucuuacauacgauaccauaaacaaugguuuaucagucuuacagugguaggaagugaaagggaauuuagaugucuaucaugagguaaguggagagauaaaauauggcagauguaaaucauaagcagugagaaacaacugacuaaauggacacaaagcaacacagauaagucuucauaagugucgagaccuagugauaucuacagcacaguaccaauuauauaaaugaauaaauauuaaugauuuacaagaguauaugcaucaaacauguuagaaagcaaaggggaaggagaacguggagggaaaugcacucuaaaugggacaacauucccuacuaggccuugaacugaggaguaugaugaacucaauucucuauacccuaugugaaaaaaaaaagguucaaaagcugacucauucauuaaucaauacugaacuacuauaugcaagacacaucugauauuuuauccuuaagaaguaauaaauaucuuaaagaaaaaagucuggaguucuucaaacaccaugauuuggguaaaaaggcaaacugucaacuuacaguguccuccucccaucccuccauagugguuggaaacagcaaucagauuauagcggcaaggaccugcauuuggauuaauuaagaauuccgacauauccaagucacuguuuaaaaaagaaaccaaguuaauuuuuauguugucccuaaaugcaaugaauucuauucccuucugccauuguuguuugacauacauauauauaucuauaucuauccaucuauauauaucuaucuauauauauauauaucucacuaaggaaauuaucaugagucaaauaacuuacaaaacaaaucauacauguaccucugagauauuaauguuuuggcaaacauuuguuuauggguugaaaauuuuaaaaugcuucauugaguauacugaagagauaucugcacuccccauguuugucgcagcaauggucacaacagcuaacauuuggaaacaaccaaaucuuguugauuugacgaaacuauguguugcaauguugauggaacuaagugucuaucaacagauaaauggcuaaagaaaaucugguacauauacacaaugaaguacuauucagcuauaaaaaggaaugagauccugccauuuccaacaacauggauggaacuggagauuauguuaaaucaaauaagccaggcacagaaagacaaacaucccauguucucauuugugggaucuaaaaauaaaaaaaaauugagcucauagacagacagaguagaaggaugauuacuagaggaugacaaguguggugggaagguaggggagauguaagguggggaugguuaacggguuaaaaaaaaaaacgaaugaauaaaacauacuauuugaucacacaacagggugacuauagucaauaauaacuuaauuauacauuuaaaaauaacuaagagugugacuggauuauaacacaaacgauaaacgcuugagaggauggauaccccauucuccauaaugugacuauuucacacuccaucaaaacaucucauguaccccacaaauauauacaccuacuauguacccacaaaaauaaaaaaauaaaauaaaauaaaaauguggaauguugucauucagauaaacguuuucaugcuaacacauuuaacucucaguauaccaggaaaaacagucaucacuauugaccaucuggguccaguagaucuuuauuuuacagucaauuuuagaaaguaauuuaugggcagggucagagauuaaaaaagaggaagugauuuauaugaagaaaaauacaggaauagugaaaacuuccuuagaaguuuuaaaaaauauuaauauaucaaaccuuaauuuuuauucuacauuugcugucuuugaugaccuauauacccgaaaugggcaacauccuuugaauguaacugacuaaucaaaaucuaucauucaagaaccuggaaaacgacuucuuguaaauagcuuauuauuauuucugguuguucuucuuguauuugcaucauuaaaaagcaauaaugauucuaaauuuuaaauacaucucugauagauucuaguuugucauuacuucugauucuuuuuuuuuuuuuuugagagggagucucgcucugucgccaggcagccuggagugcaguggcgcgaucucagcucacugaaaucuccgccuccuggguucaagcgauuccccugccuuagccucccgaguagcugggacuacaggcgcgcacaaccaugcccggcuaauguuuuugaauuuugguagagaugggguuucaccacguuggcuaggauagucuugcucuccugaccuugugauccacccaccucggccucccaaagugcugggauuacaggcgugagccacugugcccagcccugauucuuuuucuuauacuuacauugccaaaugcuauauucuugaaaacuuauggcucacuauuuuguuaaagagaaaaugaucuuuuuuucacucaauaauuacaaauaauuuuaaauuuuaaauuuauagccaccaauuagaaugaguaauccagugaauauuuuguuuuauguaaucuauuuccuucuaguuaccuuuauagauacaccugccuuuagcaauugucuacuuacuaacuguaucaaguacauuuugguguacaaauaucacaggauaugaaauaauaccgcugaaaguucuuuuugcaaaaugggauaguaccaaguacuuguacaaaauauugugugaugaaguccuucugcugaauaacuaagugacggggaauacaauguucccuuuuugucauucugaauucucaacuguuaaaagcaggggaagaaaaaaagagagauaaagugugaagauguauacagacuucuuuguaucuuuuuacagacaagaucaggguacguucaaggugguauggccauagauauaucuuuuuacaaauaugaugucauauaauggcaauaggaaaacugaaggauaaugcaauagggaugauuuauuucacuacuguguuauccuucuaagcaauuccauuguuguuuuauuuuagucuuuuugaaaacagcauauuuagggcugggcacaguggcucaugccuguaaucccagcacuuugggaggccaaggcggguggaucacuugaggucaggaguucgagaccagccuggucaauauggugaaaccucgucuguacuaaaaauuagccgggcaugauggcggguggcuauaaucccaguuacuuggaaggcugaggcaggagaaucaccugaauccaggagguggagguugcagugagccgagauugcaccauugcacuccagccugggcaacagagugagacccugucucaaaaaacaaacaaaagaaacaccaaaaaaccccaacauauuuaggaguaagugaugaguaaugaugaaguaauuccuaggauaaacaaaaucacuaaguaccauaaaguaucuuagauuuauaaaugagaccaauuaacccauagguaauauaacacagaaggauuuuuauuguuuuuauuuuuuuaaaguauauuuucucuuugaucuuuggaaaaucucuaagaaaaaauaaaaauuuugaaacacugauccuuauaaacuguuagaacuacucaaaaacaaacuugaaagcugaaauuggguccaauggcaccugauguuuacuaaaggauaauaacaaaaagcaucaaauaaguuugaaagaagaguugcccaaugcuuauaaaguacaauuaaagcuuacuugauaggaaaaucaacuaagguauccaacuugucucucauguaucgacuguaagaaaaucgcuugagauguacuacaaguacuggaggcagggaccauaaauccaauuucuuuguggcuugcugauguucuuuacaauucggacaauaccuaagaauaaacagaaguauuuaacacuugauagagguacaaacaacccccauuaaugaaaauaauaaacaaaaauguuuggaaaguucuacauuuauucagugggcaauuauaguaugccuaauauguaccagguugaaagcaacucuuauuauuuuuauuuucaagacauuuuccaaauagguuaaaccauuacaaauuaauauacaaauaaauacuuaaagacauaaugagggcuagauuauuucucuuuuaguaugcaaaaaagacauaggucacaaaucugugcuggaagacagguauuagaaaaucucaaaucugggcucuaauggaauaacaccacaaaauauaucacuacauuuuuccuaaaaagcuucucucaaaaugauuacauagcuaaaauuucuuggaaaaaagguaacuaaaaugaauuaauaguauaauggcuauuaugaaaaacacaguaauaaaauuaaggcaacacuguaaucguauuuuuuaagacauucccaucccucuuaauaggcuacaacuuauauaaagaauccuuuacuauuuaaaacaucaaagagaauuuaguaauuacuuuuucaacuugauguggcacauaucucagaauaaauccuuaaagaaaacaaaaacaauuauuuaauuuugucucuuaccagggaucuucagcaccuagcuuuucuuuuguuguaaaaaguucaaugcaaucuuuuaauuucacaaaggguuuuuuaggagguuuauacuccacacuuucauguuuuucaaaguccuaaagagaaguauuucuugaguuaagagaacaaaugaaacaaaacucauuuuagugauaccaucuuacuaugaauaauaaugaaaacuccuaaacuuucucaaaagaaucauaaagcuuauuucaguugagauuuauauacuucuaaauaauuccuguacacuucuauauggaugaccaaaacacguucaaaaugaacucugaaccuuuaaaaaaaaaagguauuuuugcaaagacuuuuuuuucuaguucaugaccaauuuuuuacuggcaaaauaaacauauuugguggaagcaaagaguguaacacaacaguaugauuaucucugguaaucacauaaaguaaaucaaggaaagguaaauaagugagugagugaugacuuaccucagcagcauuuucaucaaaauaucuuuuuuucaaaucaggaucccaauccaaagcaagaaaagaucuuucuaagguggaaaacauauuuuuucuuuaaaauuuaauaugucuuaguauuaaaguauauuuuaauguuaggauauacaccagaauaaacaaacagcaaucuuuucuacuuguacuggugauuagggcaaacagcaguuuccaagccauugaaauaauuuaagaguuuaaaaaaagauagaaaacugaagcaugaguucaaucuccauuuaugaaacacaaacacacauuuuagucuacuuagauauuaaguccuuucauguaaaauuugagauagaaaaguaaaugguauauuucuugacagagcugaauuucaugguuuucaccuaaaaaaaaaauaacaugcucggcuuguuuaauguucaagccauuuuucacaaauacuuaccaucuagccuaagcugccuaucaucaaaucuuauaugccugguaucaucuuugauguaguugauaucaguauugccuaaguuguugaacuggaauguaaacaaucguuuuuugugucccgugaguugaccuuugcaaguauccucaguacauaauccauuuucagaaucauuaucuccuccaacugaaucuucagacugacuguuuucauucucugagggaaguucuugauccuggcuggauucaucaucuggcucaucuguuuccauuucaccuaauuuuagauauuagagagcuuuaaauaaacccaaugcuauauuuuuaaauuauuaauauuauuaauccuagguuuccagguauuuuuuaguucuuuaauucccauuuucuuaacuuuuucucugaggcaauuaucuaagugaaacauuuguacaauuuaacagaaaagucuuacuuggugagccuucuucauguaugccauuugggccauucccauuaauauuuugguccuuacagcaguguagggauccuucaguuucuucaguuucaguagauauuuugacauaucggcuuaaguaaaaucaaaaaucaaacaaguucaguacuacaaagauaaaaacuuuuaaaaaguuuuccuucuaucaguaaaacaaaacuuuuuaaugcaguaacaguggucacuuaguagauucaaagauaaauucaaacuuuuaguaccauaaguauaacugacuaguaauuuguuuugcucaucuuuauaaaaauaauuaauauguuaccuuuuagguuaaauguuaaauguuuguugcaaauaauuucucaacuuacccuauuuagaugguauauauuguugcuaaaaacacuuauauuuguauaaugugaucuuuauauauggguuaugaaacuauaauaauuagauaugcaagaaagaauacuaaauauaccagcuuucaaggauaaaagggaucaaaugacauucuugauaacuucauaauucaaaucaagggauuuauucaggaaggcaaaaaauaggcugccuuacaauacuauuaaucaugaacugguaauguauauaaagaaaugaagcauuugacauuuguuauuucacagugcaaacauauggcauuugacauuuguuaugauuucacagaaugaacauguaacacauaauuauuauaacauaaauuccuauguccuucuaacuguaaacuuuugguuuaaaacugcuacagacuucgugcuuccuggguuugaaauuaccuccauaauauguuuuacaugaauaagaaaguggauuaggacuauaaucugacuaugaacaaaauugagauaauacagacuugaauaauuauauuccaauaguaccuuauguguuuauuuuuauuagcuauuuuauauuuuauucccauauuuauuuugucaauguagaauugucuggcacuuaccacauucucaagagcaggagauuauaaaguuugucuucaguauuguuucgugguacagccauaagaaagggcugaccaaaaagugaagaaccaguaugguggguauaacucgagugucugaauuuuucucuuaggcaaacaggaauaaucacgugcucuguaucuucuguccuauugauguuaauuucaaaccuacaaggacaaaacugaccauaaacucucaaaauuuuauguuacuucuauuaauuuuuuuucaaguaauauuuugcacaaugaguuuuauacuuacacauaaauaucaucccguuccauaauacuacuaagguuuucauccauagcgaauauucugugaaaucuaugauuguauauaucaguaacuaucaucuaaaaggaaacgaauuucuauuaagcugguuuuacagcacugagaaacuaaauaccaacuuauauacuucaaccccagaaacaucuuaccuuaucugcagguauuccugacaaagcagacaaugcuguacaaagaucuaauauguuuccaauuuuggggacaaccacuuuguacuaaaaaacaaaaaaaauuguaaugaauuuauuauuuuggaaaaaaaauucaguaaaugagagugaccucaugguugcuaucucacauucauuuggcauuuggauuaguguuugucuccaaucuugccacuauccuggguccugugugacaaugcccacauggauaauuuguccuaguuuuaucauuccuuggcuccucaauucaaagacacuugcauuaauucaaccucagucaacuuauuagauccugucauuacuugaaacugcucccacuuuugcuaucuuuuuuuguuuguuguuuagagacaggcucucacucacucuguugcccaggcuggagugcaguggcaugaucuuggcucaccgcagccucaaccucccgggcucaagccaucuuccgaauucagccucuugcguagcuaggacuacaugcgugugacaccaugacuggcuaauuuuuauuuuuuagagacaaggucucauuauguugcccagaauggucucaaaauccuggauucaagugaccuucugccucagucucccaaaaugcugggauuacaggacugagccacugcacccggccccacuuuuaguaucuuaaacucggguuacugucuaaccacuacuucuugcuucuccuggaaauucauucuuaucucuucuugucuugcacagagauuucuauuccuuuuaacucuuguuuucucccaguuuaccagcucccuacugucuucuagcccuuccauccaggcccuacaugcuuuaucacgaaccuuuaaugucuuuguuacucaauucuauucauuccacucuugcuaaacuuucucagagcuguucacaugugcugaagagaauuucccaauuuuagaggcuggugugcuacaaauccacagugcccaauaucaauugauccuuugacaguacucagaaauaauucugcauaucacacaugugguuauucucucauuuaucucaauaacuauuuaaaaucuucauugggcugggcccaguggcucacgccuguaaucccaacacuuugggaggccaaggcaggugaaucgcuuaagcccgaaaguucgagaccagccuggauaacauggcaaaacccuguugcuacaaaaauacaaaaaauuagcugggcucggaggcgcacaccuguagucccagcuacuugggagucugaggcgggagaaucccuugagcccaggaggcggagguugcagugagcugagaucacacccuaauguacuccaacuugggugacagagcaagacccugucucauuaacaaaaaaaaaaaaaaaaaaaaaaaaaucuucaccauucuuuaggcuuccuauuucacuacugcucccuuaauaucagcagaauaccuauuucaucucaaaaacagaaacuacugggugggaaaaucuccaacuuccuguucuacuaacuucuuugaauccacauagguacuuuucugucucuugcaacacauggaaagaaagaugucucucuucuuauucaaagcuaaccuuagcgucuauguucuaaaucccaugcucuucugcuuucucugggaccuaaaccaagcaauuauucuuucuuccauuuuaucucaacucuugcauaagcauuggaauauaaagucucucaaaaaacaaggguaccucauugcuuucccucuaauuaucuccccuucuccucuauuuuauaaauaacuuuauuaaugauaucuauauuaucauaacuuccuuaucucccauuuacuucucaacccucuugcuggcuugucuucgccucuuuauuuaacuuguuuccaagguugccaauaauguuguacaacuuaucagucuuuauuuuauugaccucuuuguaauaugacugcugaccacuuucuccuuaaaaaauucccuuuccuuauaacacgacuacuuuuaauucuuuucuauugcugugaucauauuccucuuuugaaguucuccuacauuguucuuuagaguguugucuuuagccuucuucucaauuuuauaugcucuccuuggaagaggcaacagugucuccugauuugcuuuggccaguccuggauuagccugcuauccuaguauaauuauuaaugacagucccuucuauuuucaagaguucuuguuuagaugauaaaucacggggucaccuuagccuuaaguaaucucauccuucuaaaacacuaucauuuucauagagcugauuguccaauuuauagcuaaagcagucucucuccuuuggucuagauacacaaauucaaugccuacuggauaucucuaccuaaguguuccucaugcaucuguaagucagcauauccaauacuaaacacagguuugggucauguuaggccaccacguucaauacuaaaauggauuccuucuucaacuuguucuuccuauauauuccacuaaaacagcacugcugucuccucuuuuccugucaaguaaacuuggcaucaucuuugaauauacuuacacauuuucacuuccuacauucaacugguucuucaaacugccauccugacagaguugaaguguuugucauuugucugucgucugaucauuaaaagcuucuuaccuggucuuaguacuaagccuuuucuaacugaucucugugcuacccagaaucaucuuucugaaacauaauuguggccauauaauaucuauacuuaauagucuuuaauggcuucccuaguuuuuaggaugaaguucaaacuuccuauacuggcaucaaaguucuucgugaucuagcuccugcuugccauauuaacuacuguagauuacagaagugggccauguccucuucucccauaaguucuuuguacaugccauuaucuuggccuauaaugcuuuuauuucuaguuuucaccugcuuauaaccuaauuguccuucagaauuuaucacaggccucauaaccaguuuggguagguuacucuguguucucuugcagcacccugucagagcaauuuucacacuguaugacaagcuucuugaagaacaaggacuagaaacaccauuauauuucuagcaccuugcacagcauaagagccuaagauauaauauauauucaauauuuuuccuaauaagcuuccaugaccuaaaucaacuucaaugacgggaaaacucaacaaauagggaaacucagcuaauuucacuuuucuuacaagcuggucaaagcauaguguuaaugaaaugaggugaucauuuuguauuugaguuguuacugccucuaaauggaaaaaaggaaaaaaaaaaaacacaaaacacaaaaacaaacgaauuucucugugcuaaccauggcucuaaccuccgcaaauuuauauuauugucaccaaaugagaaaagugauaagucaaugaaauucacauugcuggaaaaauaauuuagagcccaauuuauggaagagcacuuaucauauaccuuauggacuaauguguaaauuaaugcaauuugccacuauugauauagauuaccuuauauuauuggcaugggagaauauuaucucuaacaaaugugcuguagagaaauaaaacaucuacauuuauuuuuuguugcaguaaauuuauacuuauuauucuacgcucucuugcuccauuacacucauugguguauaucugcaaaguuauaaacuagagagguaaggaugugguuuggcacuguuauaguuucucaccauugaaaagaauguugacaaucuuguacuuauaaacgagugaauaagugaauaucuaaaggauauaacuuuaaaaaugugaacacauauuccccaggccaaaaguaaaagcaggucuuuauuggcucugcucacagauaagggauaguacuuagcacucuccagugaaauacugauaugagggcauuguguucaaugaguucauaaagaaaacauaaagcagcagaaaaacaaauugcuuaaauuugcauaacugaguacauaccuaguaucuacuagacuuuaauuacuuugaauaaaaggacuguguguuuaugaacacuacauauacccugucuuuguugacaauaaacccaaauacaucccugaaugguaagaucauaauuuuguucaaauauagcuuucauauagacaucgugacuauuaugcacuaacaaacugagcuauuuggcuaaaaauuuacagaaaacaaucuucuaaagcaggaaucauaucuuuuuuguuuagccaaagagcuuuauacuuaguaggugcauaguuaaguaucuugaugaauaaaauuuuugaauacuucuugugcauuaauauuuaccagccacaaaagcuggaaauacaaagguuuacaaggucucugucuucaaagacuuguagucuagggauaaaagauaaaaguaagccaaaaguuauaacaaaauuaguuaaguguuagaauuuagggaaagagagguagaaaaagaagaaguuacuuucacugggaugggucaagugucagaagaggauuaacugauuaauaaauaagggagaaaagauagugcuuuacccacaaaauauaaauaauccaauuauaacacuagguaacggaaucaggcagacaauuugacaguaagacuuaccacaggacuuuugcacagaauaaacaauaugugauacuucaaaguauuagaaauuagagaacaucacugaacaaaauauuuuuagucuaacugaauuucuacuuucuuuuaaguuccuaaaaugccuaaaaauuacagguauuuaaauacacuacuaucacacuaugaauuaaaaguauuagcuuuacuuccaauagccacuaguaaaaaaaaauuacaauuaacacuaaagaaaguugaaguuuaaaaaaauuaaaaauauuauguugaucuucauaagcuaauauucaccccaauauuauaaaaauaaaccucuauaaaaagccuuuugagaauuuuuuauaagacacacguugcucuuucaagacuguaaaaaguuacacugauuuccaaaguauucagcuuauaaaaucucuuauacaaauaaacauuauugauugggcuugauaauucaauacuuaauuuuuauaauaaggacucaacacuaauuuuuuaauaaaaauaacaaaugcaaaaaaaaaaaaaaaaaaacaaaacaaaccaacccaugauuuaccugcauagguuugguaaguggauccauucuaacuaaguaaacuuccaaggugcguucuuuuuucaugggcaauggaagugucaaguaacaaaaaggaucaaauguuacugaaaucuuagcacacucaggacaaacuaaaguugauuugaaaaggccaugaaauauaucuacuaugauagaaucauuucguuuuaaaugguuuucccaggcuucuucggcaaccaccuacaaggauaauagacacaaauuagaaagagguaucacaaaauuauaacaauggugacaauaggaucaugaaauuuaccuuaucuggccuuccaucugcaucuuuuaauuguauauaugguuuuuuccuaauucuauucaaauccucauguaauccaucuaauaggaaagcuaacaguucuugacagucuugcugcugauauccagagaacugaggugcaaaacguccuaccugugucuguaagaaaugcaaaaccaucaaaucaguucuaggaacaggguugauuuuuaaacauauguacaauagauucucauuauucauggauuccacauuugugaauuugccugcuuucuaaaauguauuuguaaccccaaaaucaauucauggucauuuguagauauuuucagaguggcaaaaaauuugagucaccugauaugcauguuaccagcugggguugaacaaggugaugcuuuggcuuguuguuucagcucugaaucuauaaacaaguguccuuuguaguuuauuuaguguuauguuuuuucacauuuuuguuuguuuuguuguuaauuucaguguuuaaaauggucacuaaaugaaguacaaacaugccagcuaguguuccuaaaugcaagaaagcugugaugugcuuuauggagaaaaaguauguguuagauaugcuucauuaagacaugaguuauagcacuguuugcugugaguucaauguuaaggacucaacaauauauauuaaacaaguuguuuuuaaacagaaacacaugcaaaacaaaguuauacauugucugguugacgaaaauguugugaacaaaggcuuggaggaaucaaacccuauaguuucccuaggaguaaugguucaguaguuguuauuucaguguuuguggcagcuucauugaacauaacuccugugaauaauaaaaauuguauacacgaacaacaggaauauauaugaauuauauuuuguuuugcauuccuaguaagcacucaacaaagcuuaucugggacaaaauagaucaacacauguaaucuuuaauauauaaaaauguauugaucuuuguuuggucauagauuucauugucauuaauuguuguuucacuauuugucaaaggauuuuccagauguccuuaauucuuagcuuuagguauuccuauugccuccuccuauaaaugucugguagguagacaggaagaggcagguucucauccuugcuauauuaccacauaaagauaauuacguaucugaaagcauuuuuaagauaacuacucuaggcucucacuuaguuucuaugcgcaaaaggaggaugaguaucacagagauaacagaaacauuaauguucauauucaauuuuccuaaucuuucaucacuaaguauuuuuguuuuuggaugagacugaaaauaaauguaauaguaugaaucaucaucugacagaaaaaaagucacacauaaagaaccuauuuacacauaauuuuaagagagaaaaucuaccaaaauaaaaccaauuagaaugcuaguaagagcugagagaugguuugucuggacuaguuuguccaaaguuuagaauguuaaggaagacaauacagaggcauuuugauuugcugguuuuuuauuuucuaagaacuaguauauagcuaauaaaaaauguuguccaguagauguccucuaucaaugccauuuaaauuacuuguauaaauaacgacuuaaaacugcuuauucucucuacaaguuuaaaacuucucaaaguuucaccuauauaauuaaguaggcauuuuuuuaacaauauaaagcuaaauuucagccauaaagcuaaauuucagcucaauucuuauuugaacaauaaauuauuugauaaguaacaauucacacaugugaauaaccuuaaaaguuuaagaacuauauugaaaguacauuuaauuuuuaaugcuugguuugcagacuauuuucauuuugauaauuuuucaaauucauaaugacucucaaaguaaaauggguucuuagaguucaguaacaugcccaaauuuagucuuuuacauuuguauagaauauucacauagguuuuccagagauguacuauauuccaaaacaacuauacaaacgcucauugcugucucuauacucauucuuguaccacaccaguguuuuucaacuuuuuuucauuauucucuccauuccagauuuagauguaaaacaaaaacaaaaacaaaaacaaaacagauaaacuguuccauaucccucccaccuaaauuuuauaucacagauguacuguauaucuauuuauguacuguguuccuuuggagggccacaaaccauuguaauagcuacuauuuuucacucccccuauccccaagaaccaacuuuuguacccuugcagguacccuugcuaaaaugcauuuaccacacuaaccuuaaaggcucuuggggugacguagcuaaacuuuccagaccacauuugcuugaucaguucggcauaagauuuagcuauuucaccucucauuccuaagggauugucaaaauucaguucuucuugauacuuaucauugaggaaauacucaguaaguggagguguguugcucaaacacugcaaaaaauaaaauauauuuucaaguaaaaguaaucauaaugaauuuuucuuaaaacacauuaauaugaagagagaaacaaauugauuugcuauaacacagagaacauuuaaaugaugguuucuugcacuaauaacuggucaaauaaacacucaaaugauguacucaacuauucauuucccaaauuucaaaauaauuacuuauaauaaauaaaaaugcuaauauccgcugcuguaaaaucugcauuaauuuuaaccacagcaaacuaccugguaacugggagagaagcucaguuuucuuuccuucuuuuacuugauugguagaaauuauggauugucuacucaucccaggcaccugcaaauuagccugaguagguaaaaacugagauagagugcaagcaagaaauuaacuuaauagagguauuuacugcuuccauugucaauuauuuaucaugaaagagcagccuuuaaaccuuccauauggucaaccauuuuuagaagagacaguacagauuacuugagccugagagaacaaacuuuaguaugugaacucugguaaguguguucucacuuccagcucuuuaauuucauaaacgauacaauuuuccuuuauggcaaaauaaaaacuauaaauaaguuaauuuuccaacucuuuccaauuccgaauuaaaaaauuucauauuuaaaauaaaacauggcagacguacaauuuuucaacauuuuaucucaaguuggaauaauuuuaaggugaugauccauauaauuugaccucaauacaaacccaguauuacauuaucaauuagaugucuauaauaugcaacgacuaacacagacauauggucacauaaguaaauuuuuuuugcuguaggaugauauuuguguuggaauuaaguggcaaagugcugcaaggaagcuaguugcuugcauggaaaauaguagaaacucacucuuaugagagccuggauucacauuaauggaaaucagaguuuuucgaagcuugcuuauagucauuuguauuaaguuagacagguuugguagcuaugaaagguucagccuguugaauucacacagauaacuuacaugccauaaacuacgacuauauacuaugcauuguuuagcuaaaauuccaaaauaagcagagucaacauuuacuuaguuuuuuagaauaauucugguacucaauuuugugguuucaauuauaaaucaacauguuuacugaaguagucaauaauaucuauuuagaaacuuucuauauaauaaaaauaauauuauuuauuauaaauugcuagccuggccccuaccucaaggcaaaagggacaacugguuauaauaucauggaauuuacgauuauauaauucuuaggcaacgaaaauaauaaaaacagcuaaaauguuuggagugagcuauauaggccuuuagagucauauacauauuuucagcaguagaacuuuuuaauauaugugagcaggagaaagagagguaugcuacaguguaggaggcaauuaagagaaaggaugcuucccuaacuuuuuaccucuuagaucucaaccucucucauaaucuuauacuccuuuugaguuucaguuucucuucuuccuuuguauuauauguccuuuuaauuauaaacccagcacuaaagggagauccaggcaauuuagaaugcaucauagcuacacagaggguaaaugccaucacuuaguaucaucugauuuaguacaaaauaagaucaacauuaaauagucagacaaaggacaggucagauaggaauuuccaacaauuaucaauaguuuuccgcuucuuauauuugaucagcucaggguuaugcuaagaauguaacauuccauuauugucuguuaaugcaauuauauaaagaaccuaauuuacaaauaucucaaaagaaccaaguugcacaaaccugaguaauucuuaaacuuuguuauaacuuaauuauucacauauacucuuaucuuggaaagagcuuaaagguauaacugaacauuuuuuagcuuuccaguaguauccagagugcucucccuaaaauguacaucucaucauguugcuuccuugcuauaaauccuuuaacggcucucccugcuuacagauuggaagcccaaauucuuagaagggucugucuuuugcucaucuauguagccucauccuuugucaauacccuuuucuuuucaacuguuccagcuuuauuuaauuagucauuccuccacauacucucucaaucugaaagucugcaacauuacuucaucuacuuggaaauguacuuuuuuuuuuuuuuuggccuuacuaacuucuauaaauccaucaagauucuggcauccuaucugggaagccucccuuagauuuccuuacaguguuuucuccuguauguuuccuuaaugcuuacugcuuacuuuuauuacagcacuuauuugauaauauacuguaacuuuaauuuuuaguuuguuuugccaaaugaacugagaccuccaugaaagcagguaccaggguauucuuauuuauauuuccagcacugagcacuaugucacguagcacugaucauguucacaauaaauguaugcuuacuaaaaauauuuuugccuguauuuacuaaugcauuuauccucuugauuuuuacucuuuuccuucaauguuuggcauagaggguucaauaaauuuuuguugaaugaaauacuacuuacuaaauggaggaaaaauauauuucuaaagaauaaucucaaaaauaucuucaaguacuucuaccuaauacuaaaccauacgggcaguacaaauuuuucugccccuuugucugauuuuucauucaaucuacuaucugcuuuguaaaugauccucugcuuugauuuuuaaaaacuccuugaaacagagaccagcauuuauuuucacagugauacaugcugguuucaaacugauuauaauucaauguuaacaaauaacaacaaaacacaaaucauuuuaaugauaauuugccuguguuaucugugaagauaucauaaccaauauuuaaauuuaagcuauuuaguccuaaaugggcccaaauaaacauucuauuuguuaaacauauauucuaacaagcuacacuuccuaacaaguuguauaaacacauauaaauacauaaauucaauagucaauauaauuguucuacuaauacacaaaucauauuaguuuaaaaacuaagaugauguccgauauuucucccucauaaaaauaccauccuuuccacccucaucuugaaaauaccauuaggagucaauauguucauuuuauuuuuuguucugagauggagucucacucugucacccaggcuggagugcaguggcacaaucuuggcucacugcaaccuccaccucccgaguucaagcgauucuccugccugagccuccccaguagcugggauuauaggcgcccaccaccgcaccuggcuaauuuuuguauuuuuuguagaguugggguuucgccauguuggccaggcuggucucaaacuccugaccucaggugaucugcccgccuuggcuucccaaagugcugggauuacagucaugagccacugcaccagaccuugaguuaguauguucuuaaaauagcauaaagaccgguuaaaauauuaaaaguucucauaauuuuugcuaaauuucaaggcauaaauggaaaaaaaaaucaagcaauuaaaaauauugccacgccccacgugauguuauaucaguauucaaugucaucauucuggcagaaaaaagaagccgguuucuuuuuuuuuuuggagauggaaucucacuuuguuguccaggcuggagugcagagcacaauggcgugaucucagcucacugcaaucucugccucccagguucaagaaauucuccugccucagccucccaaguagcugggauuacaggcacgugccaccaugccuggcuaauuuuuguauuuuuaguggagacgggguuucaccauguuggccaggcuggucuugaacuccugaccucaagugaucugcccaccuuggccucucaaagugcuaggauuacaggcgugagccaccgcaccuggcugaagccaguuucuuaaaguuggucauaauguaguuugauuaguaauuacuuuaugcaauucauuauuuaacauuuucacaugaggcuaucuuagaacaugaacauuuuugacaauuauaagaacacuaguuacuuggacuggcugcaauuaaauaccauguuuuaaugaacaaagauaauuuucagucaacaauaauuuauuguacauuuaaaaauaacuaaaagagcauaauuggauuauuugaaacaugaaggagggauaaaugcuugaagugauggauaccuaauuuacccugaugugauuauuauacauugaauuccuuuaucaaaauaccucauguacccccuaaauguauacaccuacuauguacccauaaaaauuaaaaauacauaaaauuaaaaauguauaauuuuuauaagguaauuaaaauaauaaucaguucugaaguaucuaucucgaagauucuucuacuauaaaaaaaucauuuuccuaucagaugagacuaucccaaaacaauucuuuucuuaaagacauauauguuuuaaaaaucuuccauguguagguagcaguagaaaacuucccuuuuauccuguaagacacuuuacugagugaugcauuauaauauggacuaaaaaucggauauguguugugccuacgugaauaucucuuacucucaaugcuuccuggacuguuaaacaggacaaaacuuucugcaacagccaugguuguucuuaauaaaaacugagaauauauaugaauguaucaugacaaaugaaagagauuauauaaacaguauuaguuaguauguuauuuuuguggcuacuuauaaguuuugugacaugucuaccagucucaugccauuuggagcuaugccccuguuaauuuauuggaguucaacugccugacauuaacaaaugccaaaacuucaguguuucaggagaacuagaucuuaaaauuuaucacuaauauaacaagguccaaauaugaggcuaugugacugaucauaaaacauauuucuuaagccacauuuuuguuuauaucauaaugguaccuacuguugguccuaaaauuggguagaauuuaaauauguuaaaaauaaagcaauagccagacuaaagaaaaagacuuuguacuaauaguuccaauuuuuaaugaaaaagagaaaaagaaaaaaauuuauauuaacaaguaaauguacuuauuaacuagguuauuuuuauauuuaaauauuuucaaaugcuccuauguaaguuauuagcacacaaaacugacaacagcauuugaaaauuuaaggauuaaaaaacuaaauuucauauuuaguauaugguagacuuuuggagcucacuaaccaugauauaaugacugguuggaaaguuuaggacaugagcuauuaugaaaaguugauccaugaguaaugauuaaaaaacuaaauuucauauuuaauauaugguagacuuuuggaauucacuaugauauaaugacuguuggaaaguuuaggacaugagcuauuaugaaaagcugauccacaaggaaagguaacaauggcuauuguaugugcaagacaauuauuuagugagaaaugacugcuaagugguuuugugguuuugaacuggcuuugugguucucuacuugugccuucauauauauuuuauaugggaaacugcaaguaauaagaguacucgaauuugaauuaggcgucuuaagacauauuccuuaguuuaauguauugagacugcaugcacucuugccuuucuuagaauauucauccccuauaagaaauuccuauuuauucuuaaacacuuauuucaacaucucuucuaaaugucguaucuuccucuguguaucaaggaagaacgaauauuccuuucucugggcuaacuugauaccucgaacuccguuacaccgcacuugagagcagagucuaugucuuauucacccuuguaccucagggucuaucacaauaucgggcacacucaaacagguauguggaaugaaugggaacuuguauaguagaaagauuagaaguaguccuuagagagacuuagagcagugagaaaaaacuugacuaaaaugagaucugaauugcacucuguuauaauucaaaugcagcccaaaguucuccauguucaaaaauaaaaguccaaaugaugccuaaagagguuuuccuaaugaaggaaaauaacccuuaugauuuccccaacaacuaucaagauaaauccguaaggaaaagguaugcaaaggaaauauguuuggaaauauauuuuuaugaagaucauuuccccuaaaucuucaaccucgaagcagacauaaaaauucuaaagaagaauuauucuaaauaaucaaaugucucauccaauggacacucugugauaugguucaauauauucaggccauuaauuacaccuugaagaauuauuuauaaaaauauuugaaugguuuaugcauucuuuauuaaaguacuaauucucuauuaaaaacucucuaguuauaaauacccuuccuuaaccuaauauccuaaaacugaaauauuaugcaaaauaugauuuucuuuuguuauguaauuacuuggaaagaugcaaugcauugcacauaacuuuucuuuauauacacaugcacaaauucuauugcucuuccauuauuuucagaaaguacuucuacuaaguauguucugacuaauaagccugauguuucuagaguuaucugaaaaaauauaacugcugcauguaagagucucaauuuuguauuuugcuaaauuucuacauaaguuuuuuauaaauugaugaagucaaauaauguucuauuauauaaccaaaucucaagucuucagucaacauauuuuaggaaaugaauaauuaauagccaucccaauaacuuguaaugcauuuggaauuuccccaguaccuggaaaauagccaaaguaauccccuucaaaaagagaaaguugucuuuuguaaugcugaauaugaaccacucccuuucuguucaggugcuccagaagcccaauucucaagugaucauguaugcucacuauuuuaguaaaccgguaacuagaacaggaaagaaaacaaacuuaauuuuugauuaccuaaagcuuuugaguuguguaacucauucuauaacuaaucaaaagguaauaccacucacaacccuuaaaaaaauggcuauaccuucuaacugaccaguacuaaaaauaaaagcccauucuaaauaaaauaagggauucauucuuaguuuguuaugauuuaaaaaauaaaacuugaaguaauccaugguuaaagucaucuuggaauaccuuuaaacaguuuuuuucuggauuuuaagguuagauggaaaagaauuuucauauucgccaugucaauuguuuucuaauuaaucaugacaauaguauaagcauucugaaaagguacuguaugauuccaaagcaaucuacuaauauugggauauuggcucuaguucuguaaugcuacacaaguggauaacacagcaaaguuugagguaaacuuuuucaauuaaaaacuacaaauauaggccuguuucuucaucaagcagauuuuuaaaaugauauauuuuaagucacuugauguucuuauuuuuguuauauuuuuucuaagaaagggaaaucucauuaaauuugagagaucaauucugaagaucacauauuuugugacagcaauacagcuacagcucuguuuuacuuuauaucuccauuuuucuucaacuuuaaaaaaagaacaaacuuaggcaaguaaaauagaaauggauauaauuuuccucuuauauuuuuaagacuuuuaacugcuuuuuuucccccgucagugaagagagaacuagcauacucuacuuaaaauauuaaaauguuaaauaaagguaguuuuaaaggcaagguuuuugaacuggacaaggauguuguccuaacacuugaauauauaucauuaaucuggucccugugcuuaagacaugaauaaaauuaaacuucauuuaaaguccccacuguugucccuucuuugaaauucuaugguauuucuucuucacauacuauuugaauucaaugaagaauuaucaaaguucuaggaaguauaaauacugacacugaugggaaacauuuuguuggcuagcaaagaaaugucaauccuuuuuugcccucaucuacacaggaccaaggaaggaaaacucuaaguuugucaaaaagacuacccuauuacuugcagugaguaaauucuguaacuacagaugucaauguuaaaaaagccaugauuaugugaagaccauuaauuuucauauugaaagccaaaaaaaauauggauagaggauucacuuaugacacagauaaaaguggaagucucugugauaauuauuucaccagcaaaaaggcuagaagacuaggacaaguuguuuuuaaauaagguuuugaaacuauuaauacuagauuaugucagcaguugucugacuucauuauuuuauuuuuaguaacaggcuauucgugaauuuuaaaacuuuuucauauauucacuuuaugggaaguaugcuaaaaccagaagguucuaauaacauuaagaaauguugguguaaguuauauuuauuuuaaagaauggaagcuuaaauagaagaauugaauggaauucaauuuuaauguuaaauuacguuauuuccuaucccauuaauaauucaaaacugacucacaaugaaauuuaaaagaauuaacuuuuuaggcaagcaagacagucaaaggauuuaugaaaaaaugguucuuuauaauuuuguauguguucagucccuugcacauaauauucaguaaagaaacaauuuugaauaaauaaauauuaagaauugugugaguuuacugaucuuaguucuucugcaaaggcauacaggaaaggacagcagaauuuuuuuuuaaaguuuauugauuuguuacauucuuuaagagaaacaagccauuuuuguaauaaaaaaacuuuaauuguucaacaaauauuaagagaucauuacuucaagagucucuguaaguauacaaauaauguucuaaaagaauuuuuuuccuaucauucacugaaaucuuucaaggaacuauuuccauggugguacugauaugaucugcccagcugugacuaacaugccagcucaauucaagugcuaucagaucgacugcauuugcaggaccguauaugguccaagaguuauuauacauauauagguagcucucugacccuccaguugcaagaaauaaauauauauauuaugugcuauaauucuuacuaaaauuacugugcaaucuuugggaauuuagauagcucaggucaaguuucaaauaucucugguaaauaauuuuuucuaaugcaguguuuugcaaaccaggugugugaaagaacuaauuuuuuuuaaaauaccgaacacauuauuuuuauuaaaauacaucuugauguacauuucacuaauucuugcaacagcucugaaaaguaaauuuaguaagcguuaucuccuguuuuagagcugaagaaacuaagucuuggaauagauaaguaaccugcuuacucacacacacagaagaaguugcagagcuaauauacaaacccaaauauuuccgcucgagcuauuuuuaccuccugaugcuauucccaguuuucaaaugauuagcuccacagcaaaauacacuuuccucuaaaucuauauggaagauaauuuuccauguuucucaaugaccuagaaggcacuucagguagaagcuuuauugugggugugaaagugcaauaauuacauggaaaggacuaauuuuuuaaaaauuccaccacagauugguacuuguguaagauauaauaaaaaugaaccgcuagaaaaauaaaauuaaaaacacucauauaaaaaacaagucuugcuuuuuauuauuaaacuugauauaaaauuacccuaucaaauugcuauagagacuuuugaucacuuacaauuucugugcuuauuuuauuguugaccagaauuaucuuguccauagacacauuguaaaaaacacuguucuacugugcuuacgauuaucugguacuauacuaacacuggggauauaaaagaaaaccaaagauagccucugcuuucacaauucucaccacauaauacguauuuguccaugagaaauggauagaagaaagagagaaaguaugaaaaacgcaaguagggaagcgguaacaguauauacaaagaguuuugaaacauaauaaauucuaagaauugaaaguaguuuuggcuaaacagguagacagaauccaguuugaauuuuauccuuuaggugauggggcacagguuuuaaacacauaauaaucauauuugccuuauaaaacaauaaauuuggaagcacuguauucaauggauuugaagaggacaaaugauggaacaaagagaugacacagauauauuuugauaguucacaaaaaagaugcuuaagcauugaaauaauguaacaggagaggaaagggaaaaauaugugcuauauaagaaguagaaugaacaggacuugggauaagucuucgguuuuugacuuggguuacuggguuguaccuauaagaaaguguaggaaauaaaauaaucaagauuaguguaaguaggcaucuugaguuuaaguuacauguaguuuaacuuggcaggaauguccauuuaacaguuacauauuggagggaaauucagaagagagaauuacggaugagggaaauuuuggauauuaguauauagauggaugucaaauucucaaagguaaaggggguacaaggaaccuagcaaacaggaggucaagagugagcuaaucaaaagcaauuucuauagggugguaucaugacaacaguaaugauaacaguauuugauauuuuuauauguuuacaugugccaagcacuuccuaagcacuuuaucuucauuucacagaugaagaaacuacgaaguuucuuauccaaggucacacaacuuguaaguggcagaauuaggauuugaauacaggcagucuaguuccaaaauccaugcuuugaccuaccaugcuaagcagcugacaggcuauggugagauaaggacuauugaaugggagaugggaaaguagggggaaagcacagaucauccuguucaaggucaugggucucccucacucuacuucccagaugaaaaaagacuugacuauguauauacgcugaaaggaagaaagacagugaagaggugagguuaaaaguauaaaacaaggccaggcgugguggcucaugccuguaaucccagcacuuugggaggccgagacgggcagaucacccugucucuacuaaaaauacaaauauuagccgggagugguggugcacgcuuguggucccagcuacucgggaggcuaaagcaggagaaucgcuugaacccgggaggcagagguugcaguaagcugagauugcgcuacugcacuccagccuggugauacagcgagacuccgucucaaaaaaccaaacaaaaaagaagaauaaaacaaagaguaaacaagggaacaggucucagggaugguaagagggguuccagguaucaucaugaugacacauauauuuuugguauguuauuauacaaugauacuacuguaaguauaaaaggaagcuaaauguauguuucauucuacuauuaauauuaaggauuuccuuauuuaaaaaaguaacauuuuugucacaaauuuguuucauuuuaaaaauacuuauuagaagucuucuccuggcaaaguauagaaaacugcacuuagaaaagcccuagaaauuauucauaaugccucaauuacguaucaaauauaguaaauaacagaagcagcauuaugugguauacaccaaauccgguauauaauugaggcauuaagaauaagcauuauauauugcucaagauauuuuagguacuccucuuuuuagagcuggcacaugugugaaaaagcaucgacagcuggcacaugaaaaaauaaaaaaaucagguagcaggaaaaaaaaaaaccaguuggcauauaaaggauuccaauauguuuuuauugagugugugaacaauguguuuuugcuguggcaaaacggauuucugauacgggaauuucugaggugaaaaaaauguagaaacuagcauaagcuauaauguuuuaauuugcaucccugguaauucucuauuuuaugaccaaaugaacauauaaguuauaauggacaguaaugugcucuaauaaaugaaauaaaaaugugacucaaauuucacccuccugauacagccucacuuaugucccauagacucaaagaaagaacuuugcuuccaugacauuuugcugaucauguuuucuauuauauaacauauuauaucuuauuuauaugucuaccucauucacuaaacaugaacuucuagaggacaaguacugucuuuuaaaacuggguaugccaaugucuagaauaaugcauggcacauaguagagacucaaugaaugcuuguugagucagcuaaauaaauuagcuacuaaaaacacggaaagaacaaccaguaccagccacugcaaaaacauaccaaauuguaaagaccauugacacuaugaaaaaacagcaucaaccaaugggcaaaauaaccaguuacuaucguaaugacaggaacaaauucacacauaacaaauauucaccuuaaauguaaaugggcuaaaugccucaauuaaaagacacaggcaaacuggauaaagagucaagacccaugaaugugcuguauucaggagacccaucucaugugcaaagacacacauaggcucaaaauaaaaggauggaagaauauuuaccaaccaaauggaaagcaagaaaaaaaagcagggguugcguaaucuuugauaaaacauacuuuaaaccaacaaggaucaaaagagacaaagaagggcauuacauacugguaaaggaucaaugcaucaagaagaacuaacuauccuaaauauauaugcacccaacacaggagcacccagauucauaaagcaaguucuuagagaccuacaaagagacuuagacucucacacaguaauaguggaagauuuuaacaccccacuguuaauauuagacagaucaaugagagagaaaauuaacaaggauauucgggacuugaacucagcucuggacgaagcagaccuaauagacauuuacagaacucuccaccccaaaucaacaaaacauacauucuucuuggcaccucacuguacuuauucuaaaauugaccaaauaauaagaaguaaaauacuccucagcaaaugcaaaagaacggaaaucauaacaaacagucucucagaccacaguaaaaucaaauuagaacucaggauuaagaaacucacucaaaacugcacaacuacauggaaacugaacaaccugcuccugaaugacuacuggguaaauaaugaaaugaaggcagaaauaaagauguucuuugaaaccaaugagaacaaagauacaacguaccagaaucucugggacacauucaaagcaguguagagggaaauuuauagcacuaaaugcccacaagagaaagcaggaaagaucuaaaauugacacccuaacaucacaauuaaaagaacuagagaagcaagagcaaacaaauucaaaagauagcagaagacaagagauaacuaagaucagagcagaacugaaggagacagagacacgaaaaaccuuucaaaaaaaucaaugaaaucuaggagcuaguuuuuagaaaagauaaacaaaauagacagacugcuagccagacuaauaaagaagaaaagagagaagaaucaaaaagacgcaauaaaaaaugauaaagggguuaucaccacugaccccacagaaauaaaaacuaccaucagagaauacuauaaacaccuagaaaaucuggaagaaauggauaaauuccuggacacauacacucucccaagacuaaaccaggaagaagucaaaucccugaauaggcccauaaaaaagucugaaauuucuuugggaggccaaggcaggcggaucacgaggucaggagaucgagaccauccuggcuaacuggugaaaccccaucucuacuaaaaaauacaauuauccaggugugguggcgggcgccuggagucccagcuacucgggaggcugaggcaggagaauggcaugaaccugggaggcagagcuugcagugagcugagaucacgccacugcacuccagccugggcgacagagugagacuccaucucaaaaaaacaaaaaacaaacaaacaaacaaaaaaacaacuccgaaaucaaggcaguaauuaauagucuaccuaccaaaaacauuccaggaccacauguauucauagccgaauucuaccagagguacaaagagcagcugaaacuauuccaaacaauacaaaagagggacuccacccuaacucauuuuaugaggcuggcaucauccugauaccaaaaccuggcagagacacaacaaaaaaagaaaauuucaggccaauaucccugaugaacaucgacgugaaaauccucaagaaaauacuggcaaaccgaauccagcaccacaucaaaaagcuuauccaccaugauuaagucggcuucaucccugggaugcaaggcugguucaacauaugcaaaucaauaaaaguaauccaucacguaaacagaaccaaugacaaaaaccacaugaauaucucaauagaugcagaaaaggccuucgacaaaauucaacacccuuucaugcuaaaaacucucaauaaacuagguauugauggaaugcaucucaaaauaauaagagcuauuuaugacaaacccacagccaauaucauacugaaugggcaaaaacuggaagcauuccuuugaaaacuggcacaagacagggaugcccucucucaccacuccuauucaacauauuauuggaaguucuggccagggcaacuaggcaagagaaagaaauaaaggguauucaaacaggaaaagaggaagucaaauugucucuguuggcagauggcaugauuguauauuuagaaaaccccaucgucucagcccuaaaucuccuuaaccugauaagcaacuucagcaaagucucaggauacaaaaucaaugugcaaaaaucacaagcauuccuauauaccaauaacagauaaacagagagccaaaucaugagugcacuuccauucacaauugcuacuaagggaauaaaauaccuacgaauaccacuuacaagggaugugaaggaccucuucaaggagaacuacaaaccacugcucaaggaaauaagagaggacacaaacaaauggaaaaacauuccaugcucauggauaggaagaaucaauacugugaaaauggccaugcuucccaaagugauuuacuuucaaugcuauccccaucaagcuacacugacuuucuucacagaauuggaaaaaacuacuuuaaacuucauauggaaccagaaaagagccggcauagccaagacaauccuaagcaaagagaacaaagcugaaggcaucauguuaccugacuugaaacuauacuacaaggcuacaguagccaaaacagcaugguacugguaccaaaacagauauauagaccaaugcaacagaacagaggcaucagaaauaacaccacacauuuacaucaaucugaucuuugacaaaccugacacaaacaagcaacggggaaaggauucucuauuuaauaaauguuguugggaaaacuggcuagccacaugcagaaaacagaaacuggaccccuuccuuacaacuuauacaaaaaucaauucaagauggauuaaagacuuaaauguaagaccuaaaaccacaaaaauccuagaagaaaaccuaggcaauaccauucaggacacaggcaugagcaaagacuucaugucuaaaacaccaaaagcaauggcaacaaaagucaaaauugacaaaugggaucuaauuaaacuaaaaagcuucugcacaggaaaagaaacuaccaugagcgugaacaggcaaccuacagaaugggagaaaauuuuugcaaucuauccaucugacaaagggcuaauauccagaaucuacaaagaacuuaaacaaauuuacaagaaaaaaacaaacaaccccaucaaaaagugggcaaaggauaugaacagacacuacucgaagacacuuaugcagccaacaaacauaugaaaaaaagcucuucaucacuggucauuagagaaaugcaaaucaaaaucacaaugagauaccaucucauauaccaguuagaauggcgaucauuagucaggaaacaacagaugcuggaaaggauguggagaaauaggaaugcuuuuacacuguuggugggaguguaaauuaguucaaccacuguggaagacaguguggcaauuccucaaggaucuagaacuagaaauaccauuugacccagcaaucccauuacuggguauauacccaaaggauuauaaauuauuugauuaaaaagacacaugcacacauacacuuacugcggcacuuuucacaauagcaaagucuuggaaccaacccaaauguccaucaaugacagacugcauaaaaaaaaguggcacauauacaccaugguauauuaugcagccauaaaaaaggaugaguucauguccuuugcagggacauggaugaagcuggaaaccaucauucucagcaaacuaucacaacagaaaaucaaacacugcauguucucacucauaagugggaguugaaaaaugagaacacauggacacagggagggggacaucacacaccagggcuuguuggggguuggggggcuagagaagggauagcauuaggauaaauaccuaaugaaggugacagguugaugaguacagcaaaccaccuuggcacguguauaccuuuguaacaaaacugcauuuugcgcacauguaccccagaacuuaaaguauaauaauaugauaaaaaagaaaaauuaaaaaaauaauuccauucacuaaauaaauaaauaaauacaaacaagaaaacaaguuugguugcuuuuuauuaauaacuccuuugccccuuucucuuuccaacucuagaugaaucuaggcaucuguuuuaugcaccaugcaacugaacauuguuggaaaaaaauuucaagugaauacauuuauacuauucugaauugaugaucuccaauaucaaaugagaccucaauacugcugagcaaucuucuuacccuuucauucuuagcuaaugaucuagucuuguauuuuggggauaauggaagccgucagagaaucuagacauugcuugcauccguaaucccuuucuuuccuccuauugcaaacgaagucucauuccuccauucaaauguauugcagggcuuaguucucggacgucuuuuucauagauacccucauuuagaaacaaccauuuccaugauuuuaaccaccaccuacgacacgcagauuuuuauuuccagcuuaggccucugaucuacauuccauacuagaauauccaacugucuaugaucuaucugcuuggauguuucacagacaucacaaacugaacaugccuaaaauuaacucauaaucuccuccccaccccaaauuuacuucuccuacuauguucuucuuccuacuacucuggaauuucauuaaaugguuacaucuaucauuaugauauauaagccaaaaacuagagagacacuugugauucccuucaccuuucauuaauuugagugccuucuacaugccagacacuauuccaggcaauggggcuacaacagugacuaaaacaaaauuccagcagucaugggagagagggagagagggagagagagagcacgggguggggacgcggggagagggugucuguguugggaguaggggaagauacacagacaagcaaaaaacccuaauagaaauaaaacaugccagaugguuaugaguacuguguggaauguggggcagucauuauuuuuuacagggugacugaagaagcaccucacugauagauaauagcgaccuaauggaagugagagugcaagaauauauauauuuagaggaagaacauuacagguauaggaaacugcaaguucacagacccuaaggcaggcacgcucuuggcacaugugagggugaggauggaacaagguaagcauggagguaagugauaggaaauaagcuagcauggggccagauccuacagggcuuuguacuuuuuuuuaaggacucuggcuuucauugaucguugagugaaaugagaaggcauuuuguguuauugccuaaguaauagaaaaugccuuagguuugaaacgaauugcuggcuguucuuuuaagaacagauuguggaggguaaggauagaagcaaagaaaccagcuagcagacaaauggaaugaaccaguuaagaagauaguagccugaaaccuuuagugccuuuguaacauuaaaaucuaaauucucccuauaugaucuggcuuuugccuacuccuucaaacucauuuugucucacuccccuucauacauuauuccacaaacuacacuucugauuccucaaacuugcccuucuuaguggcuuugcacauguuuuugguccuucuaacuucaccugccaaacucauacauauucuuuggucaaagcucauguuacuuuucguaaauaugacacccagcuuaaaacaggugcucuccaaguuccuguuagcacucuacuuucucuuucaugauacuuaucauaauucaugauugauuuaauauuugucucccucauuagacuguaaacuccaugggaaaaaacuguuuuguucaucauggcauaauuagugauuaugagagugagagucaccuaauagaccuucaauaaauauuugcugaguaaaugacuucaucagucauucauuacuuaugaauuacuugaaaaaaauuacccagcuugauaaucuacaauauucugaaaauagugcucugaauaacuucuggcuuucaaaaaucaacuuugucauugaaggaugaaaaauauccaccagugauacucagaagaauaaaagcaauuccaaaaggaguacuugaauaguuuuuaacauucugaacauugaaugaguaaguguguauaucaccuccuagggaaacuguuuuaaauggcacaacauuaaugcuacuuaaugagagcaucuuguauuaugggggccaaucauuugaacuaaacauaaaaacauuuuuaauaauuguacaacaugugaauauacuuaauguuacuauacacuuaaaaugguuaaacuggcaaauuguuauauuuuaccacaaaaaacaaaacauaagcauuucuuauagguugauuggcauaauuucaaaaaaauacauuaucucaaaauguacugaauaacaacucauaauaacuugucuuagugacuggaaaucaaacuuuccuugcuucaauuuccucauuaguggaauagagauucuuaugcccuaacucacagaccucugugaagagaaaauuaagugaaaaacaauauaaaaaaauaaccugcauuaugcaaagaaggguaccacucuuaacagaggcugcagguucaauacagggcuguuaauguuuuaauauggguuuauaugagaacuaguaauugauuuagauauuacuauuaaucgaacaaugguuuaaguaaccaacucacugacccucuccccugcccagaauaguuuauaaaucauuguaaagaaguaaaugguaaacuuuuagaaaacauuuugacaucaaaaaaaugagcugcuugauuuuaaguaagagaaguaaaucugaaauagguuuuucuuuccuuuuauuuucuuggagggagggagcaaaucuguaguucccauuacagacuacagauugacauuucuuuuguuuugcuuuuaauuacaaaaaaaauccuugaaauaauuauaauaauugauacaagauacuucagccuaauuacauuaauaacuucuguuauaagauguagucacuacaauacuaucuaauaaguauauuauuaaauugguguuggccuuuccuagccaggauaguaaaaccacuuuguauuuuagaauuagauguaauaauuuacaacucuuuaaaagaaccucucuauuucucuaagaucucuauuaugucauuuuccuacuacagaauuagggacagauaaacacauaaaaacuuaauucagaaagaggcacuaaucuuagggaauuuugcuuauucacugagaagaaugugaacagcgacaaaucaaaucucaugucuccaucugagauuaagaaaggcauguuuucauaacaaaucauuauuagccaaguuacacaagugcaaggcauucuuuuagagauaccauuuuuccccuaguugugaacacuaaauuuuuacagaacuaucccauauauacucuuucuuaaaauaaucugucugagaacguagguucuucuuucccaccucuguucucuuucaaaaaggaagggcuauucuaguccaaagggaaaaguaaaaacauugguauucauguugagaaaaaugaaugguucuaaugcaaguaagguuguuuacauuuuuuuuuuuugcuuuuaucaaaauggauagaugaccugacugaguugucauuugacagaggauugaauauauuuuugaugacaauuugcuauguaauuucuggcacauaacaugaaaggaacucacauaauugaguuuaacauccuggauuaggaugaaaaccugaccuagaaaguaguaguuuuaaauuuuucauuagccacguucucaguuuaucagaacaaauauaagauccuaaacuauuuuuuaaaaaguguuuugugucucagaagugagguuuuuccuuuuacgaugaaaaguauauucauuuaaauauaagguugguaauuuaaauaaaacuagaagguuuaguguuaaacuggacuucuaagaaacugaguuccaauaaaugcaaaaagaaagucucaagguaagaguaggcuaguugaaguaauguaacauagaaauaacagcuucagaaauaacuuuuucucuguuuuacaauguaaugaagaucuaucuaguuucuuaaaaauguuauuucuguguaguauuacuuauucucuuaaauuaaaucuuuaaaaaaguuuaaacuuucuauuuaacauucuucuaaauuuuugaaauuaaguuuuuuccuaauaaacagaucauagaaaaaaaagcugaccuuaaaaaugcuugaaaucccaauuuauuuuauauauuaugacaggaauaaugaauaagucuuugauuaguaucauuuuuuucaaugacuuccuagaaucuaucuaaggagcucuauuauguccaaguaaauauuuugaaaauaaccaucuuaugccaugcugcuuuccaauggaaaagaccacauuacuccccugcuucaaauccaucugaggagaugcuucauccaggaaacuaaccaugagccuccuagguaggccuugacaaugaaaaagacaaggguugaagugcucuugaaucuacugaacuaaugcuaauuaaaauuaucaccaauaaugcaaaauuuaaaaacugggcauucucuagauggaguaacagauuuagggaacuagaaaacuaucuuauuauauuauuugaaccaaugggacauggugguauaugccuauaaucauaacuacucaggaggcaggggcuagggguaaccaaacucaacaauuuugaauuuccuagugcccuacagauagaauauucauaaacaauucuaugcuauuauaucccuuccuuaucagcuugccuaggaagaguuaaauuagcauaguucagaaauuaaaggguugauaaauaccauuccuacaauaacacuauaugaaaaauaaaaguacacucaauuauuucuucuuaguccacuaagguccacguggaaaaagacucaagaaaagaggacagauagaacgguuauggagaacagaaucuuuccagagucauucugcuuaacuuguugaauuuuaaaaaaagaugagauaauuucuacauaauauguauucaguauuuauaaugugccagucagcauccuacgaguuaaaaccaucaacucacguaacccuuacaaaacuccuaagauaggguacuauuauuuucuugucagacgaugagaaaaaugaauuguggaauuaacuugucuagggaaauacaguuauuauaauaagcaggaaggccauguuuuuaauccaaguaguguaacuccauaaacugugaucuuaaucuguauuauuaguuuuuuauguguuucuuuuuuuuuuuuuuuuucaagccagacuuuggcuuucaaacuguuccucagaguccugggauccaugagaaagcuucuggggccauuguggaaaguaaaggaaagcagaugggguucugggaacuucacccaaccaaagcaauuuuaccauaucuacuuaaauauuggggauacaauuaaacuuuccacgguaacuuaaaaaaaaguuuugaugcuaaaauacaaagaguuugaaaaucacaauaucuaggcuauaaucuucauaaggucaggauauacaguuguucuugguauccacaggggauuggucacaggagcccccucuccaccuuggggauaccaaaauccacagaugcucaaguucuugauauaaaaugguguuguuauuuguauauaaccuacauauaucuucacauauacuuuaaaucaucucuagauuuguuauaauacuuaauaaaauguaaaugcuauguuaauuguuauacugcauuguuuuaaaauucacauuauuuuaaauugucauuuauuuauuuauuuuugagauggaguuuugcucuugucacccaggcuggaguguaaugguguaaucuuggcucacugcaaccucugccucccggguucaagcgauucuccugccuuagccucccgaguagcuuggauuacagguguccaccaucaugcccggcuaauuuuuguauuuuuuaguagagaugagcuuucaucauguuggccaggcuggucucaaacuccugacuucaggugauccacucgccuuggccucccaaagugcugggauuacaggcaugagucaccaugccuggacaaacuguuguauuguuauuuuuuacugugcuauauggcaguaccauauucaccaaacaagguuaauacucauaccauuacaucagaaaaucuuaaguaccaauaucauuaaauuaaauaauaacaguaauaauguuaaaucacacucagauuggugcugcuuaguuuuuaaucauguguggucaaaagauuucacuaucucaaggcuacugaugggcuaaguauaacccacgcuuacauuaaaaaaguauacuuuuuacacucuuuuuuuuuuaacauauguuaauacuauaccaccugaugugcugaaaugaucacuuaaauuuggaggacacugaauuaauuuaagagguuacauuaaaauucaaauugucaguagagauaauauuugauaauauuuucuaaaauucaugaacgucuucaauuucaaagaaguuacaaggaaacuugaaaaaagcauacugaagaaauaguaucugacaaaaccuaaagaaucuauucuauuaguuaucuauuacccuuuuuauuuuuggaucuaugaacuacaugaauuuuugugaaauagaggaguaaaggcuacugccaccauuuuguacucccucuuacagucaauuuucagcucgagagcugacaucuuaaucaauuaaaaaucauggaaguuuuaagaaaauaaaacuaaaggccuagcuuuucuaauuccagaugugaacuaaaagcuaaagccgcacaaguaaaaacucauuuuucucuucuccaaauuguuugaagaauuuuauuuuagagacaauauaguuuccaacuaaauaaagcuauaaugaugaaauaauauccacugcuuaaaauacucacugcuaaaauuuuugucaaaaaauuuuauggcuauuaccauaaaauuauaaaccaucacgcucacggcugugucucagaugaaauggaauacgugaugguaaaauauauuaggagugucugcaauagagcuaucaauuuauucuaauaaaauaguuuugaauagaagcaaaaaugaauaaacugaagauccucacaccuuaaacauaacaugcaagaaagcuaaacgaugccaaaucuagcuuaaccuagcugguuaaaagauucaauuugaauaccuauuucugagaaauugcaguuaaccauaugcagacaauacuaaacagauguaucaaaggcacagaaaacuaggaugcaguauugcuuuagaaggaauuuagucugaaugcuggcccaagccucccaugaaugauuagcaucaacacaaacucuugugcucuccugacagauucaaauuuugaaucccuauguuguugaaauauuuuauuaauauuuaugaaaaagcaccaagauugguuuucuaaacuaggaaaaaaaacucuagcugauaucaagcaucuggaaccaaaguaauuuuggcaguucaaggauaaagagguacauaaaaauuaauauaacuuggugaucugagaacaggguuuucuaguacugguauaaacacaauuuacauaaaacauguuccagagaugguccaacagauauuauaauuugucugucccauuccuaucucugaaagcuaagcacccauguacuuuacuuuguuauuuaacuauuaggauaauaauacauuuuggcuuucuuccucaucuagaaaaauaaagauaaaaauuuaaauugucucuaugucuaacuagugcuagaauucuugaaaaacuauuuugaauaaaguaauucacacuauacuaugagcaggauuacucauuugaagauuuaaaggaagaguuuauuaaccuauauauuaaccuaucugcuuaggcagauaggccacuucccaagugguucaacucuaaagcaaaauaccagaaaucgauuaugccuucccuauucaauuucuaaaaggaugcuaacuccuggccuauaguguaugacagauucuaauuuccaagaaugcuauaaaggcaaugguuaauuuaggaaacagcuguaugaaugaugauguacaaaaagauucacuuagaauacugaauggugaagagucauccuuuucucagauagugagaaagaugucuaauaauguccuuaucaaucuauacccugcauuuaaucuauaucuuuugaggcugccuccugggcauaggagauucaacaaaaaaauaagaauagagaacagaaaaguuuagauuuaaaacuaaaaauccagaauucacaagagacugacgaaaaaaagguuaaaauucaaauaucaaaaaugguuugccauuauucugagcuuuuauaaacacagaaauuuuaucuguaaaaggggaauaaaauaaccagcccuaaguuuauacacaguaacagugauauuaaaaaauauaucucucucauuacuucagaaucaaucaaagacauaaauauuuaacaaguugaggauauagacuagagcagaaagaaaagaaaaagggggugggggcaggggaaaaguaguuaucucuuauauccccaaauuaaaagaccuuuaagggaaagugauuuguuaaaguauguauacaaaaagaaguucccaagauuuuccuuuuuaaaauuuuaauuucccauuaagacaaaaaaaaaaaaaaaagaaaaaaaaagugcaacagacuucuacugaauaauggagggaacucauuaguuuugcuuuuuuuucccucccuuuuuagacagcuuaaguuuucugucugauauuauauuuuugcaaagugauauauaaucuuguacauuauguuaaucaaucacaggucaccuaauugagaaacauauauuccacuaccaguaguagaaugaauaagucaaauauguaugcuuaaaucuuccaugaaaaaugaacuuucaaaacauauacucauguucuggcaugaaaaacccaacuuuaucuucuuguauuacagauuuccaugaaacaugaguuucauuuuguuuacaaagaccuaccugaauagcugaguucaugaaacacguauuucccaaguuacuuaggccacagaggccuggcuguucauuguuucuuccagguuccgaauaaucauaguucuuauaagcgguauaugauggaagacaguaauuugaguuuuucacacuggaagaaaaaaaauuuucauaaugcagccaauuauauuacaacauauuuauaauaaagaguacuuuaggccuauuuaugagauaugugguugaucauuacauuucuuuuauaaaguacucaacucagauacuuuuuuaaagacuugaaccucaaaaaaauaacucacccugaauuaagauacuccuuauccaaucaacaaaauaacucucauauaccacaccaaccaauacaaagcacuauuauaucuuccuaccuuugauuaacuagagcagcuuuacaguuugcuccauuccccauugcuccaucaaauuuaaaacauucagauuuuaaauaccacccgcagcaacaaaucaucuccuuuaugacccuuugcauucuguuauuguaauagaguaaaaaugguagaaacaguaagaguuaugcuuuaaaaaguuacagguaagagcagagauuuccaaggccacugugaccucacuguuaugaugcacugaagauuccauuuauaguuucuaugcgagaccagcaaaaacuaguauucaaaugcagaaaaaagccugggugaacaggaaugcaaaaaugauuccacgcaaguauaucccaguguuauuugccuuuucuuucuuuugguuucucagaacaauguaguuuauuuaaucagauaaauauaaccucaagauauuuuaaauguuaauauuaaaaaacuguaauauucuaaaaguuacaaaaucaguauaauuuuuagaaagaagaaaauaaguuaaacgaucccucuuccuuuggcauauaauaaaaaauaauuuugugaaaaagaauggauucuuucuuauuuuuuaauagguuaucuuauaaaauauguaugaugaauauuuuggauauaauucaaaagcaugcuuucaaucuguuuuuauuaauuagaaaaaaccugaaugagaucuuuccuaaaagcaaaugaugcuauaaauagaacagcuuuauaaaugagcaugauaaaucaguaucucuagcaauucacaacuggcuauaauuuauuccugguauuacuuuuuuaaaguaguuuuuucuuauaauuuuaaauacuucacuuuauuauuccauauaggacgcucucacuuuauuauuauaaaaguuuaugugaacuauacuaccuguucuaagaaagucuuuaguaaacacacauacacacacacacacgcacacacacacacaccacccccagagaaaacacacaaaaccaaaccaaccuaaaauuacacauacaauguuggccuacuaauguuuuugcauuuuuuaaaaaacacuccuuucuucuacaaacaaaagaggucaacuccucaacucugaaaaaauaauccacccugagauaaaaacagcaggcgccaaagaaauguaacauuaaucaauucaaauucggaauugcuagacuuauagcuauuuacuugacuuaaacuaaaacaaaacacaaaaaauauaauucaugcaucuuucuuuggcaaaucauuagcccaugauucacauuuuauuucauauuccuaguaacuaauaaaguacaaagcgccuauuagcaauuuuaaguauuuucgcucauaauuggauuauugaaucuaacuuuggguacacacaacaaaaagcugaaguacaaaaaaaauccuguuuuucuuuuauaaguuuaaguagugcuaaaaaugaagaucugcuguauauuauuuuaaaaaaagcaaggcuuucauuuucuacacauucuacacauuacagagaagaaaaaacuucuggcuguaaaaucauaguaaaauuuaagcagccagagcacacaggaaaguaugcccaaaugcauggucaugccuauacacacacacacacgugaaaagacuaaaagcacauuuacaugcucauuccauaaguauauauucagauauccugucucuccccacguguaacacaaagggaugcuggaagcucuacucuucuuugcagcaacaugauggaauuugaugggauagaaauugcuauuuacugagaacugaacaaaaaacuuacuugcaaagcaguuuuuugguuuuguuuuuaaaaaaaucuaaaucccuaaauaauaucuacaacuuugcucaaagauugagauagucuagaugcucaaaaugauaaugaaaaucaaucaauuuaagauacuuuaauaucuugaucggucacuuauaauccacauauuaugugugcucuaaaugaaauauuaaggcuugucauggaaaauaucaaaacuagcaguuuauauaauucaaaaaauauaugaaaaucugggcccuaaagauagccucuaguaccuuucaugacuaugucuacuaauuauuuccuaaagaucuuaagcuagucaucaucuuuuaaggcuaugcuacuuugcaaaaauaaauuuacaguaauaguaaugggaauuguaauauuauauuagauuaauucuguauuauauccuucuuuaauaaaaauacacuaaaaauacacuuuuuuuuugugaaauugaaccuuaccuuuccauaaaagaugucagauugacuuuuaaacuagcacugacaccugacuuuauaaauauauaauuuaauccucaaaacuauaauuaugcccauuuuucaguuaaugaaaugaugcuuuuagcuaacaaauuuaucaagagccagauggcuagcucugguaguuuccaaaauucacaguuccuguugaggcucaaucucauacagggagucauuuucauuucaaagaaaaagauauaaaugaauuaacagaaaaauaaaaaaguguucugcauuuggaaugucaaauugagacaauaaacacguuaaaaauauuuuuaaaaggcaguauuaguaauauaccaaagcaaauauagcagggcagaaaaauacagguuauagaacuauuaccagaaagacaaucugacagauauuuaaaaauguacuuaaauuauaacugaggcaaaaccaaauacacaagggacuaauagguaaaauuaugacacaagguaaacaaacuauauuacaguaauggauuuuucauaauacugguuuuuaauaaaaacuuauuaaacuuaaaugaaauaauuccaaguauacuuuauuacuuggaauuauuuuauaacaauauucuuauuucuggaaauaaaaauuuuauaucuuagaaauguaucaguguaggguuaaaucuugaauuuauaaauaaauuucauaaacuauugauuuuaauauauuacuuauacuuguagacuauuuccacauacauaagguuucaaaaacauacuuaauccaaaaaggucauuaccuauuuuacauauuuuuaaagaaacuaugcuauuucuaucugaagucuucccacaagcugaauggaaauucaagaaauaaauuguauguaaaacaguuguuuaaauacgauagaauucaaguuuuuuaaaguuaaaaaaaaaaaacuuuccauuuuacgaaugcuuaaguucuguuccuuacuaagaaagauaauccuuacauaaaaauguauuuuuaagcucaaaaugguucacagcuucaugguaccucagugacuauucgcuauuaaaauuccauaauaugacagggcuauuuuaguguuugaauuaaaaaaauauaaauagcuaaaaauauaauguagucauaugauagaaucauucaaacuuaagacucuaauuucucucaauaguuucugcagucagagguuuugagauuagauuauacugucacguauuuacuaagaaugcaaacagaacaaaaccagaaacacaccagaccacucauaccaauaugguaauucuggucaaaauauagucuacauucaacauagucuauauacaauguuaaaaaucucuccaaagaaugacuguaaauaccuguaaaugaauucucuuacaguaaguaugagagccaucugcaaugaguaaaucauaaguaauauuuuaucuaguaugaaaaaaugacuuuugguaaguuuacuuaaagcucucauguaauacaaaccaaauuacgagggguuauuuucacucuuuuuuuuuggccugugcacauacauuuuuaaauagaagagaagauacugcaguguaauucugaauauucagugucuucaguauuuuaguauuacacuauguuguaauauuauuacacauagugcacauaucuuuuuaugaauuacugaaauaagaauguaaauguuuuaaauguucuugauucauauugguaaacaauuuugcuagaaaaaauuauucuaguacuccaaacacucagaaucauuauaaaaauacaugucauuguuuaauuuuucccaaugugacugagguaagggaaagcaaaugggguuuuucaugguuuuaauuuacauaucucuaaucaguagugaaugugaaaauguaaaauauuuaucccagcugggcaagguggcucaugccugcaaucucagcacuugggaggcugaggcaggaggauugcuugagcccaggaguucgaaaccagcaugggcaacauagugggacugucucuaugaaaauaauaaaaagaaaauuagcaggguguaguggcgugugcuguaauccaaguacucaagaggcuaaggugggaggaucacuugagccugggaggucaugggugcagggagcugugauugugacacuguacuucaaccugggugacagggugagauccuaccucaaaaaaaguuugucccuuauuuaauuccuuuacuuguauugcccaguguuucuaagacugucuuagaaaauuucugauuuuuaugagcuugauauauuuagaauauaaauccuuuaucauuuguaacaaguucuuuuuuccauuuauuuuuccuuuuuaaauaugcuuaacaauuaucuuggauuuaaaauuccagagaagaauucucagauaugagccaauuuucucaaccauauuuccuggauaaucugcccauucguauuagucuacaaugccuccugaucauauuaaauucuuuuuauacaaagaucuguuucugagcuguuagaaaauaaauuuaacuauugguguuuuaauuauugguguuuuaauuuaauuauugguguuuuaauuuuaaagauuauuucacaaauagcuuuagucuuuuagaauuuacucacugagauaaucagaugccauuuagaaacugaaaaaaaucuaaauacuaaaauuuuugauuaguauaauaguaauacauaauuaguauaaguauuagauaaauaucuaauacuaauauguuagugcaaauaucuaaauacuuucaaucuaauccauaaaaggcacuauacaugucaaaaaaaaauaaaaggauaaucaucucuagaucaauguucuucccacaauuugggcuaauuacaaauaauaaagguuuucuuuuuuccuuuuugaauuaaaaaaacaugucaauguucaagguaauacacuaagagucaauacaagauaauacacucagagugaagcuguguaaccuugacuuucaacuguuuuucuuauagcaauauaacacacacuucaauaaaauuuuuauaaauuccaugauucuaaauuuuauuuggcaagagguaaggaaauuguuuuucugaacuucucaagaaaaagugauugccuuuuucauaaacaaaaauuuauugugugcuuuccacuugagaaucacugauacacacuuuuuaaaaauacuuuauuauaugugauuacacaucuaguucuaaaaugacaucugaauuuaaauucuuccuaaaaaguuguguucuaacaaacuucuaaauauauuuuaaugauuaguguuuaguauauaaaauuuaaguguuuuauuucuuucaguauauguauuaaaucaagaagcaauuuaauugcuuucuuuuuuguuguuacucauggaagaacugaccgguaauuuaaaagaaaaccaauuuuaaugcauuaagacuuuuauccuaaauuuuagauacaagagauuuuuugcaaccauaauagggugaucaauuaaacaaagaguuuuuaagauucagugcuuacuuucuguuguucauguuguuauaauuauuugauagagaugaaggagagaucuuugguaaaguugaaaaauuggaugcaccuggggaccuuuaaaaauaugaaaauguuaaauuagauaaaaaaaugaagaauuuuuaaauuaauuaugaaauaaaagaacagaugacaauguuuguaguaaaugaaugcugaaaaauagauuuaugagcaaaaucacuauuauccuuugguuuucaauuuugaauguauuauuccuuauaaaaacauaaaaguacaaaagggaacuauuuucaaauaaaauuuaucaaauuaaauaugcgacuugcuauuauuccuauaaaucuacuaacuacauauacccauuuccgaguuuagguaaccauuuuuaacauuuuacgaucaauuuccaucagucaauggaauuaaacuauucuacuuuguuucucacugguacaccauggcauucuaauuauguacaacacugacacagagaucagagaacauuccaauuuuuaaaaauuuaaggcaauggggacaaaauagauaaaauaauuccaagcauaaucccaauaugcuauauuuggccaaagggaaaagucauaaaucugacuauaguauacauaccuuauuaauucagaaucuuuuugaagaaacugcaauuacuauugguuuuuaaucaacaaguauguauuaaaggcaugacuuauaaucaacaaaucuauaauacagcaauaauuuaaguacauaaaggucacuaaaaguuuuauuuccccuuguaauuuuguaaacauguuauuuuaauuuacuaggcaacaucuaggcaaggggcuguaaaaagcuaggcuucaguccagugacucagucauuguaaauuuuaaaucagugaggccccgaaugauucacuuuuaaauauuaugcuaacgaacaaugaaauggucaacaggcagaaaagcauaaucuacaaaauuugcuuuuaggugauuuggauuuaucuaaauauauauaucuacaaugcauuaugcagaacaaauggugggcaauaaaauuuuuuaaauauaaaaaaauguacauuuuaaauuucauuuuuauuuacuuuuuuagagacaggguuucguucuguugcccaggcuggggggcagugacacaaucacagcucacugcagccuugaccucccaggcucaagagcuccuccaucucagccuacugagaaacugaaacuauaggcgugugccaccgugcccagcuaauuuaaaaacaaauuuuuuuugcagagacagagaucucaccauauugcccagccuagucucaaacuccuggccucaagugauccucuugccucagccucccaaagcacugggacuacaggugugauuacaggcugcaccaggccuaauuuaacuuuuaaaguuuuauacauuauaaaaucuuagaaaaaaauguuuucuuuucaacgagguuguuuuagcugauaaaugauauauauuacuggauucuguuaagugggauuucuaguuacguacccuucugauagaagucccuuuaacaagauuuuauuuuacuguacuaaacucaaaaacaaaauagaaucaaccaaguuuucucauaaaacaauguauagaacacacuuaaaaaguaauuuuaauaauccuaauauucccagauaguaguuuuaaaauauuaauaaaaauggaaauauccuggcauuuuugccuccacauuaagaauucuaaauuaggaaaaaacgucuaaauugauuagagacugaguuauaauaaauuaaggagguuaauuuuuuaaaauguaauucauuacaacuuuucaaaaacauauauaaaucgaauguuccccugaaucuuauaguaaaaauuauggaaauaaagauccauugcuucauccaauaaagugacugagacauauauauuauauauaauauauaugcacaguguauacacuuuguguauauacacacacacuguguaugucuguguacauauauauauguacacacacacacuuuuuucuuuuucuucucaucuguggccuuuuuuauuauuaauuagcaacucugagaacuauauuggaaaagaaaaugaaauaccauggaauuaauuuguauuuucaguuuuuauggaguucauuuaaacacucaaacauuuauuaaaugacuacuguaugccucacccuugauaaguacugggaauacaaagaaagacacaguuccugaccucaaacagcucacaauaggaaaaaaugacauauaagcaaaaugacuauaauacaauacaaguaugauaacaaauucuaauauaaaauuuuguagguggugacauaaggugauuuaaaaaugacguacaauuagagggauaggugggaaguaaaagaguauuacaguuaggaagaauagcauguagaaaucauguagaaaccaugauguguucagggaauuaccaguaaauucagcuuggcugaaagacuaggaaguacugacaggaacagagguuacuaagguagguaugauaauaaagggucuuuuauauucuaugaagaaaucuggauuuuauccaauugugcuggagcauguggaaagauuuuaauaguguaucaacaaaaucagauuucuauucuaggaacuuuuaaggaagagaaaaagacugaagauugggagaccaguuagggaacuauaaaaacaacaaagguaagaauuaauaagggguggaguuaagaaaguagagugggcaagggcaacauaucuuggauguuuaggaagcaguucucaaaguauaguccauggauccugggggucaucaagacccuuuuuaagguguccauuggugaggucaaaacuauuuucauaauaauaucaaaguguuauuuaaauguuauuugaccucuuucacugaguggauauuggcacugauagugcaaaagcaaugguggauaaaacugcugaaaccuuagcaugaaucaaaggaguagcacuaaccuauacuucacaucacaguaaaaaaguuucacuugagaauauccacauugaaaaaaauaaaaaauuauugauuuuauuaaaucuuaacucuuauauuucuuuuuaauauuaucugacaaacugggaaguuugcauaaagcauaucugcuacaaacugaaguaucauggcugucaugaggaaaagcuuguguaguuauuugaacugcaugaacuacaaguggaaccagucauuguuuucaugacaccacucuuuuuucucuuuuacguuaggaaacgacuacgugugguuaugugaacuugacuauugauaugguuugauucuguguccccacccaaaucucaucuuguagcuuucauaauccucugguguugugggaggguccuggugggaaaugauugaaucacgggggcgggucuuucccaugcaguucuugugauagugaaugaaucucacaagaucugauggucuuaaaaaugggaguuuuucugcacaagcucucuuucuuugccugccaccauccauguaagacaugacuugcuccuccuugccuucugccaugauugugaggcccccccaccccagaaacguggaacuguuaaguccaaugaaccucuuucuucuguaaauugcccagucucaaguaugucuuuaucagcaguaugaaaacugacuaaaagaguaaauugguaccaguagaaugggguguuguugaaaagauacccgaaaauguguaagcaacuuuggaacuggguaauaggcagagagguuggaacaguuuggaggacucagaagacaggaaaaugugggaaaguuuggaacuuccuggagacuuggaggacucaggagacaggacgaugugggaaaguuuaaaacuuccuagagacuugcugaauggcuuugaccaaaaugcugacacuguuauagacaauaaaguccaggcugagguagucucagauggaaaugaggaacuugugaacuggagcaagggugacucuuguuauguuuuagcaaagagacugguggcauuuugccccgacccuagagauuuguggaacuuugaacuugggagagaugauuuagggaauuuggcagaagaaaucuaagcagcaaaccauucaggaugugacuugggugcugcuaaaggcauucaguuuuauaaugggaacagagcauaaaagguuggagaauuugcagccugacaaugcaauagaaaugaaaaucccauuuucugaggagaaauucaagccggcaaaaguaccgagcagccaaauguuaauccccaagacaauggggaaaaugucuccagggcaugucagaggucuucacagcagccccucccaucacaggccuggaggccuaaaaggaaagaugguuuuaugggcugggcccaggaccacccugcucugugcagccuagggacuugguacccuguguuucagcugcucuggccauggcuaaaaggggccaagguacagcucaggcuguugcuucagaguguggaagccccaaaucuuggcagcuuccaugugguguugggccuguguguguacagaagucaagaauugagguuugggaaccuccaccuugauuucagaggauguauggaaacgccuggauaaccaggcagaaguugcuguaggggcgggguccucauggagaaccucugcuagggcagccaggaagggaaauauggguuuggagcccccauagagagucccuacuggggcaccaccuacuggagcugugagaagagggccgcuguccuccagaccccagaaugguagaucuacugacagcuugcacugugcaccuggaaaagcugcagacaaugcuggcccaugaaaacagccaggaguggggcuacacccugcaaagccacagggaaagagcugcucaaggcugugggagcccaccucuugugccagcgugacccagaugcaagacauggagucaaaggagaucauuuuggagcuuuaagauuugacugcccugcuggauuucggacuugcacugggccuauagacccuuuguuuuggccaauuucucccauuuggaauggcuguguugacccaaugccuguaucuuccuuguaucuaggaaguaacuaacuuguuuuugauuuuacaggcucauagguggaagggacuugccuugucuugaaugagacacuggacuguguacuucugaguuaaugcugaaaugaguugagacuuuaggggacuguugggagggcaugacugguuuugaaaugugaagagaugagauuugggaggggccaggggcagaaugauaugguuuggcucuguguccccacccaaaucucaucuuguagcuccuguaauucccauguguugugggaugggccuugugggagaugacugaaucauggaggcgagucuuuuccaugcuguucugugauagugaaugggucucaugagaucugaugguuuuaaaaauggcaguuucggggaggggccaagauggccaaauagaaacagcucuggucugagguucccagggagaucaauggagaagguaggugauuucugcauuuccaacugagguauccaucucauugggacugguuagguaguggguacaacccacagagagugagcagaagcaggguggggcacugcuucaccagggaagugcaaggaguugggggaccucccuccuccagccaagggaagccaugagggacugugcuaccuggcccggguacuacgcuuuucccaugguuuuugcaaucugcagauuaggagauucccuccugugccuacaccaccagggcccuggguuucaagcacaaaacuggguggcuguuugggcaggcacugagcuagcuguaggaguuuuucucguaacuacaguggugccuggaaugccagcgagacagaaccauucgcuccccuggaaagggggcugaagccagggagccaaguggucucgcucagcgggucccacucccauggaucccagaaagcuaggaaccacuggcuggaaauucucacugccagcacaggucuggaguugaccugggacgaucgagcuuguuuaggggaggggcaucugccauuacugaggcuuuaguaggugguuuccccugacagugcuauggagacugggagguuuugacugggcaggauucaccacaguguggcaaaguggcuguggccagacugcuucucuacauuccuccucacugggcagggcaucucugaagaaaaugcagcagccccagccaggggcuuacagaugaaacucucaucucccugggacagagacacuggggggagggacggcuguggguguagcuucaguggacuuaaucuuuccuggcugcuggcucugaagagagcagcugauccugacaagggggauucucccagcacagcguaccagcucugcuaagggacaggcugccuccucaagugggucccugaucccgugucuccugccugggagagaccucccaacagggguugacagacaccucauacgggagagcuccggcuggcaucaggccagugccccucugggacgaagcuuccagaggaaggaguaggcagcaaucuuugcuguucugcagccuccacuggugauaaccaggcgaacagggucuggaguagaccuccagcaaacugcagcagaccugcagaagaggggcccgacuguuagaagaaaaacaaacaagcagaaagcaacaacaucaacaaaaagaccccccaauaaaaaccccauccaaaggucaucagccucaaagaccaaagguagacaaaucaugaagaugaggauaaaccagcacaaaaacgcugaaaauuccaaaagccagaaugcuucuucuccaaaugaucacaacuccucuccagcaagggcacaaaacuggauggagacugagacugaugaauuaacaaaagauuucagaagguggguaauaacaaacuccucugagcuaaagcagcauguucuaacccaaugcaaggaagcuaagaaccuugauaaaagguuacaggaacugcuaacuacaauaaccaguuuagcgaggaacauaaauggccugauggaacugaaaaacauagcacgagaaaucagagaagcauacagaaguaucaauagcucaaucgaucaagcggaagaaaggauaccacagauugaagaucaccuugcugaaauaaggugugaagacaagauuagagaaaaaagaaugaaaaggaaugaacaaagccuccaagaaauaugggacuaugugaaaagaccaaaccuacaauugauuaguguaacugaaagugacggggagaauggaaccaaguuggaaaacacacuucagagagacgugaacucucaggagaacuuccucaaccuaguucaggagaaccuccccaaccuuguaagacaggccaacauucccauucaggaaauacacagaccaccacuaagauacuccaugagaagaucaaccccaagacacauaaucgucagauucuccaagguugaaaugaaggaaacaacguuaagggcagccagagagaaaggucaggucaccuacaaagggaagcccaucagacuaacagcagaucucucugcagaaacccuacaagccagaagagagugggggccaauauucaacauucuuaaagaaaggauuuuucaacccagaguuucauauccaggcaaacaaagcuucagaagcaaaggagaaauaaaauccuuuccagacaagcaaaugcagagggauuuugucaccaccagguagcccuuacaagaauuccugaaggaagcacuaaauauggaaaggaaaaacugguaccagccacugcaaaaacacaccaaaauauaaugaccaaugacacuaugaagaaacugcaucaacuaaugugcaaaaaaaccagcuagcaucaugaugacuggaucaaauucacacauaacaauauuuagccuuaaauauaaaugggcuaaaugccccaauuaaaagacauagacuggcaaauuggaugaagagucaagacccauuggugugcuuuauucaggacacccaucucacaugcaaagacauacauaggcucaaaauaaaggguuggaggaguacuuaccaagcaaauggaaaggaaaaaaaaaaagcagggguugaaauacuagucucugauaaaacagacauaaaaccaacaaagaucaaaaaagacaaagaagggcauuacauaacgguaaagggaucaaugccacaagaagagcuaacuauccuaaauauauguggacccaauauaggagcacccagauucauaaaacaaguucuuagagaccuagaaagagacucagacucccaugcaauaauagugggacucuuuaacacccuacugucaauacuagacagaucaaugagauagaaaauuaacaaggauauucaggacuugaacucagcucuggaucaaguggaccucacagacaucuacaaacucuucaccacuaaucaacagaauauacauucuucucagcaccgcauggcacuuauucuaaaaucaaucacauaaauggaaguaaaacacuccucagcaaaugcaaaagaacagaaauccuaacagucucucagaccacagugcaaucaaguaagaacucaggauaagaaacucacccaaaauggcacaacuacauggaaauugaagaaccugcuccugaaugacuccugaguaaguaacaaaaugaaggcagaaauaaagaaguucuuugaaaccaaugagaacaaagagacaauguaccagagauucugcuaaagcaguguguagagggaaauuuauagcacuaaaugcccauaucagaaagcuggaaagauaugaaauugaaacccuaauaucacaauuaaaagaacuaaagaaggaagagcaaacaaauucaaaagcuagcagaagacaagaaacaacuaagaucagagcagaacugaaggagauagagacaggaagaacccuucaaaaaauaaaaauaaacgaauccaggagcugguuuuuuggaaaaaaauaaaauagauagacugcuagcuagacuaaugaagaauaaagagagaagaaucaaauagacacaauaaaaaugauaaaggggauaucaccacugaucccacagaaauaaaaacuaccaucagagaguacuauaaacaccucuaugcaaauaaacuagaaaaucuagaagaaacggauaaauuccuggacacauacacccuccccagacuaaaccaggaagaagucgaaucccugaauagaccaauaacaaguucugaaauugaggcaguaaucaauagccuaccaaccacaaaaggcccaggaccagacugauucacagccaaauuguaccagagguacaaagaggagcugguaccauuccuucugaaaauauuccaaacaauugaaaaagagggacuccucucuaacucauuuuauggggccagcaucauccugauaccaaaagcuggcagagacacaacaaaaaaagaaaauuucaggccaauaucccugaugcacauugaugcaaaaauccuuaauaaaauauuggucaaccgaauccagcagcacaucaaaaagcuuauccaccaugaucaagugagcuucaucccugggaugcaaagcugguucaacauaugcaaaucaauaaaaguaauccaucacauaaacagaaccaaugacaaaaaccacauaaguaacucaauagaugcacaaaaggccuucaauaaaauucaacaucccuucauguuaaaaacucucaauaaacuauugaugaaacauaucucaaaauaauaagagcuauuuaugacagacccauagccaauaucauauugaaugggcaaaagcuggaagcacucccucugaaaaccagcacaagacaaggaugcccucucaccacuccuauucaacaaaguacuggaaguucuggccagggcaacuaggcaagagaaagaaauaaagaguauuuaaauaggaagagaggaagucaaauggucucuguuugcagaugacaugauuguauauuuagaaaagcccauugucucaguccaaaaucuccuuaaccugauaagcaacuucagcaaaaucucaggauacaaaaucaacgugcaaaaaucacaagcauuccuauacaccgaaaauagacaagcagagagccaaaucaugagugaacucccauucauaacugcuacaaagggaauaaaauaccuacgaauaccaccuacaauggacgugaaggaccucuucaaggagaacuacugugaaaauggccacauugcccaaaguaauuuauagauucaaugcuauccccauugaauugacauugacauucuucacagaauuagaaaaaacuacuuuaaauuucaugugaaacaaaaaaugagccuguauagccaagacaguccuaagcaaaaauaacaaagcuggaggcaucacacuaccugacuucaaacuauacuacaaggcuauaguaaccaaaacagcaugguacugguaccaaaaaagauauauagaccaaugcaacagaacagagaccccagaaauaacuccacacaucuacaaccaugugaucuuacacaaaccugacaaauacaagcaauagggaaaugauucccuauuuaauaaacagugcugggaaaacuggcuagccauaugcagaaaacagaaacuggaccccuuccuuauaccuuauaaaaaauuaagauagauuaaagacuuaaauguaaaacccaaaaccauaaaaaccuagaagaaaaccuaggcaauaccauucaggacacagucaugggcaaugauuucaugacuaaaacaccaaaagcaaucacaacaaaagccaaaauugacaaaugggaucuaaucaaacuaaagagcuucuacacaggaaaagaaacuaucaucagagugaacaggcaaccuacagaaugggagaaaauuucugcaaucuauccaucugacaaagggcuauuauccagaaucuacaaggaacauaaacaaauuuacaugagaaagaaaaaucccaucaaaaagugggcaaaggauaugaacagacaauucacaaaagaagacauuuaugcagccaaaaacauaugaaaaaaagcucuucaucacuggucauuagacaaaugcaaaucacaccacgaugagauaccaucucacaccagucagaauagugauuauuaaaaagucaggaaacaaaagaugcuggagaagauguggagaaacaggaaugcuuuuacacuacuggugggaccguaaauuaguucaaccauuguggaagacaguguggcgauuccucaaggaucuagaaccagaaauaccauuugccccagcaaucccauuacuagguauauacccaaaggauuauaaaccauucuacuauaaagacacaugcacauguauguuuauugcagcacuauuuacaacagcaaagaauuggaaccaacccaaaucuccauccugauagacuggauaaagaaaauguggcacauauacaccauggaauacuaugcagccauaaaaaagaaugaguucauguccuuugcagggacaugggugaagcuggaaaccaucauucucagcaaacuaacacaggaacagaaaaucaaacaccacauguucucacucauaagugggaguugaacaaugagaacacauggacacagggagggggaacaacacacaccagggccuguuggggggugggggcaaggggagggagagcauuaggacaaauaccuaaugcauguggggcuuaaaaccuagaugauggguugauaggugcagcaaacuaccacggcacaugcauagcuauguaacaaaccugcacauucugcacguguaucccagaacuuaaaauaaaauaaaauuuaaaaaagacaaaaaacaaaacaaaacaaaacgggaguuucucugcacaagcucugagacgugacuugcuccuccuugccuuccaccaugauugugaggccucgcuagccauguggaacuguaaauccaauaaaccucuuucuuuuguaaauugccccgucuccuauaugucuuuaucagcagcaugaaaauggacuaauacagcuaucaagcagagguuuucugaaaaaugaaugaaggaaggcugugucuuuaaggaaaacaauguauuugcagccaaugauaaaauuugggcuuucgaugaagaauuagaaucuuggaaaacuugacucugacaccacaaaguugacagcuucccaauacuuaggcguuucucauaagauaggugauguuuuaaaaaaugugauuugaaaaaaauuguagaauaaaaugugucaacauuuggaagaucugcauaacuccgugaauauuucccaaaugaccaaaaugcaugaaauuuacauuugaaagauuuuaauacuauaaaagguucauugauaugguuucagauucuaucauuuaacuuuaagacuuaaaccaccacuagucaaguuuugauguaguauuaaugaucugaaaauacuccuuuucaacuauguaucugugugaggcugauuuugcuucauguacuucaacccaaacauuguauuacaauaaauuaaaugcagaagaauauacaagaauuuagcuguccucuauucagucagauaguaaagaaauuucaaaaauaaaaaacaaugcaacuuuuugguaauuuuauuguuuuggaauauaguuauuuucauaaaaguguuauucaugucaaaauacaaugguuuuguacuguuauuuuaaaauaccuuaaaaucuuauuucaauuucgaauaugacaaauauuaacagcuauaacccauauaacagaaguucuuuggaucuuuaauaauuuucaagaauguaaagggguacuguuugaaaacuucaggugaggaggcagaaucugcaagacuugcugacuaacuagacaagagaagaaaggcuggaggaggaacucaggauggcucuuggaugguacuugaaauaggcaauacaggaaaugaagacaguuuagguugaggggaugggagaaggagggguaaaaagauuugguuuaauuugagguggugaguccuacaugaaauuuaugaaaaaucuggaauucagaaaaguggucuagucuagaaauacagaauggcauauuuugugucaguuugagcugggggagaggauuagcauagaaucaccuaauuuugaacaccuacuaugguaugauaaaagaggucuucugacagaaauuuagugaaugucaaugcauuuaaggucugaguagagcugcugcaaacaguuagugaagcugcacugcaccgugccaaggagggccuaucacauagacuacauaugauaugaaugaugccuccuagagcugugcacaauuugcaaaacuaaauguggcaacccuaaagaggaaccgagcuagacagacaaaggacuggucagagaggcaaaguccuuggcauaaaaggucguaucaugcauucaaauucagagaauuucuuuagaagaugguuaucaaaaagaaauacuaaagacaggucaaauaaacuagguuaaaagaaagacaaauaagaacuuuguuaaauccugaauggguggcaagcaacauuaaguauagccuuuuaaauguagguggcugucaaagaaaaaaaagcuuaaggaugguaaauggaggaaguauaugguuuuugguuuuaaagaugaagauguguuuauauucauaggcugagggggaagaugacauuagaaaagaaauaaaaauaauaaacugguguuuaccauauguguggcacuaugcuaggcauuuauauauguaggagagaggagauaauaaaagaaaaagcaaggaccaggaagcauugagauaaauacuacagguagaguagagggacuguccuuaaauaguaaggugaucagagagcuaaggauggauguggucgacagguaaaguacaacaauuuuacaauacuguugcagacauuacuguugagugauaacgcaucauuuaucucuucugauuccgacuucugacucagauuacacaugguccaaucuagcuaacauuuguggaguuaauaucagguuauuuagggguugacuggucagucuguggaugauaaccagagcccuuuagcucucuuucugugacguauguggaaauuaaacuguucacuagcaacucugcucuaguggcuuucuagaaaaaggagaaaaaaaagugcuaagaauaucauacauuaacuagacaucaaaccacuuaccuagaauuaaacuaauuuuggccaguuugggcuagguguaacauaucgugcccucagacagaaaaagguaagacuuccauuuagcugaagugguuucaugaagacagaaaauucagccuuacuccugacaaauggaaguuuguaguaucugaauuucccuaugcccaauauguuucaacuaaaaacaugcaauucaaggcuaaguugagccucuuacuucaauagaaaaacauaacuugcuuuuaguaagucaacuaaacauuuaacacucauggaaaucuaccaccauauuaagcaaccaaaauacagagaaguuaagucugaacguugagacagcaaaacaguuauuuaaagauuuuuauauuuucaaacccaacauuguaaaacaacguaacuucauacaaccuaacaucauaaaacaaaaauuagcuuaguaacuaaaacaagaccaacauuacacucuccauuucuaaucaacauucuaagacaaguucugaaagaaaaagaaaauucuaaaucuccuaaaaaauuaaacacuuuuacuguuguaagauacagauuaguucaguucaacagcauuuacuguaugcuuccuauaugccagguaggguguuagguacuuaaagauacacaaaagagaguuuaaguagauuuauacuauauauaaauuguuuuucauagcucuauuuuuccuuauuuugacugcuuacuuuuacauauaauauuugauaacacaaaauguuccauuuuaaauaaaugaaauuacaauaauuuuuucagccaauuaugaaucuaagcaccaaaacuugcaacccauuuuuaaacuuuauuacagaaauuuugaaacauacauuaacccucauguaccuaauaucagaaacuuagcuuuaaaaauaacauucuagugcucgcuucagcagcacauauaccaaaauuggaacgauacagagaagauuaguauggccacuacaaaaggaugguauucaaaaauuaacauucuaccauucuuacuuuuucuauaaucccuucagcuucccuccgacccccucuuuugcuggaguaguuugaagcaaauucuagacacccauaauuucaccugaaaacacaacaguauguauguaucccuaaaaaauaagggauuuuuuguuuuaaucagcacaaguuuuccugagccuucaugauuauucuauuugaugccaacuguccuucuucauuaccucaggaugcucuuuaagguuuugguauguugucucuacauuuuugguuagauaauuuauauaugcuuauauucccauuuauaggaauaugacuccauaccugcaguucucaguacuccauacugcaguucccuuuaauuguaaccuaagcauuuuuguuuggcuauuucauuaccuccaacuuuaaagucucagaaaacaccauucuacaucuguuucuuaaugagaauaacaacauaaaaaaaggcauaaaaggaaauuuaaggauucaaaaugucuuuuaaaaagauaacagcugggcaugguggcucacacuuguaaucccaacacuuugggaggcugaagugggcagacugcuugagcccaggagaccagccugggcaacauggugaaaccccaucuuuauaaaaacaaaacaaaacaaacaaacaaaagaacaaaaaaacccaaaaauuagccaggugugguggugugccuguagucccagcuacuugggaggcugaggugggaggaucaccugagccugggaauuugaggcuacagugagcugugacugcuccacugcauuccagccuggguaaugagagugagguccugucuuaaaacaacaacaacaacaaauuauagauuuuggaguaucacucuagauuuaugguucacagauugcauuucaaauugaagauugguguuacugaaauguaugaacuggcugaaugacaaggaauaaagaauggcuacagccaacauguauuuuaauaauuuuuaaccaaaugagucuaugcaucauuuccaaauccauuuagcugcuucgcaguuauaaaugcaaacagggauugaauacucucuaaaaauuucuaaagacguuuaagauaguguaaaaaaaauaaaaacagaauauugcagaaucaccuaagugcuuacuaucugucucaaccaaaaaaguaguaugcaaugguuuuauuuauaaaguucuuccucucuccaagcagagcacucaagaagacagugcugugaaaauacuauugugucaugaaauuaaguuuauaguguuucagucaucaauuuggaauucccuuaaucagaacaccacaaauggcagagggacaguguaugaguaagagcuauuagcaugguuuuccauuugauuuuucuuucugccacucauguccuauucuggacgauaguacauuuuucucuggauguuuuccaguccaagaaaaaucaccucuucaaaaucaucaaugacucuuauuuuuuuuccacccaauacuuaagcacauaucuuuugacaauacuuuuugacuaaucaaugaaaaugaauaaauuuaaaucaaauuuucucuuuaggaacccccagguuucuauaaugacuccacuguaaaaucauuuuuuagaaauccaagauuuuacuagcuacacgucugcaauagaacaacuagauuauccacccaaugcuaacauccuuaaaaaaaaagaaaugaaauuuuacagaauuuuuaaaacuaggggggaaaacuuuuucuaagguaucauuagaaaagaucauguuuuuaagaggcuguuuaagaaaucaaacuuaaaaacuagauaagaaaugcaaauccugauaaaacaaguaguguuaaaaaugcagcaugaacauaaaaauaaaaauuucaaauucuuuguugauaucuaguagaaaaauucaguuagaaaacuuuuuuuuuuuuuuucuuuuugagacagagucuugcucugcuacccaaaguggagugcacuggcgcgaucucagcucacugcaaccuucaccuuuagcauucaagugauucuccggccucagccucccgaguagcugggacuacaggcgccgccaccaccccuggcuaauuuuuguauuuuuaguggagacgggguuucaccauguuggccaggcuggucucaaacuccuggccucaagugauccguucaccuuggccucccaaagugcugggaucauaggagugagccacugugcuugaacagaagacuuuugagugaguauuuuuuggguagguucuuagaucucuaauacagacuuugaguuguuuuaggugcugauuaaaagcauauacacauauuuuuuuuguaacuaaaugacuacauguuuuaaauuaaauuuuacccuuaacauuuuuugaauauuuagcauuucuucucaaggagcccaaaaauuuaugcuucagcugaagacacaguuucaaaacuaaucaaaauggggccaauacaauaggacaucagagcacuaaguagguuccucuauuuucagcaguauagaacagacaaaauacuaacaugugguuucacgugugccuacuugugguaauauucuucuauuuucuuguucauaugaaguacuuaaaaugcaaauuccuuggcuaacuauauuuauauuuugcuggucuggggugggaacccuggaugccacuaugugguucaccuaguaaaugucaauaaacaucaccuacaaaauuucugagugucauccuuagaccaacagcauuggugugaccugcaagcuuauuagaaaugagccacacccagacauaauaagaaauucugaggauggggcccaggaaacuguuuuaauaaauucuaccagugauucuucuuucuaucaccauauuacagcuuuaauuaucuuucuuugguguuugacacccuagcuaggaacugguuaugugcuaugcaacauuauggacaaauuccagguuagugauauauaucagaacuagcauuuucaugccaucuugaaggccagggguugucuucuggcaaaugugagaauuuugaggaguauaaacuguucuguaucuuaauaucuugaaguccuuccuaaggacuuaaaauuacguguucugugcuggaguuaaauuugccuaagcuaacaucaugugcuuauaacaugcuuuucuguuuuuuuuuuuuuuuuuccuuuuuggagacagagucucacucuuuugcacaggcuagagugcaguugugugaucacagcucuuugcagccuugaacuccugggcucaugcaaucuucccaccccagcuucuggaguagcugagacuacaggugcaugccaccauaacuggcuaauuuuuguuuuuuuuuuuuuguagagacggggucuuguuauguugcacagagucgucuugaacuccugggcucaagugauacuccuauucuggccucccaaaaugcuaggauuacaggugugagccaccuugcucagccuaaaaugugcuuuucaaugaacacagaggcauucuauuuuuuuuuuuuuuuuugagauggagucucacucuaucacccaggcugggguguaguggugugaucuuggcucacugcaaccucugccuccuggguucaagcaauucuccuugccucagccuccugaauagcugggguuacaggcgccuguuaccaugccuaauuuuuguauuuuuaguagagaugggguuucaccauguugaucaggcugguuuugaaauccugaccucaaaugaucugccugccucggccucccaaagugcuaggauuacaggcaugagccacugugcccagccccauuuguuuuuuuuucaagccaggcuucauccagaaaaaagaaucuguaucauccuugcuucaucuauagaaauauaauauaaauaaauuuagcaagugauauuuccucaaacuuguuuccucuuuccuccuauuaucucuacuccgauuuccuucuacugugcuuuuucuauuuucuuaaauauuuaugaaucucauuguuucuuucucucaacuguauguuuuaaaguuucaucuaguuuuaaagaucucaccauuguuacucccauuucauuuuucuuauuugcucuauuuaccagugauggauauuuagcuaggcuaucuccaaauccccacuacuacaaacuaugcagcuacaaagauuauauccucaaagaucuguuuaaaaauuccucugagugcugggucagagggauuaaacacuucugauuuaauuauugacugguuuacagaaugacaauauuaguuuacacucacaucguaaguacacagauaucuacaccauacccaauacuuggcaucagaaaacuuuuaaauauuugucauuuugaugggugaaaaauuguaucucauuuacuuucauuuuuuucugauuacuagugaguuugucuaucuucucaucuaccuguuagcacuuagcuacccuuuauuuaaauugucuguuaguaucuuuuaccuauuuuuuuaaaagcuauuguucuuuguuucuguuaacuuuuaggaguucuuaauauauuacagguauuauucccuuuagguuuuaaaaguuccaaagcugacaucugacuuuuaacucuguguauaguucuuuuaacagaaaucuuuaauucugauguaaucagaucuacuaaauuugaacauuauguucuaugaucccuaugauguaguuauucuccaaaauuucuacuauucacauuuauuuauuuauuuauuuucagauagagucucacugugucaccgaggcuggagugcaguggcacgaucuuggcucacggaaaccuccgccuccuggguucaagugauucuccugccucagccucccgaguagcugggacuacagguguccaccaccauaccagcuaauuuuuguauuuuuaguagagguaggauuucaccauguuggccaggcuggucuugaacuccugaccacucaaagugcugggauuacaggcauaagccaccaugcccagccuacuauucacuaaauauaagugaauauucacuaaauauaagugaauucauuaaauauaaguguuauauuucuuauuuaggucuuuaauccuucaagaguuagccuuugcauauaaaguugaaaguagggaucuagcuuuuuuuuccaaauagccaguacuccuacuaaaucuaaauaaucaucuucuuuaagcaaccucacuaccuaguugugccacaucauauaccaaguugucaaauauacaugaaucuuucugagauuacuaguuuauaccaaucuauuugccuuucuuuugcuagcauuauguuguuuuuauuaguauaauuuuacaguaacucucauuuaccuuguaggucuaguguuccuuccuuccucuuucugucaaaacugacucagcuaauucuggaccuguauuggucuaugcuaacuuuaaaaugaauuugucaaguuucuaggaaaaaaaaaauuuugaacaggagacacugaugugcuuuaaagaaaacaggcauuacuagguuaagccauauaucacauaacaaucuuuuauuuucuaauaaacuuagauuuuuuuuuucccaugaagguuuuaugcguuuuuaauuaaguuaauuuuuguuagacuauuuucuaaguggguuucucaugauaaauggcagggguuagaaauuuauggcucacaggccaaauccaagcuugccaucuacuuacaaagaaagcuuuauuggaacacaggcauugccaugucuugacaugaugucuaaggcugcuuucauacuacaucagcaguuauaguuaugacagagaccauauggcccacaaagcugaaaacauuuaaaaaagauugcugaucucucgguauagaaaaaacaacugcuuuuuauaaauuaaucuuauauuagacaaccuugcugaauuuucucaguucuaguaguuugcuguuuuggauuuuauacaaaugacuauaucauauacgaauagugaacuuuauuucuucuuucuuaucuucuccucuuacuuaaauugugcucaaaauuucucaaugaaauguaacuuuugcuauagacuugaggugcacaggauguaucaaguuagaauuucccuuuauucuuaguuuucugagaaucuuuucauacauaggugcagaucuuuuucuguauuacaguaaauuauuauuuggcaauuuaugacauauuacugcauaguauuucuuagauuuuauagggaauggauauuuaacuuuucuaugcuuuaguauauggcauccuuauucaacuaguagauccagugaaaaauaggacucuuaauuguacuuuugucaucucuaguacagcaccuguauucaccaauauuuauugcaugaguaugguguguuggguauuacauagggaauucuguuuucuuucacacaaagccaaguacuaaaguuguuggaauaaauaaaaaugauauugugcuauuagggaauaaaagaaaauauaaaauuagucaucuuuugggcaaaaaucagucauuuuaaguagaaaagauuucucaaucuuuagaacucauggguuuuuuuuaauauuaauccacaaacaauuuuguaauuucaaaaauaacuuaaagauauagcaaguacauagcaaucuaaacauuuaggaaacaacagugguucugcuuugaagacuaaaaguaaauguucacaaaaaauauuccuaucuaaaccuucaucaguuaugaaaucuccauaauucaacccacaugcuuuuaauauuaacaucuucuuaaaaguucuacuuuuauacuaaguucuacccuuguacugcauccaacuaaguaggguaagaauaaaaaucaccuccauguaauuaacauauuuaggugccuucucaugauauuuuuaaaugggaaaaaaaaauuucacguaagauaaaaaaggauagaaaaccacuuauaaaagguacauuguaguuuuauuuuauuuauuuauauuuauuuauuuuuuggagaaagucgcauucuguuggccaggcuggaaguacagcagcacgaucucagcucacugcaaccucugccuccuggguucaagugauucucaugcaucagccucccgaguagcugggauuacagggaugcaucaucacuccuggcuaauuuuuguauuuuuaguagagaugggguuucaccauguuggccaggcuggucuuaaacuccugaccucuugaucugccugucuucgccucccaaagugcugggauuacagggaugugccacugcacccggagggcauuguaguuuuaaaucaaauaaaguagcagauuuuuuuauucacuugguuaaaauguacuaaauuguuauuaguuuuuuaaaaauaucauuauuuuaagaauuucaaaauauauguucacaaucccuuaucagaacaugugaaauuccaaagcuccaaaaacuuaaaaauuuuuucacaguucauuugguggcaaccuaaccugaacugauauaaugcuauuuauaguccuuauuuaucccacuuagugugaauauuugcugaaaaaauauuaauguguuugauuauaaagaaguguccuuuugcagaaacagaaacauuacaguaauggagggacauguaccauauuacuucuuagagcuuugagaagucuguauauuuaaacacaacuggccuuguguuuugauaauggaguguagaucuauuaguucuaaaacagauaaaaagauuccuaauucuucuuucauuuacccucaaaaauaccucauauacuccucuaccucuauuuguucuuuuuuauucuaaaacuuuucauuugaauaaauauauuacuuucacaucagauucauuuugauaaagaaauauuuuaagauacuuuuaaaaaccacgaaaaagcuucaagaaauuaaacaaauguuuaaugauuugacuguaucagacaacgcaacuuucucauuuauaccauacauuuauacuaugccuuaagauauuugaauuggaggcuuuuaaaauaguaacauauuaauuaagagcaaauuuagauagcuuguauacuaagaacaaaauacucaaauauaaacaaggcaugaauuucugcaauacacaucuagguucuucuaucauuguggauuugauuaucuagcaucaagggcuucaaaaucauacaauaagccauaagaagugggagcacuuacuuaggaguagaaggaccccuuggccauguuccaucuucauuuuucuguucuaucacuaauaccugcaaauaugacacaauaaaaggguguuuuuccauaacucugaaguuaaaauaacuuuagaagauagcuggauaaacuaagaaacuaaaguaacucugugauuauuuaaaggaaaacaguagacaaggugaacagguaaucugcauuucgauuccaaagcuaggcaggugagacuaaaagaccucaaauaacaagaaaucaguaaugauagugagaaggaauccuagaagauaaacuguaaagaaacuauugguuccauuaaguauaagaaaacuuaaaccaaguaaacagaauauaaauuccuugaauuuagagaauauauuuucuauuuguauuuguagguugaacagagaacucuguaaauaacagauggucaauaaauguuugcaguuguuaaacauacuuacauaggaucuuggguaacuuauuuuuaugcaaaugcagacgaagggcgacacagauaauuccaaauuacagauuauguagaauuuauuugggguuuugaaauuaguguguauuuacauuaucacaauggaaauuauagaaucuuuaaauauacaaaugauagagucccauuuaugagaaucagacugaaguucucuguuacagcauggaugaggcagacagaaaucaccucuaauaaauaaaaaguauaggcuuagggagagcuauacuuuauuuuaaaacacccgaaaaucuuuccuuauaucguccagucuaauaagucuuucuaguuuuugcuauggauuagucugugcaaagaagaaaaacuuagcaaaaauaauuaaauuagcaaaggaaauauacgauaauaccaauaaaaaguuaaaaucuacaauuuccauugaaaaacuguaauacagacaauaugacgugaaauaaauccaaggcauuauaaauuugaauacauuucauuuacuguuucauuaagucuuuuucuuaaaguugcaauuucauaaacuacucuacaugcacuuaguaauauauuuuugugaacuauauguuuccaggucauuuauaaauuggcauuuagagccuagcuauguaaaauguaagcauguuucagaguauauguaacaauaaaauguugauuuuaaaaaaauucaugaaaucuuguuguuaaaagagaugcuaauuaaaauauuaaaguuagcuuuaaaaaaucuauuauuucacacauuaaaaaguguauuuguaccauauaaaaaauaaauguaccauguaccuaauauacugaucccuuccugaucaccuuccucucccuaccuacuagagacaaguaaucacugucucaauuuucugauuuucauucugauauaguuuuauaaauuuaugaagauuuacaaaguagaauuuagagagugauuuuucacuucuccagaauguuuugcuuuacugcaauuuauacaagaguaacaguuacauauuaacuauauguauaaauauacauauaaacuuuacaaucauuugaggacuuaaaucaguuuuaaaacaagagauuuuagcuauagaagauuucaaaguuaugcauuuaauauaauuauuuaaccauaaugccuuaauuccuaacaguauuuauacuuaaaauuccauguuuuaaaaaccacaaauacuaaugcugaagaccaucagaaagauuaaaauucaguccuuuauucaagugcaucauuuucugcauaaaauuuuguuauaguuaaaacuuuaacuccaaauaaaaauauuuuugaaaagauuucaaaauuaaaauuaaacccacacaaaaaggagagaagaaaugcuucacauuuugggaggcaaacucuucaauaauaugucuuuguuuuauuuucuaguaaggauacuuucaaucuaaguauuaaaaaaaaaaagguccaggagaggguuuaugucacuuaucuucucuggcugaagaauuauuauaaagucugaaaaauuuaaugacuauucuuugaaacauuccuguuuuuaaaggucaaguccuuaaggauacuuaaucuuauuaaauuauuuucucaucugccaucugauaaauacauaccuaucaagaacaucaaauuauuuaacuucucugagucucaguuuucuaauguacacgaugaaaagaguaacacucauuucagaggauugcugaaaagguuuaaauaaagaauucuauagauuucaaauuguacuuuuggagcuaccucaaggccuaauggaugaaaaccaaggagagagguuaugucuacuggaagacagaaagagagagcuggcuacauaaaagggcgguguuggcuaaucaguggauuuccaagguccacacuucaagcuucuaucagcuucauuucccuuuuaacuguaauacauauuggauuuuguaagauuucucuuaagaauauaaugacuaaaauaaaucugaaaaccacuguauuuugacagccuaguacaauucuugacauauagugggcauuuacuaaaaauuaauuucccucacuuuaucugaauuuuuccacaacucagaaucauauuauugauguuaacaguaauuuuuaaacaaaacaaaaaaaucuuccauuuaucagagcaccgggcauguuagguucugaaaauaaaaauaggguacaaagucuaaccaaaacaaggaccucauagucuggggagauuaaaauacaaauaacuaaagcauauaaugaacgauacaaaacaaauauacauacaucuuuguggaaguuaaggaagcaauucuuuucuccaaaguagaaacauccuauaccucaauggacauugagagaaauagggaaggcugaauagaugaugugacaguugagcuagaaccugaaggaugaauaaucugauacggcuggccuacaugaugguaugggaugguuaauuuuauuauauggaugguuaaaaggacuuuuugcuggaugaauacagggacuccaaagacguuuacaucaucaggcagauggaauaacacaucagaaagcacaagaauauggaauagcauaguguguucagggaacuauaagcagcucaguuugguacugcuugaguauaaaccacaaaacaaagauaaucuagagaugguggaagaguagguacaagguuaaaccauaacuugcaugcuggcuuaaagugccuggacuuaauuauuaaggaaccaggaaaaguuuaugaaaggaagacagugaaguuuacauuuuagaaugaguauucuugcaaaaacaagacuguccuaugguuaucugcuaauaacaaaaaaacaaaggaagaaagauugaacagacauacaagagccuggagauacaggaauuuguaaagagacuaugaaagauaagggcugagaauggagcacagagauuacuucaagacacaguuagaagauagaaucaguaggacuugcugacagugacuaaaccucuucauuucucaauacuuuauuaaaaaaauaccggccgggcacgguggcgcacaccuguaaucccagcacuuugggaggcugaggcgggcagaucaagaggucaagagaucgagaccauucuggcccauccuggccaacaugaugaaaccccaucucuacuauaaacacaaaaauuagcugggugugguggcacaugucugcagucccagcuacucaagaggcugaggcaggagaaucacuucaacuugggaagcagagguugcagugagccgagauugcaucacugcacuccagccugggcaacagagugagacuccgucucaaacaaacaaacaaaaaagccaaauugggagcugacaccuuucaacaagggcuggcaaacuagaguucacuuagccugcugcacauuuauauaaauagcuuuauuagaacauagccauacucauuuauucauguaucaucuaugcuuguuuuuguguacuacaauggcaauguuuuagaugcuacuuuauggccugcagagaacuguaauuuguaauaaagaacuguguaaauaagagaugcuccauauauguuuacuauuuggucuuucacagaaaguuugcugacccaccuuauaauauuagcugggauuuuuuucuaauuaaaaaugauuucuuuuuaacaaguagauuauucccaagcucaaggagggaaucaaaagucagagucaguaaccagcaaggaaagacaagagaugaguuuagaaagaggaagccagaaacaguacagcccauuauauauugccaggauaauuauuaaaguuugugaauccaaaaaccuucauguauaauacaguaugcuuaaaauaaacaauaccuguccuugguauaaaccagcauccugaauggugcugucugguuuauucagugguucaaauguguuacucauguauuuguuccacaaucuggucuccuuuucaucuggaauacugaagauuuuucuuauuuccuuuucaauuguaucuagauuuaaggaggaaagauauauaaauauaguauguauuucaaaauauaccacauacagcuaaauguuaccagcacaaaaauucuuuaaaauacuaauagaaaaucaagacuaaauauguaauaaaucuauaaaacacaaaccaacaaaaggguuuuuaagaccaaguuuuuauggaaaaaaugguauuuguacuccaacaaauuacuuggggaauuuaaaaucucaaaagguaagaguucaaucaccuaacacuaaaauacaauuuaugcuacacaggauaaacuuuaaauuuuaacauacuauaauucaaauauuuucugaggagauguaggaauuagaaauuaaaguaugauuaagagauguuacagauuuuuuuuagugugcaaaauuuuuuaaguaccacauaagcaauuuaaaaauaauuuauauuaaacugaacagcucacuagaauauauggacacaauaaaaaagaaagugccuuguuugaagggaugucuguauucaccaaaauuuaguauuuucaaaguaaagucacgucuuuuucugauuucuaaaucaauuuacugaaauuucaucuaguucuggucaauaacuugccuaaucaacucaagaaaauaguaaucaaaauauuuuaugauauaugaauacagaauacuuuuagauuuuagaauaguuguaguuuugaaaaaauuuauaaaauauuaaacuuaauaauauacguucuccgaagaaauaugaaaacccacaucuauccuacauaauuuaguccaauaauacuaucuacuuagcagcuaauguuuuguaauagucuuguagucaguaagguuuugauaagggcauuaaaucaguaggaaaaaaaggcacuaauucaaaauaucaacagcguuaucucaaaacuuaaagcaaaucacccagaauauuuaaauaauuacauaaaauaaauauacuguuaguacuuguauuagucuguucucacacugcuauagagaacuaccugagacuggguaacuuaugaagaaaagagguuuaauugacuuacaguuccaugggcuguacaagaagcauggcuaggaggccucaggaaacuuacaaucaugguggaaggcgaaggggaagcaagcacaucuuaucauggaggagcaggagagagugcgaagggggaagugcuacacacaaacaaccguaucucaugagaacucauucacuaucacaagaacagcaagggggaaaucugccucuaugaucuaaacaccucccagcaggcaccuccuccaacacaugggggauuacaauuugacaugagauuugggugggaacacauagccaagccuuaucaguacugcuuucuacuuuggcaggguuguauuuuuuucuuuuuguucuuuuuauuaaagugaacauguauacagaaacaugcacuaaucaucaguaucuugugauaaauuuccaaaguggacacacccauguaaauugcaccaagaucaagaaacaaaacauuaccuagaaagaggauaaaggaagaagccaaggaagggagcuguuuuaaucuuucuauaaaaaugaauaaauguuuccugagggcagaaauaauuuuugcuuuuggcaaaaauaccaaaaauacugacaaauauaaauaaaaugucuaccuagauauaaccacuguugacauucugauauuucuucuagauguuuuuucuauuaauacaggcaucuguguacauaacauguuauaaacaaauguggaaauuuccucuucauugaguuuugugaucuaauuuacauaugggggaacauuacaggcauagggguaguaacgcaaaagccuugaggugcaaaugugcuuggcauguuuuagaauagccugauacaucaauguggcugaaguagaauaagugagguagaaaugagacuauaaagguacuucuguaggauuauauacacuucugugaccuaucaaaguauuuauauuuuaaucugagcaaaagagaaagcuauugaggaguugggaagagaaguggcaugauaugacugacauuuuaaauguucacuuuugcugguagugaagaacacugcagaaggucugauaagguuuggcucuguguccccacccaaaucucaugccaaauuguaauccccaguguuugaggaggcaccuggugggagaugacuggaucaugggggcagauuucccccuugcuguucccaugacagugagugaguucucaugugaucugguuguuugaaaguguguagcacuucccccuuugcucucucucucuugcuaugccacgguaagaugugguugcuuccccuuugccuuccaccaugacuguuaaguuuccugaggccuucuagccaugcuuccuguacggccuauggaacuguaagucaauuaaaccucuuuucuucauaaauuaccuagucuccaguaguucuuuauagcagugcgagaauggacuaauucaaggucaaaggugggaaacuagguuacugcaacaauccuaaccaaagugguagcaauggaagcaguguuaaguggucugacugagaauaaauucugaaggaauugcuaagaagauaugcugcuagauuacaugaagggugagaaauaaaagaaucagaaaugauuuuuggccuaagcaauuggaagagcagaagugggaauuauggagauaaggaagaaugacagagccuaagguuuuuugggaaagggagcuuaguuuuauaucugauagucuucuugagaagccugucagauauacaaaugaagauaugggauaguucaaacuggaauuaugggagacuucagggcaggaccuaucaacuuaaaagauaucaacacauggaaaauauuuaaagccaggagaacaaaagaaaucaccaaggaaaggagggcugggagaauauggagacacugauauuuugagauaaagaauaugaagaagguuuuacaaaggacuccaacaagaugcagccagugagaaacugugcccaggaagccaagugaagagaaagugcuucuagauagaaaaguaguuuaucuguguuguacuuugcuggcaggucaggaaaauggaagauuucuauauuaccacuggauuugucaauggcaaggucaugagagacuaugacaguaguaguaccaacagagugguagguuucgaugucucauguagugggcucaagagaaaaugggagcagagaaagugguggccagaaugcaggaugcuaaaauugagaucuggcaagugcaguuacagauaacaacagccuaggguuuaacuguaauaauugguggcugagcuuggcugaugguugagaucacugaaguugagaauggucaaaggacugacagugugugcuuauuuuuccacauauuaauucaacuguacuagccaguuaaugaaaagcauacagagguagaaaaauaauacagguuacucacaaaaauuagaaauuaaaaaauauuaauacaggucauagaaauuaaaucauauuuuucaagaaguuuuauguuuuugguaguuaaucuuaaaggaaaauaaaacuauuauuuuaucucuuacuuaaacaugcucaaugcucaaauauaucaauuuuggcagaaaacauuugaaggcagaagauuuuggcccugauagguaaaucauuuagauauggccuauggccugcuaucauuuuuacuauauaucaguguagguaguacuagcugaaaacagaauauuuuauuaauuugguaacaagagaaaacagacacuuauauuuccuaaaucuguucauaaaauuuauacagcuguauuucacauacauagcuauuuuaaucauuuucaaucaagauuucuuaaaagaccauaagggaaaaauacauauccaucuuaaguuccuuauguaaauucuguguuucaaaacccacuuccuuuagaaaaacaaaaucagcccaguuaauaucuccaaaacgaauauuccuuuagcauacacagauuguguaaggcagcaauugagagaugagacucuaguuuaagagcucugcuuaugaaguuaaaguacuagcucuaccacuugguaccagggugaauugaaguagauucuaaaucucagcuucauuaucuauaagaggaagauaccugcuuguuuaacuucaaacaagaaaauuccuguaaagugcuuaaaacauaguaaauauucaacaacuguuaaccuguacuauaaccauaaccaugaagugucuaaaauuccugacuugacuaauuuuugcaaaccuuuuugcuuaagaagaagacucauucuaccacagacuuucaaauuuuuuaaacuaagagcuauaguaagaaauugugacccaggaaauaaacauauauguugauauuuuguauucuaauaucucccauucaauuuucuuuacucccaaaacuguuuaaugaaccaccaaaauaucaacaauccaguuugaaaaacaaugauuuaauacaguaaaaaauuauagcuaugcaaaaauuggguucauauauaauguuaaaguacauauccaauuuaucuagcauuuuaaaguauuaguauauauguugauuaaaaucuaugcuagauuguaaacuuuuugaagcagugauccuuuauaaauuacauaucuucgugacaaauucuuacacaguucuuaucaugagaacccauaauucuuguuuugaauucagaaauuaaaucaguugcugauuuuccugaguuucaaaauaccuaguauaauaauguucuaaaauaauaucucugauggucucauauuuaauuuuccuaucaaaaugaggcagggagagaagaaaauaccaaacuuuaaaaauaacuagaaaacauuauuuuaagagguagcuucucauuuauauuccaauuggcuauaaacuucagagacgacucucugaauuaauuuuaacagacuacccuuauuaaauuuauagacucuucucauguacauauucauaugauuaaaauaauuuucauauguugaaaacuuuguuuuuaauauguagaaauaucuuauuuuccugaauauauucuacaaauguggaaauucaaaagucaagcaauuuaucuguaauaauaauuauaauaaaacuuacauaugaaauuccuuaucuuuuaagcauucauuuuagaaagaugacucuaugggcuuuuuuuuuuuuuuuugagauaaagucucacucuguugccaggcuagaguacagagguacgguuucggcccacugcaaccuccaccucccgguucaagcaauuuuuuugccucagccucccaaguagcugggacuacaggcgcacacccacuacacccggcuaauuuuuguacuuuuaguagagaugggguuucaccauguuggccaggcuggucucgaacuccucacuucaggcgauccacccgccugagccucccaaagugcugggauuacaggugugagccacugcguccggccaacuaucagcuuauugaaacuuaaucucgaacuuauaaauguucuagcuaaaugaagaggggagaauaaagauucauaacauaaugcuguauuuuauuuggugcaaacauuaggauuaaccaagcacugaguacuugaauaaugcuacuauuucauaaaaaauacggguuaaaaggauuuuccagcugugaaguggguaaguggugaaagaaagccaaaugcaguuaaugaaauucagaaauacuuucauuuacuuuaaugacugguuccaacaaggaaaucuuaugccacgcuauaauucauaaauuggcuaaucuguuuccaagcuggguucuacaaguuauguguccuucuucacuguucauuuguauuuucuaagaucaaugguauuaccauuaaucuuguuuuacaacuucauuugaaauuaaauacuuuaaaaauucuugaguuuuaugaaacaaaaaccauguaauuuuuauuaaauucauaaucauuuauuuuaaaaaacauuuuauucaaucuauucuuuaccuaaaauuaaaaaugugucuuuuaaauagaaagaaaacaauuuauauauauuuuaauauauagagagaauuaaguccacuuauauuugacuuacaacugcuuacgcuacucauuaauuugaaaaaucaaugugucaaaauaacgcuaagccugcugccuuggcuacuugacuguauuuauaguaccaaagaauaaacuaagagaaaaaaggaaauaaccaauugucauuuuccaugcuaccuuaccaaguuuuaauuaaguuuuuauuuaaaggucuauguuacaaaugacacaccaguugcuaaauaaaaacaauaauuauuugauguuuuauaaaaaagcaaaacagcacaaauguuaaaauucauuuaauaaaugcaaaagcauacaagaaacaauaaauaauuuaacucuaagacauuguaucaaagcuggaaaucaaaugucuauauauaaauccuuaaaaugguuaucauccaaguagcauauacaaagauaauucuaauuaaauaucuaauagcaauggauuaaaaacaagacaggaucuugcauuaccuauugugucagcuuugcuaaaucuucgaguuacaacauuauucauguuuccauuuucacauagcuucaauucugugagauauacuucuacuuugcagugcuuuacaaacauacccuguucaaccaccuaaaauaaugaaacaaaacaaaucagugucaccuauaucaauauauuucacucuaauaacaauacauuuaaagagacuuuagaaaacugcagaucuccagugaaaaaccagucacuauuaaagccugccaauauauauaaaaaaagauauuggauaguuaaaacuucaaaagcaagaaaacuuuuuggaaauuuugauauuuaaaagaaagaaauaaucaugauuuuaaaacauuaagugacaguuuggaaaggcauucuauugaucuaugaagauacacuaguacaccauaaauaauuaauauucaguauuuauaaugagaaagauuacccaaaaugacuaugugcaaauauauauguacguucucuguuuauacauuauaauacaaauaaacagaguucugauugaagauacaaacauacuucuuagcuuuuaguagugaucccaagcagaaaaccuuuaaaaaguuguuuauacaauuugaacuuaauggcuauauuaucacuguuauguuaaaauauaucuauuaaaaugauaacuccaaaucacuguugccaaaauauccagcuauggcuagguaacugauauguuaguuucacccuacagugacuuacuuuguuugaccuuuaacuacacacuuaguaauucuaugcagcaauuaaaagaaagcuguuaagcaugcaagccauaaagcauaaaaaggaaauauguauauauuaaggucaccuuuuaaauaaguauaauuccuuucgaucuucuaaagguuaacuguaggauuucagucaugaauacuguuucugaaaauaguaauaggccugauaugugauccauuagacaaauauggcaaaagggaggcuccaaaugaccguugggauauacucacaagcuuacaucaauucaaaagaggacuuuacaaacuugucuuucacugcauugaaaaaauucaaaugcaguucaucuaguauuuacuaucuaauccaacacacauuuuuaugauacuuugucauauauauuuucuuaaucauacuuguuacaauuuuuuuaaacagguagcagccuguaccucuccuucugcuaauaaauguaauuuguuuuguaaaaccaauauguuaaacuacugagauuuguuuuaaacaucuuaggcugauuuacuucaugguuacaaauguaguaacauuuaauuuuauaagauuacuuguaguuauauuuaaguagagaaacaaggaaucaaauauucuuaucagucaguaauuucuauacuggggcucaauagcugaguaaaauccuaaaauaaacuacauuaaaguagcuacuaaucacugguaguaacuaaaacuaagguaaacugcaggccucauuuuuauggaagaaaaagaaaaauggaaugaccaacacaaagcaggaaaaggaauaaguaugguuaaaaaacaaaacccccauuaugauuuauauugagguauauacuuucuaaauaggcauaguuuucuaaaaaugaaaauacauuuucauaauacuauagauauuuuccuggaaagaaccuggugacuuaacugucagaguuauugugagaucuaugaaaacaaaauaucaagaauauuucaaaguccacacuacugggauucagaauuuuucucaacauuuuuuucuucuuuccuacauuuuacauugcuaaaaucuucaucaucacuacucagaaaacugcuacuauauuuauaagauauuuauuuuacuaauucccaaaguaguguauuaacaagguguuguuuuuaaaaauaugaguuuguugucaaacuauuuuuauaugaaaaggucauacuauauguacuauuaaagcuugaaaauaacagcaccauaaaaagaaaaauaauuagcacauuuacgaaucaauguguaauggucacauguagauuauuugcuuauauaaucuccuucauauuuguuuacauaaaaucuccuuccuaccuuaauuaaaaauguaugcauugaaaaugauggucaugaagacuaacaggaagaaacaagcuuauaaaaaaaguauaguuuuauuuaccuaauuauuauaacuauuaaaauauguauuugaaauaagaucggaagggggauauucagaagugauaguuauguuucaguauuauagaugauaguuauaauguuuacucuaagugaauuauaacacuguuauauuaccauaaauaaaaagugaguacaugaugaaaucuggcuccuuguccaaaauggaagacuuauggauauguaaacauauuuucauuaauuuauaaccauaaugaaggcaaagucucuuuacuaaguauuugagcuacauauaaguuuacagaggauuaaaauaaauaauuucuauuuguucauuuuuugcugugaauauuuaggguauuuuuuacaaggccauuaaacauauuaaauaaaccuaauauagucuacccuuuaugucuguguaugaaaaguuucauggaaacuuuaccuucauuccaaguaugcucccucccugaaaugggaagagaaauauaaguaauuucuaaaaaaaucuaguacuauauaaacaauuucauaauaccaggccucuaacagacugacuuacucuuuuguagagcuagcuucauucauuuuaaaagcauuuauugaguaccuacauuuggugcagauaaauuagaccuagauccuggagccugagugagaacagauaacggugaagacagagaaguagauaaauacaacaaaacuaugaaaucauaguucuuaauguguaagaaacaaauccuauguaugugauuuuccauccacaaauacuucagaauauucagaaacaaagacucaaacauaaccacaauaccaucaucacaccuaaaaaauuaaaacuaaucaauuaauaucaaauauccagucaaaagucaaauuuuuccuucugucucauuuuuaauguauuguuugaaucaggauccaaauaagguccauauauugccaauagacuaauucgucucuuaagugucuuuuaaccuagaaguucuccaucuuuccuauucuuguaauuuuuacuuuagaccacugcauagauggugacauacacucacucugaacaggaugcaaacaucuaguugcuccuuuuuuugugaugcugguagacauuaaagccaaugccuagaucuagugaugggcaaacuuaugaacuaaguuuggcuaaacuuagguuuagauggcuaaaucuacccaucaaucuauuuuuguauauagugcuuuaccggaacacaacaacccccauucauuuauguuuacggcuacuuucauacccaauuauuaauuaucuagggcugcuuuuaugccuaaaucagcaaaguuuagucauuucaaaagaaacuaaagggcgcauaaagcuaaaaauauuuacuaucuggcccuuuacagaaaaacauuagugaccuacuccuucuccuacaucuucagcuucuagaccuucaggcuagauccauuaauucauuaagucuucuuuaauuuuacccaguaauguuucacaauuuucaguauagaaaaacacaguucuuacuagguuuauuccuaaguauuuugaccuguaaauguuauuuuaaaauucaacuuuauuaagagacaaccuguugaaguguagaaaauauuuauaagcuauucauccaacagaggauuaauauccagaauauacaaggacucaacaacucaacagguaaaaaucaaucccauuuaaaaguaggcaaaggacaugaauagacauuucucaaaagacaaaugaauggccaacagguauauaaaaauguucaacaucacuaaucaucagagaaaugcaaaucaaaaccacaaugagauaucaccuuaaccaagccauaaugguuauuauuaaaaagacaaaagacaacagauguuagcgaagaugcggagaaaagggaacacuuauacacuguugaugggaauguaaacuaguacagccacuacagaaaacaguguggagauucucaaaaaucuaaaaacagaauuaccauugaauccagcaauccuacuaccgcauaucuacccaaaggaaaagaagucaguauaugaaagggauaccugcacucacauguuuauuguagcacuaucuacaauagcaagauauggaaccaaccuaggugcucaucaauggaugaauggauaaauauuguauauauauauaaacaauggaguacuauuccgccauuacaaagaaugaaaucaugucuuuugagcaacauggaugaagccggaggucguuauauuaagugaaauaagccagggacaaaacgacaaauaucaucuguucuuacuuuuacguggaagcuaaaaaauuugaucacaugaaguaaagaguggaaagauagauaacagacacugggaaggauaaggaagggagcagggaaggaugaagggaacuggcuuaaaaguacaaacauacaguaaaauggaauaaauucaauguuugguagcagagcagggugacuauacuuaacaaaaauguauugaauuugggugaaggacacccaaaauacccugacuucauuacuacuuauuauauauauguaacagauuuucucauguacaccacuaauuuguacaaauaaaaauaaacuuuauuuguugccaauaaaaaacugguuucccuauacugcccuuauaucaggcaaccuguuaaauuuaccuauuaauucuaauuguuuaccaguacauauuuuuggaauuuuaaaccuguagaaucgugccuucuaaaaacacugacagucuuguaucuucuuuuacaagauucacucuuuuaguucuuuuuacuauauuaccauacuggcuaagauuucuaacacaguuauucuugacuugggaagaacuuuuaauauuuuaccaauaaguacaauauuuacaggcgauuucuaguccuaguuuucuaggaguuuuuuuuuuuaagaucauacauggauguugagcaucaaauguucuuuguaucucuauugagauuauuuuucuccuuuagucugcuaaaauuaugaaugcuuuucaaaguuaaaauuguauucuuugaaaaauauccaccuuggucauuuuuguccuuuuuacauaaugcuggauuugucuugcuaacauuguguuuaggacuuaagcaucuauguucaugagugagaccagccuguaauuuuucuuucuuguaauguccuucagguuuuaugucauguuuaugcuagccuuauaaaauaaguuggggaguacugcuucuauucucagaaagaaucugugugguauugguuuauggcuucccuaaauauuugguagaauacacugguaaagcuuucuuggccugaagcuuucuuugugggaagguuuucaaugacucaauuucuuuaaucacauaggugaauucgaguuuccuauuucuuacuguauugacauuuuaaaguucuguuugucuagaaauuauccacuucaucuaaauuuucaaauuuacauaaaacuguucaaaacauaaucuuuucaaaaaagucuuuagacucugcuaugauguuuccuuuuucauucgcaauauagguuauuugugccuacucucuuuuuauucuuaaacaauccugccaggacucaucuuuacuuuacuggucuaauuucacugcucucuacaaugacugaauuuuguucauuuaauguagguuuguuuucuauuuuguuaaugucuacauuauaauguuucuucuuaaguucaauuuccuuaacuuguugagacaauagauuuucacuuucuuuuccaauauuugcacugaagcuauaaaauuccuucugagaauuucagccaaucuuuuaaguuguauuuuaauuauuauucaguuuaaaauaugucuaauuuucauucuucucuuugccucaaggauuacuuaaaaguauauuuuuccauuucuagauaguugggggauaaucagguuaucucuuuguuacugauuuuagcuuaaucccacuaaugacagaaaauacagugaacaauuucuaucauuugaaguuuacuggaauuuugauaacccagaauauggucaauuuugcuuaaaaauuccacuuaauagaaauguguauucugcaaugacuaaguacaauguacaugucaauuagguuauggugguuaaucauguuguucaaaucuuaauuacaagcucacucauguagcuguuggcagccucuguuccucauuaugugagucucucuauaggguaaguuaagggcaaaguuauggcuucgcccagagugagugauccgaggggaggggaugagggagguaugugcacucccaauagaaguacaggcauccauuaaggacuaaucucagaagugacauaccaccacuucugccacaugcuacugacugcauagaccaacugucguacaaugugggaaaggauuacaccagacuaaggauucuaagaggucacaaucacuggggagcaucuuugaggcuggcuaccacagucuacccccuggcccccaaugauucacaguuccuucccccaaaauacaaaauacacucaguucuuccaaaggccccaacuagucucaauucauuuuagcaaccuggaguucagaaauuugucaucuauaauugacaaauuauaaauuuucuauaagccuuugaagacauauauuccgagaccccuaguggaugccugaaacuacaaauagcacacuaaucccuauauucacuauguuuuuuccuuuacaaacauacauaccuaugacgaaguuuaauuuauuaauuacgcacacuaagagauuaacaauagcuaauaauaaaauagaacaauuagaacaauauacuauaauaaagguuauguguauguggucucucaagguagcuuaucauauuguacucacccuuuuucuuguaaugauaugagaugauuaaaugucuaccugaugagaagaggugaagugaaugauguacauuguaacgcugcauuaugcuacuaaugcccuucaacaaagcacugugacaguagauugauaaccaagauggcuacuaagugacaaacgggaagguaguguauaguguccauggggaggacauggagugggauggcaucauguuacucagaauggugcacaauuuaaaacucacgaauuguuuauuuccagaauuucccacuuaauauuuuuggaccaugguugcuugcagguaacugaaaucgcggaaagcaaaaccauagauaagggggacuacuguagugccucuugauguauaggccugugaacuaagagacaaguuuucugccccccauacacccaaaauaaaacaaugaagcacacagaacauagccuuuuaaauauuccuguuuuguaagaggggaaauaggacguacaaaggaaucaaugguccauaacgauuaugaaaucuaccuggacaaauacuagaaauuccuugacuggaacucaguucuacccuugccugaaaauuauucuaucuaacauuugguucuguucucugagucauccuuuuuucaugcauuagcacaugcuugaaguuaaguaaauuuucagccugauuccuacuuauuggaguuugggaggucaaaggcgucuuucauuuaauacugcuucugcaguccaaaauggcagugguucugcgagguaauucgaaaacaauguaggucuccacuggaucuuacuggaguucauuccauuagacaaaagccauauccacaaauguucuguaggauaaguccucucuacuuuggcuuuaugcugagaaagcuaagggguugcccguaagcuucuugaagcccuccuguucuuagaagccacauauugagaagacacccuuaauauuaauuaauauuacuacugacaggacaaccucuaaguuaacccuuaaauacuuuauagggccuuuugucugaauaguacugugaggcaugaccuuugauuuuucugagguaacuuacagucacacccuuggcugccagauuagaucacacuuuuuuucugagaauacucugaguuuuaucuuugcucagaaacacugcuuaguauuagcaccguuugccaucuggagggacuaggaaucuucaaaacuaguaaauauuggcucuguuuuauugaacaauccuuucuuuaguguauuucucuucucucacaucugacuauaaccaacacaaaaagaaacuaggcaguacuuuuaacacuuuggcagaccuauaauuucauuaaauacuaucuuuaaccuuucaguuuacugcaggcaacauguugcuaaacuuacucuaccacuguauaacaaagaccacuuucuaccaguuuccaguaagacuuuccucacuucaaguucucacuggcagcuaucucaaagucuaguaaucuacuaacgguuuguuuaaggcccuuuaagcuuucauugauacucuuaaaguucugacaaccucuauucacugucagcuccaaagccacgccacauuucaaguuuucauaucagcaccuauuuacagguaccaugauuaguauuaguuaucuauugcugcauaauaaauuaccccaaaauuuaccagcuuaacacagcaaacauuaucucacaauguuucugagggucaagaaucugggagcagcuuaacuggguugauuugguguagaguuucucaugagguugcucucaagguauggcugggguuucaaucaucugaaagcuaaacuagaacuaaaggauccacuuccaaggucacucacaugguuguugcaggccuccguuccucucuauuggccagagaucucaguuccucaccaugugggccucuccauaggcugccugaguguccucgccauaugcaguugaauuccccgagugagaaaugagaaagagagacagcuagagugcgugugcacccaagauguaagccgcgguguuuuuuuauaaccuaaucucgaaagcgauguaccaugaguacugcuauaugcuauuggccacacagaccaaccucaguacaacauggaagaagagugcccaagaauauggauaugaggagcuggggaucaccagggaacauaguagagaauauuaucuuaacuuacaugcuaacacuauuguguaguuaauucuauacacauuuucaacuccauaaaaauuauuauuaauguuuucaacaguccaucuuaagacuuacucacaacauuuacauuuugucagucuacacuguuuuccugcaucuccaagcuuucaucuggaauaauuuuccuuccauucuuaagauuauuuuguagugccuuuaauacacgucugcagguaacaaauucuauuaguuuucauuugaaaauggcuuuuuucaccuucaucccugaaggauuauuuucuuagucacagaauccuacauuggcaguuauuuucuuuuaacauaucaaaguccauuguuuucuggcuuccaugguuucucuugagaaaucauuauuuugucuuauccuuauuuugaagauaacaugucuuuuucucuggcuauuauuagaaauuuuuuugccuuugcuuuucaacauuuguacuagguacaguuuuguuuguauuauuucaguuugggauucauagcauuucuuuaaagcaugacaccuuucucaguuugggaaaauucucagcuauuacguccuuugguauuaguucuacccacucuuucuuuccucuccaagauuccaacuauauguaugcauguuaaacuuacuuacugcauuccauuuaugccuuagcuuuuuucuguauuuucuauucuuuugucucucuaagcuuuagacucuauauuuucuauugacaaaucauuuaguuuacaaauuuucucuucaguucuguuuggucuaauaauuuuauucccaaacauuaaauccauaaaauuuccauauuauuaguuuuagaauucuauuugcuucuucuuuaauaguuuugcccuacuucucaucugccuuuuuuuuuuuuuuuaagcauaauaagcccacuauucuaaaaucuacuaacucaauuaccuggguuucuuaugggucuguuucuauugucugcuguuucucuuggauuuugauuccaucguauuuucugcuuauauccuugcuuucuuuucguccauucuuugaguguugacacuauaaaugacgcauuuuagagaucuuugagguacaggaagauguuuaacuugguuucugcauuauagcuaggggaaccaccaauccuagauucuuuaaugcaaucagagauggguaacauugaaaguugggcuucagacacuauaagcuggucuauuuacuucuuugaguuccaccugcaucagucaugugggccacagugaaaaugcaaaugaaauucccaaauuuaagugugauuaauuaaauuuuacugcagauuuaauguuguaggaaauugcaucuguaauaagaacuccacgcaauguaauauagcacaugaacauuugcaaacuauuuuacagguugaauauauuucauucaucuuguuaaaaauaaguauguggucucccaagagauuugucaauguuuuuucuucuacuugugugaaauuuuugauuauauuuuacuuuguuauuagacacagguuucaagaacucucaaugaggacuauuucaaagaguaauggcaaugaaauugguaguugaucuguuuaucauacugaagaccgcuaguguauaaugugcuacauuuauaagaaaaaaaaguguaucauuaagauuaaaggaauacaguguaauaccuuuagagauauuuuggacacaaauuuuccuuuauccuaggaaugaaauaauucuagacaguuuuacagcuaaauaggcuaccuuugaucaaaacacucaauucuccagcaacuauagauaaagcaacuagaucauuucacagaucuauaaggcuagcauuccuacaacagagaaauucuaauuuugaaguggcugagugaaacuaaggaauaaaacuaaacaaaaauaaauaaaagguacauucaagaucuauucagaaaauaagauccaagguuagcuucuaauauaccuaaaaccauggauacacaaauacaaauuguuaacauggcaacuuuguagcaucaauuccaaauaaauucaaauauaguuaggucuacuagagguuuuuuuacccuuauguuaccuaauccaacuuuuuaauuguuucuauguggcgggggauggggggagggucgggggacccaaaccagauacaaaauuaugccaagagauuuuggucccuucucagccucccaccccuccuacaauaaaugaucaaauacauguguaagguucacucauuuaccuugaauauuugguauucuacuacagcaacacccuuacuuauugcuuuuuaguucccuaaaaaaacgaaauugguuauucuuaauguuucuagacuacaauuuuaaaauguuaaaggauaugaaaaaaaaucuacauuuucaaguuuaaaaaauuuuuauguuccaaaaaacauugcuucaacuuuuaguuucuucauuguuuucuaauuguuuuaucaaaaacagugcagcacagaaaacagggucagguugccaaagucuguauccugauaugacuuucuaaaauaacuagauccuaacuuuuuauccucauuuccuacuacuuaccuuacagaguuuucucucuauauauagaggauuaaucaauaauacauacuuacaauaguggcuagcauaaguaaaccuucuuaacauguuacuugccauuauuguaacacaguguacgguuauuuugcuggcuuuuucucuaagauaagugaugaaacuucacaauucauugaauuaauaauaaaaugugaacuaaucaagaaaaauaauauuuauagucaguuauuauuaaaauguaccuuucgugcuauuggcucuugaccuuccaucaauguguaccagcugacaaguuuauuccaaccuucaguuggcaacaguauguaauccaauucaucaauaagguguuccuuaagugacugggcaucaccaucugcaaaagaaaaaauaaacucaauaccuaacucuaaauacuuuguuuggacacauuacaaauuaaacucaugaaggcuaauuuaaguauuuaaaacaaguuuuaagcucuaaagcaauucagcucccuuacaucagggguguccaauuuuuggguuucucugggccguauuggaagaauuguaacacuaacaauaguugaugagcuuaaaaaaaucauaaaaaaaaacucauaauguuuuaagaaaguuuacaaauuuguguuuggcuguauucaaagccauccugggccgcaugcagcccaugggcugcagguuggacaagccugccauacauauuucaaaauaaacuauugcuuuaaaacuuucaguuuguaccauaaaucaaaaagcaauauuuaaaaacauaauucuuuuauuagguucuuuaaaaaauacuauggaguaacuguuagucaagagacuugacaaaagaguguuucccacauauuuugaguagcagagaucccucauaugguaacaauauucauucuagcaucagcuuuuguaggaaauucagaagcaaaucaacaaccuuuuacaaugacaccaagacacacgggcuaggaaccaugacagaaaucacaaaugggcaucuugugaaccauuucauuauuccagaaggcccacaaucuggauuucucccaagaacuaaaauggagguaauucuucagaugugauucuaauucacaguccacuuucaaauuucuagcuagacuaaaaaaauuuaguauaagacaggccacagaucuagaagaaauuucuggaaccauaccuacaucacaguccuaaucugagacuuguuaucuguccaugugaauuuuuaaaaugcagaaagaggaacagaaauaucucacugaguuauauccaacuuaauggagauuuuucuuguccuaaguuagucuuaauuaacagauacggaaagcaaaauuguucuugguagcauuucaauaaugagaacacaguauucccaauaagauauaaacaauaaaaaucaagaagcgagaaaaaaccugagggauuaagagaauguuacuuauucuguguuuugcaacuauagucuacuuugcauuuucuagacuuguacaugaaaacaguacuugcuuucuguuacuauagacgaauuugcaauuucuagagucuuacauaaaaauaguauguccucuuuuuuguuuggcuuuguucaugccauguaauuauuuugagaucuauccauguuuuuacauaucaauacuuaauuucuuuuaauugcugagugggauuucauuguauggauaugcuacauuuuguuucuccauucagguguugaugggcauuugaguuguucacaacuuuuucuauuacaaauaacacuguaugaccauuuguguacaaucggucauauggauaaaaugcuuucauuuauucuggguaaauaccuaggaguggaaugacugggcucuacaauaaacguaugucuaacuuguuaagaaacugccagacuauuuucugaagugcuuuuaugauaugacaucgauagaaacaguguaugagaguucuacuuccucuacaaucuugccaacacuugguauggaucaguuuucucauugugguuuuaaucuucauuucucuaauaugaauuauguugagcauuuuugcacgugcuuuuugaaaccuauaucuucuuuggugaauuauguguucaaaucuuuugccuacuuuuuccauugggcuuuacguuuucuucaaaaugaguuuuauaaacuguauauucuacaaacaagucuuuuaucugcuacaugauuguaaauaucuucucccacacuguggcuucucuuuucuuucucuuaacagugucauuuaaagaagcuuuuguuacugaugagacacaacuacauuuuuucuuuuagcaaccuugcuuuugaaucauauccaagaaaacuuuggcuaauacaacaucgcaaagacuuuuuccuaaaaguuuuaguuuuuacauucaggucuauaauccauuuuggauuaauacuguauacagugccauguaugcaucaaaauucaguuuuuugcaaacagauauccaaauacucaaggcgcauuuguuuaaaagacuauccuuuugccagugaauuccucuuuuaccuuuuucuaaagcugaaugacuauauauguguagaucuauuucuggauucucuaaucuggucaacugauguauuugucuuuauaucaauaucaacuauauuuauuauuacagcuuuaaaauaaggauugaaaucaaauaguguuaacuucuaugauuuuauuuuaaaauucaaaguuguuucagccauucugucauuugaauuuccacaugaauuuuuggaucagcuuauccuuuucuauuaaaaagcuuacuggacaacuuaauauccacaugcaaaaggaugaaguuagaacacuacugcacaccauauacaaaacuaacuuaaaguagaccaaugcuguaaauguaacagccaaaacuauaaaacucguaaaagaaaauguaaguauaaaucuuacauaaaucuuugcaaccuugguuucagcaaugcucucugacaccaaaagcacaagcaacaaagaaaaaaaaggcaaauuggacuuaaaauuaaaaaacuuuugugcuucaaaggucaccaucaagaauauaaaaagcccacagaauaagaaaaaauuuuugcaaaucauacaucugauaagggucuagcauccuaaauaaauaacaaacugaaaauacaacaauaaaaagacaaacaauucuauuaaaaauaggcacaggaucugaauguauuucacuaaaaaagauauauaacaagcacacaaaaaaagaacuuaucaucaaucacuagggaaaugcacgucaaaaaucacaaugagauaccacuucacacccacuuggacggcuauaauaaaaaggacagacaagaacaaguguugguaauaaugugaagcaaugaauccucauacacugccagcaaugauguaaaaggaugcaaugacuuuggaaaaacagucuaagaguuccuaaaauaguuaaacaacgaaguuuaaaaagacccaacaauuucaugucuagguaucuacccauuagaaaggaaaacacauuaucuacccaaaaacuuuuacaugaauguucauagcaacaauauccagaagagccaaaacgugaaaacaacucaaauguccaucaacugaugagugcauaaaguaaaugugcaccauucaguagaaaucauucaucuauaaaaagaaaucaaguacugauucaugcaacaacauggauaaaacaugaaaacauugugcuguccuaaauaaaagaagacaaacauaaaagaauucauauugggccaggcacaguggcuaacaccuguaaucccaguacuuugggggacugaggcggauggaucaccugaggucaggaguucagagaccagccuggccaacguggugaaaccccaucucaacaaaaaugcaaagaucagccaggugugguggcacgcaucuguaaucccagcuacuuggcaggcugagguaggauaaucgcucgaaccugggaugcggagguugcagugagcugagauucuagccugggcaacagagugagacuccaucucaaaaaauaaaauaaacaaaaaaacacacauauuguaugauuccauuuauaugagauguccagaauaagcaaauacauacagacaaaggagauuaguaguugucuagagugggggguggcagcaaagaagggauagggugugauucuuaauggguacaaggaauguuuuacaaaauucaauuaggucaaguugauuaacaguguuguucaacucuuugggcuucgugaauguagauguccaauuucccuucccaguuucaggaaguuucagccauuauuucacucauucuuuuuuuuuuuuuuuuuuuuuuugcaagacagggucuuacucugucacccaugcuggagugcagugguacaaucucggcuccauacaaccucugucuccugggcugaagcaaucaucucaccucagccucccaaguacugggacuacagguguaugccaccacccacauauuauguuauuuuauuuuuuugagauggagucuugcucugucgccaggcuagagugcaguagcaugaucucagcuugcugaaccgcugccuuccagguucaagcgauucuccugccucagccuccugaguagaugggacuacaagugcgcgccaccacacccagcuaauuuuuuguauuuuuaauagagacgggguuucaccauguuggccagaauggucucgaucucuugaccuugugauccuccugccucggccucccaaagugcugggauuacaggugugagccaucgcgacuggcuggauuauuuuuuuuguauuuauucuagagacaagguuucaccauguugcccaagcugaucucgaacuccuguguucaugugauccguccacuuuggccucccacagugcugggauuacaggugugagccacuacaccuggccucagccaguaugucuuuaaauaugcuuucugccccucucacuuuccuccuucuggaacuuccauacacacaaauugguucauuugauggugucccagaagucacuuggacuuccuuuaugcuuuuuuauuauuuuuaauccucugauuagauaauuucaaaugauccgucuacaaguuugccaauucaucuacuuguccaagucugcuguugaagaccucuagugaauuuuucaguuaucguauuccaaaauuuguuugguucuucauaauuuuuagcuccuuguugauauuuuaauuuugugaauuuuuauuuuucuuguuuuguuaaguugucuauguuuucguguaacucagugagcuuuauaagacaauuauuuugaauucucugucaggcaauucaucucuauuucuuuagggucaguuucuggagauuuuguuuuuuugugucacguuucccugauugaguucuuguagcuuugcacagguguuugugcaacugaagaaacagccaccucucucccagucuuuaucaacuggcuuugaaaggcaaauagcuucacuuccacccaaaagccuggcuagagauucugagaacaucucaaacuuuuuuuguggauaugucuuuucuguacuugugcaugcagauuccuaauuagaaggauuuguugauuuccuuuuuuuucagaaacccauaaucucuuccuccuucugguaucuuacaucauacugcagaccagaacauuagaggaacaucccacuugucucccucuuccuugaguucucugccuucucaaaucuuguagagcugugcugagugcagcaagccacuugccccucuuccuuuguuccuaucugcccccaccaaacacuggguaagguaagacagaagucaguccuucaagcaguacccugaaagacuggaacacuggggguacacuccacuccuuuuccucuuccuuggaagacaagucucagguucuaugccuucucccaauauuacaggguuguggcagcugcagcaagccaccuaucccuuuucuuuuguuguuaacuucccccaguuauuugaacuaugucagcucucugguacaauaaggcaugacagaaacuggccccucaagcagcacacugaaaggcaugggcagugcaggaugcccccacuccucuccuuccuuccugggagagaagccucagguucuuagccuucucucaaucucucagagccuuccagcugcagcaaccaccuacccucuuuccuuuguuaacugcccccaggcaucagaacuaugcugguuccuucagcacucuauguaaggugaucaaaauuuuuuuuuagaaaacuggccuguuggguaguacacugaagggcuggaaaauuaagcacgugaucucccucuuuucccccaagggagagguccugaucugagacaaucucucuugagacuaagcuaagacuccuuggaggaggggcugaugugggcaaaauaaaauuguucuuacucauuucaauguuguuguucucaguuuugggcucaucuggaguacuacaaauucuuaacuggaucuuggguuucucauaaagagucugguccauuguuacuucaguguuucuguuggguguugggggcugggacuuucuauucuaucauccugcugacaucacucuucuucacauauuuucaaguuaugccauuagguagguauguauuuaggauuacuauauucucuugaugaacuaucccaucccauuagucauuaucaagugaccuuuucuaucccugauuauguucuuuauucugaaacuuaaugucuccggcuuuuuaaaaaacaguguuagcauguguuauuaguuuuccacuguuacauaaugaauuaccauaguggcuuaaacaucaccgauuuauuaguucacaguucugugggucaguaguuaaggagggcccaaauggauuugugcuuagggcuuuacaaggcugaagucaagauaucaccccugcugggcucuuaucugaaggucugagggagaaucugcuuccaagcccauucaguuguuggcagaauucaguuacucaugguugugaguuugagguucccguuuccuugcuggcugucaaccugaggccacucucuguuccuagaggcugccugccuugcaucucacaugauuccuuccaacuucaaaccagcaaugacauauugacccucuuucaugcaucucugaauucuuuugccaccagacagagaaaacucucuguuuuuaaaggguaugugugauuagauuacguucaccaggauagucucuuuuugccacauaacauaaucacaagagugauaucuucauccuauuuacagguuucaccuacacucaaaggggagaguauuauacaagagugaggaucacuggggguuagucuugcuuaccacagccugguguuaucuuguuccauaucuuaaucuaucuguguucuugcauuuaaagugaguuucuuguaggcaguuauagcugguucuuaacuuuuuaaucuagucucacccucacuaccuuuaguugagguguuuacauuuaaugugauuauucauagagcuggguuucaaucuagcaacuuuuaauuuuguauuugucucaucuguucuuuauuaauuuuuuccaugucuugugggggagauuuguuuuuaagauugacauugcuugucauuauugaucauauuuuccugcuucuucacaugccagguaauauuuggucagauccaagccauuauaaauuuuacauuuuuguaugcuggauauuuuuguauucuuauaaauacucaaguuuuauucugaaaugcaguuaaguuucuucgaaauaguuugaugcuuucagguuagcagagcaggaaaauuaauuucacccuauuacauaaguaaaacuguucucagaagucuacucuaaauuaugugguuuuccacucuggcugcugagaacacaaacgauucccaauccuauauuagccucgaugauuguuccuucuuuucagugguaccuugucugaccuugggcaguuuucuuauaugcaaagugcgguuuaauaguugaagacuuaagagcaacccuaugggggggggucuaggucucucucucucugagcuacucacuacuuucugguauuuuccuggacucuuguagccuugguuuuccuagacugcaaacucuguuuccucaacuaagggagauagcaagggucugcauggguuucaucuucccauguugugucuuggaaaucucuuuuaaugcaguaaacugaaggcaguuggagggcuuaccuauuuuguuucgcaucucucaaggaucacuguuuuccguugccugauacacaguguuuugagaaccacuguuagaaauggaaguucugguacuuauguuuuguucccuuuacccauaauaagagguauauagaaggacuggcaaguagugaggguuguagaaagcuaaugcaaaaauuuaagaacuuaagcauauaugauuauuccucaaauuuuaaaaaaugucauguguccacuaggaaaaacaauaugugacauagcauuucucaaaauaaucaguguuuaauuauuuaauaacaaauaaugagucuuauuauuuaguaauaaauaaucauuaaauaaugauuacuuaauaaugaaaucuuuaaaugaagaaaucaguucuucauuuaaggguuuaaacaacaauaaaaccuuauuacaucauaaaugaaaaacaaaacuugucauacagaauaauaacuaauaaaauuuuuaauaacuuauuagaauaaugaguucauuagguaaaaucuguaaugcaaaacuuuaucaacuuauuugcgcuaacauuuuccaaauucaacccacugacauuuauauaaugaaauuuaacacauuuacaacuugacugaaggaagaaaauaaugaccuuugagaaguccagaguuaucaauggguccaggauacacauuuugaucucccaucugguauuugucccaacugucaaagccaacauauuuuuuccacuguuugaaccagcgacuaucgacuagguaccuaaaaaauaaaagaaauugguuaaggaaaauaccugaaaauacaggaacaguagaacagccaucuauuuuuugauauuuccuuuuauauuaaaagacauaucuacuucaaaggauauuugaaaacuguaaugccccuuaguauuagaaagacaagacuucauuuguauaaaguauuauuccuauuguucuauaaauauauacuacuuaaugacaaauacugacauaaaaauacaaauauacguauucaagaaaaugcuucucauugaauaaaaauggaaauaaccguaagaauuugucaaaauaaauuuaaaaaugcaauaugguaaauagaaaaaaugguucuuuuacaagaagcuugcaaauaauuuuauguacuuuauuguguguuucggagguaaaggaaaccaguuaucaaggguugcaagguuaauuauaauaaucauaaucagagagagagguucaagauggcugacuaaagacaucaaguuccaguucucuucagaaaaaagaaccaaaauuacagccgggcgcaguggcuuacgccuguaaucccagcgcuuuggaaggcugagguggguggaucaguugaggucaggaguucaagaccagccuggccaacaucgugaaaccccgucucuacuaaaaauacaaaaauugggaggcauagugguaggugccuguaaccccagcuacucaagaggcugaggcaggagaauugcuugaaccugggaggcagagguugcagugagccgggaucgcaccacugcaguccagccugggcgacagagagagacucggucucaaaaaagaaccaaaauuacaaacacauaaucacagcucuaacagaauaucagagagagaauacuaguacacaaaaaucacaggaaaaaauuuaggcauagaaaaagaaggaagugagaggccaaaaaagaguggcugggagccccaagggacuugguguugcacggaaaggguaagcgagaguguuugggauccuucauuccuguggcagagugcuaguaugcgaucuaugggagagcuccucugcucucacaaaccuagacugugguauggguagggauuucuugaggguguuacaccagacugcaagcucacgcuggguugcucaccuucccaccauccuagacucgagcaucuguggcaaggcaucauuaucagagcauauccaucaggggacuuuaucuugcccagggaaccucagcccuugugcuuccacauccugggagcucuugcugacauuccccagcacccacucagcaggcagcaguggcacagugcuaguuagacccggggugcugcaggguucccaauaaucuaucccacaaggagugcuacuuuuaagagaaggaaaagugcagugcaccaaaaggacagccucugggacaaaggaaaccaaagcaugcauuuuccagcgccccccaagagcucucugcuuggggcugcaagugaaugccugcuccuggcagagacacagagacacaaacucugcucagcacugcaagugaggaguaagguccuguaccacuggccaaguggccucugugcuugagcccagacauagagaagggaacuucuccucccccuccacccacugcugcagacacaguaauugcugcucccaugggaagcuggcacaagaaaccagagggcaggcuaucugaagcugugaggggcaacugcaguuccacuggcaguggccucugggcccagguucaugagaaagguggguccugucccacucucugccuagaguuucagggguccugccauggggagggagcagagucugcauggcacccauuuccagauagcacagaaguguacugucaagccauggggcaagcaucuccuguaguucuaggcuacauugcagcuuggagauaaacagcagugucuaagagaacugaacaaccugagcaccagaauaggagugugagagggaaacaucacauuccugccugcugaggccagggugcuaagacagcucaucaccuggcccacacccccccaucccaccccucuccacaagagaccucagugcauuuuaccaguggcccaaugacuccccucuccccugccacccuugucagggcuggugccucugccagucaucagaauaucugagcuuucccuggcaaacaaaggucaagcguaaaccccacuguuaccacugaagcugacucauaccugcaaaugcuacuuauuggccuggagaugaacugcacaacccaaucugguaacauaaaugcacacaauuugggaacaagauacacuucuugagaccucugcuacccugacuuacaggaggcugugagccugcucacaagccaaguauaccacuaucacaccugauguuugagaaagccaccaaaggcuaucuaaaaccaggaaauucauauagagucuuugccacuaaaagcacccagaagcaaagccaaaugaccauauucaacauacauuacagucacauccucaagggaaaacagucucguucaaacaaaaauuaauucaaacugagaaauguguuuuuccagaugagaaagaaccaguguaauaauucuggaaguuugaaaaaacaggguguuacgauacccucaaaggaucacacuaacucucuagcaauaaauccuaaccaacauuacugaaaugcuaaauaauucacaauauugauuuuuaaggaagcucaaugagauucauggaaaaugugaaaaaccaacacaaagaaacagaauaucaauuaaggauauaaaugaaaucuuuugaaaauaaaaaauucacugaaggauuuacaaaauacagaugaaagcuucaacaauaaacuagaucaaggagaauaaacaaucucagaacauaaagacaggucuuuugaagaaagaaaaaagaauguuaaagaugaacaaagccuuugagaaguaggagacuacaauaaaaugucuggaucuaggaauuguagguauucucgagaaagaaaagaaaagaaagcaaaaaguuuggaaaaccaacuucucuuguccagcaagugaucuagacauccagaguaagaggcucaaugaaacccagaaaaauacauugcaagaagggccucaccaugacauagagucaucagacuguguggucucagcaagagaaaagcauuuggacaccuacaaaggaaacuccaucagacuaacagcagacuuccuggcagaugacuuacaagucagaagagacugggauucuauuuucaaaauaggcuuaaagaaaaaaaaaacugucaaccugaaaauuuguauccugcuagaaaaagcuucaggaauaaaggagauauaaagucuuuccuagaaaaacaaucauugagggaaucugucaucacuagacuggcucuacaaaaaugaucaagggaagucuaaacauggaaaugaagggucaauacuugccaucauaaaaauguaagaaaguaaaaaauccacaggucuuguaaaauaauuacaccaacgaaacuacaaagcaaugugauaacaauuaacauuacuacaggaauaaaaccucacauaucaauauuuaccuuaaacauaaaugaguuaaaugcucuacuuaaaagauaaagauuggcaggacgaauuuagaaaacaagauccaacuauaugcugcuuacaauaaacucaccuuagugguaaagaaacuuacagacugaagaaaggggugcaaaaagauacuccaugcaaacggaaaccaaaaacaaguaggaguagcuauacuuagaucagauaaagcugacuuuaaaucaaaaacaguaaaaaaauacacaaaguuauuauaaagggaucaauucaauagaaagacauaacaauccuaaauauauauguacccaacaccagaagacccaaacccagauucauaaaacuaauauuacuagaccuaagaaaagauauaaacagcaauacaauaauagugggggacuuccauauuccacugacagcacuagacagaucaucaggacacaaaaccaacaaagaaacaccagaauuaaauuggacucuaaacuaaauguauuuggcagacauuugcagaacauucuagccccaaauagcagaauauacauucuuuuucaucaugcaugaaacauucuccaaaauaggccauaugguaugccacaaaacaagucuuaaagaauuuuuuuuuaaauugaaaucauaucaaguaucuucuuaaaccacagugaaauaaagcuagaaaucaaucccaagggggaauucuugaagcuauacaaauacauggaaauucagcaacauguuccugaacgaucuuugggucaacaacaaaauuaagaugaaaauuuuaaaaaauguuuaaaugaaugaaaaaggagauacaacauaccaaaccucugggauacagcaaaagcagugcuaagaggaaaguuuauacugcugucuaaacacacacacacacacacacacacacacacacacacacacaaauuaacaaccuaaugucacacccaaugaaacagaaaaacaagaacuaaauccaaauuugacagaagaaaagacauaaagaucagaggaaaaguaagugacacugagaccaaaaacacaauacaaaaagaucaaugaaaugaaaaguuaguucuuugaaaagagaaacaaaacggacagacugcuagcuagacuaaccaagaagagagaagauucgaauaaacacaaucggaaauaaaaaagaagauauuauaacggauacugcagaaauacaaaaggucaucagagacuacuaugagcaucacuacaugcacaaacuagaaaaccuagaggaaguggguaaacuccuggaaacauacaaccucccaagauuguacugaaccagaaagaacuggaagcccugaacagaccaauaaugaguacuaagauuaaaucaguaagaugaaaaucucccaacaacaacaacaacaacaacaacaacaagcucaggagaggacagauucagagcugaauacuaccagacauacaaagaacuuguaccaaucccacugaaacuguuccaaaauaguagagggaaucuucccuuucuaauucuacaaggccagugucacccggauaccaaagccaaacaaggacucaucaaauaaagaaaacuacagaucaauaucuccugaugaauauagaugcaaaauuccucaagaaaauauuagcaaauugaauacaacagcauucgaaaagauaauacaccaugaucaaguggguuuuacuccaggcacgcaaaggaaguucaacauaugcaaaucaauaaaugcaauucaccaccuaaacaaaauuaaaaacaaaaaccauauaauaaucucaauagacgcaaaaacagcaucugguaaaauucaacaucucaugauaaaaaccugcaacaaacuaggcacagaaggaacauaucucaaaauaauaaaagucacaaacaacgaaacuacaaccaauaucauacgaauggagaaaaguugaaagaauuccugcuaaaaaugggaacaagacaaaaaugcccacuuacacacuccgauucaguauaguacuaaaagucacagccagaaaagaggcaacagaaauaagucauccaaguuggaaaagaggaagccaaguuaucucuguuugcugacaauaucaucuuauaccuagauaacucuaaagauuccacgaagacuucuuugagaaacgaacucaguaaaguuucagcauacaaaaucaacuuacaaaaaccagaagcaauuuuauacacuaguaacaaucgagcugagaaccaaaucaaagucaguuucauuuaccaaagcuaccaaaaaaaaaaaaaaaaaaaguaaaaugccagggaacacaucuaaucaaggaggugaaagaccucuauaaggaaaacuacaaaacacugaugaaagaaacuguagaugacacaaauaaguggaacaacaucccaugcugauggaucagaagaaucgauaauguuaaaauaacucauacuuccccgcccaaagcaaucuacagauucaauguaauuucuaucaaaauaccaacaucauguuucacugaauuagaaaaaacaauucuaaaacucauaugaaauaaaaaaaagaaucucaauagauuaagcaauacuaagcaaaaagaacaaagcuggaggcaucacauuacccaacuucaaauuaaacugcaagguuauaguaaccaaagcagcaugguacugguacaaaaauagacacacagaucaauggaacagaauagagagcccagaaauaaagccacauaccuuugccaacugaucuucaacgaagcugacaaaaacauucgcugggaaaggagacccuauucaauaaaugguacagggaaaacuggauugccacaugcagaagaaugaaacugggccccuacuucucacuauauaaaauauuuaacucaagguggaaaaacaacaacaacaaaaauuaacgcaagguguauucaagaucuugaaacuuuuauaaaaguccuaaaaaaaaccuaggaaaaacucucuguucacuggccuacacaaagaauuuaugacuaacaucucaaaaacaaauccaacaaaaaacaaaaauagacaaaagugacuuaguuuaacugaaaaacuucuguacagcaaaggaaauaauugagagaacagacaaccuaacaaugggagaaaacaucuguaaucuaugccuccaacaaaggacuaauauucagaauuuacaaggaacucaaacuacucaaugacaacaauggcaaccaaaaaaacucauuuaaaugugggcaaagaacacagauuuuuaaaauuuauuuuuauaucauaaauucguuuuaaaaaauuuuaaauuuuauuuuaaauauuagauucaggggguacauaugcagguuuguuacauggguauauugcgugaugcugagguuucggcuucuaaugauccuguugcccaguagcaaauacgguaccugagagguuuuuuuccaaccgcuacuccccucucucccucuucucuuuuggaauccccagugucuauuguucucaauuuuguguucguguauacccaauguuuagcuccuacuuauaagugagaacacacaguauuuggucuucuguaucuguguuaauuugcuuagaauaauggccuccagcugcauccauguugcuguaaaggauacaauuucauucuuuuugauagcugcacaguauugcaugguauauauguaucacuuuuuuuuuuuuuuugagacagaguuucgcucuuguugcccaggcuggagugcaauggugcgaucucagcucaccgcaacuuccaccucccggguucaagcgauuccccugccucagccuuccgaguagccgggauuacaggcaugcgccaccucgccuggcuaauuuuguauuuuuaauagagacgggguuuuaccauguuggucaggcuggucucgaacuccugaccucaggugacccgcccaccucagccucccaaagugcugggauuacaggcaugagccaccacgcccggccauguaucacauuuucuuuauccaauccaucaaugaugggcaccuggguugauuccaugucuuuacuauugugaacaguacugugauaaacauaugaguguaagugucuuuuugguagaaugauuuauuuucuaguaaugggacugcugagcgaaugguauuucuauuuuuaguucuuugagaaaucuccaaacugcuuucuuuccacaggggcugaacuaauuugcauucucaccaauaacauauuaaacauucccuuuucucugcaaucuugcuaaaaucuguuaacuuuuuaauaauagccauuucaacuggugugagaugguaucuuacugugguuuugauuuguauuucucugauuauuagugauuuugugcauuuuuucauacauuugcuggcugucuguauguguucuuuggagaauucucuucauguucuuuguccacuuuuuaaugggcguuuuuuuucuuauuaaguuccuuauagaguccagauauuagucuuuuguuguaugcauaguuugaaaauauuuucucccauuuuguagauugucuguuuacucuaaacagaaaaauuucaaacuaacacauaugaauggucaacauaugaaaaaaaauuccacaucacuaauuaucagauaaauacaaguaaaaccacagugaaaaagcauccauaccagucagaauggcuauuauuagaagcucaaaagauaacagauguuggcaaggaugcagaagaaaaggaauggugggaauggagggaauggaaauuaguacaaccuuuauggaaaacaguauggagauuucucaaaaaacuaaaaauagaacuaucacuggaucuaguaauuccacuacuagguauauacccaaaggaaaugaaaucauucuaucaaaaagacaccugcacuuguauguuuaucacagcacuauucacaauagugaagauauggaaacaaccuaaguguccaucaguggaugauuggauaaaggcaauguagcauauauggauacacacacacacaccauggaauacuacucagccauaaaaaagaauaaaaccauguuuuuugcagcaccauggauggaaguggaggccauuaucuuaggaaacacuuuaaguguccauaaauggaugacuggauaaagacaauguggcacacucauguacacacacacauacacaaacacaaagacacaaacaccauggaauacuacuuagccauaaaaaagaaggaagccauguuuuuugcagcaacauggauggaacuggaggccauuaucuuaggggaaauaauucagaaauacaaaaucaaauacugcauguuaucacuuauaagugggagcuaaaucauguauacacauagagcgugaauaacagacauuggagacucagaagggugggaggcaggagagggaugauaaauuauuaaaugaguacaauauacacuauucagcugauggcuacauuagaagcccuuacuucaccauuaugcaguucauccauguaacaaaacugcauuuguagucccuaaaucuauaaaaauauuaauagaaaguauaaucaacucuuaaaaccuuaauuaagcuucuuuaccaacagaaguuaauaacaacaauacuaucucugacuguuccuccuauaguaguaaaauauggggcaagcaggauugguuuuugaaugauuucaaaagugugauacagcuaacacuguaaacauuacugaaacuauauccaucuuauuuucagcugccuagaaacuagcuucucaucagaugaccaaugacagaaaaaguaaaacaagaguucacuaggauagaaagcauuaaaaaaaaaccuaaaacauuguaaaaauuuauucugacuacaguaugccugcuauaaaauacugcuuugucauugguucacaaugauuuuaaauuuuucuagaaacauuucucccacauuuaaccagguucaaucacaagcagaaucaaagguaaagauaaagguuaaugagagauuuaaagcucauguguguaauacuacagguaacaaagcuuuuuagaagauuauccauucuaguguuucuuuucuaugcuuaccauauauagcacuauaagaacaaaaacccacaguuacguccgaaaauagcuaaagcaaaggcacuaaccuaacaaaaccucagauuucuuaaagaauauucaugaguuuaacucccuaaaaguggauaugcagaauuaucuauguaccaguauucugaacucacugucaagauuaugcaauugaaagcccccacacauuguggaauuuaagauuugugagaaaagaauugagggacuaagucuuaagaaaauccuauuuucuaaaauaaauauugacuagacuagcaaugacuuuacuuauacucagacauucgacuugcuuucuucgcaaaguuccacaaaaaagucuaauaagauuuugauuggaaguacauuacacuuacaaaguugagggacacugccaucuuuaccaaagugagucuucuuauccacagccacggcguaucucuccauuauucagguuaaugucuuucaauaaauuuuauauguuuuuccaauaaaaaucauguuuugcuaaauucguuccuagaaaccucaguuuuucuaugugaauuuuacauuuuuuccccaauuaauuaaauucuauaacugcuuguaguugaugcauagaaauaauauuuguuguuuguuuuuuggagauagggucucgcucugcugcccaggcuggagugugguggcacgaucuuggcuuacugcaaccuccacuucccagguucaagcaauucucgugccucagccuccagaguagcugggauuauggcuugugccaccaugcccagcuaauuuuucuauuuuuaguaaagaccggguuuugccaucuuagccaggcuggucucaaacuccuggccucaagugauccgccugccucggccucucaaagugcuaggauaacaagcaugaaccacugugcucagccuaauuuuuuuaagugauuaaucugauauccaccagcauccugaacucuuaguaguuuuaccugguuguagguucccuuagauuuuucuauguaaaaacucauacuguugcugcaaauaauguguuuaaucauuccuuucuaauuguauuccuauuguucuugucuauugccuauuuuucuuggcuagggcuccuaaaauauaggugaagagacagcaaacauuuuugucuuuuuuuuuaugacaacauuuaaaguuucaccacuagguagauuuuugauaaaugcugcuuauuagcuugcuguagguuuuugauaaauacugcuuaugaacuuagagaaguuccuuucuauucaacauuuguuuagacuaucaugacuaaguguuaaaggugaugaaaauuuucugcacuugccaagcuuuuucuccuguacucuucugaacaaaccuggaauagcuuuuacucuucuacuaucuacaaaaguaguuuguaacggguuaucugccccuuaaugauuuacuuguaugaaaaacuacuggggaguauaguaucauuugggaggguagacucugaucuucaguuaauuuuucuuaguuacugauuuuucccuuuaaaauggaaaugcaaaauuucccguuaguuuucuuaaaaagcuaaugccauauccauuaaaaauagaauauggacuugagauaacauuaauacuacaguuacaaauaucauuuauaaaacacauuaaaaacaauuuguggaaaaguauagaaauucuauuuauaguuacuuagacauuuuuaagauauagaguuuuaucucccaaaguacuuaauaaauccuuuacaguuauacaguagccuccuuuuaucugcaguuucacuuucugcggguuaacugucaacugugguacucucacuacucuugcauuuugggucauuauuaaauaaaauaagggauacuugaacauaaggauugugauacugcaacagucaaccugauaaccaagagggcuugaaggcaguuuggguggaauggcacaguauuucaucaugcuaugcagcacacauguaauuuaaaaccuauaaauuauuucugaaaucuuccauuuacaucacaaugccuaugucauuuaccucaugucaucucaucaccuaugcauuuuaucaucucacacuauuacaaaaaggguaaguacaguacaguaagguauuuugagaaaccacauccacauaacuuuuacagaauauugucauaacuguccuauuuuauuauuaauuguugcuguuaaucuuccuguggcuaauuuauaaguuaaacuuauuuauuuauuuuuuuuuggagacagggucuugcucugucacccaggcuggagugcaguggggcaugaucacagcucacuguagucucaaccucccuggcucaagugaucuucccaccucagucuccugaguagcugggacuacaggcaugugccacaaacucagcuaauuuuguuuauuuuuuguagagaugagauaucacuacguugcccaggaugguuucaagcuccugggcucaaggugcccucccacuuuggccuccgaaagugcugggauuacagacaugagccagugugccuggccuauaaauuaaacuuuauuauauguaagcauaggaaaaagcaguguauauaagguuugcuacuauuugcagguucaggcauccacugagggucuuggaacuuauacucugcagauaaaaagggacugcgguacuaaaaguauauacuugguaaaccuucuauaaugucauacauuucuaugucaacugucuauugucauauauuucuguaucaacuaucuuuccuagaucuuguagugacuucuuucuguacaaugauacuauuaugauaggagacuuucccauuugaugauauuuaauugcuuucaauacuaucuucaauugaaaaagggcaccauauuucucuuagggcuaucuacacaauuuuaugguaaugaaacaucaggaaaguagaaaaauaggagaaucuggccaggugcuguggcucacgccuguaaucccagcacugugggaggccaagauggcuggaucacuugaggccaggaguucaagaccagccuggcccacauguugaaaccccgucuccacuaaaaauacaaaaauuagucaagugugguggcgcauacuuuuguaaccccagcuacucaggaggcugaggcacaagaauugcuugaacccaggagguggagguugcacugagcugagagcaugccacugcacuccagccugggcaauagagcaagauucugucucaaaaagcaaacagaaaaagaaaaauaggagaaucuacuccagaaacaauguauaguguuguuagguauauauuagaaagaugagauuagaagacguagacaagaaagaagacuaagaaagguaagauuagaugacacagacaaauaaaugaaaagauuuuauuucaauacauuuauauagaucuguugcacuguaaaaacuauacuucuacaucuaugaaaucugccaaaauucccaauguucaaucugaacugauaaaauacuagaacggaaucaacagauuacaaagacuacaaacaaugaacaaagaccugaauucauauauucucaaugguauucuuaauccuuauauacuauuaggguccagauaagcccaauuuucacuuugaguuucuuuuauggacuuaaagucauuaggauaucaaccaauacaaauaguuauaacuauguaggaugaagucuaaaaugcuuaacauugucuaaaaggucuugcaugaucuaaucccuagcuaccucuuuagacucagcugguaccauuuuucuuugugcccagauccagcugcaagagccuucuuucauuuccuugacacaccauuuucugccucauaaccccuucuaccuagaaaauucccuuauucuuuucaacauguagagcuauggucugaaugcgugugucuccucccccagaauuaauguuaaaauccuaacccccaaggauagggaauuaggaggugauuagaucauaagggcagaguccucacgaauggaauuuaugccuuuauaaaagaggcucccagagagacaccucaucccuuccacuauagcuagaagguuccaucuaugaaccagaaaguaugcuguguccuccucaccagacacagaaccugccaguaccuagucaucuuggacuuaccagccuccagaacagugacaaauaaauuugcuguuuuuaagccacuuacagguacuuuguuauagcagccugaaggggcuaagacacauaguuaacaacuauaaucuuucacauaucugccuaaaugucacugcuucagggaaucccuccauaacccucuccccacuuccccagaaagucuggaagaaaaacaaaguggaaaucucaguuuccucauuacuaagccucuuuauuaagcuuaauuuauuauuaauuauuaacauauuaagguuaauuauuaccuuuauuaaguuuaauaacaaaaucacuaauauuugaguuuuacucuugagccaugugcauacuucuaagcacauucauauauuuucauuuacccaaugaaguagguacuauuaucuuaauuucagauggaguauauauacacacagaaauuaacuugcccaagguuacaaagugucaaagcugugauuaagaaaaugugauauuggcauagagagaaguaaaaagaccaaugaaaacaguggaaagaaauaagagccagacucacauauauaugaagacauaugucaaaagcaucauuacaaacuaauaggcaaagauggacuauucuauaaaagguacuggcacaacagaucaugcauaaaggaaaaaaucaauuacagcucuaucuuauuauacaugcagucgguucuuuucuaaugcuuguuuuugaaaauuucaagguguuacaacacuuaauuaggcaaaucaaaaccacaaugagauaucaccucacacguguuaggauggcuauuauugaaaaaaacaaaagguaacuguuggugaggauguggagaaauuggaacucuuguagacuauauaauauggugcacuggcuauggaaaaugguaugaagguuccucaaaaaauuaaaaauagaaugaccauaugauccagcaauccuacuuuuggguacauauccaaaaggauuaaaaucagaguccugaagauauauguacuaucauguuuacugcagcauuauucacaauagccaagaugcggaaacaaccuuaaugucuuuugauggaugaaagaauaaagaaaaauggaguacuauuuagccugaaaaaagaaaauccugccauaugcagcaacauggaugaaccugaaggucacuaugcuaaaugaaguaaaugagucacagaaagacaaauccugcaugauuccacuuaugagguaucuaaaacaucauagucauagaaacagaguaaaauggugacugccaggggcuggggaaaggaagaaauaaggaggugaugauauucaguggguauaaaguuucaguuaugcaaaaugaguaagucuauuguacaauauugugccuauaguuaacaauauuauauuguacagaaaaaaauuaagagggcagcgcucauguuaaguauucuuacuacaaugaaaaaaguugauauagacaguucaacuuacggugugacuuaagauuuuuggacuuuauaauggugugaaacugauaagcauucagcagaaaccauauuucuaauauccauacgaugauucuguuuuucauuuucaguacaguagucaaugcuuuauuauaaaacagauuuucuguuagcugguuuugcccaacuguagauuaauuuaaguguucuaagcauguuuaagguaggcuagucuaaccuauauuguaugguacguuaggcauauuaaauggauuuuuuacuuacaauauuuucaauuucuaaugaguuuagcaggcuguaacuccaucauuaaguugaggaccaucuguauacagucaugcacugcauaaugacuuucuugccaaugacaaacuacauauaugaugguggucccauacaccauaauguaccuaaaaaagcccuuuugcuuaaugauguagccauugugauguuguagcauaacucauuacucacauguuuacggugaugcugguguaaacagaccuacugugcugccaaucuuacaacaguauagcacauauaauuauguacagcauauaauacuugacaauaauaaacaacuguuaugaguuuauguauuuacuauacuuuguuacuauaaucguuauuuuagagugugcuccuucuacuuauauauaaaaaaaaguuagcuguagaacagccucaggcagguccuucaggaaguauuccagaugaaggcacugauaucacaggagaugacagcuccaugaauauuacugcccaugaagaccuuccaaugggacaagauauggaggcagaagacagugauacugaucacccugacugugcaggccuagguuaauguguguuugucucuuaguuuacggcaaaaaaacuuuuuaauuagaaaaaauuuagaaauagaaaaaagcuuauagaauaaggauaugaagaaaauauuuuuguacagcuguauaauguauugguguuuuaaaccaaguguuauaacaaacgagucaaaaacauuuaaaacauuuuuaagguuuauaacguaaaaauguuacaguaagcuaaaguuaauuuuauuauugaagaaaauauuuuuaaauuaacuuaguguagccuaaguguaugguguuuauaaagauuacagcaguguacauuaaugcacuaggccaagcuuguccaaccugaggcccacagguggcccaggacaccuuugaaugcagcccaauacaaauucguaaacuuucuuaaaacauuaugagauuuuuuugugauuuuuuuuuucgcuuaucaucuauuuuuagcguuaguguauuuuacaugugguccaagacaauaauucuucuucugauuuggcccagggaagccaaaagaugggacaacccugcccuaggccuucacauucacucucuacuaacucacugacucacccagagcaacguccagcccugcaaacuccauucaugguaaguguucuaaauaaguguaccauuuaaaaaaaucuuuuauaugccauuuuuacuguucuuuuucuauauuuagaaacacaaauacuuaacauuauauuaaaacugccuacacuauucaguaugguaacaugcuguacagguuugcaugcuucccuaauaccauccccuuccuucucuugcugaagcacugucagugacauguuuuaaagaagauaauaaaaacaguagcacagcuuuacauguguugaaugguuaggaaauauauaaauaccauaauaaacaugacauuuuaucuuaaaaaagauugucugcuuguggaaguggaauucagaagaguugcagcuugugaguuauuaucaaguggugcaaggaggguuauccaaaaucugccagaaaguuuuaacagcaagaguaaacgucuuuuguuuaacacagaaguuauguauagauacaucuucacauauaugcacacagaaugaaguacagucaaauagacuaagaauaauauugaggcuagcaaaagugauaguguucagugacagucaacaauggaaauuuuaugcauaaaaauaagaaaacuaauuacaaacacauuuaaaaauugggacaaaauauacacagcaaaaugcauaaaaggcacaguuuuuauucauuacuuuuuauuucugaaaaaauucauaacuuuauaugaucuuuuguauuuauuuuuuauaguuguacuuuuucuaaacaggugaauuugcauuagauuuuaauuaaaaauuuacguaagucuugaagaauuuucuucaagacuuggaaaagcacaauucauuugcaaucauuucuaaauuuaucaaaaugugauucugauauacgguaguguauucauuccugagaaaauacuuccuuuugguaacuagagcaaccagugaauaagccagaaaaauaaugaguguuaucucauauaugauuuuauaugagugauaucucauauaaaaggaaaagcacauaaaggacagauuauuacccuuuauaucuuggaagauaauauaagcaaaacaaacaauuccaaaacugacauauuuacugauuugaagcugaucaaauuuugguaccaaauauuauacuaacuacagaccugcaaccaucuaaaauucaucuaaauacuaauguacaaaccaucuugagcagcccagaguaguaauuaaauuguuuugugaugaacaggcuaaauuucuuauacaaaggagucaaugcuuuauaaaugaaaccaaaggugaaguauuucugaauacuaagacauuugacuguguuccuguaaagaaguuaugaaguaaauguaccaauguauaaucuaaaagaucuauggcuuaaucacuauaaucuuccuguuucagaggauuacaaggaauuuuaugagggugccucauaccuggucauuacacacgauucuuacauacaucaaucugaaauuauuuuuaucauaauguuaauauuaucuggguucauaguuacuaaagaaaaugauauagagacugaagaccuaugguuuucaaucucucaaguccuucaaagaugaccuguaaucuuccaccauguccauagcauacccuucuauauccucaauaauuauuucaaaccuuuggcagucuuaccuagucucuaacccauuagguugaacaaccuugcuaccuaccuuacaaagcagucagaagccuguccaacucuacugcaucacaccugaaucuuaccugauucccuuacguaucaguagaggaaguaaucuuccucaaaucccaggccaauaauuuuugcuccuaugcuguggaucuaauuuccuucugcuuccuuggagaccuuuuccuaccagcauuucaacagggauuaagucuuuuccuccucuccccucauaucaccucucaacucucguauuuucucaucuauucucauuuuaugacuuguccuuacagucaagcuucucaaguuuccauuuccucaacuuucacuuacaggucuuccuagucuaaugggcccucacaaaucaccaaugaccaccuuaacaaauccaacggauucauaauuuuauauaucuauuaaucccucuaaaaauuagccucuguaauucuuuuuuuuuuuugggugggggggugauacuccucccaauuuuuuuuacaaccuucucuuuugcuuaaauguauuacauagcccugcucuuugauuucuucuuucacuguuuauauucuccuauaauucauaucaauaauuccaaaaucugcaucucagagcuaguccucaaguucuugaaucguauuuccaauuccuauuaguccaugucaacuuggauuuuccagacaucucaaccuugagucaauccucucucucuccauuuacccauucucuacuauuacuuuaacaagugacuucaucaguaauuuaauuucccaagccacaaaccagaauauuaaccuauauuccccgcuccauaacauccauuaaccaagcaccuccagaauauuucuaagagucugccccucgccucuucauccucagaaaaguacuuuaguucugcagcuccccuuccacacuauuuuuaguggcauagauuacuaugauagcugcuugauuuguccaacuacuuuaaguuuugcuugcuuccaagcuguccuccacucugcugccaaacauuuuaaaaccacaaacgugaucaucucacuucuguuuaaaaucuuaguaucugcauaauauaaauguuuaauguuuauauaagguuuucguacaaaguguuuuuauauuaguugaugguagagcaaccuuuuucuucccucccuucccuccuuccuuugagacaggguagagcaaccuuuuauuuaucuucauuuauuuaucuguuuguuuguuugagguggucuuacucuugcacaggcuggaaugcaguguugugaucauagcucacuguaaccucaaacaccugagcucaagugauucucuugccucagccuuccaaguagcugggacgacagacagcaccaccacacccgguuaauuuuuaaaaauuuuuuguagggacaggucuaauuugaggaaaccagagagguaguaaaugcaccguuuuuuuuuuuuguuguugcugauuuguacauguuuaugcugacaauuuucagauaaauguuccugcuuaauugccuaauauuaaaauaaauauaaccuuguuuauuuuuugaaauccuauguuccccaggcugguuuugaacugcucgccucaagugauccuccugccagggccucucaaaguguugggauuacaggugugaaccacugugcccagccuccuuuuuaacagaaggaaaagccaaaacucagagagguuauauaacuuaucaaggucauguaacacuacucgguggguacacaaagucccgcacucuaguuuucagacucuaaaguucaguguucuuuucauuacaccaaacuuuaaauuccauuuauuuaacaaagaccuagaaauguaacagaugccuaguaaaaucauauaccacacucccucuuuaugaaacaauaaguucacuuuuaaaagugagauagcagaggauaugauaacauuaucaccaagcuauaaauagaacuggaaggcuuauuuagaagauaaauuccaacaauuucuaacaauccacuuuacuuauugagaaaaugaguauuuucaaagugaguaucuuuaggguuagagcuuugacuaucagaaacuucguagaauaagagcccaaauguucacacgcaugccuauaagagauucauguuuucacaucaauaaagaucacacacacacaaaaacacuaccauucucugaagaaguuuccuagaaauguagcaaacacuaaacuguggaugaauuugucauaccaaucucaauuuguuuucaugauuauuuuuguuuauauauauucuuaucuccugaaaucagacuugaguagauauaaauucuaaauuuacuauagaaaaagcaccacaccaaacuucuauuuuugacacuacuugcuaugaagucuuagaaaaguuacucagcaauaaaacccuucgacuguccaucuuagaaaugggaauucauucauucaaaaaauacuucauaugaauaaagugguuggcaaaacagccaaggucccuuuguucaagaguccaguggaggagagaggaaaaguaagcaaucaagguacauaauaaaauauuguuaagugcugugaaguaaacguacagggagcuaugaaagcauauaaugagggcccuauauagaauaaaugaaaaucucucugaaaaaauguuuuagccucugaauaagaguuacuccaagaaaagugguaagaaaaaguaucuaaacugaaugaggaugacaugcuaaggccagaaggacuuugggaauuuugaguguugaaggaaugacuaaauaaaguuggaguuuaugacaaggugggggagaaaugguagaugagacuaaagaguuagacugagaccgaacuaaauagugccuuuaaugcaaugacaaggauuucaucucaaguaaucugaaaaccacugaaagauuuuuaacuguaaagagauaugauuugauuuacauuucaugaagaccacugggacuaccucacaagauuacuggaacgaucaaauacaugugaaauacuacgucaaaaacuuacauaaaguuauauuaacaugaauaccucaaaaugaucuaaauuguauggugcuaaauauucugaaggcauuaugauaaauaauuuguauuaugguguggauagaauaauuuucaauggcucuggagaaacuggggcuucagagucaauuuuaagacacuguucaaaugcaguaaagcuacuauaugaauguaaaagguuuuggaguuggcagggagaaagagaauaucaaaaguuguuuggugcuuuuacacuagaugcaaauuuaagaaagauauacaaggaccaacaaaugauuaagaaauaguuccagauacaacagaguauaaaaggaauauguggaaauuccaacagcaggauuuaggaaaccagagagguaguaaagcaguuuuuuuguuguuauugauuuguacauguuuaugcugacaauuuucagauaaauguuccugcuuaauugccuaauauuaaaauaaauauaaccuuguuuauuuuuugaaauccuaucugccucuuuacagaguaggcauaggcaguccuuuuauaaguaaaaaaauacacaaaaaucucagccuaauccaauguagcacacuuaaucucagaaaaauauuuauaaucaucuugugcagaauggcauaaacaauucuggauacuaauucacucuuaugacuaauucucuuauuuaacaaaaugcuuaaauuauauuugaguagugauagcauaaaacaauuuucaacacuaaggagauacuggcagcaucuaguauuuuaaauuauuauaaaucagauauuucacugacuuuuuuuuuaaguaccacaaacuaagacucagaauuucaugguuucaguaaaacugaaacaaauaaaacuaugaaauucacucaaauaaaccaauggaauaguuuaccaucucuuuauagcuuaauuuuuagauuccaugcacuucuaaccuauuuucuucuccacacauuaaauccaucaccuagcaauaaauaauuuuuaugaucucuuuuuagaucuaaacuaagacaaauaagaaacucaaggaggccaaguaagauuguuuuuaaacuauucauccagaauacacauacaugaccauuaauaucuuaaauguguaugucucuccauacuaaagauaucuuguaaccauaugugacauauaagcgugauaagcauauaugaagcaagaaggaaaugauaauuaauaaugcuugacucuacauaaauucucucagcucuguguaacuuuucuacaccgggagaauuagguuugguauuaacaauauaaaaauaauaaacagaaaaaacuaagaaaaauugggacuuccucaaaauaaaaagcucuuacaaucaacuucgcuuuuuaaaaguauuuuguaucauauaaaggcauacauuaaacuucgaauaauaacgagcaucuauauacauaccaucaaaacaagcaccuaaagaaaauuaucauaaauauuaauauagccccuugugggccccucucuuggaauacccuuacucugauuuagcauuuaucauuccaugaauauuuuuauacuuuucuugcauaacugcauuuccacaaagacucauaaauaauuauucauaaauaauuuugaauguuuuaaagcauuauuuaaaggguaugaugugacgauuuuuucauuugaaggauuaaugugaguuuagccuccuuuuaggaugccaggucauuuucaucugcugaggguguugucuuacauuuuccagguacuguaaauguguuuuugauaauuagcacacuuaucuauguucuuaagacagcgcauuguuugugcuuuuggggcaugagauuaggaguggaagagagauccauggguuaaaugacacaaaacauucacugcaaauacuacuauaccacauaccucuaagaaauaaagagaugggguagauuucgaaugagagaagguaagaagacaggcugcaaaaagaugagugugucauuuauacggaguaaugaaauacacauauuuaagaauauuuacaaaacaacauuucaacauaguguaaacuaauaagagaagagggccaaaacaaacuugaaaaguuguuggaggacacaguuccagauuuuaaaacugucuacacaguuauaaucugguacugguauaugucaaucaaauauagaaucuagaaauaaacccucacuuuuacagucaauugauuuucaagcaggguaccaagauaauugcacagggaaaagaaugaucuuuuugacaaauaguuuugggacaacuggauaaccacaugcaaaagaaugaaauugaacuccuccccugaccauauacacaaaaaauuaacucgauugaauuacagacuuaaauguaagagccagaacuacaaaacuuggaaaagaaaauauaugaguaaauccucaugaccuugaguuaagccaagccuucuuagacaugauaccaaaagcaaaagugacaaaggaaaaaacaggcaaauugaauuucaauaaaauaaaaacuuccauguuucaguggacacuaccaagaaaguaaaaagaaaauccacagaaugggagaaaaauuuguaaauuaacuauuuaauaaggaaccuguaucuagagaacuuuuacaaugcaauaauaaaaagacaaaauaaccaaauuuuuuaaaugggcaaagaaucuggacagacauccaaaagacauacaaauggccaauaagcaggugaaaagauacucaacaucauuaccuaucaagaaaaugcaaaucaaaacuacaaugagauacuacuucauauccacuaagauggcuauauauuaaaaaaaagaacauaagugcugacgaggugaaaaaacuggaacccucauacacugcugguggcaauguaaaauuacggccacuuagaaaaacagucuagcaguuccuuaaaaaguuaaacagggaccuagcaauuccacuuacagguauauacacgagaaaugaaaacuuguaauggauguucauagcaggauuauucaaaauaggcaaaaauuggaaauucaaaugucuaucaauugauaaauggauauaucaaauguguuauaucuauacaauggaauauggucacauaccacauaacaacauuuaggucaauaacagacacauuaugucuggcuagacacaguggcucaugccuauaaucccaacacuuuggaagacuaaggugggaggagugcuugaggccaggaguucaagaccagccugggcaacacagcaagauccucauuucuacaaaaaaauaaaaauaaaaaauagacacaguggugcuugccuguaguccuagcuaauugggaggaugaggcaguggaauugcuugagcccaggagaucaagggcaaugugagccaauauugggcuacugcauuucagucugggugacagagccagacccugucucuaaaaacaaaaaagaucauaauauuguauuuuuacucuaccuuuucuauguuuagauauauauauauacacacacacacauauauauauuuauacacacacacauauauauauacuuaccauuguauuagaauugacuacaguaugcacuacaguaacauguuguacagguuuuuuuugccuaggagcaauaggcaauacauccuagguauguaguaggcaaucccaucuagauuuguguaaguacccccuuaagauguucacacaacgacaaaauugccuaaccauacauuucucagaaguuauccuugucauuaagugacucaugacuguaucauucagcaguaaaaauaaacauugauauaugcuauaacaugcaugaaccuagaaaacauguaugcuaaguaaaagaagcaagaugcaaaaaucgcacauacuauacgauuccauuuauauaaaauauccagaauaggcaaauauauaaagacagaaaauagauuaguagcugccuagaacagaggaguuugggagagaaaugggaggugacuauuaauggguaugagguuccuuuuuggauuccaaaauugauuauggucauggcugcacaacucuuucgaguauacuaaaacccagugaacuguccacuuuaagugggcaaauuguaagguaugugaauagcaucacaauaaagcuguuuuauauauacauauauauuuuaaaagcaaagaauggaggggccacaaauuuggaugagauuagaggugguuuuagagacugacuuugaacuagguuuugaaaugaaagucaguaauuuuuaagaaguaucugaaacaacagaaauggggcauaaaggccccaaaagcaggaaaaagcaaauaauuugcaggaaaugggagacacuaucuguaucaaaacagagauauguuaauuagaaaugagacugcugagacuacaaggcuaaaacaagaagacucacaaaauucuagaggcucuugauauuaauaacaaaugaaaauguguuuaacaaguauuacaaagcugucauuucuugauuuuaauacuuucaaguauuugucuuucaaaaaguugcuuccauaaucuggguauggcucuaucacacauaggcaggcaguacacuuagaauuuaaaaugcaagcuuuaaguuagaccuccugcucuaccacugacuaaguguuaugaccauauacauuuaacuaucccaguuucuguacugguaaaaugagaauacuaccauguauuucauauauguaauauauuuggaauaaauauauuacauuauauauggaaccuguaucuagagaacuuuuaaaaugcucuuaacauaguaaaugaguaauaaguuauuguaaaccauagccacaacuaugugguacauauaaauacuuagcuacaucucuccugagaauuaaaaaguucuucagcuugaaauccauucaaauguaugaauauaaauuucccaucuuuuuaucaaaggcaaaucucuugacuaaccuguuaaacuuuguuaagcuguaaaaacauauggguaaauaacagaaaucaauccagauuaccagguguuuucuaccuggaacaaggaacuugaugcucuuuucaguuaaguaacuuugucucuaaauguucucaggucuugauuuaacuggcucuaaacuuagaauacccuggccucagagccacccuugaacuucuuugugagaucuuugacuuccuucacaaagaaguccuugcuacugguacuucugcuaaaugauuuucucuuaugguggggaauuaccacgcuaauaucugggucuucucaaaacuaaagggagaauggaagggacaguuagcauucuuaguucuccauuccuuggaggaaaaaaaggcaucauuacucuuuucuuuuuggagagcuauaaggaaaccauguagaaucuuagugauggaaguaguaaaggcagucuagacauaaucaaaugcagguuaauccuacagggguuuucuguuuuauauuauaauuggaacuuauuuccuucuuuguaaggagccauuuuugacccuucccucaaauaauuuuaaucuguauccaaaacugaggcuacuuacuaggcuuaugcuagauuucuugaauagugacuuuuguguaaacugggugauaaaaucuaaaggaucuacauuccccuguuuaaaggauaaaugggagaacgagucuggcgaaguggcuucagaggaaugaauaugagacacagaaugugaauuacagugguaagugaggaaauuaaaagaaacaagcuagacugacauuacucagggaagaaaaaaaguauuuaguaauuguugaaaaauucuauacaaggacuaagaaaaaagagaaauucccaugguuuaaugaaauauuguuugaauuacauucgaguagugacagcauaaaaccauuuuuaauacuaaggaucuauucuuaguauuagauaguaucuaguacuuuaaaucuuuauaaaccagguauuuaaaccagcucugaaaucaucaaagauaaaaugaaguguaauaagagcauguacuuuaaaggcuauguaaguguaaagcauuuaaaauaguggcugcgacagacuaagcauuuaauaaauguccgcugguaguaaacuaugagcaagcaaauuaauuucucucagauuccucaucuauaagucauauaaauauauauauuuugguccuucuuuugaggaucaaaucucguaaugcacauaaucaaccuuuaucaguuguucucuaucuuccccuuauuucccuaccaauaugcccaaugguuucaauuuacuuuugucaauaaucaugacuuauuaaugaagugauuuucagugaaaaaaagaagaaucacucuaaacucacaucauaagauaaauucaagacuaagauagcaaaauugacuguuuuauuaucauuguaucuuccacuaucuuaauuuaaauguucuuucacuucaaaaauucuuuaagaguuaucucuagggaaaaaaucaguuggugaacauaauaaugcauucauauuugcauuuucugugcugagugguucauauggauuuaaguccaagaagaaagccguauguauuuguggcuuauaguaaaccaauaccauacuuuuaaaauauggaccaaguaccgaaacaaaauagccuacaagaucuuacuauaugcuucauggguuauuucuguaaaacuauaugugaaggggccauaucaucucuaauaagagcuuaugauuauugauagacaauuaaaauucaaaagcucaauaguaaaugaccucaaauuuuuuugucugaauguacuuguggaucaaaaugacauuugcucuguacauucaauuauucaccuaucaaucuuuaagcauguuuuaauauccagaagcaagguguuaagauuuccuacauguucuaucauaucuaaacugaacagucacaagaggcaaaugguagaauucugcuacuaaauauaaaauagacuuccuuuaaaaagaaaaauagguucuuuucuuuuuaaagugaaucuacuuuuuaaaaaaugaaucuuuaaaauaagagacagaggcugggcauagggguucacaccuguaaucccagcuauuaauacuugcgaggcugaagucagaggaucauuugaggucaggaguuucaaaccagucuaggcaacacaguaagaucccgucuccacaaaaacuuuaaaaauuagcugggugugguggcgcacaccuguaguuccagcuauuucagaggcugaggcaggaaaauugcuugagccaaggaguuugaagcuacagugagcuaugacuaugccacuacacuccagccugggugaugaagcgagacucugucucuagaaaaaauuuuuuuaaauaaaaucagaggcaaugugguacagugcuuuaagggcacaaaccaaagaccuaaacuacuuggguucaaaucccagcuauaccacuaugugaaaaccuuuuugagccuaugauuccuauuuugucaaaugugaauaacaccgauucccagaauugugguaauauggugaugaguaaauaagucaauaugcauuuauaacaguaccuggcacauaguguuuuuaaauguaauauuacaggucauggccugacaaacugauuuuaucuuguuacacuuacguagaagcaaaauuguuaacugucacaaaaccauuuugcaaaaaggucauuuaaugccuuauaugugcuaacaggaaaaugguauaauuuaggaaaaaaagccuuaauuucacaaaacagauaaacgaaaucauugacuagcucuggaccuuccuggacuauuaggguacauuaacccuggacucacuaacagaagucauuuaaaaacuuacgaaaaaggcuuaaauuaagaaaaguugcuuuccuagauuuuuaagcaucuaagaugugaaacaugccuuaaggucacuaucucuguccuuguuuucaccaauuuaccaagacugaagaaguuuuuccuuuuaguuucauuuccuauaaaugauguaguauauacccuacucuggucguaaacacccuggcacuacugaaacuaauuuuaaaaguaauaguaauauaaaaauuucuuuaaguauacacuaaauauuuugaaauucauguugaguaauaguguuccuuuucauuauuaagggauuugugaguauaagguuauuuucuuuuaguuucaaaguugcacgaacauaagggaucaaauaaaauuaagccucaaagauuucuaaguaaaagucggaauggacagaaagcucuaaaaacugaaaucaaugucucuugucuaaaacuucacugaucagauucuuuggcaauuauugaaaugaaaaugucacagagauuuuaaaugacuucacacacaaauuacuuacucuguaaaguuaccuacuacaguuauuaggguuuauacaaaaauggcaugcaauguuuugcuaaacugcaaaaguuaacuacacauuaccacuuaacauaaucacacauaaaaauuacugaaaaugauuggcagaugaauaacauuuaauaaaaaugguggaaacgaagcagugcuuuggaugauuugugguuauguuuuacuuacucauaauaggcccauuucuuuaaaaauuuccaggccagaaauuuugcaggugguucacaccuguaaucccggcccucugggaggccaagguaggcagaucacuugaggccaggaguucgagaccaacccggguaacauggggaaacccugucucuacuaaaaauaaaaaauuagcugggcgugguggcaugugccugcaggcccagcuacugcggaggcugaggugggaggaucacuugaacccuggaggugguugcggugagccgagaccacgcacuguacucuagccugggcgacacagcgagacucuguuucaaaaacuuuuuuuccaaagagaguauuuuauaacccauaauuuucuuuguaacucauuaacuaccauuccuuaaauauguuccuaaaauacucauauguaccuuaagcaaauuaucuuuuugucucaucagaagaaaccaccauguaucugaaaauuguuuuuaauucauccuaagcgauacaauucuaguucauuuaucucuuuccuauaguuccuaaacucuaaauuuuguucguguuuuucugaucucuuguugaaauugaaacacagaucaacaaauaucauuuugagacugcuuuauuccuuauacaaaucagugcuaccuucuucuugcuuuuuaaaaagguauuacucucguauuaauuuugauuuacuucucaauauaaagucuagaacuaaauacaucauaaaguauguuucucuucaucucacacuuguguaacuuauuuucaucucuagaaaaucaguuuuuagauaaaaaucauucacugcuuacaaauaaagagaaacuguaguacuuacacagaaugaaauaaaucuuuauacuugccuagguauggaaguuaguuacccgaguuaccaugagacagucauuaucugcaaagugcucaaaagcuaguaaaugaaauuuauucacugugaugcauaugacuauaacuucagacauguguauuaaacuuucaagaauaaacuuaugguaaacccaccauuuuuucucaacagcccaaucagucuuuccuagacaguuacauacauaugccacgacaauauuccacagggcaaauuucaaauaaccugauucaaagauuaaaaaaagauauuaaaaggaaaaacaacuuucuagugaguuccaaaaacauaaacuaaauuauuacauaucaccaccaguucuguaccuguaaguucaucaucaaauuuauacuuaucaaauuauucucuuuaaaauucugaaucaaauuuuugcucucuacuacuuuguuuuuggacagguuucacuugcuaauuugcaaauaaacuggcucacaaauaaaccaaacugguuucugcaacucccaguaccaucuuucucuugcaguuuuuuuccuuuaagagaaaauuaacgugaggauaaacuugcacaaucugcuuuuaucuaaauauguggcccucaguuuacuuuuauuuaaaauaaaagcacugaaaugacuuaaauuuaugagccucuuguauuuagucaugguucauacuuguaauacuagcauuuugggaggcugagguggaucacuugaagccaggaguucaagaucagcaugggcaauauagugagacacuguaccuauacagcuauacacgcacacacacacgcacauauauaaaacaauuuacauuaauuuuguaaaaaagcaaaaauauacuuauuugaaaauaccaaacuucauaaaguuaaacgcccacaaugcacauauugcuccuaucauccuguagugucaaugcuaccaauuacucuauauacaaaaacgugacauuaaugagagacaauaacacuuauauuuuaacuuauagacuuacagauuucuauuuuaaggaaauucacuuuuuaaaauaaggugguacuagguugggugaauuaagaauuuuuaaauguucuuuaacuuacaauagccagcggggacuuauuugucauuaccacaagccaagguaaacauggguguccuaggaaauguccaauuuccccacaguaauaaacaucuaacauuauaauaaaaacaauaacuuuuuuuuuucuuuuuuugagauggagucucacguugcccaggcuagagugcaguggccggaucucggcucacugcaaccuccgcuuccuaggcucaggcaauccucccaccucagccuccugaguagcugggaccacaggcgugccaccaugcccagcuaauuuuuuuguauuuuuguagagacgggguuucaccauggugcccaggcuggucuggaacuccugaguucaagugauccucccuccucggccucccaaagugcuggguuacaggcgugaaccacccugccaggccaacaauaacuauuauuaagucacuugaagauucuauuuuuuugauauaaugaaacaaguauguauuuacauccuuagggauuucuaucauacaaacauaguauauagccuaccaaaaaagaaaaaagagacuaagacuuagaucaagguuaaauuaagguccuaagucugccaccuauuagcuuaacugaaaaugaucccaauaucacagccuuuugucaggaguaaagagcagagauaagaggauaacuaaaauuugauaucucauaaauaugaaauucuuaagauauuaaaacgaaucaagauaaaauccuuauaauaaaauuacuguccauuuuacagcaugaagauaaugaggugcaaugauuuaaauuaacucuccucaaagccauacugcaaguugaguggugaaacugugacauaacucaggucuaaaucuuacuguuccuuucacuaugccauacugaaacacucuaugaauuauauacuacuguuaugguaacaguggaaagugaaaauauguuuuauuauaaugaagaggcacauuaugcuucccaaaaaauaaggaauuuuaaauuauguuacauauucacauauuuaaguuauuguagaugccacuugauauggucgacaagugugaaaauguccacauacauccuucaguauuuuaaauguauaaccuuugguauuuuacaaguuugaauauuagcaguuaguuaagccucaaguggacuuaucuacuuuuugcaggccuacauuaucuuucaaacagaagggaagggcugcacgucuaacagaaacgcugccggcuucuaucaagccaccacuaaagcacaagaccacguggucucucauaagcccaagguucccuacuccucucccuccuuugacaaggaacuggaaacuaggguuucuuucucuuauguggagcccugacaugccaccuguguaguacagaccgcaaacauccugcagccugccucccggaagaccaagaaucagaauaaaagggaacuuggacgccgacaauucuaggaaaggaaaugaacagagaaguaaagccggugagaucgugauaagccgcggcaccgggaccugucaaaacggcguauauaagacucaaaccaaaccacuauaaccuaucauucgggaaggccugaggugggagcggcacuacggaaggaaggaggacgaagagaaccgcacgagucagaaccgccgccgccgccgcuccccggauaccuuucagcaugcccuggcaagccaagaacccugacccucaucuagaguccaaccuuugccccaacauuucagaagcggccaaaaucccgcugccccggcggccgccgccggaccugcccgcaccugucacuagcgaaagaaccagcucgcggcucccgcccacuucuccacuauccucgggcaaccgcgggcaucucaaccccuuucucuuaccagguguccccuuuccggagcgagguuuugagcagcgucgcgaugucagaccgcuggguguccagauccgccgcuccgccuuccgccaucuucuucca

SEQ ID NO: 192964 - RNA, 145712 nt, Homo sapiens
uggaagaagauggcggaaggcggagcggcggaucuggacacccagcggucugacaucgcgacgcugcucaaaaccucgcuccggaaaggggacaccugguaagagaaagggguugagaugcccgcgguugcccgaggauaguggagaagugggcgggagccgcgagcugguucuuucgcuagugacaggugcgggcagguccggcggcggccgccggggcagcgggauuuuggccgcuucugaaauguuggggcaaagguuggacucuagaugagggucaggguucuuggcuugccagggcaugcugaaagguauccggggagcggcggcggcggcgguucugacucgugcgguucucuucguccuccuuccuuccguagugccgcucccaccucaggccuucccgaaugauagguuauagugguuugguuugagucuuauauacgccguuuugacaggucccggugccgcggcuuaucacgaucucaccggcuuuacuucucuguucauuuccuuuccuagaauugucggcguccaaguucccuuuuauucugauucuuggucuuccgggaggcaggcugcaggauguuugcggucuguacuacacagguggcaugucagggcuccacauaagagaaagaaacccuaguuuccaguuccuugucaaaggagggagaggaguagggaaccuugggcuuaugagagaccacguggucuugugcuuuagugguggcuugauagaagccggcagcguuucuguuagacgugcagcccuucccuucuguuugaaagauaauguaggccugcaaaaaguagauaaguccacuugaggcuuaacuaacugcuaauauucaaacuuguaaaauaccaaagguuauacauuuaaaauacugaaggauguauguggacauuuucacacuugucgaccauaucaaguggcaucuacaauaacuuaaauaugugaauauguaacauaauuuaaaauuccuuauuuuuugggaagcauaaugugccucuucauuauaauaaaacauauuuucacuuuccacuguuaccauaacaguaguauauaauucauagaguguuucaguauggcauagugaaaggaacaguaagauuuagaccugaguuaugucacaguuucaccacucaacuugcaguauggcuuugaggagaguuaauuuaaaucauugcaccucauuaucuucaugcuguaaaauggacaguaauuuuauuauaaggauuuuaucuugauucguuuuaauaucuuaagaauuucauauuuaugagauaucaaauuuuaguuauccucuuaucucugcucuuuacuccugacaaaaggcugugauauugggaucauuuucaguuaagcuaauagguggcagacuuaggaccuuaauuuaaccuugaucuaagucuuagucucuuuuuucuuuuuugguaggcuauauacuauguuuguaugauagaaaucccuaaggauguaaauacauacuuguuucauuauaucaaaaaaauagaaucuucaagugacuuaauaauaguuauuguuggccuggcagggugguucacgccuguaacccagcacuuugggaggccgaggagggaggaucacuugaacucaggaguuccagaccagccugggcaccauggugaaaccccgucucuacaaaaauacaaaaaaauuagcugggcaugguggcacgccuguggucccagcuacucaggaggcugaggugggaggauugccugagccuaggaagcggagguugcagugagccgagauccggccacugcacucuagccugggcaacgugagacuccaucucaaaaaaagaaaaaaaaaaguuauuguuuuuauuauaauguuagauguuuauuacuguggggaaauuggacauuuccuaggacacccauguuuaccuuggcuugugguaaugacaaauaaguccccgcuggcuauuguaaguuaaagaacauuuaaaaauucuuaauucacccaaccuaguaccaccuuauuuuaaaaagugaauuuccuuaaaauagaaaucuguaagucuauaaguuaaaauauaaguguuauugucucucauuaaugucacguuuuuguauauagaguaauugguagcauugacacuacaggaugauaggagcaauaugugcauugugggcguuuaacuuuaugaaguuugguauuuucaaauaaguauauuuuugcuuuuuuacaaaauuaauguaaauuguuuuauauaugugcgugugugugugcguguauagcuguauagguacagugucucacuauauugcccaugcugaucuugaacuccuggcuucaagugauccaccucagccucccaaaaugcuaguauuacaaguaugaaccaugacuaaauacaagaggcucauaaauuuaagucauuucagugcuuuuauuuuaaauaaaaguaaacugagggccacauauuuagauaaaagcagauugugcaaguuuauccucacguuaauuuucucuuaaaggaaaaaaacugcaagagaaagaugguacugggaguugcagaaaccaguuugguuuauuugugagccaguuuauuugcaaauuagcaagugaaaccuguccaaaaacaaaguaguagagagcaaaaauuugauucagaauuuuaaagagaauaauuugauaaguauaaauuugaugaugaacuuacagguacagaacugguggugauauguaauaauuuaguuuauguuuuuggaacucacuagaaaguuguuuuuccuuuuaauaucuuuuuuuaaucuuugaaucagguuauuugaaauuugcccuguggaauauugucguggcauauguauguaacugucuaggaaagacugauugggcuguugagaaaaaaugguggguuuaccauaaguuuauucuugaaaguuuaauacacaugucugaaguuauagucauaugcaucacagugaauaaauuucauuuacuagcuuuugagcacuuugcagauaaugacugucucaugguaacucggguaacuaacuuccauaccuaggcaaguauaaagauuuauuucauucuguguaaguacuacaguuucucuuuauuuguaagcagugaaugauuuuuaucuaaaaacugauuuucuagagaugaaaauaaguuacacaagugugagaugaagagaaacauacuuuaugauguauuuaguucuagacuuuauauugagaaguaaaucaaaauuaauacgagaguaauaccuuuuuaaaaagcaagaagaagguagcacugauuuguauaaggaauaaagcagucucaaaaugauauuuguugaucuguguuucaauuucaacaagagaucagaaaaacacgaacaaaauuuagaguuuaggaacuauaggaaagagauaaaugaacuagaauuguaucgcuuaggaugaauuaaaaacaauuuucagauacauggugguuucuucugaugagacaaaaagauaauuugcuuaagguacauaugaguauuuuaggaacauauuuaaggaaugguaguuaaugaguuacaaagaaaauuauggguuauaaaauacucucuuuggaaaaaaaguuuuugaaacagagucucgcugugucgcccaggcuagaguacagugcguggucucggcucaccgcaaccaccuccaggguucaagugauccucccaccucagccuccgcaguagcugggccugcaggcacaugccaccacgcccagcuaauuuuuuauuuuuaguagagacaggguuuccccauguuacccggguuggucucgaacuccuggccucaagugaucugccuaccuuggccucccagagggccgggauuacaggugugaaccaccugcaaaauuucuggccuggaaauuuuuaaagaaaugggccuauuaugaguaaguaaaacauaaccacaaaucauccaaagcacugcuucguuuccaccauuuuuauuaaauguuauucaucugccaaucauuuucaguaauuuuuaugugugauuauguuaagugguaauguguaguuaacuuuugcaguuuagcaaaacauugcaugccauuuuuguauaaacccuaauaacuguaguagguaacuuuacagaguaaguaauuugugugugaagucauuuaaaaucucugugacauuuucauuucaauaauugccaaagaaucugaucagugaaguuuuagacaagagacauugauuucaguuuuuagagcuuucuguccauuccgacuuuuacuuagaaaucuuugaggcuuaauuuuauuugaucccuuauguucgugcaacuuugaaacuaaaagaaaauaaccuuauacucacaaaucccuuaauaaugaaaaggaacacuauuacucaacaugaauuucaaaauauuuaguguauacuuaaagaaauuuuuauauuacuauuacuuuuaaaauuaguuucaguagugccaggguguuuacgaccagaguaggguauauacuacaucauuuauaggaaaugaaacuaaaaggaaaaacuucuucagucuugguaaauuggugaaaacaaggacagagauagugaccuuaaggcauguuucacaucuuagaugcuuaaaaaucuaggaaagcaacuuuucuuaauuuaagccuuuuucguaaguuuuuaaaugacuucuguuagugaguccaggguuaauguacccuaauaguccaggaagguccagagcuagucaaugauuucguuuaucuguuuugugaaauuaaggcuuuuuuuccuaaauuauaccauuuuccuguuagcacauauaaggcauuaaaugaccuuuuugcaaaaugguuuugugacaguuaacaauuuugcuucuacguaaguguaacaagauaaaaucaguuugucaggccaugaccuguaauauuacauuuaaaaacacuaugugccagguacuguuauaaaugcauauugacuuauuuacucaucaccauauuaccacaauucugggaaucgguguuauucacauuugacaaaauaggaaucauaggcucaaaaagguuuucacauagugguauagcugggauuugaacccaaguaguuuaggucuuugguuugugcccuuaaagcacuguaccacauugccucugauuuuauuuaaaaaaauuuuuucuagagacagagucucgcuucaucacccaggcuggaguguaguggcauagucauagcucacuguagcuucaaacuccuuggcucaagcaauuuuccugccucagccucugaaauagcuggaacuacaggugugcgccaccacacccagcuaauuuuuaaaguuuuuguggagacgggaucuuacuguguugccuagacugguuugaaacuccugaccucaaaugauccucugacuucagccucgcaaguauuaauagcugggauuacaggugugaaccccuaugcccagccucugucucuuauuuuaaagauucauuuuuuaaaaaguagauucacuuuaaaaagaaaagaaccuauuuuucuuuuuaaaggaagucuauuuuauauuuaguagcagaauucuaccauuugccucuugugacuguucaguuuagauaugauagaacauguaggaaaucuuaacaccuugcuucuggauauuaaaacaugcuuaaagauugauaggugaauaauugaauguacagagcaaaugucauuuugauccacaaguacauucagacaaaaaaauuugaggucauuuacuauugagcuuuugaauuuuaauugucuaucaauaaucauaagcucuuauuagagaugauauggccccuucacauauaguuuuacagaaauaacccaugaagcauauaguaagaucuuguaggcuauuuuguuucgguacuugguccauauuuuaaaaguaugguauugguuuacuauaagccacaaauacauacggcuuucuucuuggacuuaaauccauaugaaccacucagcacagaaaaugcaaauaugaaugcauuauuauguucaccaacugauuuuuucccuagagauaacucuuaaagaauuuuugaagugaaagaacauuuaaauuaagauaguggaagauacaaugauaauaaaacagucaauuuugcuaucuuagucuugaauuuaucuuaugaugugaguuuagagugauucuucuuuuuuucacugaaaaucacuucauuaauaagucaugauuauugacaaaaguaaauugaaaccauugggcauauugguagggaaauaaggggaagauagagaacaacugauaaagguugauuaugugcauuacgagauuugauccucaaaagaaggaccaaaauauauauauuuauaugacuuauagaugaggaaucugagagaaauuaauuugcuugcucauaguuuacuaccagcggacauuuauuaaaugcuuagucugucgcagccacuauuuuaaaugcuuuacacuuacauagccuuuaaaguacaugcucuuauuacacuucauuuuaucuuugaugauuucagagcugguuuaaauaccugguuuauaaagauuuaaaguacuagauacuaucuaauacuaagaauagauccuuaguauuaaaaaugguuuuaugcugucacuacucgaauguaauucaaacaauauuucauuaaaccaugggaauuucucuuuuuucuuaguccuuguauagaauuuuucaacaauuacuaaauacuuuuuuucuucccugaguaaugucagucuagcuuguuucuuuuaauuuccucacuuaccacuguaauucacauucugugucucauauucauuccucugaagccacuucgccagacucguucucccauuuauccuuuaaacaggggaauguagauccuuuagauuuuaucacccaguuuacacaaaagucacuauucaagaaaucuagcauaagccuaguaaguagccucaguuuuggauacagauuaaaauuauuugagggaagggucaaaaauggcuccuuacaaagaaggaaauaaguuccaauuauaauauaaaacagaaaaccccuguaggauuaaccugcauuugauuaugucuagacugccuuuacuacuuccaucacuaagauucuacaugguuuccuuauagcucuccaaaaagaaaagaguaaugaugccuuuuuuuccuccaaggaauggagaacuaagaaugcuaacugucccuuccauucucccuuuaguuuugagaagacccagauauuagcgugguaauuccccaccauaagagaaaaucauuuagcagaaguaccaguagcaaggacuucuuugugaaggaagucaaagaucucacaaagaaguucaaggguggcucugaggccaggguauucuaaguuuagagccaguuaaaucaagaccugagaacauuuagagacaaaguuacuuaacugaaaagagcaucaaguuccuuguuccagguagaaaacaccugguaaucuggauugauuucuguuauuuacccauauguuuuuacagcuuaacaaaguuuaacagguuagucaagagauuugccuuugauaaaaagaugggaaauuuauauucauacauuugaauggauuucaagcugaagaacuuuuuaauucucaggagagauguagcuaaguauuuauauguaccacauaguuguggcuaugguuuacaauaacuuauuacucauuuacuauguuaagagcauuuuaaaaguucucuagauacagguuccauauauaauguaauauauuuauuccaaauauauuacauauaugaaauacaugguaguauucucauuuuaccaguacagaaacugggauaguuaaauguauauggucauaacacuuagucagugguagagcaggaggucuaacuuaaagcuugcauuuuaaauucuaaguguacugccugccuaugugugauagagccauacccagauuauggaagcaacuuuuugaaagacaaauacuugaaaguauuaaaaucaagaaaugacagcuuuguaauacuuguuaaacacauuuucauuuguuauuaauaucaagagccucuagaauuuugugagucuucuuguuuuagccuuguagucucagcagucucauuucuaauuaacauaucucuguuuugauacagauagugucucccauuuccugcaaauuauuugcuuuuuccugcuuuuggggccuuuaugccccauuucuguuguuucagauacuucuuaaaaauuacugacuuucauuucaaaaccuaguucaaagucagucucuaaaaccaccucuaaucucauccaaauuuguggccccuccauucuuugcuuuuaaaauauauauguauauauaaaacagcuuuauugugaugcuauucacauaccuuacaauuugcccacuuaaaguggacaguucacuggguuuuaguauacucgaaagaguugugcagccaugaccauaaucaauuuuggaauccaaaaaggaaccucauacccauuaauagucaccucccauuucucucccaaacuccucuguucuaggcagcuacuaaucuauuuucugucuuuauauauuugccuauucuggauauuuuauauaaauggaaucguauaguaugugcgauuuuugcaucuugcuucuuuuacuuagcauacauguuuucuagguucaugcauguuauagcauauaucaauguuuauuuuuacugcugaaugauacagucaugagucacuuaaugacaaggauaacuucugagaaauguaugguuaggcaauuuugucguugugugaacaucuuaaggggguacuuacacaaaucuagaugggauugccuacuacauaccuaggauguauugccuauugcuccuaggcaaaaaaaaccuguacaacauguuacuguagugcauacuguagucaauucuaauacaaugguaaguauauauauauguguguguguauaaauauauauauguguguguguguauauauauauaucuaaacauagaaaagguagaguaaaaauacaauauuaugaucuuuuuuguuuuuagagacagggucuggcucugucacccagacugaaaugcaguagcccaauauuggcucacauugcccuugaucuccugggcucaagcaauuccacugccucauccucccaauuagcuaggacuacaggcaagcaccacugugucuauuuuuuauuuuuauuuuuuuguagaaaugaggaucuugcuguguugcccaggcuggucuugaacuccuggccucaagcacuccucccaccuuagucuuccaaaguguugggauuauaggcaugagccacugugucuagccagacauaaugugucuguuauugaccuaaauguuguuaugugguaugugaccauauuccauuguauagauauaacacauuugauauauccauuuaucaauugauagacauuugaauuuccaauuuuugccuauuuugaauaauccugcuaugaacauccauuacaaguuuucauuucucguguauauaccuguaaguggaauugcuaggucccuguuuaacuuuuuaaggaacugcuagacuguuuuucuaaguggccguaauuuuacauugccaccagcaguguaugaggguuccaguuuuuucaccucgucagcacuuauguucuuuuuuuuaauauauagccaucuuaguggauaugaaguaguaucucauuguaguuuugauuugcauuuucuugauagguaaugauguugaguaucuuuucaccugcuuauuggccauuuguaugucuuuuggaugucuguccagauucuuugcccauuuaaaaaauuugguuauuuugucuuuuuauuauugcauuguaaaaguucucuagauacagguuccuuauuaaauaguuaauuuacaaauuuuucucccauucuguggauuuucuuuuuacuuucuugguaguguccacugaaacauggaaguuuuuauuuuauugaaauucaauuugccuguuuuuuccuuugucacuuuugcuuuugguaucaugucuaagaaggcuuggcuuaacucaaggucaugaggauuuacucauauauuuucuuuuccaaguuuuguaguucuggcucuuacauuuaagucuguaauucaaucgaguuaauuuuuuguguauauggucaggggaggaguucaauuucauucuuuugcaugugguuauccaguugucccaaaacuauuugucaaaaagaucauucuuuucccugugcaauuaucuugguacccugcuugaaaaucaauugacuguaaaagugaggguuuauuucuagauucuauauuugauugacauauaccaguaccagauuauaacuguguagacaguuuuaaaaucuggaacuguguccuccaacaacuuuucaaguuuguuuuggcccucuucucuuauuaguuuacacuauguugaaauguuguuuuguaaauauucuuaaauauguguauuucauuacuccguauaaaugacacacucaucuuuuugcagccugucuucuuaccuucucucauucgaaaucuaccccaucucuuuauuucuuagagguaugugguauaguaguauuugcagugaauguuuugugucauuuaacccauggaucucucuuccacuccuaaucucaugccccaaaagcacaaacaaugcgcugucuuaagaacauagauaagugugcuaauuaucaaaaacacauuuacaguaccuggaaaauguaagacaacacccucagcagaugaaaaugaccuggcauccuaaaaggaggcuaaacucacauuaauccuucaaaugaaaaaaucgucacaucauacccuuuaaauaaugcuuuaaaacauucaaaauuauuuaugaauaauuauuuaugagucuuuguggaaaugcaguuaugcaagaaaaguauaaaaauauucauggaaugauaaaugcuaaaucagaguaaggguauuccaagagaggggcccacaaggggcuauauuaauauuuaugauaauuuucuuuaggugcuuguuuugaugguauguauauagaugcucguuauuauucgaaguuuaauguaugccuuuauaugauacaaaauacuuuuaaaaagcgaaguugauuguaagagcuuuuuauuuugaggaagucccaauuuuucuuaguuuuuucuguuuauuauuuuuauauuguuaauaccaaaccuaauucucccgguguagaaaaguuacacagagcugagagaauuuauguagagucaagcauuauuaauuaucauuuccuucuugcuucauauaugcuuaucacgcuuauaugucacauaugguuacaagauaucuuuaguauggagagacauacacauuuaagauauuaauggucauguauguguauucuggaugaauaguuuaaaaacaaucuuacuuggccuccuugaguuucuuauuugucuuaguuuagaucuaaaaagagaucauaaaaauuauuuauugcuaggugauggauuuaauguguggagaagaaaauagguuagaagugcauggaaucuaaaaauuaagcuauaaagagaugguaaacuauuccauugguuuauuugagugaauuucauaguuuuauuuguuucaguuuuacugaaaccaugaaauucugagucuuaguuugugguacuuaaaaaaaaagucagugaaauaucugauuuauaauaauuuaaaauacuagaugcugccaguaucuccuuaguguugaaaauuguuuuaugcuaucacuacucaaauauaauuuaagcauuuuguuaaauaagagaauuagucauaagagugaauuaguauccagaauuguuuaugccauucugcacaagaugauuauaaauauuuuucugagauuaagugugcuacauuggauuaggcugagauuuuuguguauuuuuuuacuuauaaaaggacugccuaugccuacucuguaaagaggcagauaggauuucaaaaaauaaacaagguuauauuuauuuuaauauuaggcaauuaagcaggaacauuuaucugaaaauugucagcauaaacauguacaaaucaauaacaacaaaaaaacugcuuuacuaccucucugguuuccuaaauccugcuguuggaauuuccacauauuccuuuuauacucuguuguaucuggaacuauuucuuaaucauuuguugguccuuguauaucuuucuuaaauuugcaucuaguguaaaagcaccaaacaacuuuugauauucucuuucucccugccaacuccaaaaccuuuuacauucauauaguagcuuuacugcauuugaacagugucuuaaaauugacucugaagccccaguuucuccagagccauugaaaauuauucuauccacaccauaauacaaauuauuuaucauaaugccuucagaauauuuagcaccauacaauuuagaucauuuugagguauucauguuaauauaacuuuauguaaguuuuugacguaguauuucacauguauuugaucguuccaguaaucuugugagguagucccaguggucuucaugaaauguaaaucaaaucauaucucuuuacaguuaaaaaucuuucagugguuuucagauuacuugagaugaaauccuugucauugcauuaaaggcacuauuuaguucggucucagucuaacucuuuagucucaucuaccauuucucccccaccuugucauaaacuccaacuuuauuuagucauuccuucaacacucaaaauucccaaaguccuucuggccuuagcaugucauccucauucaguuuagauacuuuuucuuaccacuuuucuuggaguaacucuuauucagaggcuaaaacauuuuuucagagagauuuucauuuauucuauauagggcccucauuauaugcuuucauagcucccuguacguuuacuucacagcacuuaacaauauuuuauuauguaccuugauugcuuacuuuuccucucuccuccacuggacucuugaacaaagggaccuuggcuguuuugccaaccacuuuauucauaugaaguauuuuuugaaugaaugaauucccauuucuaagauggacagucgaaggguuuuauugcugaguaacuuuucuaagacuucauagcaaguagugucaaaaauagaaguuugguguggugcuuuuucuauaguaaauuuagaauuuauaucuacucaagucugauuucaggagauaagaauauauauaaacaaaaauaaucaugaaaacaaauugagauugguaugacaaauucauccacaguuuaguguuugcuacauuucuaggaaacuucuucagagaaugguaguguuuuugugugugugugaucuuuauugaugugaaaacaugaaucucuuauaggcaugcgugugaacauuugggcucuuauucuacgaaguuucugauagucaaagcucuaacccuaaagauacucacuuugaaaauacucauuuucucaauaaguaaaguggauuguuagaaauuguuggaauuuaucuucuaaauaagccuuccaguucuauuuauagcuuggugauaauguuaucauauccucugcuaucucacuuuuaaaagugaacuuauuguuucauaaagagggagugugguauaugauuuuacuaggcaucuguuacauuucuaggucuuuguuaaauaaauggaauuuaaaguuugguguaaugaaaagaacacugaacuuuagagucugaaaacuagagugcgggacuuuguguacccaccgaguaguguuacaugaccuugauaaguuauauaaccucucugaguuuuggcuuuuccuucuguuaaaaaggaggcugggcacagugguucacaccuguaaucccaacacuuugagaggcccuggcaggaggaucacuugaggcgagcaguucaaaaccagccuggggaacauaggauuucaaaaaauaaacaagguuauauuuauuuuaauauuaggcaauuaagcaggaacauuuaucugaaaauugucagcauaaacauguacaaaucagcaacaacaaaaaaaaaaaacggugcauuuacuaccucucugguuuccucaaauuagaccugucccuacaaaaaauuuuuaaaaauuaaccgggugugguggugcugucugucgucccagcuacuuggaaggcugaggcaagagaaucacuugagcucagguguuugagguuacagugagcuaugaucacaacacugcauuccagccugugcaagaguaagaccaccucaaacaaacaaacagauaaauaaaugaagauaaauaaaagguugcucuacccugucucaaaggaaggagggaagggagggaagaaaaagguugcucuaccaucaacuaauauaaaaacacuuuguacgaaaaccuuauauaaacauuaaacauuuauauuaugcagauacuaagauuuuaaacagaagugagaugaucacguuugugguuuuaaaauguuuggcagcagaguggaggacagcuuggaagcaagcaaaacuuaaaguaguuggacaaaucaagcagcuaucauaguaaucuaugccacuaaaaauaguguggaaggggagcugcagaacuaaaguacuuuucugaggaugaagaggcgaggggcagacucuuagaaauauucuggaggugcuugguuaauggauguuauggagcggggaauauagguuaauauucugguuuguggcuugggaaauuaaauuacugaugaagucacuuguuaaaguaauaguagagaauggguaaauggagagagagaggauugacucaagguugagaugucuggaaaauccaaguugacauggacuaauaggaauuggaaauacgauucaagaacuugaggacuagcucugagaugcagauuuuggaauuauugauaugaauuauaggagaauauaaacagugaaagaagaaaucaaagagcagggcuauguaauacauuuaagcaaaagagaagguuguaaaaaaaauugggaggaguaucacccccccacccaaaaaaaaaaaagaauuacagaggcuaauuuuuagagggauuaauagauauauaaaauuaugaauccguuggauuuguuaagguggucauuggugauuugugagggcccauuagacuaggaagaccuguaagugaaaguugaggaaauggaaacuugagaagcuugacuguaaggacaagucauaaaaugagaauagaugagaaaauacgagaguugagaggugauaugaggggagaggaggaaaagacuuaaucccuguugaaaugcugguaggaaaaggucuccaaggaagcagaaggaaauuagauccacagcauaggagcaaaaauuauuggccugggauuugaggaagauuacuuccucuacugauacguaagggaaucagguaagauucaggugugaugcaguagaguuggacaggcuucugacugcuuuguaagguagguagcaagguuguucaaccuaauggguuagagacuagguaagacugccaaagguuugaaauaauuauugaggauauagaaggguaugcuauggacaugguggaagauuacaggucaucuuugaaggacuugagagauugaaaaccauaggucuucagucucuauaucauuuucuuuaguaacuaugaacccagauaauauuaacauuaugauaaaaauaauuucagauugauguauguaagaaucguguguaaugaccagguaugaggcacccucauaaaauuccuuguaauccucugaaacaggaagauuauagugauuaagccauagaucuuuuagauuauacauugguacauuuacuucauaacuucuuuacaggaacacagucaaaugucuuaguauucagaaauacuucaccuuugguuucauuuauaaagcauugacuccuuuguauaagaaauuuagccuguucaucacaaaacaauuuaauuacuacucugggcugcucaagaugguuuguacauuaguauuuagaugaauuuuagaugguugcaggucuguaguuaguauaauauuugguaccaaaauuugaucagcuucaaaucaguaaauaugucaguuuuggaauuguuuguuuugcuuauauuaucuuccaagauauaaaggguaauaaucuguccuuuaugugcuuuuccuuuuauaugagauaucacucauauaaaaucauauaugagauaacacucauuauuuuucuggcuuauucacugguugcucuaguuaccaaaaggaaguauuuucucaggaaugaauacacuaccguauaucagaaucacauuuugauaaauuuagaaaugauugcaaaugaauugugcuuuuccaagucuugaagaaaauucuucaagacuuacguaaauuuuuaauuaaaaucuaaugcaaauucaccuguuuagaaaaaguacaacuauaaaaaauaaauacaaaagaucauauaaaguuaugaauuuuuucagaaauaaaaaguaaugaauaaaaacugugccuuuuaugcauuuugcuguguauauuuugucccaauuuuuaaauguguuuguaauuaguuuucuuauuuuuaugcauaaaauuuccauuguugacugucacugaacacuaucacuuuugcuagccucaauauuauucuuagucuauuugacuguacuucauucugugugcauauaugugaagauguaucuauacauaacuucuguguuaaacaaaagacguuuacucuugcuguuaaaacuuucuggcagauuuuggauaacccuccuugcaccacuugauaauaacucacaagcugcaacucuucugaauuccacuuccacaagcagacaaucuuuuuuaagauaaaaugucauguuuauuaugguauuuauauauuuccuaaccauucaacacauguaaagcugugcuacuguuuuuauuaucuucuuuaaaacaugucacugacagugcuucagcaagagaaggaaggggaugguauuagggaagcaugcaaaccuguacagcauguuaccauacugaauaguguaggcaguuuuaauauaauguuaaguauuuguguuucuaaauauagaaaaagaacaguaaaaauggcauauaaaagauuuuuuuaaaugguacacuuauuuagaacacuuaccaugaauggaguuugcagggcuggacguugcucugggugagucagugaguuaguagagagugaaugugaaggccuagggcaggguugucccaucuuuuggcuucccugggccaaaucagaagaagaauuauugucuuggaccacauguaaaauacacuaacgcuaaaaauagaugauaagcgaaaaaaaaaaucacaaaaaaaucucauaauguuuuaagaaaguuuacgaauuuguauugggcugcauucaaagguguccugggccaccugugggccucagguuggacaagcuuggccuagugcauuaauguacacugcuguaaucuuuauaaacaccauacacuuaggcuacacuaaguuaauuuaaaaauauuuucuucaauaauaaaauuaacuuuagcuuacuguaacauuuuuacguuauaaaccuuaaaaauguuuuaaauguuuuugacucguuuguuauaacacuugguuuaaaacaccaauacauuauacagcuguacaaaaauauuuucuucauauccuuauucuauaagcuuuuuucuauuucuaaauuuuuucuaauuaaaaaguuuuuuugccguaaacuaagagacaaacacacauuaaccuaggccugcacagucagggugaucaguaucacugucuucugccuccauaucuugucccauuggaaggucuucaugggcaguaauauucauggagcugucaucuccugugauaucagugccuucaucuggaauacuuccugaaggaccugccugaggcuguucuacagcuaacuuuuuuuuauauauaaguagaaggagcacacucuaaaauaacgauuauaguaacaaaguauaguaaauacauaaacucauaacaguuguuuauuauugucaaguauuauaugcuguacauaauuauaugugcuauacuguuguaagauuggcagcacaguaggucuguuuacaccagcaucaccguaaacaugugaguaaugaguuaugcuacaacaucacaauggcuacaucauuaagcaaaagggcuuuuuuagguacauuaugguguaugggaccaccaucauauauguaguuugucauuggcaagaaagucauuaugcagugcaugacuguauacagaugguccucaacuuaaugauggaguuacagccugcuaaacucauuagaaauugaaaauauuguaaguaaaaaauccauuuaauaugccuaacguaccauacaauauagguuagacuagccuaccuuaaacaugcuuagaacacuuaaauuaaucuacaguugggcaaaaccagcuaacagaaaaucuguuuuauaauaaagcauugacuacuguacugaaaaugaaaaacagaaucaucguauggauauuagaaauaugguuucugcugaaugcuuaucaguuucacaccauuauaaaguccaaaaaucuuaagucacaccguaaguugaacugucuauaucaacuuuuuucauuguaguaagaauacuuaacaugagcgcugcccucuuaauuuuuuucuguacaauauaauauuguuaacuauaggcacaauauuguacaauagacuuacucauuuugcauaacugaaacuuuauacccacugaauaucaucaccuccuuauuucuuccuuuccccagccccuggcagucaccauuuuacucuguuucuaugacuaugauguuuuagauaccucauaaguggaaucaugcaggauuugucuuucugugacucauuuacuucauuuagcauagugaccuucagguucauccauguugcugcauauggcaggauuuucuuuuuucaggcuaaauaguacuccauuuuucuuuauucuuucauccaucaaaagacauuaagguuguuuccgcaucuuggcuauugugaauaaugcugcaguaaacaugauaguacauauaucuucaggacucugauuuuaauccuuuuggauauguacccaaaaguaggauugcuggaucauauggucauucuauuuuuaauuuuuugaggaaccuucauaccauuuuccauagccagugcaccauauuauauagucuacaagaguuccaauuucuccacauccucaccaacaguuaccuuuuguuuuuuucaauaauagccauccuaacacgugugaggugauaucucauugugguuuugauuugccuaauuaaguguuguaacaccuugaaauuuucaaaaacaagcauuagaaaagaaccgacugcauguauaauaagauagagcuguaauugauuuuuuccuuuaugcaugaucuguugugccaguaccuuuuauagaauaguccaucuuugccuauuaguuuguaaugaugcuuuugacauaugucuucauauauaugugagucuggcucuuauuucuuuccacuguuuucauuggucuuuuuacuucucucuaugccaauaucacauuuucuuaaucacagcuuugacacuuuguaaccuugggcaaguuaauuucuguguguauauauacuccaucugaaauuaagauaauaguaccuacuucauuggguaaaugaaaauauaugaaugugcuuagaaguaugcacauggcucaagaguaaaacucaaauauuagugauuuuguuauuaaacuuaauaaagguaauaauuaaccuuaauauguuaauaauuaauaauaaauuaagcuuaauaaagaggcuuaguaaugaggaaacugagauuuccacuuuguuuuucuuccagacuuucuggggaaguggggagaggguuauggagggauucccugaagcagugacauuuaggcagauaugugaaagauuauaguuguuaacuaugugucuuagccccuucaggcugcuauaacaaaguaccuguaaguggcuuaaaaacagcaaauuuauuugucacuguucuggaggcugguaaguccaagaugacuagguacuggcagguucugugucuggugaggaggacacagcauacuuucugguucauagauggaaccuucuagcuauaguggaagggaugaggugucucucugggagccucuuuuauaaaggcauaaauuccauucgugaggacucugcccuuaugaucuaaucaccuccuaauucccuauccuuggggguuaggauuuuaacauuaauucugggggaggagacacacgcauucagaccauagcucuacauguugaaaagaauaagggaauuuucuagguagaagggguuaugaggcagaaaauggugugucaaggaaaugaaagaaggcucuugcagcuggaucugggcacaaagaaaaaugguaccagcugagucuaaagagguagcuagggauuagaucaugcaagaccuuuuagacaauguuaagcauuuuagacuucauccuacauaguuauaacuauuuguauugguugauauccuaaugacuuuaaguccauaaaagaaacucaaagugaaaauugggcuuaucuggacccuaauaguauauaaggauuaagaauaccauugagaauauaugaauucaggucuuuguucauuguuuguagucuuuguaaucuguugauuccguucuaguauuuuaucaguucagauugaacauugggaauuuuggcagauuucauagauguagaaguauaguuuuuacagugcaacagaucuauauaaauguauugaaauaaaaucuuuucauuuauuugucugugucaucuaaucuuaccuuucuuagucuucuuucuugucuacgucuucuaaucucaucuuucuaauauauaccuaacaacacuauacauuguuucuggaguagauucuccuauuuuucuuuuucuguuugcuuuuugagacagaaucuugcucuauugcccaggcuggagugcaguggcaugcucucagcucagugcaaccuccaccuccuggguucaagcaauucuugugccucagccuccugaguagcugggguuacaaaaguaugcgccaccacacuugacuaauuuuuguauuuuuaguggagacgggguuucaacaugugggccaggcuggucuugaacuccuggccucaagugauccagccaucuuggccucccacagugcugggauuacaggcgugagccacagcaccuggccagauucuccuauuuuucuacuuuccugauguuucauuaccauaaaauuguguagauagcccuaagagaaauauggugcccuuuuucaauugaagauaguauugaaagcaauuaaauaucaucaaaugggaaagucuccuaucauaauaguaucauuguacagaaagaagucacuacaagaucuaggaaagauaguugauacagaaauauaugacaauagacaguugacauagaaauguaugacauuauagaagguuuaccaaguauauacuuuuaguaccgcagucccuuuuuaucugcagaguauaaguuccaagacccucaguggaugccugaaccugcaaauaguagcaaaccuuauauacacugcuuuuuccuaugcuuacauauaauaaaguuuaauuuauaggccaggcacacuggcucaugucuguaaucccagcacuuucggaggccaaagugggagggcaccuugagcccaggagcuugaaaccauccugggcaacguagugauaucucaucucuacaaaaaauaaacaaaauuagcugaguuuguggcacaugccuguagucccagcuacucaggagacugaggugggaagaucacuugagccagggagguugagacuacagugagcugugaucaugccccacugcacuccagccugggugacagagcaagacccugucuccaaaaaaaaauaaauaaauaaguuuaacuuauaaauuagccacaggaagauuaacagcaacaauuaauaauaaaauaggacaguuaugacaauauucuguaaaaguuauguggaugugguuucucaaaauaccuuacuguacuguacuuacccuuuuuguaauagugugagaugauaaaaugcauaggugaugagaugacaugagguaaaugacauaggcauugugauguaaauggaagauuucagaaauaauuuauagguuuuaaauuacaugugugcugcauagcaugaugaaauacugugccauuccacccaaacugccuucaagcccucuugguuaucagguugacuguugcaguaucacaauccuuauguucaaguaucccuuauuuuauuuaauaaugacccaaaaugcaagaguagugagaguaccacaguugacaguuaacccgcagaaagugaaacugcagauaaaaggaggcuacuguauaacuguaaaggauuuauuaaguacuuugggagauaaaacucuauaucuuaaaaaugucuaaguaacuauaaauagaauuucuauacuuuuccacaaauuguuuuuaauguguuuuauaaaugauauuuguaacuguaguauuaauguuaucucaaguccauauucuauuuuuaauggauauggcauuagcuuuuuaagaaaacuaacgggaaauuuugcauuuccauuuuaaagggaaaaaucaguaacuaagaaaaauuaacugaagaucagagucuacccucccaaaugauacuauacuccccaguaguuuuucauacaaguaaaucauuaaggggcagauaacccguuacaaacuacuuuuguagauaguagaagaguaaaagcuauuccagguuuguucagaagaguacaggagaaaaagcuuggcaagugcagaaaauuuucaucaccuuuaacacuuagucaugauagucuaaacaaauguugaauagaaaggaacuucucuaaguucauaagcaguauuuaucaaaaaccuacagcaagcuaauaagcagcauuuaucaaaaaucuaccuaguggugaaacuuuaaauguugucauaaaaaaaaagacaaaaauguuugcugucucuucaccuauauuuuaggagcccuagccaagaaaaauaggcaauagacaagaacaauaggaauacaauuagaaaggaaugauuaaacacauuauuugcagcaacaguaugaguuuuuacauagaaaaaucuaagggaaccuacaaccagguaaaacuacuaagaguucaggaugcugguggauaucagauuaaucacuuaaaaaaauuaggcugagcacagugguucaugcuuguuauccuagcacuuugagaggccgaggcaggcggaucacuugaggccaggaguuugagaccagccuggcuaagauggcaaaacccggucuuuacuaaaaauagaaaaauuagcugggcaugguggcacaagccauaaucccagcuacucuggaggcugaggcacgagaauugcuugaaccugggaaguggagguugcaguaagccaagaucgugccaccacacuccagccugggcagcagagcgagacccuaucuccaaaaaacaaacaacaaauauuauuucuaugcaucaacuacaagcaguuauagaauuuaauuaauuggggaaaaaauguaaaauucacauagaaaaacugagguuucuaggaacgaauuuagcaaaacaugauuuuuauuggaaaaacauauaaaauuuauugaaagacauuaaccugaauaauggagagauacgccguggcuguggauaagaagacucacuuugguaaagauggcagugucccucaacuuuguaaguguaauguacuuccaaucaaaaucuuauuagacuuuuuuguggaacuuugcgaagaaagcaagucgaaugucugaguauaaguaaagucauugcuagucuagucaauauuuauuuuagaaaauaggauuuucuuaagacuuagucccucaauucuuuucucacaaaucuuaaauuccacaaugugugggggcuuucaauugcauaaucuugacagugaguucagaauacugguacauagauaauucugcauauccacuuuuagggaguuaaacucaugaauauucuuuaagaaaucugagguuuuguuagguuagugccuuugcuuuagcuauuuucggacguaacuguggguuuuuguucuuauagugcuauauaugguaagcauagaaaagaaacacuagaauggauaaucuucuaaaaagcuuuguuaccuguaguauuacacacaugagcuuuaaaucucucauuaaccuuuaucuuuaccuuugauucugcuugugauugaaccugguuaaaugugggagaaauguuucuagaaaaauuuaaaaucauugugaaccaaugacaaagcaguauuuuauagcaggcauacuguagucagaauaaauuuuuacaauguuuuagguuuuuuuuuaaugcuuucuauccuagugaacucuuguuuuacuuuuucugucauuggucaucugaugagaagcuaguuucuaggcagcugaaaauaagauggauauaguuucaguaauguuuacaguguuagcuguaucacacuuuugaaaucauucaaaaaccaauccugcuugccccauauuuuacuacuauaggaggaacagucagagauaguauuguuguuauuaacuucuguugguaaagaagcuuaauuaagguuuuaagaguugauuauacuuucuauuaauauuuuuauagauuuagggacuacaaaugcaguuuuguuacauggaugaacugcauaauggugaaguaagggcuucuaauguagccaucagcugaauaguguauauuguacucauuuaauaauuuaucaucccucuccugccucccacccuucugagucuccaaugucuguuauucacgcucuauguguauacaugauuuagcucccacuuauaagugauaacaugcaguauuugauuuuguauuucugaauuauuuccccuaagauaauggccuccaguuccauccauguugcugcaaaaaacauggcuuccuucuuuuuuauggcuaaguaguauuccaugguguuugugucuuuguguuuguguauguguguguguacaugagugugccacauugucuuuauccagucauccauuuauggacacuuaaaguguuuccuaagauaauggccuccacuuccauccauggugcugcaaaaaacaugguuuuauucuuuuuuauggcugaguaguauuccaugguguguguguguguauccauauaugcuacauugccuuuauccaaucauccacugauggacacuuagguuguuuccauaucuucacuauugugaauagugcugugauaaacauacaagugcaggugucuuuuugauagaaugauuucauuuccuuuggguauauaccuaguaguggaauuacuagauccagugauaguucuauuuuuaguuuuuugagaaaucuccauacuguuuuccauaaagguuguacuaauuuccauucccuccauucccaccauuccuuuucuucugcauccuugccaacaucuguuaucuuuugagcuucuaauaauagccauucugacugguauggaugcuuuuucacugugguuuuacuuguauuuaucugauaauuagugauguggaauuuuuuuucauauguugaccauucauauguguuaguuugaaauuuuucuguuuagaguaaacagacaaucuacaaaaugggagaaaauauuuucaaacuaugcauacaacaaaagacuaauaucuggacucuauaaggaacuuaauaagaaaaaaaacgcccauuaaaaaguggacaaagaacaugaagagaauucuccaaagaacacauacagacagccagcaaauguaugaaaaaaugcacaaaaucacuaauaaucagagaaauacaaaucaaaaccacaguaagauaccaucucacaccaguugaaauggcuauuauuaaaaaguuaacagauuuuagcaagauugcagagaaaagggaauguuuaauauguuauuggugagaaugcaaauuaguucagccccuguggaaagaaagcaguuuggagauuucucaaagaacuaaaaauagaaauaccauucgcucagcagucccauuacuagaaaauaaaucauucuaccaaaaagacacuuacacucauauguuuaucacaguacuguucacaauaguaaagacauggaaucaacccaggugcccaucauugauggauuggauaaagaaaaugugauacauggccgggcgugguggcucaugccuguaaucccagcacuuugggaggcugaggugggcgggucaccugaggucaggaguucgagaccagccugaccaacaugguaaaaccccgucucuauuaaaaauacaaaauuagccaggcgagguggcgcaugccuguaaucccggcuacucggaaggcugaggcaggggaaucgcuugaacccgggagguggaaguugcggugagcugagaucgcaccauugcacuccagccugggcaacaagagcgaaacucugucucaaaaaaaaaaaaaaagugauacauauauaccaugcaauacugugcagcuaucaaaaagaaugaaauuguauccuuuacagcaacauggaugcagcuggaggccauuauucuaagcaaauuaacacagauacagaagaccaaauacuguguguucucacuuauaaguaggagcuaaacauuggguauacacgaacacaaaauugagaacaauagacacuggggauuccaaaagagaagagggagagaggggaguagcgguuggaaaaaaaccucucagguaccguauuugcuacugggcaacaggaucauuagaagccgaaaccucagcaucacgcaauauacccauguaacaaaccugcauauguacccccugaaucuaauauuuaaaauaaaauuuaaaauuuuuuaaaacgaauuuaugauauaaaaauaaauuuuaaaaaucuguguucuuugcccacauuuaaaugaguuuuuuugguugccauuguugucauugaguaguuugaguuccuuguaaauucugaauauuaguccuuuguuggaggcauagauuacagauguuuucucccauuguuagguugucuguucucucaauuauuuccuuugcuguacagaaguuuuucaguuaaacuaagucacuuuugucuauuuuuguuuuuuguuggauuuguuuuugagauguuagucauaaauucuuuguguaggccagugaacagagaguuuuuccuagguuuuuuuuaggacuuuuauaaaaguuucaagaucuugaauacaccuugcguuaauuuuuguuguuguuguuuuuccaccuugaguuaaauauuuuauauagugagaaguaggggcccaguuucauucuucugcauguggcaauccaguuuucccuguaccauuuauugaauagggucuccuuucccagcgaauguuuuugucagcuucguugaagaucaguuggcaaagguauguggcuuuauuucugggcucucuauucuguuccauugaucugugugucuauuuuuguaccaguaccaugcugcuuugguuacuauaaccuugcaguuuaauuugaaguuggguaaugugaugccuccagcuuuguucuuuuugcuuaguauugcuuaaucuauugagauucuuuuuuuuauuucauaugaguuuuagaauuguuuuuucuaauucagugaaacaugauguugguauuuugauagaaauuacauugaaucuguagauugcuuugggcggggaaguaugaguuauuuuaacauuaucgauucuucugauccaucagcaugggauguuguuccacuuauuugugucaucuacaguuucuuucaucaguguuuuguaguuuuccuuauagaggucuuucaccuccuugauuagauguguucccuggcauuuuacuuuuuuuuuuuuuuuuuuugguagcuuugguaaaugaaacugacuuugauuugguucucagcucgauuguuacuaguguauaaaauugcuucugguuuuuguaaguugauuuuguaugcugaaacuuuacugaguucguuucucaaagaagucuucguggaaucuuuagaguuaucuagguauaagaugauauugucagcaaacagagauaacuuggcuuccucuuuuccaacuuggaugacuuauuucuguugccucuuuucuggcugugacuuuuaguacuauacugaaucggaguguguaagugggcauuuuugucuuguucccauuuuuagcaggaauucuuucaacuuuucuccauucguaugauauugguuguaguuucguuguuugugacuuuuauuauuuugagauauguuccuucugugccuaguuuguugcagguuuuuaucaugagauguugaauuuuaccagaugcuguuuuugcgucuauugagauuauuauaugguuuuuguuuuuaauuuuguuuagguggugaauugcauuuauugauuugcauauguugaacuuccuuugcgugccuggaguaaaacccacuugaucaugguguauuaucuuuucgaaugcuguuguauucaauuugcuaauauuuucuugaggaauuuugcaucuauauucaucaggagauauugaucuguaguuuucuuuauuugaugaguccuuguuuggcuuugguauccgggugacacuggccuuguagaauuagaaagggaagauucccucuacuauuuuggaacaguuucagugggauugguacaaguucuuuguaugucugguaguauucagcucugaaucuguccucuccugagcuuguuguuguuguuguuguuguuguuguugggagauuuucaucuuacugauuuaaucuuaguacucauuauuggucuguucagggcuuccaguucuuucugguucaguacaaucuugggagguuguauguuuccaggaguuuacccacuuccucuagguuuucuaguuugugcauguagugaugcucauaguagucucugaugaccuuuuguauuucugcaguauccguuauaauaucuucuuuuuuauuuccgauuguguuuauucgaaucuucucucuucuugguuagucuagcuagcagucuguccguuuuguuucucuuuucaaagaacuaacuuuucauuucauugaucuuuuuguauuguguuuuuggucucagugucacuuacuuuuccucugaucuuuaugucuuuucuucugucaaauuuggauuuaguucuuguuuuucuguuucauugggugugacauuagguuguuaauuuguguguguguguguguguguguguguguguguguguguguuuagacagcaguauaaacuuuccucuuagcacugcuuuugcuguaucccagagguuugguauguuguaucuccuuuuucauucauuuaaacauuuuuuaaaauuuucaucuuaauuuuguuguugacccaaagaucguucaggaacauguugcugaauuuccauguauuuguauagcuucaagaauucccccuugggauugauuucuagcuuuauuucacugugguuuaagaagauacuugauaugauuucaauuuaaaaaaaaauucuuuaagacuuguuuuguggcauaccauauggccuauuuuggagaauguuucaugcaugaugaaaaagaauguauauucugcuauuuggggcuagaauguucugcaaaugucugccaaauacauuuaguuuagaguccaauuuaauucugguguuucuuuguugguuuuguguccugaugaucugucuagugcugucaguggaauauggaagucccccacuauuauuguauugcuguuuauaucuuuucuuaggucuaguaauauuaguuuuaugaaucuggguuugggucuucugguguuggguacauauauauuuaggauuguuaugucuuucuauugaauugaucccuuuauaauaacuuuguguauuuuuuuacuguuuuugauuuaaagucagcuuuaucugaucuaaguauagcuacuccuacuuguuuuugguuuccguuugcauggaguaucuuuuugcaccccuuucuucagucuguaaguuucuuuaccacuaaggugaguuuauuguaagcagcauauaguuggaucuuguuuucuaaauucguccugccaaucuuuaucuuuuaaguagagcauuuaacucauuuauguuuaagguaaauauugauaugugagguuuuauuccuguaguaauguuaauuguuaucacauugcuuuguaguuucguugguguaauuauuuuacaagaccuguggauuuuuuacuuucuuacauuuuuaugauggcaaguauugacccuucauuuccauguuuagacuucccuugaucauuuuuguagagccagucuagugaugacagauucccucaaugauuguuuuucuaggaaagacuuuauaucuccuuuauuccugaagcuuuuucuagcaggauacaaauuuucagguugacaguuuuuuuuuucuuuaagccuauuuugaaaauagaaucccagucucuucugacuuguaagucaucugccaggaagucugcuguuagucugauggaguuuccuuuguagguguccaaaugcuuuucucuugcugagaccacacagucugaugacucuaugucauggugaggcccuucuugcaauguauuuuucuggguuucauugagccucuuacucuggaugucuagaucacuugcuggacaagagaaguugguuuuccaaacuuuuugcuuucuuuucuuuucuuucucgagaauaccuacaauuccuagauccagacauuuuauuguagucuccuacuucucaaaggcuuuguucaucuuuaacauucuuuuuucuuucuucaaaagaccugucuuuauguucugagauuguuuauucuccuugaucuaguuuauuguugaagcuuucaucuguauuuuguaaauccuucagugaauuuuuuauuuucaaaagauuucauuuauauccuuaauugauauucuguuucuuuguguugguuuuucacauuuuccaugaaucucauugagcuuccuuaaaaaucaauauugugaauuauuuagcauuucaguaauguugguuaggauuuauugcuagagaguuagugugauccuuugaggguaucguaacacccuguuuuuucaaacuuccagaauuauuacacugguucuuucucaucuggaaaaacacauuucucaguuugaauuaauuuuuguuugaacgagacuguuuucccuugaggaugugacuguaauguauguugaauauggucauuuggcuuugcuucugggugcuuuuaguggcaaagacucuauaugaauuuccugguuuuagauagccuuugguggcuuucucaaacaucaggugugauagugguauacuuggcuugugagcaggcucacagccuccuguaagucaggguagcagaggucucaagaaguguaucuuguucccaaauugugugcauuuauguuaccagauuggguugugcaguucaucuccaggccaauaaguagcauuugcagguaugagucagcuucagugguaacagugggguuuacgcuugaccuuuguuugccagggaaagcucagauauucugaugacuggcagaggcaccagcccugacaaggguggcaggggagaggggagucauugggccacugguaaaaugcacugaggucucuuguggagaggggugggaugggggggugugggccaggugaugagcugucuuagcacccuggccucagcaggcaggaaugugauguuucccucucacacuccuauucuggugcucagguuguucaguucucuuagacacugcuguuuaucuccaagcugcaauguagccuagaacuacaggagaugcuugccccauggcuugacaguacacuucugugcuaucuggaaaugggugccaugcagacucugcucccuccccauggcaggaccccugaaacucuaggcagagagugggacaggacccaccuuucucaugaaccugggcccagaggccacugccaguggaacugcaguugccccucacagcuucagauagccugcccucugguuucuugugccagcuucccaugggagcagcaauuacugugucugcagcaguggguggagggggaggagaaguucccuucucuaugucugggcucaagcacagaggccacuuggccagugguacaggaccuuacuccucacuugcagugcugagcagaguuugugucucugugucucugccaggagcaggcauucacuugcagccccaagcagagagcucuuggggggcgcuggaaaaugcaugcuuugguuuccuuugucccagaggcuguccuuuuggugcacugcacuuuuccuucucuuaaaaguagcacuccuugugggauagauuauugggaacccugcagcaccccgggucuaacuagcacugugccacugcugccugcugagugggugcuggggaaugucagcaagagcucccaggauguggaagcacaagggcugagguucccugggcaagauaaaguccccugauggauaugcucugauaaugaugccuugccacagaugcucgagucuaggauggugggaaggugagcaacccagcgugagcuugcagucugguguaacacccucaagaaaucccuacccauaccacagucuagguuugugagagcagaggagcucucccauagaucgcauacuagcacucugccacaggaaugaaggaucccaaacacucucgcuuacccuuuccgugcaacaccaagucccuuggggcucccagccacucuuuuuuggccucucacuuccuucuuuuucuaugccuaaauuuuuuccugugauuuuuguguacuaguauucucucucugauauucuguuagagcugugauuauguguuuguaauuuugguucuuuuuugagaccgagucucucucugucgcccaggcuggacugcaguggugcgaucccggcucacugcaaccucugccucccagguucaagcaauucuccugccucagccucuugaguagcugggguuacaggcaccuaccacuaugccucccaauuuuuguauuuuuaguagagacgggguuucacgauguuggccaggcuggucuugaacuccugaccucaacugauccacccaccucagccuuccaaagcgcugggauuacaggcguaagccacugcgcccggcuguaauuuugguucuuuuuucugaagagaacuggaacuugaugucuuuagucagccaucuugaaccucucucucugauuaugauuauuauaauuaaccuugcaacccuugauaacugguuuccuuuaccuccgaaacacacaauaaaguacauaaaauuauuugcaagcuucuuguaaaagaaccauuuuuucuauuuaccauauugcauuuuuaaauuuauuuugacaaauucuuacgguuauuuccauuuuuauucaaugagaagcauuuucuugaauacguauauuuguauuuuuaugucaguauuugucauuaaguaguauauauuuauagaacaauaggaauaauacuuuauacaaaugaagucuugucuuucuaauacuaaggggcauuacaguuuucaaauauccuuugaaguagauaugucuuuuaauauaaaaggaaauaucaaaaaauagauggcuguucuacuguuccuguauuuucagguauuuuccuuaaccaauuucuuuuauuuuuuagguaccuagucgauagucgcugguucaaacaguggaaaaaauauguuggcuuugacaguugggacaaauaccagaugggagaucaaaauguguauccuggacccauugauaacucuggacuucucaaaggucauuauuuucuuccuucagucaaguuguaaauguguuaaauuucauuauauaaaugucaguggguugaauuuggaaaauguuagcgcaaauaaguugauaaaguuuugcauuacagauuuuaccuaaugaacucauuauucuaauaaguuauuaaaaauuuuauuaguuauuauucuguaugacaaguuuuguuuuucauuuaugauguaauaagguuuuauuguuguuuaaacccuuaaaugaagaacugauuucuucauuuaaagauuucauuauuaaguaaucauuauuuaaugauuauuuauuacuaaauaauaagacucauuauuuguuauuaaauaauuaaacacugauuauuuugagaaaugcuaugucacauauuguuuuuccuaguggacacaugacauuuuuuaaaauuugaggaauaaucauauaugcuuaaguucuuaaauuuuugcauuagcuuucuacaacccucacuacuugccaguccuucuauauaccucuuauuauggguaaagggaacaaaacauaaguaccagaacuuccauuucuaacagugguucucaaaacacuguguaucaggcaacggaaaacagugauccuugagagaugcgaaacaaaauagguaagcccuccaacugccuucaguuuacugcauuaaaagagauuuccaagacacaacaugggaagaugaaacccaugcagacccuugcuaucucccuuaguugaggaaacagaguuugcagucuaggaaaaccaaggcuacaagaguccaggaaaauaccagaaaguagugaguagcucagagagagagagaccuagacccccccccauaggguugcucuuaagucuucaacuauuaaaccgcacuuugcauauaagaaaacugcccaaggucagacaagguaccacugaaaagaaggaacaaucaucgaggcuaauauaggauugggaaucguuuguguucucagcagccagaguggaaaaccacauaauuuagaguagacuucugagaacaguuuuacuuauguaauagggugaaauuaauuuuccugcucugcuaaccugaaagcaucaaacuauuucgaagaaacuuaacugcauuucagaauaaaacuugaguauuuauaagaauacaaaaauauccagcauacaaaaauguaaaauuuauaauggcuuggaucugaccaaauauuaccuggcaugugaagaagcaggaaaauaugaucaauaaugacaagcaaugucaaucuuaaaaacaaaucucccccacaagacauggaaaaaauuaauaaagaacagaugagacaaauacaaaauuaaaaguugcuagauugaaacccagcucuaugaauaaucacauuaaauguaaacaccucaacuaaagguagugagggugagacuagauuaaaaaguuaagaaccagcuauaacugccuacaagaaacucacuuuaaaugcaagaacacagauagauuaagauauggaacaagauaacaccaggcugugguaagcaagacuaacccccagugauccucacucuuguauaauacucuccccuuugaguguaggugaaaccuguaaauaggaugaagauaucacucuugugauuauguuauguggcaaaaagagacuauccuggugaacguaaucuaaucacacauacccuuuaaaaacagagaguuuucucugucugguggcaaaagaauucagagaugcaugaaagagggucaauaugucauugcugguuugaaguuggaaggaaucaugugagaugcaaggcaggcagccucuaggaacagagaguggccucagguugacagccagcaaggaaacgggaaccucaaacucacaaccaugaguaacugaauucugccaacaacugaaugggcuuggaagcagauucucccucagaccuucagauaagagcccagcaggggugauaucuugacuucagccuuguaaagcccuaagcacaaauccauuugggcccuccuuaacuacugacccacagaacugugaacuaauaaaucggugauguuuaagccacuaugguaauucauuauguaacaguggaaaacuaauaacacaugcuaacacuguuuuuuaaaaagccggagacauuaaguuucagaauaaagaacauaaucagggauagaaaaggucacuugauaaugacuaaugggaugggauaguucaucaagagaauauaguaauccuaaauacauaccuaccuaauggcauaacuugaaaauaugugaagaagagugaugucagcaggaugauagaauagaaagucccagcccccaacacccaacagaaacacugaaguaacaauggaccagacucuuuaugagaaacccaagauccaguuaagaauuuguaguacuccagaugagcccaaaacugagaacaacaacauugaaaugaguaagaacaauuuuauuuugcccacaucagccccuccuccaaggagucuuagcuuagucucaagagagauugucucagaucaggaccucucccuugggggaaaagagggagaucacgugcuuaauuuuccagcccuucaguguacuacccaacaggccaguuuucuaaaaaaaaauuuugaucaccuuacauagagugcugaaggaaccagcauaguucugaugccugggggcaguuaacaaaggaaagaggguaggugguugcugcagcuggaaggcucugagagauugagagaaggcuaagaaccugaggcuucucucccaggaaggaaggagaggagugggggcauccugcacugcccaugccuuucagugugcugcuugaggggccaguuucugucaugccuuauuguaccagagagcugacauaguucaaauaacugggggaaguuaacaacaaaagaaaagggauagguggcuugcugcagcugccacaacccuguaauauugggagaaggcauagaaccugagacuugucuuccaaggaagaggaaaaggaguggaguguacccccaguguuccagucuuucaggguacugcuugaaggacugacuucugucuuaccuuacccaguguuuggugggggcagauaggaacaaaggaagaggggcaaguggcuugcugcacucagcacagcucuacaagauuugagaaggcagagaacucaaggaagagggagacaagugggauguuccucuaauguucuggucugcaguaugauguaagauaccagaaggaggaagagauuauggguuucugaaaaaaaaggaaaucaacaaauccuucuaauuaggaaucugcaugcacaaguacagaaaagacauauccacaaaaaaaguuugagauguucucagaaucucuagccaggcuuuuggguggaagugaagcuauuugccuuucaaagccaguugauaaagacugggagagagguggcuguuucuucaguugcacaaacaccugugcaaagcuacaagaacucaaucagggaaacgugacacaaaaaaacaaaaucuccagaaacugacccuaaagaaauagagaugaauugccugacagagaauucaaaauaauugucuuauaaagcucacugaguuacacgaaaacauagacaacuuaacaaaacaagaaaaauaaaaauucacaaaauuaaaauaucaacaaggagcuaaaaauuaugaagaaccaaacaaauuuuggaauacgauaacugaaaaauucacuagaggucuucaacagcagacuuggacaaguagaugaauuggcaaacuuguagacggaucauuugaaauuaucuaaucagaggauuaaaaauaauaaaaaagcauaaaggaaguccaagugacuucugggacaccaucaaaugaaccaauuuguguguauggaaguuccagaaggaggaaagugagaggggcagaaagcauauuuaaagacauacuggcugaggccagguguaguggcucacaccuguaaucccagcacugugggaggccaaaguggacggaucacaugaacacaggaguucgagaucagcuugggcaacauggugaaaccuugucucuagaauaaauacaaaaaaaauaauccagccagucgcgauggcucacaccuguaaucccagcacuuugggaggccgaggcaggaggaucacaaggucaagagaucgagaccauucuggccaacauggugaaaccccgucucuauuaaaaauacaaaaaauuagcugggugugguggcgcgcacuuguagucccaucuacucaggaggcugaggcaggagaaucgcuugaaccuggaaggcagcgguucagcaagcugagaucaugcuacugcacucuagccuggcgacagagcaagacuccaucucaaaaaaauaaaauaacauaauaugugggugguggcauacaccuguagucccaguacuugggaggcugaggugagaugauugcuucagcccaggagacagagguuguauggagccgagauuguaccacugcacuccagcaugggugacagaguaagacccugucuugcaaaaaaaaaaaaaaaaaaaaaaagaaugagugaaauaauggcugaaacuuccugaaacugggaagggaaauuggacaucuacauucacgaagcccaaagaguugaacaacacuguuaaucaacuugaccuaauugaauuuuguaaaacauuccuuguacccauuaagaaucacacccuaucccuucuuugcugccaccccccacucuagacaacuacuaaucuccuuugucuguauguauuugcuuauucuggacaucucauauaaauggaaucauacaauauguguguuuuuuuguuuauuuuauuuuuugagauggagucucacucuguugcccaggcuagaaucucagcucacugcaaccuccgcaucccagguucgagcgauuauccuaccucagccugccaaguagcugggauuacagaugcgugccaccacaccuggcugaucuuugcauuuuuguugagaugggguuucaccacguuggccaggcuggucucugaacuccugaccucaggugauccauccgccucagucccccaaaguacugggauuacagguguuagccacugugccuggcccaauaugaauucuuuuauguuugucuucuuuuauuuaggacagcacaauguuuucauguuuuauccauguuguugcaugaaucaguacuugauuucuuuuuauagaugaaugauuucuacugaauggugcacauuuacuuuaugcacucaucaguugauggacauuugaguuguuuucacguuuuggcucuucuggauauuguugcuaugaacauucauguaaaaguuuuuggguagauaauguguuuuccuuucuaauggguagauaccuagacaugaaauuguugggucuuuuuaaacuucguuguuuaacuauuuuaggaacucuuagacuguuuuuccaaagucauugcauccuuuuacaucauugcuggcaguguaugaggauucauugcuucacauuauuaccaacacuuguucuugucuguccuuuuuauuauagccguccaagugggugugaagugguaucucauugugauuuuugacgugcauuucccuagugauugaugauaaguucuuuuuuugugugcuuguuauauaucuuuuuuagugaaauacauucagauccugugccuauuuuuaauagaauuguuugucuuuuuauuguuguauuuucaguuuguuauuuauuuaggaugcuagacccuuaucagauguaugauuugcaaaaauuuuuucuuauucugugggcuuuuuauauucuugauggugaccuuugaagcacaaaaguuuuuuaauuuuaaguccaauuugccuuuuuuuucuuuguugcuugugcuuuuggugucagagagcauugcugaaaccaagguugcaaagauuuauguaagauuuauacuuacauuuucuuuuacgaguuuuauaguuuuggcuguuacauuuacagcauuggucuacuuuaaguuaguuuuguauauggugugcaguaguguucuaacuucauccuuuugcauguggauauuaaguuguccaguaagcuuuuuaauagaaaaggauaagcugauccaaaaauucauguggaaauucaaaugacagaauggcugaaacaacuuugaauuuuaaaauaaaaucauagaaguuaacacuauuugauuucaauccuuauuuuaaagcuguaauaauaaauauaguugauauugauauaaagacaaauacaucaguugaccagauuagagaauccagaaauagaucuacacauauauagucauucagcuuuagaaaaagguaaaagaggaauucacuggcaaaaggauagucuuuuaaacaaaugcgccuugaguauuuggauaucuguuugcaaaaaacugaauuuugaugcauacauggcacuguauacaguauuaauccaaaauggauuauagaccugaauguaaaaacuaaaacuuuuaggaaaaagucuuugcgauguuguauuagccaaaguuuucuuggauaugauucaaaagcaagguugcuaaaagaaaaaauguaguugugucucaucaguaacaaaagcuucuuuaaaugacacuguuaagagaaagaaaagagaagccacagugugggagaagauauuuacaaucauguagcagauaaaagacuuguuuguagaauauacaguuuauaaaacucauuuugaagaaaacguaaagcccaauggaaaaaguaggcaaaagauuugaacacauaauucaccaaagaagauauagguuucaaaaagcacgugcaaaaaugcucaacauaauucauauuagagaaaugaagauuaaaaccacaaugagaaaacugauccauaccaaguguuggcaagauuguagaggaaguagaacucucauacacuguuucuaucgaugucauaucauaaaagcacuucagaaaauagucuggcaguuucuuaacaaguuagacauacguuuauuguagagcccagucauuccacuccuagguauuuacccagaauaaaugaaagcauuuuauccauaugaccgauuguacacaaauggucauacaguguuauuuguaauagaaaaaguugugaacaacucaaaugcccaucaacaccugaauggagaaacaaaauguagcauauccauacaaugaaaucccacucagcaauuaaaagaaauuaaguauugauauguaaaaacauggauagaucucaaaauaauuacauggcaugaacaaagccaaacaaaaaagaggacauacuauuuuuauguaagacucuagaaauugcaaauucgucuauaguaacagaaagcaaguacuguuuucauguacaagucuagaaaaugcaaaguagacuauaguugcaaaacacagaauaaguaacauucucuuaaucccucagguuuuuucucgcuucuugauuuuuauuguuuauaucuuauugggaauacuguguucucauuauugaaaugcuaccaagaacaauuuugcuuuccguaucuguuaauuaagacuaacuuaggacaagaaaaaucuccauuaaguuggauauaacucagugagauauuucuguuccucuuucugcauuuuaaaaauucacauggacagauaacaagucucagauuaggacugugauguagguaugguuccagaaauuucuucuagaucuguggccugucuuauacuaaauuuuuuuagucuagcuagaaauuugaaaguggacugugaauuagaaucacaucugaagaauuaccuccauuuuaguucuugggagaaauccagauugugggccuucuggaauaaugaaaugguucacaagaugcccauuugugauuucugucaugguuccuagcccgugugucuuggugucauuguaaaagguuguugauuugcuucugaauuuccuacaaaagcugaugcuagaaugaauauuguuaccauaugagggaucucugcuacucaaaauaugugggaaacacucuuuugucaagucucuugacuaacaguuacuccauaguauuuuuuaaagaaccuaauaaaagaauuauguuuuuaaauauugcuuuuugauuuaugguacaaacugaaaguuuuaaagcaauaguuuauuuugaaauauguauggcaggcuuguccaaccugcagcccaugggcugcaugcggcccaggauggcuuugaauacagccaaacacaaauuuguaaacuuucuuaaaacauuaugaguuuuuuuuuaugauuuuuuuaagcucaucaacuauuguuaguguuacaauucuuccaauacggcccagagaaacccaaaaauuggacaccccugauguaagggagcugaauugcuuuagagcuuaaaacuuguuuuaaauacuuaaauuagccuucaugaguuuaauuuguaauguguccaaacaaaguauuuagaguuagguauugaguuuauuuuuucuuuugcagauggugaugcccagucacuuaaggaacaccuuauugaugaauuggauuacauacuguugccaacugaagguuggaauaaacuugucagcugguacacauugauggaaggucaagagccaauagcacgaaagguacauuuuaauaauaacugacuauaaauauuauuuuucuugauuaguucacauuuuauuauuaauucaaugaauugugaaguuucaucacuuaucuuagagaaaaagccagcaaaauaaccguacacuguguuacaauaauggcaaguaacauguuaagaagguuuacuuaugcuagccacuauuguaaguauguauuauugauuaauccucuauauauagagagaaaacucuguaagguaaguaguaggaaaugaggauaaaaaguuaggaucuaguuauuuuagaaagucauaucaggauacagacuuuggcaaccugacccuguuuucugugcugcacuguuuuugauaaaacaauuagaaaacaaugaagaaacuaaaaguugaagcaauguuuuuuggaacauaaaaauuuuuuaaacuugaaaauguagauuuuuuuucauauccuuuaacauuuuaaaauuguagucuagaaacauuaagaauaaccaauuucguuuuuuuagggaacuaaaaagcaauaaguaaggguguugcuguaguagaauaccaaauauucaagguaaaugagugaaccuuacacauguauuugaucauuuauuguaggaggggugggaggcugagaagggaccaaaaucucuuggcauaauuuuguaucugguuugggucccccgacccuccccccaucccccgccacauagaaacaauuaaaaaguuggauuagguaacauaaggguaaaaaaaccucuaguagaccuaacuauauuugaauuuauuuggaauugaugcuacaaaguugccauguuaacaauuuguauuuguguauccaugguuuuagguauauuagaagcuaaccuuggaucuuauuuucugaauagaucuugaauguaccuuuuauuuauuuuuguuuaguuuuauuccuuaguuucacucagccacuucaaaauuagaauuucucuguuguaggaaugcuagccuuauagaucugugaaaugaucuaguugcuuuaucuauaguugcuggagaauugaguguuuugaucaaagguagccuauuuagcuguaaaacugucuagaauuauuucauuccuaggauaaaggaaaauuuguguccaaaauaucucuaaagguauuacacuguauuccuuuaaucuuaaugauacacuuuuuuuucuuauaaauguagcacauuauacacuagcggucuucaguaugauaaacagaucaacuaccaauuucauugccauuacucuuugaaauaguccucauugagaguucuugaaaccugugucuaauaacaaaguaaaauauaaucaaaaauuucacacaaguagaagaaaaaacauugacaaaucucuugggagaccacauacuuauuuuuaacaagaugaaugaaauauauucaaccuguaaaauaguuugcaaauguucaugugcuauauuacauugcguggaguucuuauuacagaugcaauuuccuacaacauuaaaucugcaguaaaauuuaauuaaucacacuuaaauuugggaauuucauuugcauuuucacuguggcccacaugacugaugcagguggaacucaaagaaguaaauagaccagcuuauagugucugaagcccaacuuucaauguuacccaucucugauugcauuaaagaaucuaggauuggugguuccccuagcuauaaugcagaaaccaaguuaaacaucuuccuguaccucaaagaucucuaaaaugcgucauuuauagugucaacacucaaagaauggacgaaaagaaagcaaggauauaagcagaaaauacgauggaaucaaaauccaagagaaacagcagacaauagaaacagacccauaagaaacccagguaauugaguuaguagauuuuagaauagugggcuuauuaugcuuaaaaaaaaaaaaaaaggcagaugagaaguagggcaaaacuauuaaagaagaagcaaauagaauucuaaaacuaauaauauggaaauuuuauggauuuaauguuugggaauaaaauuauuagaccaaacagaacugaagagaaaauuuguaaacuaaaugauuugucaauagaaaauauagagucuaaagcuuagagagacaaaagaauagaaaauacagaaaaaagcuaaggcauaaauggaaugcaguaaguaaguuuaacaugcauacauauaguuggaaucuuggagaggaaagaaagaguggguagaacuaauaccaaaggacguaauagcugagaauuuucccaaacugagaaaggugucaugcuuuaaagaaaugcuaugaaucccaaacugaaauaauacaaacaaaacuguaccuaguacaaauguugaaaagcaaaggcaaaaaaauuucuaauaauagccagagaaaaagacauguuaucuucaaaauaaggauaagacaaaauaaugauuucucaagagaaaccauggaagccagaaaacaauggacuuugauauguuaaaagaaaauaacugccaauguaggauucugugacuaagaaaauaauccuucagggaugaaggugaaaaaagccauuuucaaaugaaaacuaauagaauuuguuaccugcagacguguauuaaaggcacuacaaaauaaucuuaagaauggaaggaaaauuauuccagaugaaagcuuggagaugcaggaaaacaguguagacugacaaaauguaaauguugugaguaagucuuaagauggacuguugaaaacauuaauaauaauuuuuauggaguugaaaauguguauagaauuaacuacacaauaguguuagcauguaaguuaagauaauauucucuacuauguucccuggugauccccagcuccucauauccauauucuugggcacucuucuuccauguuguacugagguuggucuguguggccaauagcauauagcaguacucaugguacaucgcuuucgagauuagguuauaaaaaaacaccgcggcuuacaucuugggugcacacgcacucuagcugucucucuuucucauuucucacucggggaauucaacugcauauggcgaggacacucaggcagccuauggagaggcccacauggugaggaacugagaucucuggccaauagagaggaacggaggccugcaacaaccaugugagugaccuuggaaguggauccuuuaguucuaguuuagcuuucagaugauugaaaccccagccauaccuugagagcaaccucaugagaaacucuacaccaaaucaacccaguuaagcugcucccagauucuugacccucagaaacauugugagauaauguuugcuguguuaagcugguaaauuuugggguaauuuauuaugcagcaauagauaacuaauacuaaucaugguaccuguaaauaggugcugauaugaaaacuugaaauguggcguggcuuuggagcugacagugaauagagguugucagaacuuuaagaguaucaaugaaagcuuaaagggccuuaaacaaaccguuaguagauuacuagacuuugagauagcugccagugagaacuugaagugaggaaagucuuacuggaaacugguagaaaguggucuuuguuauacagugguagaguaaguuuagcaacauguugccugcaguaaacugaaagguuaaagauaguauuuaaugaaauuauaggucugccaaaguguuaaaaguacugccuaguuucuuuuuguguugguuauagucagaugugagagaagagaaauacacuaaagaaaggauuguucaauaaaacagagccaauauuuacuaguuuugaagauuccuagucccuccagauggcaaacggugcuaauacuaagcaguguuucugagcaaagauaaaacucagaguauucucagaaaaaaagugugaucuaaucuggcagccaagggugugacuguaaguuaccucagaaaaaucaaaggucaugccucacaguacuauucagacaaaaggcccuauaaaguauuuaaggguuaacuuagagguuguccugucaguaguaauauuaauuaauauuaagggugucuucucaauauguggcuucuaagaacaggagggcuucaagaagcuuacgggcaaccccuuagcuuucucagcauaaagccaaaguagagaggacuuauccuacagaacauuuguggauauggcuuuugucuaauggaaugaacuccaguaagauccaguggagaccuacauuguuuucgaauuaccucgcagaaccacugccauuuuggacugcagaagcaguauuaaaugaaagacgccuuugaccucccaaacuccaauaaguaggaaucaggcugaaaauuuacuuaacuucaagcaugugcuaaugcaugaaaaaaggaugacucagagaacagaaccaaauguuagauagaauaauuuucaggcaaggguagaacugaguuccagucaaggaauuucuaguauuuguccagguagauuucauaaucguuauggaccauugauuccuuuguacguccuauuuccccucuuacaaaacaggaauauuuaaaaggcuauguucugugugcuucauuguuuuauuuuggguguauggggggcagaaaacuugucucuuaguucacaggccuauacaucaagaggcacuacaguagucccccuuaucuaugguuuugcuuuccgcgauuucaguuaccugcaagcaaccaugguccaaaaauauuaagugggaaauucuggaaauaaacaauucgugaguuuuaaauugugcaccauucugaguaacaugaugccaucccacuccauguccuccccauggacacuauacacuaccuucccguuugucacuuaguagccaucuugguuaucaaucuacugucacagugcuuuguugaagggcauuaguagcauaaugcagcguuacaauguacaucauucacuucaccucuucucaucagguagacauuuaaucaucucauaucauuacaagaaaaagggugaguacaauaugauaagcuaccuugagagaccacauacacauaaccuuuauuauaguauauuguucuaauuguucuauuuuauuauuagcuauuguuaaucucuuagugugcguaauuaauaaauuaaacuucgucauagguauguauguuuguaaaggaaaaaacauagugaauauagggauuagugugcuauuuguaguuucaggcauccacuaggggucucggaauauaugucuucaaaggcuuauagaaaauuuauaauuugucaauuauagaugacaaauuucugaacuccagguugcuaaaaugaauugagacuaguuggggccuuuggaagaacugaguguauuuuguauuuugggggaaggaacugugaaucauugggggccaggggguagacugugguagccagccucaaagaugcuccccagugauugugaccucuuagaauccuuagucugguguaauccuuucccacauuguacgacaguuggucuaugcagucaguagcauguggcagaaguggugguaugucacuucugagauuaguccuuaauggaugccuguacuucuauugggagugcacauaccucccucauccccuccccucggaucacucacucugggcgaagccauaacuuugcccuuaacuuacccuauagagagacucacauaaugaggaacagaggcugccaacagcuacaugagugagcuuguaauuaagauuugaacaacaugauuaaccaccauaaccuaauugacauguacauuguacuuagucauugcagaauacacauuucuauuaaguggaauuuuuaagcaaaauugaccauauucuggguuaucaaaauuccaguaaacuucaaaugauagaaauuguucacuguauuuucugucauuagugggauuaagcuaaaaucaguaacaaagagauaaccugauuaucccccaacuaucuagaaauggaaaaauauacuuuuaaguaauccuugaggcaaagagaagaaugaaaauuagacauauuuuaaacugaauaauaauuaaaauacaacuuaaaagauuggcugaaauucucagaaggaauuuuauagcuucagugcaaauauuggaaaagaaagugaaaaucuauugucucaacaaguuaaggaaauugaacuuaagaagaaacauuauaauguagacauuaacaaaauagaaaacaaaccuacauuaaaugaacaaaauucagucauuguagagagcagugaaauuagaccaguaaaguaaagaugaguccuggcaggauuguuuaagaauaaaaagagaguaggcacaaauaaccuauauugcgaaugaaaaaggaaacaucauagcagagucuaaagacuuuuuugaaaagauuauguuuugaacaguuuuauguaaauuugaaaauuuagaugaaguggauaauuucuagacaaacagaacuuuaaaaugucaauacaguaagaaauaggaaacucgaauucaccuaugugauuaaagaaauugagucauugaaaaccuucccacaaagaaagcuucaggccaagaaagcuuuaccaguguauucuaccaaauauuuagggaagccauaaaccaauaccacacagauucuuucugagaauagaagcaguacuccccaacuuauuuuauaaggcuagcauaaacaugacauaaaaccugaaggacauuacaagaaagaaaaauuacaggcuggucucacucaugaacauagaugcuuaaguccuaaacacaauguuagcaagacaaauccagcauuauguaaaaaggacaaaaaugaccaagguggauauuuuucaaagaauacaauuuuaacuuugaaaagcauucauaauuuuagcagacuaaaggagaaaaauaaucucaauagagauacaaagaacauuugaugcucaacauccauguaugaucuuaaaaaaaaaaacuccuagaaaacuaggacuagaaaucgccuguaaauauuguacuuauugguaaaauauuaaaaguucuucccaagucaagaauaacuguguuagaaaucuuagccaguaugguaauauaguaaaaagaacuaaaagagugaaucuuguaaaagaagauacaagacugucaguguuuuuagaaggcacgauucuacagguuuaaaauuccaaaaauauguacugguaaacaauuagaauuaauagguaaauuuaacagguugccugauauaagggcaguauagggaaaccaguuuuuuauuggcaacaaauaaaguuuauuuuuauuuguacaaauuagugguguacaugagaaaaucuguuacauauauauaauaaguaguaaugaagucaggguauuuuggguguccuucacccaaauucaauacauuuuuguuaaguauagucacccugcucugcuaccaaacauugaauuuauuccauuuuacuguauguuuguacuuuuaagccaguucccuucauccuucccugcucccuuccuuauccuucccagugucuguuaucuaucuuuccacucuuuacuucaugugaucaaauuuuuuagcuuccacguaaaaguaagaacagaugauauuugucguuuugucccuggcuuauuucacuuaauauaacgaccuccggcuucauccauguugcucaaaagacaugauuucauucuuuguaauggcggaauaguacuccauuguuuauauauauauacaauauuuauccauucauccauugaugagcaccuagguugguuccauaucuugcuauuguagauagugcuacaauaaacaugugagugcagguaucccuuucauauacugacuucuuuuccuuuggguagauaugcgguaguaggauugcuggauucaaugguaauucuguuuuuagauuuuugagaaucuccacacuguuuucuguaguggcuguacuaguuuacauucccaucaacaguguauaaguguucccuuuucuccgcaucuucgcuaacaucuguugucuuuugucuuuuuaauaauaaccauuauggcuugguuaaggugauaucucauugugguuuugauuugcauuucucugaugauuagugauguugaacauuuuuauauaccuguuggccauucauuugucuuuugagaaaugucuauucauguccuuugccuacuuuuaaaugggauugauuuuuaccuguugaguuguugaguccuuguauauucuggauauuaauccucuguuggaugaauagcuuauaaauauuuucuacacuucaacagguugucucuuaauaaaguugaauuuuaaaauaacauuuacaggucaaaauacuuaggaauaaaccuaguaagaacuguguuuuucuauacugaaaauugugaaacauuacuggguaaaauuaaagaagacuuaaugaauuaauggaucuagccugaaggucuagaagcugaagauguaggagaaggaguaggucacuaauguuuuucuguaaagggccagauaguaaauauuuuuagcuuuaugcgcccuuuaguuucuuuugaaaugacuaaacuuugcugauuuaggcauaaaagcagcccuagauaauuaauaauuggguaugaaaguagccguaaacauaaaugaauggggguuguuguguuccgguaaagcacuauauacaaaaauagauugauggguagauuuagccaucuaaaccuaaguuuagccaaacuuaguucauaaguuugcccaucacuagaucuaggcauuggcuuuaaugucuaccagcaucacaaaaaaaggagcaacuagauguuugcauccuguucagagugaguguaugucaccaucuaugcaguggucuaaaguaaaaauuacaagaauaggaaagauggagaacuucuagguuaaaagacacuuaagagacgaauuagucuauuggcaauauauggaccuuauuuggauccugauucaaacaauacauuaaaaaugagacagaaggaaaaauuugacuuuugacuggauauuugauauuaauugauuaguuuuaauuuuuuaggugugaugaugguauugugguuauguuugagucuuuguuucugaauauucugaaguauuuguggauggaaaaucacauacauaggauuuguuucuuacacauuaagaacuaugauuucauaguuuuguuguauuuaucuacuucucugucuucaccguuaucuguucucacucaggcuccaggaucuaggucuaauuuaucugcaccaaauguagguacucaauaaaugcuuuuaaaaugaaugaagcuagcucuacaaaagaguaagucagucuguuagaggccugguauuaugaaauuguuuauauaguacuagauuuuuuuagaaauuacuuauauuucucuucccauuucagggagggagcauacuuggaaugaagguaaaguuuccaugaaacuuuucauacacagacauaaaggguagacuauauuagguuuauuuaauauguuuaauggccuuguaaaaaauacccuaaauauucacagcaaaaaaugaacaaauagaaauuauuuauuuuaauccucuguaaacuuauauguagcucaaauacuuaguaaagagacuuugccuucauuaugguuauaaauuaaugaaaauauguuuacauauccauaagucuuccauuuuggacaaggagccagauuucaucauguacucacuuuuuauuuaugguaauauaacaguguuauaauucacuuagaguaaacauuauaacuaucaucuauaauacugaaacauaacuaucacuucugaauaucccccuuccgaucuuauuucaaauacauauuuuaauaguuauaauaauuagguaaauaaaacuauacuuuuuuuauaagcuuguuucuuccuguuagucuucaugaccaucauuuucaaugcauacauuuuuaauuaagguaggaaggagauuuuauguaaacaaauaugaaggagauuauauaagcaaauaaucuacaugugaccauuacacauugauucguaaaugugcuaauuauuuuucuuuuuauggugcuguuauuuucaagcuuuaauaguacauauaguaugaccuuuucauauaaaaauaguuugacaacaaacucauauuuuuaaaaacaacaccuuguuaauacacuacuuugggaauuaguaaaauaaauaucuuauaaauauaguagcaguuuucugaguagugaugaugaagauuuuagcaauguaaaauguaggaaagaagaaaaaaauguugagaaaaauucugaaucccaguaguguggacuuugaaauauucuugauauuuuguuuucauagaucucacaauaacucugacaguuaagucaccagguucuuuccaggaaaauaucuauaguauuaugaaaauguauuuucauuuuuagaaaacuaugccuauuuagaaaguauauaccucaauauaaaucauaauggggguuuuguuuuuuaaccauacuuauuccuuuuccugcuuuguguuggucauuccauuuuucuuuuucuuccauaaaaaugaggccugcaguuuaccuuaguuuuaguuacuaccagugauuaguagcuacuuuaauguaguuuauuuuaggauuuuacucagcuauugagccccaguauagaaauuacugacugauaagaauauuugauuccuuguuucucuacuuaaauauaacuacaaguaaucuuauaaaauuaaauguuacuacauuuguaaccaugaaguaaaucagccuaagauguuuaaaacaaaucucaguaguuuaacauauugguuuuacaaaacaaauuacauuuauuagcagaaggagagguacaggcugcuaccuguuuaaaaaaauuguaacaaguaugauuaagaaaauauauaugacaaaguaucauaaaaauguguguuggauuagauaguaaauacuagaugaacugcauuugaauuuuuucaaugcagugaaagacaaguuuguaaaguccucuuuugaauugauguaagcuugugaguauaucccaacggucauuuggagccucccuuuugccauauuugucuaauggaucacauaucaggccuauuacuauuuucagaaacaguauucaugacugaaauccuacaguuaaccuuuagaagaucgaaaggaauuauacuuauuuaaaaggugaccuuaauauauacauauuuccuuuuuaugcuuuauggcuugcaugcuuaacagcuuucuuuuaauugcugcauagaauuacuaaguguguaguuaaaggucaaacaaaguaagucacuguagggugaaacuaacauaucaguuaccuagccauagcuggauauuuuggcaacagugauuuggaguuaucauuuuaauagauauauuuuaacauaacagugauaauauagccauuaaguucaaauuguauaaacaacuuuuuaaagguuuucugcuugggaucacuacuaaaagcuaagaaguauguuuguaucuucaaucagaacucuguuuauuuguauuauaauguauaaacagagaacguacauauauauuugcacauagucauuuuggguaaucuuucucauuauaaauacugaauauuaauuauuuaugguguacuaguguaucuucauagaucaauagaaugccuuuccaaacugucacuuaauguuuuaaaaucaugauuauuucuuucuuuuaaauaucaaaauuuccaaaaaguuuucuugcuuuugaaguuuuaacuauccaauaucuuuuuuuauauauauuggcaggcuuuaauagugacugguuuuucacuggagaucugcaguuuucuaaagucucuuuaaauguauuguuauuagagugaaauauauugauauaggugacacugauuuguuuuguuucauuauuuuaggugguugaacaggguauguuuguaaagcacugcaaaguagaaguauaucucacagaauugaagcuaugugaaaauggaaacaugaauaauguuguaacucgaagauuuagcaaagcugacacaauagguaaugcaagauccugucuuguuuuuaauccauugcuauuagauauuuaauuagaauuaucuuuguauaugcuacuuggaugauaaccauuuuaaggauuuauauauagacauuugauuuccagcuuugauacaaugucuuagaguuaaauuauuuauuguuucuuguaugcuuuugcauuuauuaaaugaauuuuaacauuugugcuguuuugcuuuuuuauaaaacaucaaauaauuauuguuuuuauuuagcaacuggugugucauuuguaacauagaccuuuaaauaaaaacuuaauuaaaacuugguaagguagcauggaaaaugacaauugguuauuuccuuuuuucucuuaguuuauucuuugguacuauaaauacagucaaguagccaaggcagcaggcuuagcguuauuuugacacauugauuuuucaaauuaaugaguagcguaagcaguuguaagucaaauauaaguggacuuaauucucucuauauauuaaaauauauauaaauuguuuucuuucuauuuaaaagacacauuuuuaauuuuagguaaagaauagauugaauaaaauguuuuuuaaaauaaaugauuaugaauuuaauaaaaauuacaugguuuuuguuucauaaaacucaagaauuuuuaaaguauuuaauuucaaaugaaguuguaaaacaagauuaaugguaauaccauugaucuuagaaaauacaaaugaacagugaagaaggacacauaacuuguagaacccagcuuggaaacagauuagccaauuuaugaauuauagcguggcauaagauuuccuuguuggaaccagucauuaaaguaaaugaaaguauuucugaauuucauuaacugcauuuggcuuucuuucaccacuuacccacuucacagcuggaaaauccuuuuaacccguauuuuuuaugaaauaguagcauuauucaaguacucagugcuugguuaauccuaauguuugcaccaaauaaaauacagcauuauguuaugaaucuuuauucuccccucuucauuuagcuagaacauuuauaaguucgagauuaaguuucaauaagcugauaguuggccggacgcaguggcucacaccuguaaucccagcacuuugggaggcucaggcggguggaucgccugaagugaggaguucgagaccagccuggccaacauggugaaaccccaucucuacuaaaaguacaaaaauuagccggguguagugggugugcgccuguagucccagcuacuugggaggcugaggcaaaaaaauugcuugaaccgggagguggagguugcagugggccgaaaccguaccucuguacucuagccuggcaacagagugagacuuuaucucaaaaaaaaaaaaaaaagcccauagagucaucuuucuaaaaugaaugcuuaaaagauaaggaauuucauauguaaguuuuauuauaauuauuauuacagauaaauugcuugacuuuugaauuuccacauuuguagaauauauucaggaaaauaagauauuucuacauauuaaaaacaaaguuuucaacauaugaaaauuauuuuaaucauaugaauauguacaugagaagagucuauaaauuuaauaaggguagucuguuaaaauuaauucagagagucgucucugaaguuuauagccaauuggaauauaaaugagaagcuaccucuuaaaauaauguuuucuaguuauuuuuaaaguuugguauuuucuucucucccugccucauuuugauaggaaaauuaaauaugagaccaucagagauauuauuuuagaacauuauuauacuagguauuuugaaacucaggaaaaucagcaacugauuuaauuucugaauucaaaacaagaauuauggguucucaugauaagaacuguguaagaauuugucacgaagauauguaauuuauaaaggaucacugcuucaaaaaguuuacaaucuagcauagauuuuaaucaacauauauacuaauacuuuaaaaugcuagauaaauuggauauguacuuuaacauuauauaugaacccaauuuuugcauagcuauaauuuuuuacuguauuaaaucauuguuuuucaaacuggauuguugauauuuuggugguucauuaaacaguuuugggaguaaagaaaauugaaugggagauauuagaauacaaaauaucaacauauauguuuauuuccugggucacaauuucuuacuauagcucuuaguuuaaaaaauuugaaagucugugguagaaugagucuucuucuuaagcaaaaagguuugcaaaaauuagucaagucaggaauuuuagacacuucaugguuaugguuauaguacagguuaacaguuguugaauauuuacuauguuuuaagcacuuuacaggaauuuucuuguuugaaguuaaacaagcagguaucuuccucuuauagauaaugaagcugagauuuagaaucuacuucaauucacccugguaccaagugguagagcuaguacuuuaacuucauaagcagagcucuuaaacuagagucucaucucucaauugcugccuuacacaaucuguguaugcuaaaggaauauucguuuuggagauauuaacugggcugauuuuguuuuucuaaaggaaguggguuuugaaacacagaauuuacauaaggaacuuaagauggauauguauuuuucccuuauggucuuuuaagaaaucuugauugaaaaugauuaaaauagcuauguaugugaaauacagcuguauaaauuuuaugaacagauuuaggaaauauaagugucuguuuucucuuguuaccaaauuaauaaaauauucuguuuucagcuaguacuaccuacacugauauauaguaaaaaugauagcaggccauaggccauaucuaaaugauuuaccuaucagggccaaaaucuucugccuucaaauguuuucugccaaaauugauauauuugagcauugagcauguuuaaguaagagauaaaauaauaguuuuauuuuccuuuaagauuaacuaccaaaaacauaaaacuucuugaaaaauaugauuuaauuucuaugaccuguauuaauauuuuuuaauuucuaauuuuugugaguaaccuguauuauuuuucuaccucuguaugcuuuucauuaacuggcuaguacaguugaauuaauauguggaaaaauaagcacacacugucaguccuuugaccauucucaacuucagugaucucaaccaucagccaagcucagccaccaauuauuacaguuaaacccuaggcuguuguuaucuguaacugcacuugccagaucucaauuuuagcauccugcauucuggccaccacuuucucugcucccauuuucucuugagcccacuacaugagacaucgaaaccuaccacucuguugguacuacuacugucauagucucucaugaccuugccauugacaaauccagugguaauauagaaaucuuccauuuuccugaccugccagcaaaguacaacacagauaaacuacuuuucuaucuagaagcacuuucucuucacuuggcuuccugggcacaguuucucacuggcugcaucuuguuggaguccuuuguaaaaccuucuucauauucuuuaucucaaaauaucagugucuccauauucucccagcccuccuuuccuuggugauuucuuuuguucuccuggcuuuaaauauuuuccauguguugauaucuuuuaaguugauagguccugcccugaagucucccauaauuccaguuugaacuaucccauaucuucauuuguauaucugacaggcuucucaagaagacuaucagauauaaaacuaagcucccuuucccaaaaaaccuuaggcucugucauucuuccuuaucuccauaauucccacuucugcucuuccaauugcuuaggccaaaaaucauuucugauucuuuuauuucucacccuucauguaaucuagcagcauaucuucuuagcaauuccuucagaauuuauucucagucagaccacuuaacacugcuuccauugcuaccacuuugguuaggauuguugcaguaaccuaguuucccaccuuugaccuugaauuaguccauucucgcacugcuauaaagaacuacuggagacuagguaauuuaugaagaaaagagguuuaauugacuuacaguuccauaggccguacaggaagcauggcuagaaggccucaggaaacuuaacagucaugguggaaggcaaaggggaagcaaccacaucuuaccguggcauagcaagagagagagagcaaagggggaagugcuacacacuuucaaacaaccagaucacaugagaacucacucacugucaugggaacagcaagggggaaaucugcccccaugauccagucaucucccaccaggugccuccucaaacacuggggauuacaauuuggcaugagauuuggguggggacacagagccaaaccuuaucagaccuucugcaguguucuucacuaccagcaaaagugaacauuuaaaaugucagucauaucaugccacuucucuucccaacuccucaauagcuuucucuuuugcucagauuaaaauauaaauacuuugauaggucacagaaguguauauaauccuacagaaguaccuuuauagucucauuucuaccucacuuauucuacuucagccacauugauguaucaggcuauucuaaaacaugccaagcacauuugcaccucaaggcuuuugcguuacuaccccuaugccuguaauguucccccauauguaaauuagaucacaaaacucaaugaagaggaaauuuccacauuuguuuauaacauguuauguacacagaugccuguauuaauagaaaaaacaucuagaagaaauaucagaaugucaacagugguuauaucuagguagacauuuuauuuauauuugucaguauuuuugguauuuuugccaaaagcaaaaauuauuucugcccucaggaaacauuuauucauuuuuauagaaagauuaaaacagcucccuuccuuggcuucuuccuuuauccucuuucuagguaauguuuuguuucuugaucuuggugcaauuuacauggguguguccacuuuggaaauuuaucacaagauacugaugauuagugcauguuucuguauacauguucacuuuaauaaaaagaacaaaaagaaaaaaauacaacccugccaaaguagaaagcaguacugauaaggcuuggcuauguguucccacccaaaucucaugucaaauuguaaucccccauguguuggaggaggugccugcugggagguguuuagaucauagaggcagauuucccccuugcuguucuugugauagugaaugaguucucaugagauacgguuguuuguguguagcacuucccccuucgcacucucuccugcuccuccaugauaagaugugcuugcuuccccuucgccuuccaccaugauuguaaguuuccugaggccuccuagccaugcuucuuguacagcccauggaacuguaagucaauuaaaccucuuuucuucauaaguuacccagucucagguaguucucuauagcagugugagaacagacuaauacaaguacuaacaguauauuuauuuuauguaauuauuuaaauauucugggugauuugcuuuaaguuuugagauaacgcuguugauauuuugaauuagugccuuuuuuuccuacugauuuaaugcccuuaucaaaaccuuacugacuacaagacuauuacaaaacauuagcugcuaaguagauaguauuauuggacuaaauuauguaggauagauguggguuuucauauuucuucggagaacguauauuauuaaguuuaauauuuuauaaauuuuuucaaaacuacaacuauucuaaaaucuaaaaguauucuguauucauauaucauaaaauauuuugauuacuauuuucuugaguugauuaggcaaguuauugaccagaacuagaugaaauuucaguaaauugauuuagaaaucagaaaaagacgugacuuuacuuugaaaauacuaaauuuuggugaauacagacaucccuucaaacaaggcacuuucuuuuuuauuguguccauauauucuagugagcuguucaguuuaauauaaauuauuuuuaaauugcuuaugugguacuuaaaaaauuuugcacacuaaaaaaaaucuguaacaucucuuaaucauacuuuaauuucuaauuccuacaucuccucagaaaauauuugaauuauaguauguuaaaauuuaaaguuuauccuguguagcauaaauuguauuuuaguguuaggugauugaacucuuaccuuuugagauuuuaaauuccccaaguaauuuguuggaguacaaauaccauuuuuuccauaaaaacuuggucuuaaaaacccuuuuguugguuuguguuuuauagauuuauuacauauuuagucuugauuuucuauuaguauuuuaaagaauuuuugugcugguaacauuuagcuguaugugguauauuuugaaauacauacuauauuuauauaucuuuccuccuuaaaucuagauacaauugaaaaggaaauaagaaaaaucuucaguauuccagaugaaaaggagaccagauuguggaacaaauacaugaguaacacauuugaaccacugaauaaaccagacagcaccauucaggaugcugguuuauaccaaggacagguauuguuuauuuuaagcauacuguauuauacaugaagguuuuuggauucacaaacuuuaauaauuauccuggcaauauauaaugggcuguacuguuucuggcuuccucuuucuaaacucaucucuugucuuuccuugcugguuacugacucugacuuuugauucccuccuugagcuugggaauaaucuacuuguuaaaaagaaaucauuuuuaauuagaaaaaaaucccagcuaauauuauaaggugggucagcaaacuuucugugaaagaccaaauaguaaacauauauggagcaucucuuauuuacacaguucuuuauuacaaauuacaguucucugcaggccauaaaguagcaucuaaaacauugccauuguaguacacaaaaacaagcauagaugauacaugaauaaaugaguauggcuauguucuaauaaagcuauuuauauaaaugugcagcaggcuaagugaacucuaguuugccagcccuuguugaaaggugucagcucccaauuuggcuuuuuuguuuguuuguuugagacggagucucacucuguugcccaggcuggagugcagugaugcaaucucggcucacugcaaccucugcuucccaaguugaagugauucuccugccucagccucuugaguagcugggacugcagacaugugccaccacacccagcuaauuuuuguguuuauaguagagaugggguuucaucauguuggccaggaugggccagaauggucucgaucucuugaccucuugaucugcccgccucagccucccaaagugcugggauuacaggugugcgccaccgugcccggccgguauuuuuuuaauaaaguauugagaaaugaagagguuuagucacugucagcaaguccuacugauucuaucuucuaacugugucuugaaguaaucucugugcuccauucucagcccuuaucuuucauagucucuuuacaaauuccuguaucuccaggcucuuguaugucuguucaaucuuucuuccuuuguuuuuuuguuauuagcagauaaccauaggacagucuuguuuuugcaagaauacucauucuaaaauguaaacuucacugucuuccuuucauaaacuuuuccugguuccuuaauaauuaaguccaggcacuuuaagccagcaugcaaguuaugguuuaaccuuguaccuacucuuccaccaucucuagauuaucuuuguuuugugguuuauacucaagcaguaccaaacugagcugcuuauaguucccugaacacacuaugcuauuccauauucuugugcuuucugauguguuauuccaucugccugaugauguaaacgucuuuggagucccuguauucauccagcaaaaaguccuuuuaaccauccauauaauaaaauuaaccaucccauaccaucauguaggccagccguaucagauuauucauccuucagguucuagcucaacugucacaucaucuauucagccuucccuauuucucucaauguccauugagguauaggauguuucuacuuuggagaaaagaauugcuuccuuaacuuccacaaagauguauguauauuuguuuuguaucguucauuauaugcuuuaguuauuuguauuuuaaucuccccagacuaugagguccuuguuuugguuagacuuuguacccuauuuuuauuuucagaaccuaacaugcccggugcucugauaaauggaagauuuuuuuguuuuguuuaaaaauuacuguuaacaucaauaauaugauucugaguuguggaaaaauucagauaaagugagggaaauuaauuuuuaguaaaugcccacuauaugucaagaauuguacuaggcugucaaaauacagugguuuucagauuuauuuuagucauuauauucuuaagagaaaucuuacaaaauccaauauguauuacaguuaaaagggaaaugaagcugauagaagcuugaaguguggaccuuggaaauccacugauuagccaacaccgcccuuuuauguagccagcucucucuuucugucuuccaguagacauaaccucucuccuugguuuucauccauuaggccuugagguagcuccaaaaguacaauuugaaaucuauagaauucuuuauuuaaaccuuuucagcaauccucugaaaugaguguuacucuuuucaucguguacauuagaaaacugagacucagagaaguuaaauaauuugauguucuugauagguauguauuuaucagauggcagaugagaaaauaauuuaauaagauuaaguauccuuaaggacuugaccuuuaaaaacaggaauguuucaaagaauagucauuaaauuuuucagacuuuauaauaauucuucagccagagaagauaagugacauaaacccucuccuggaccuuuuuuuuuuuaauacuuagauugaaaguauccuuacuagaaaauaaaacaaagacauauuauugaagaguuugccucccaaaaugugaagcauuucuucucuccuuuuuguguggguuuaauuuuaauuuugaaaucuuuucaaaaauauuuuuauuuggaguuaaaguuuuaacuauaacaaaauuuuaugcagaaaaugaugcacuugaauaaaggacugaauuuuaaucuuucugauggucuucagcauuaguauuugugguuuuuaaaacauggaauuuuaaguauaaauacuguuaggaauuaaggcauuaugguuaaauaauuauauuaaaugcauaacuuugaaaucuucuauagcuaaaaucucuuguuuuaaaacugauuuaaguccucaaaugauuguaaaguuuauauguauauuuauacauauaguuaauauguaacuguuacucuuguauaaauugcaguaaagcaaaacauucuggagaagugaaaaaucacucucuaaauucuacuuuguaaaucuucauaaauuuauaaaacuauaucagaaugaaaaucagaaaauugagacagugauuacuugucucuaguagguagggagaggaaggugaucaggaagggaucaguauauuagguacaugguacauuuauuuuuuauaugguacaaauacacuuuuuaaugugugaaauaauagauuuuuuaaagcuaacuuuaauauuuuaauuagcaucucuuuuaacaacaagauuucaugaauuuuuuuaaaaucaacauuuuauuguuacauauacucugaaacaugcuuacauuuuacauagcuaggcucuaaaugccaauuuauaaaugaccuggaaacauauaguucacaaaaauauauuacuaagugcauguagaguaguuuaugaaauugcaacuuuaagaaaaagacuuaaugaaacaguaaaugaaauguauucaaauuuauaaugccuuggauuuauuucacgucauauugucuguauuacaguuuuucaauggaaauuguagauuuuaacuuuuuauugguauuaucguauauuuccuuugcuaauuuaauuauuuuugcuaaguuuuucuucuuugcacagacuaauccauagcaaaaacuagaaagacuuauuagacuggacgauauaaggaaagauuuucggguguuuuaaaauaaaguauagcucucccuaagccuauacuuuuuauuuauuagaggugauuucugucugccucauccaugcuguaacagagaacuucagucugauucucauaaaugggacucuaucauuuguauauuuaaagauucuauaauuuccauugugauaauguaaauacacacuaauuucaaaaccccaaauaaauucuacauaaucuguaauuuggaauuaucugugucgcccuucgucugcauuugcauaaaaauaaguuacccaagauccuauguaaguauguuuaacaacugcaaacauuuauugaccaucuguuauuuacagaguucucuguucaaccuacaaauacaaauagaaaauauauucucuaaauucaaggaauuuauauucuguuuacuugguuuaaguuuucuuauacuuaauggaaccaauaguuucuuuacaguuuaucuucuaggauuccuucucacuaucauuacugauuucuuguuauuugaggucuuuuagucucaccugccuagcuuuggaaucgaaaugcagauuaccuguucaccuugucuacuguuuuccuuuaaauaaucacagaguuacuuuaguuucuuaguuuauccagcuaucuucuaaaguuauuuuaacuucagaguuauggaaaaacacccuuuuauugugucauauuugcagguauuagugauagaacagaaaaaugaagauggaacauggccaagggguccuucuacuccuaaguaagugcucccacuucuuauggcuuauuguaugauuuugaagcccuugaugcuagauaaucaaauccacaaugauagaagaaccuagauguguauugcagaaauucaugccuuguuuauauuugaguauuuuguucuuaguauacaagcuaucuaaauuugcucuuaauuaauauguuacuauuuuaaaagccuccaauucaaauaucuuaaggcauaguauaaauguaugguauaaaugagaaaguugcguugucugauacagucaaaucauuaaacauuuguuuaauuucuugaagcuuuuucgugguuuuuaaaaguaucuuaaaauauuucuuuaucaaaaugaaucugaugugaaaguaauauauuuauucaaaugaaaaguuuuagaauaaaaaagaacaaauagagguagaggaguauaugagguauuuuugaggguaaaugaaagaagaauuaggaaucuuuuuaucuguuuuagaacuaauagaucuacacuccauuaucaaaacacaaggccaguuguguuuaaauauacagacuucucaaagcucuaagaaguaauaugguacaugucccuccauuacuguaauguuucuguuucugcaaaaggacacuucuuuauaaucaaacacauuaauauuuuuucagcaaauauucacacuaagugggauaaauaaggacuauaaauagcauuauaucaguucagguuagguugccaccaaaugaacugugaaaaaauuuuuaaguuuuuggagcuuuggaauuucacauguucugauaagggauugugaacauauauuuugaaauucuuaaaauaaugauauuuuuaaaaaacuaauaacaauuuaguacauuuuaaccaagugaauaaaaaaaucugcuacuuuauuugauuuaaaacuacaaugcccuccgggugcaguggcacaucccuguaaucccagcacuuugggaggcgaagacaggcagaucaagaggucaggaguuuaagaccagccuggccaacauggugaaaccccaucucuacuaaaaauacaaaaauuagccaggagugaugaugcaucccuguaaucccagcuacucgggaggcugaugcaugagaaucacuugaacccaggaggcagagguugcagugagcugagaucgugcugcuguacuuccagccuggccaacagaaugcgacuuucuccaaaaaauaaauaaauauaaauaaauaaaauaaaacuacaauguaccuuuuauaagugguuuucuauccuuuuuuaucuuacgugaaauuuuuuuuucccauuuaaaaauaucaugagaaggcaccuaaauauguuaauuacauggaggugauuuuuauucuuacccuacuuaguuggaugcaguacaaggguagaacuuaguauaaaaguagaacuuuuaagaagauguuaauauuaaaagcauguggguugaauuauggagauuucauaacugaugaagguuuagauaggaauauuuuuugugaacauuuacuuuuagucuucaaagcagaaccacuguuguuuccuaaauguuuagauugcuauguacuugcuauaucuuuaaguuauuuuugaaauuacaaaauuguuuguggauuaauauuaaaaaaaacccaugaguucuaaagauugagaaaucuuuucuacuuaaaaugacugauuuuugcccaaaagaugacuaauuuuauauuuucuuuuauucccuaauagcacaauaucauuuuuauuuauuccaacaacuuuaguacuuggcuuugugugaaagaaaacagaauucccuauguaauacccaacacaccauacucaugcaauaaauauuggugaauacaggugcuguacuagagaugacaaaaguacaauuaagaguccuauuuuucacuggaucuacuaguugaauaaggaugccauauacuaaagcauagaaaaguuaaauauccauucccuauaaaaucuaagaaauacuaugcaguaauaugucauaaauugccaaauaauaauuuacuguaauacagaaaaagaucugcaccuauguaugaaaagauucucagaaaacuaagaauaaagggaaauucuaacuugauacauccugugcaccucaagucuauagcaaaaguuacauuucauugagaaauuuugagcacaauuuaaguaagaggagaagauaagaaagaagaaauaaaguucacuauucguauaugauauagucauuuguauaaaauccaaaacagcaaacuacuagaacugagaaaauucagcaagguugucuaauauaagauuaauuuauaaaaagcaguuguuuuuucuauaccgagagaucagcaaucuuuuuuaaauguuuucagcuuugugggccauauggucucugucauaacuauaacugcugauguaguaugaaagcagccuuagacaucaugucaagacauggcaaugccuguguuccaauaaagcuuucuuuguaaguagauggcaagcuuggauuuggccugugagccauaaauuucuaaccccugccauuuaucaugagaaacccacuuagaaaauagucuaacaaaaauuaacuuaauuaaaaacgcauaaaaccuucaugggaaaaaaaaaaucuaaguuuauuagaaaauaaaagauuguuaugugauauauggcuuaaccuaguaaugccuguuuucuuuaaagcacaucagugucuccuguucaaaauuuuuuuuuuccuagaaacuugacaaauucauuuuaaaguuagcauagaccaauacagguccagaauuagcugagucaguuuugacagaaagaggaaggaaggaacacuagaccuacaagguaaaugagaguuacuguaaaauuauacuaauaaaaacaacauaaugcuagcaaaagaaaggcaaauagauugguauaaacuaguaaucucagaaagauucauguauauuugacaacuugguauaugauguggcacaacuagguagugagguugcuuaaagaagaugauuauuuagauuuaguaggaguacuggcuauuuggaaaaaaaagcuagaucccuacuuucaacuuuauaugcaaaggcuaacucuugaaggauuaaagaccuaaauaagaaauauaacacuuauauuuaaugaauucacuuauauuuagugaauauucacuuauauuuagugaauaguaggcugggcaugguggcuuaugccuguaaucccagcacuuugaguggucaggaguucaagaccagccuggccaacauggugaaauccuaccucuacuaaaaauacaaaaauuagcugguauggugguggacaccuguagucccagcuacucgggaggcugaggcaggagaaucacuugaacccaggaggcggagguuuccgugagccaagaucgugccacugcacuccagccucggugacacagugagacucuaucugaaaauaaauaaauaaauaaaugugaauaguagaaauuuuggagaauaacuacaucauagggaucauagaacauaauguucaaauuuaguagaucugauuacaucagaauuaaagauuucuguuaaaagaacuauacacagaguuaaaagucagaugucagcuuuggaacuuuuaaaaccuaaagggaauaauaccuguaauauauuaagaacuccuaaaaguuaacagaaacaaagaacaauagcuuuuaaaaaaauagguaaaagauacuaacagacaauuuaaauaaaggguagcuaagugcuaacagguagaugagaagauagacaaacucacuaguaaucagaaaaaaaugaaaguaaaugagauacaauuuuucacccaucaaaaugacaaauauuuaaaaguuuucugaugccaaguauuggguaugguguagauaucuguguacuuacgaugugaguguaaacuaauauugucauucuguaaaccagucaauaauuaaaucagaaguguuuaaucccucugacccagcacucagaggaauuuuuaaacagaucuuugaggauauaaucuuuguagcugcauaguuuguaguaguggggauuuggagauagccuagcuaaauauccaucacugguaaauagagcaaauaagaaaaaugaaaugggaguaacaauggugagaucuuuaaaacuagaugaaacuuuaaaacauacaguugagagaaagaaacaaugagauucauaaauauuuaagaaaauagaaaaagcacaguagaaggaaaucggaguagagauaauaggaggaaagaggaaacaaguuugaggaaauaucacuugcuaaauuuauuuauauuauauuucuauagaugaagcaaggaugauacagauucuuuuuucuggaugaagccuggcuugaaaaaaaaacaaauggggcugggcacaguggcucaugccuguaauccuagcacuuugggaggccgaggcaggcagaucauuugaggucaggauuucaaaaccagccugaucaacauggugaaaccccaucucuacuaaaaauacaaaaauuaggcaugguaacaggcgccuguaaccccagcuauucaggaggcugaggcaaggagaauugcuugaacccaggaggcagagguugcagugagccaagaucacaccacuacaccccagccugggugauagagugagacuccaucucaaaaaaaaaaaaaaaaauagaaugccucuguguucauugaaaagcacauuuuaggcugagcaagguggcucacaccuguaauccuagcauuuugggaggccagaauaggaguaucacuugagcccaggaguucaagacgacucugugcaacauaacaagaccccgucucuacaaaaaaaaaaaaacaaaaauuagccaguuaugguggcaugcaccuguagucucagcuacuccagaagcuggggugggaagauugcaugagcccaggaguucaaggcugcaaagagcugugaucacacaacugcacucuagccugugcaaaagagugagacucugucuccaaaaaggaaaaaaaaaaaaaaaaacagaaaagcauguuauaagcacaugauguuagcuuaggcaaauuuaacuccagcacagaacacguaauuuuaaguccuuaggaaggacuucaagauauuaagauacagaacaguuuauacuccucaaaauucucacauuugccagaagacaaccccuggccuucaagauggcaugaaaaugcuaguucugauauauaucacuaaccuggaauuuguccauaauguugcauagcacauaaccaguuccuagcuagggugucaaacaccaaagaaagauaauuaaagcuguaauauggugauagaaagaagaaucacugguagaauuuauuaaaacaguuuccugggccccauccucagaauuucuuauuaugucuggguguggcucauuucuaauaagcuugcaggucacaccaaugcuguuggucuaaggaugacacucagaaauuuuguaggugauguuuauugacauuuacuaggugaaccacauaguggcauccaggguucccaccccagaccagcaaaauauaaauauaguuagccaaggaauuugcauuuuaaguacuucauaugaacaagaaaauagaagaauauuaccacaaguaggcacacgugaaaccacauguuaguauuuugucuguucuauacugcugaaaauagaggaaccuacuuagugcucugauguccuauuguauuggccccauuuugauuaguuuugaaacugugucuucagcugaagcauaaauuuuugggcuccuugagaagaaaugcuaaauauucaaaaaauguuaaggguaaaauuuaauuuaaaacauguagucauuuaguuacaaaaaaaauauguguauaugcuuuuaaucagcaccuaaaacaacucaaagucuguauuagagaucuaagaaccuacccaaaaaauacucacucaaaagucuucuguucaagcacaguggcucacuccuaugaucccagcacuuugggaggccaaggugaacggaucacuugaggccaggaguuugagaccagccuggccaacauggugaaaccccgucuccacuaaaaauacaaaaauuagccaggggugguggcggcgccuguagucccagcuacucgggaggcugaggccggagaaucacuugaaugcuaaaggugaagguugcagugagcugagaucgcgccagugcacuccacuuuggguagcagagcaagacucugucucaaaaagaaaaaaaaaaaaaaaguuuucuaacugaauuuuucuacuagauaucaacaaagaauuugaaauuuuuauuuuuauguucaugcugcauuuuuaacacuacuuguuuuaucaggauuugcauuucuuaucuaguuuuuaaguuugauuucuuaaacagccucuuaaaaacaugaucuuuucuaaugauaccuuagaaaaaguuuuccccccuaguuuuaaaaauucuguaaaauuucauuucuuuuuuuuuaaggauguuagcauuggguggauaaucuaguuguucuauugcagacguguagcuaguaaaaucuuggauuucuaaaaaaugauuuuacaguggagucauuauagaaaccuggggguuccuaaagagaaaauuugauuuaaauuuauucauuuucauugauuagucaaaaaguauugucaaaagauaugugcuuaaguauuggguggaaaaaaaauaagagucauugaugauuuugaagaggugauuuuucuuggacuggaaaacauccagagaaaaauguacuaucguccagaauaggacaugaguggcagaaagaaaaaucaaauggaaaaccaugcuaauagcucuuacucauacacugucccucugccauuugugguguucugauuaagggaauuccaaauugaugacugaaacacuauaaacuuaauuucaugacacaauaguauuuucacagcacugucuucuugagugcucugcuuggagagaggaagaacuuuauaaauaaaaccauugcauacuacuuuuuugguugagacagauaguaagcacuuaggugauucugcaauauucuguuuuuauuuuuuuuacacuaucuuaaacgucuuuagaaauuuuuagagaguauucaaucccuguuugcauuuauaacugcgaagcagcuaaauggauuuggaaaugaugcauagacucauuugguuaaaaauuauuaaaauacauguuggcuguagccauucuuuauuccuugucauucagccaguucauacauuucaguaacaccaaucuucaauuugaaaugcaaucugugaaccauaaaucuagagugauacuccaaaaucuauaauuuguuguuguuguuguuuuaagacaggaccucacucucauuacccaggcuggaaugcaguggagcagucacagcucacuguagccucaaauucccaggcucaggugauccucccaccucagccucccaaguagcugggacuacaggcacaccaccacaccuggcuaauuuuuggguuuuuuuguucuuuuguuuguuuguuuuguuuuguuuuuauaaagaugggguuucaccauguugcccaggcuggucuccugggcucaagcagucugcccacuucagccucccaaaguguugggauuacaagugugagccaccaugcccagcuguuaucuuuuuaaaagacauuuugaauccuuaaauuuccuuuuaugccuuuuuuuauguuguuauucucauuaagaaacagauguagaaugguguuuucugagacuuuaaaguuggagguaaugaaauagccaaacaaaaaugcuuagguuacaauuaaagggaacugcaguauggaguacugagaacugcagguauggagucauauuccuauaaaugggaauauaagcauauauaaauuaucuaaccaaaaauguagagacaacauaccaaaaccuuaaagagcauccugagguaaugaagaaggacaguuggcaucaaauagaauaaucaugaaggcucaggaaaacuugugcugauuaaaacaaaaaaucccuuauuuuuuagggauacauacauacuguuguguuuucaggugaaauuaugggugucuagaauuugcuucaaacuacuccagcaaaagagggggucggagggaagcugaagggauuauagaaaaaguaagaaugguagaauguuaauuuuugaauaccauccuuuuguaguggccauacuaaucuucucuguaucguuccaauuuugguauaugugcugcugaagcgagcacuagaauguuauuuuuaaagcuaaguuucugauauuagguacaugaggguuaauguauguuucaaaauuucuguaauaaaguuuaaaaauggguugcaaguuuuggugcuuagauucauaauuggcugaaaaaauuauuguaauuucauuuauuuaaaauggaacauuuuguguuaucaaauauuauauguaaaaguaagcagucaaaauaaggaaaaauagagcuaugaaaaacaauuuauauauaguauaaaucuacuuaaacucucuuuuguguaucuuuaaguaccuaacacccuaccuggcauauaggaagcauacaguaaaugcuguugaacugaacuaaucuguaucuuacaacaguaaaaguguuuaauuuuuuaggagauuuagaauuuucuuuuucuuucagaacuugucuuagaauguugauuagaaauggagaguguaauguuggucuuguuuuaguuacuaagcuaauuuuuguuuuaugauguuagguuguaugaaguuacguuguuuuacaauguuggguuugaaaauauaaaaaucuuuaaauaacuguuuugcugucucaacguucagacuuaacuucucuguauuuugguugcuuaauauggugguagauuuccaugaguguuaaauguuuaguugacuuacuaaaagcaaguuauguuuuucuauugaaguaagaggcucaacuuagccuugaauugcauguuuuuaguugaaacauauugggcauagggaaauucagauacuacaaacuuccauuugucaggaguaaggcugaauuuucugucuucaugaaaccacuucagcuaaauggaagucuuaccuuuuucugucugagggcacgauauguuacaccuagcccaaacuggccaaaauuaguuuaauucuagguaagugguuugaugucuaguuaauguaugauauucuuagcacuuuuuuuucuccuuuuucuagaaagccacuagagcagaguugcuagugaacaguuuaauuuccacauacgucacagaaagagagcuaaagggcucugguuaucauccacagacugaccagucaaccccuaaauaaccugauauuaacuccacaaauguuagcuagauuggaccauguguaaucugagucagaagucggaaucagaagagauaaaugaugcguuaucacucaacaguaaugucugcaacaguauuguaaaauuguuguacuuuaccugucgaccacauccauccuuagcucucugaucaccuuacuauuuaaggacagucccucuacucuaccuguaguauuuaucucaaugcuuccugguccuugcuuuuucuuuuauuaucuccucucuccuacauauauaaaugccuagcauagugccacacauaugguaaacaccaguuuauuauuuuuauuucuuuucuaaugucaucuucccccucagccuaugaauauaaacacaucuucaucuuuaaaaccaaaaaccauauacuuccuccauuuaccauccuuaagcuuuuuuuucuuugacagccaccuacauuuaaaaggcuauacuuaauguugcuugccacccauucaggauuuaacaaaguucuuauuugucuuucuuuuaaccuaguuuauuugaccugucuuuaguauuucuuuuugauaaccaucuucuaaagaaauucucugaauuugaaugcaugauacgaccuuuuaugccaaggacuuugccucucugaccaguccuuugucugucuagcucgguuccucuuuaggguugccacauuuaguuuugcaaauugugcacagcucuaggaggcaucauucauaucauauguagucuaugugauaggcccuccuuggcacggugcagugcagcuucacuaacuguuugcagcagcucuacucagaccuuaaaugcauugacauucacuaaauuucugucagaagaccucuuuuaucauaccauaguagguguucaaaauuaggugauucuaugcuaauccucucccccagcucaaacugacacaaaauaugccauucuguauuucuagacuagaccacuuuucugaauuccagauuuuucauaaauuucauguaggacucaccaccucaaauuaaaccaaaucuuuuuaccccuccuucucccauccccucaaccuaaacugucuucauuuccuguauugccuauuucaaguaccauccaagagccauccugaguuccuccuccagccuuucuucucuugucuaguuagucagcaagucuugcagauucugccuccucaccugaaguuuucaaacaguaccccuuuacauucuugaaaauuauuaaagauccaaagaacuucuguuauauggguuauagcuguuaauauuugucauauucgaaauugaaauaagauuuuaagguauuuuaaaauaacaguacaaaaccauuguauuuugacaugaauaacacuuuuaugaaaauaacuauauuccaaaacaauaaaauuaccaaaaaguugcauuguuuuuuauuuuugaaauuucuuuacuaucugacugaauagaggacagcuaaauucuuguauauucuucugcauuuaauuuauuguaauacaauguuuggguugaaguacaugaagcaaaaucagccucacacagauacauaguugaaaaggaguauuuucagaucauuaauacuacaucaaaacuugacuaguggugguuuaagucuuaaaguuaaaugauagaaucugaaaccauaucaaugaaccuuuuauaguauuaaaaucuuucaaauguaaauuucaugcauuuuggucauuugggaaauauucacggaguuaugcagaucuuccaaauguugacacauuuuauucuacaauuuuuuucaaaucacauuuuuuaaaacaucaccuaucuuaugagaaacgccuaaguauugggaagcugucaacuuuguggugucagagucaaguuuuccaagauucuaauucuucaucgaaagcccaaauuuuaucauuggcugcaaauacauuguuuuccuuaaagacacagccuuccuucauucauuuuucagaaaaccucugcuugauagcuguauuaguccauuuucaugcugcugauaaagacauauaggagacggggcaauuuacaaaagaaagagguuuauuggauuuacaguuccacauggcuagcgaggccucacaaucaugguggaaggcaaggaggagcaagucacgucucagagcuugugcagagaaacucccguuuuguuuuguuuuguuuuuugucuuuuuuaaauuuuauuuuauuuuaaguucugggauacacgugcagaaugugcagguuuguuacauagcuaugcaugugccgugguaguuugcugcaccuaucaacccaucaucuagguuuuaagccccacaugcauuagguauuuguccuaaugcucucccuccccuugcccccaccccccaacaggcccugguguguguuguucccccucccuguguccauguguucucauuguucaacucccacuuaugagugagaacaugugguguuugauuuucuguuccuguguuaguuugcugagaaugaugguuuccagcuucacccaugucccugcaaaggacaugaacucauucuuuuuuauggcugcauaguauuccaugguguauaugugccacauuuucuuuauccagucuaucaggauggagauuuggguugguuccaauucuuugcuguuguaaauagugcugcaauaaacauacaugugcaugugucuuuauaguagaaugguuuauaauccuuuggguauauaccuaguaaugggauugcuggggcaaaugguauuucugguucuagauccuugaggaaucgccacacugucuuccacaaugguugaacuaauuuacggucccaccaguaguguaaaagcauuccuguuucuccacaucuucuccagcaucuuuuguuuccugacuuuuuaauaaucacuauucugacuggugugagaugguaucucaucguggugugauuugcauuugucuaaugaccagugaugaagagcuuuuuuucauauguuuuuggcugcauaaaugucuucuuuugugaauugucuguucauauccuuugcccacuuuuugaugggauuuuucuuucucauguaaauuuguuuauguuccuuguagauucuggauaauagcccuuugucagauggauagauugcagaaauuuucucccauucuguagguugccuguucacucugaugauaguuucuuuuccuguguagaagcucuuuaguuugauuagaucccauuugucaauuuuggcuuuuguugugauugcuuuugguguuuuagucaugaaaucauugcccaugacuguguccugaaugguauugccuagguuuucuucuagguuuuuaugguuuuggguuuuacauuuaagucuuuaaucuaucuuaauuuuuuauaagguauaaggaagggguccaguuucuguuuucugcauauggcuagccaguuuucccagcacuguuuauuaaauagggaaucauuucccuauugcuuguauuugucagguuuguguaagaucacaugguuguagauguguggaguuauuucuggggucucuguucuguugcauuggucuauauaucuuuuuugguaccaguaccaugcuguuuugguuacuauagccuuguaguauaguuugaagucagguagugugaugccuccagcuuuguuauuuuugcuuaggacugucuuggcuauacaggcucauuuuuuguuucacaugaaauuuaaaguaguuuuuucuaauucugugaagaaugucaaugucaauucaauggggauagcauugaaucuauaaauuacuuugggcaauguggccauuuucacaguaguucuccuugaagagguccuucacguccauuguaggugguauucguagguauuuuauucccuuuguagcaguuaugaaugggaguucacucaugauuuggcucucugcuugucuauuuucgguguauaggaaugcuugugauuuuugcacguugauuuuguauccugagauuuugcugaaguugcuuaucagguuaaggagauuuuggacugagacaaugggcuuuucuaaauauacaaucaugucaucugcaaacagagaccauuugacuuccucucuuccuauuuaaauacucuuuauuucuuucucuugccuaguugcccuggccagaacuuccaguacuuuguugaauaggaguggugagagggcauccuugucuugugcugguuuucagagggagugcuuccagcuuuugcccauucaauaugauauuggcuaugggucugucauaaauagcucuuauuauuuugagauauguuucaucaauaguuuauugagaguuuuuaacaugaagggauguugaauuuuauugaaggccuuuugugcaucuauugaguuacuuaugugguuuuugucauugguucuguuuaugugauggauuacuuuuauugauuugcauauguugaaccagcuuugcaucccagggaugaagcucacuugaucaugguggauaagcuuuuugaugugcugcuggauucgguugaccaauauuuuauuaaggauuuuugcaucaaugugcaucagggauauuggccugaaauuuucuuuuuuuguugugucucugccagcuuuugguaucaggaugaugcuggccccauaaaaugaguuagagaggagucccucuuuuucaauuguuuggaauauuuucagaaggaaugguaccagcuccucuuuguaccucugguacaauuuggcugugaaucagucugguccugggccuuuugugguugguaggcuauugauuacugccucaauuucagaacuuguuauuggucuauucagggauucgacuucuuccugguuuagucuggggaggguguauguguccaggaauuuauccguuucuucuagauuuucuaguuuauuugcauagagguguuuauaguacucucugaugguaguuuuuauuucugugggaucaguggugauauccccuuuaucauuuuuauugugucuauuugauucuucucucuuuauucuucauuagucuagcuagcagucuaucuauuuuauuuuuuuccaaaaaaccagcuccuggauucguuuauuuuuauuuuuugaaggguucuuccugucucuaucuccuucaguucugcucugaucuuaguuguuucuugucuucugcuagcuuuugaauuuguuugcucuuccuucuuuaguucuuuuaauugugauauuaggguuucaauuucauaucuuuccagcuuucugauaugggcauuuagugcuauaaauuucccucuacacacugcuuuagcagaaucucugguacauugucucuuuguucucauugguuucaaagaacuucuuuauuucugccuucauuuuguuacuuacucaggagucauucaggagcagguucuucaauuuccauguaguugugccauuuugggugaguuucuuauccugaguucuuacuugauugcacuguggucugagagacuguuaggauuucuguucuuuugcauuugcugaggaguguuuuacuuccauuuaugugauugauuuuagaauaagugccaugcggugcugagaagaauguauauucuguugauuaguggugaagaguuuguagaugucugugagguccacuugauccagagcugaguucaaguccugaauauccuuguuaauuuucuaucucauugaucugucuaguauugacaguaggguguuaaagagucccacuauuauugcaugggagucugagucucuuucuaggucucuaagaacuuguuuuaugaaucugggugcuccuauauuggguccacauauauuuaggauaguuagcucuucuuguggcauugaucccuuuaccguuauguaaugcccuucuuugucuuuuuugaucuuuguugguuuuaugucuguuuuaucagagacuaguauuucaaccccugcuuuuuuuuuuuccuuuccauuugcuugguaaguacuccuccaacccuuuauuuugagccuauguaugucuuugcaugugagauggguguccugaauaaagcacaccaaugggucuugacucuucauccaauuugccagucuaugucuuuuaauuggggcauuuagcccauuuauauuuaaggcuaaauauuguuaugugugaauuugauccagucaucaugaugcuagcugguuuuuuugcacauuaguugaugcaguuucuucauagugucauuggucauuauauuuugguguguuuuugcaguggcugguaccaguuuuuccuuuccauauuuagugcuuccuucaggaauucuuguaagggcuaccugguggugacaaaaucccucugcauuugcuugucuggaaaggauuuuauuucuccuuugcuucugaagcuuuguuugccuggauaugaaacucuggguugaaaaauccuuucuuuaagaauguugaauauuggcccccacucucuucuggcuuguaggguuucugcagagagaucugcuguuagucugaugggcuucccuuuguaggugaccugaccuuucucucuggcugcccuuaacguuguuuccuucauuucaaccuuggagaaucugacgauuaugugucuugggguugaucuucucauggaguaucuuagugguggucuguguauuuccugaaugggaauguuggccugucuuacaagguuggggagguucuccugaacuagguugaggaaguucuccugagaguucacgucucucugaaguguguuuuccaacuugguuccauucuccccgucacuuucaguuacacuaaucaauuguagguuuggucuuuucacauagucccauauuucuuggaggcuuuguucauuccuuuucauucuuuuuucucuaaucuugucuucacaccuuauuucagcaaggugaucuucaaucugugguauccuuucuuccgcuugaucgauugagcuauugauacuucuguaugcuucucugauuucucgugcuauguuuuucaguuccaucaggccauuuauguuccucgcuaaacugguuauuguaguuagcaguuccuguaaccuuuuaucaagguucuuagcuuccuugcauuggguuagaacaugcugcuuuagcucagaggaguuuguuauuacccaccuucugaaaucuuuuguuaauucaucagucucagucuccauccaguuuugugcccuugcuggagaggaguugugaucauuuggagaagaagcauucuggcuuuuggaauuuucagcguuuuugugcugguuuauccucaucuucaugauuugucuaccuuuggucuuugaggcugaugaccuuuggaugggguuuuuauuggggggucuuuuuguugauguuguugcuuucugcuuguuuguuuuucuucuaacagucgggccccucuucugcaggucugcugcaguuugcuggaggucuacuccagacccuguucgccugguuaucaccaguggaggcugcagaacagcaaagauugcugccuacuccuuccucuggaagcuucgucccagaggggcacuggccugaugccagccggagcucucccguaugaggugucugucaaccccuguugggaggucucucccaggcaggagacacgggaucagggacccacuugaggaggcagccugucccuuagcagagcugguacgcugugcugggagaaucccccuugucaggaucagcugcucucuucagagccagcagccaggaaagauuaaguccacugaagcuacacccacagccgucccuccccccagugucucugucccagggagaugagaguuucaucuguaagccccuggcuggggcugcugcauuuucuucagagaugcccugcccagugaggaggaauguagagaagcagucuggccacagccacuuugccacacuguggugaauccugcccagucaaaaccucccagucuccauagcacugucaggggaaaccaccuacuaaagccucaguaauggcagaugccccuccccuaaacaagcucgaucgucccaggucaacuccagaccugugcuggcagugagaauuuccagccagugguuccuagcuuucugggauccaugggagugggacccgcugagcgagaccacuuggcucccuggcuucagcccccuuuccaggggagcgaaugguucugucucgcuggcauuccaggcaccacuguaguuacgagaaaaacuccuacagcuagcucagugccugcccaaacagccacccaguuuugugcuugaaacccagggcccuggugguguaggcacaggagggaaucuccuaaucugcagauugcaaaaaccaugggaaaagcguaguacccgggccagguagcacagucccucauggcuucccuuggcuggaggagggaggucccccaacuccuugcacuucccuggugaagcagugccccacccugcuucugcucacucucuguggguuguacccacuaccuaaccagucccaaugagauggauaccucaguuggaaaugcagaaaucaccuaccuucuccauugaucucccugggaaccucagaccagagcuguuucuauuuggccaucuuggccccuccccgaaacugccauuuuuaaaaccaucagaucucaugagacccauucacuaucacagaacagcauggaaaagacucgccuccaugauucagucaucucccacaaggcccaucccacaacacaugggaauuacaggagcuacaagaugagauuuggguggggacacagagccaaaccauaucauucugccccuggccccucccaaaucucaucucuucacauuucaaaaccagucaugcccucccaacaguccccuaaagucucaacucauuucagcauuaacucagaaguacacaguccagugucucauucaagacaaggcaagucccuuccaccuaugagccuguaaaaucaaaaacaaguuaguuacuuccuagauacaaggaagauacaggcauugggucaacacagccauuccaaaugggagaaauuggccaaaacaaagggucuauaggcccagugcaaguccgaaauccagcagggcagucaaaucuuaaagcuccaaaaugaucuccuuugacuccaugucuugcaucugggucacgcuggcacaagaggugggcucccacagccuugagcagcucuuucccuguggcuuugcaggguguagccccacuccuggcuguuuucaugggccagcauugucugcagcuuuuccaggugcacagugcaagcugucaguagaucuaccauucuggggucuggaggacagcggcccucuucucacagcuccaguagguggugccccaguagggacucucuaugggggcuccaaacccauauuucccuuccuggcugcccuagcagagguucuccaugaggaccccgccccuacagcaacuucugccugguuauccaggcguuuccauacauccucugaaaucaagguggagguucccaaaccucaauucuugacuucuguacacacacaggcccaacaccacauggaagcugccaagauuuggggcuuccacacucugaagcaacagccugagcuguaccuuggccccuuuuagccauggccagagcagcugaaacacaggguaccaagucccuaggcugcacagagcagggugguccugggcccagcccauaaaaccaucuuuccuuuuaggccuccaggccugugaugggaggggcugcugugaagaccucugacaugcccuggagacauuuuccccauugucuuggggauuaacauuuggcugcucgguacuuuugccggcuugaauuucuccucagaaaaugggauuuucauuucuauugcauugucaggcugcaaauucuccaaccuuuuaugcucuguucccauuauaaaacugaaugccuuuagcagcacccaagucacauccugaaugguuugcugcuuagauuucuucugccaaauucccuaaaucaucucucccaaguucaaaguuccacaaaucucuagggucggggcaaaaugccaccagucucuuugcuaaaacauaacaagagucacccuugcuccaguucacaaguuccucauuuccaucugagacuaccucagccuggacuuuauugucuauaacagugucagcauuuuggucaaagccauucagcaagucucuaggaaguuuuaaacuuucccacaucguccugucuccugaguccuccaagucuccaggaaguuccaaacuuucccacauuuuccugucuucugaguccuccaaacuguuccaaccucucugccuauuacccaguuccaaaguugcuuacacauuuucggguaucuuuucaacaacaccccauucuacugguaccaauuuacucuuuuagucaguuuucauacugcugauaaagacauacuugagacugggcaauuuacagaagaaagagguucauuggacuuaacaguuccacguuucuggggugggggggccucacaaucauggcagaaggcaaggaggagcaagucaugucuuacauggaugguggcaggcaaagaaagagagcuugugcagaaaaacucccauuuuuaagaccaucagaucuugugagauucauucacuaucacaagaacugcaugggaaagacccgcccccgugauucaaucauuucccaccaggacccucccacaacaccagaggauuaugaaagcuacaagaugagauuuggguggggacacagaaucaaaccauaucaauagucaaguucacauaaccacacguagucguuuccuaacguaaaagagaaaaaagaguggugucaugaaaacaaugacugguuccacuuguaguucaugcaguucaaauaacuacacaagcuuuuccucaugacagccaugauacuucaguuuguagcagauaugcuuuaugcaaacuucccaguuugucagauaauauuaaaaagaaauauaagaguuaagauuuaauaaaaucaauaauuuuuuauuuuuuucaauguggauauucucaagugaaacuuuuuuacugugaugugaaguauagguuagugcuacuccuuugauucaugcuaagguuucagcaguuuuauccaccauugcuuuugcacuaucagugccaauauccacucagugaaagaggucaaauaacauuuaaauaacacuuugauauuauuaugaaaauaguuuugaccucaccaauggacaccuuaaaaagggucuugaugacccccaggauccauggacuauacuuugagaacugcuuccuaaacauccaagauauguugcccuugcccacucuacuuucuuaacuccaccccuuauuaauucuuaccuuuguuguuuuuauaguucccuaacuggucucccaaucuucagucuuuuucucuuccuuaaaaguuccuagaauagaaaucugauuuuguugauacacuauuaaaaucuuuccacaugcuccagcacaauuggauaaaauccagauuucuucauagaauauaaaagacccuuuauuaucauaccuaccuuaguaaccucuguuccugucaguacuuccuagucuuucagccaagcugaauuuacugguaauucccugaacacaucaugguuucuacaugauuucuacaugcuauucuuccuaacuguaauacucuuuuacuucccaccuaucccucuaauuguacgucauuuuuaaaucaccuuaugucaccaccuacaaaauuuuauauuagaauuuguuaucauacuuguauuguauuauagucauuuugcuuauaugucauuuuuuccuauugugagcuguuugaggucaggaacugugucuuucuuuguauucccaguacuuaucaagggugaggcauacaguagucauuuaauaaauguuugaguguuuaaaugaacuccauaaaaacugaaaauacaaauuaauuccaugguauuucauuuucuuuuccaauauaguucucagaguugcuaauuaauaauaaaaaaggccacagaugagaagaaaaagaaaaaaguguguguguguacauauauauauguacacagacauacacaguguguguguauauacacaaaguguauacacugugcauauauauuauauauaauauauaugucucagucacuuuauuggaugaagcaauggaucuuuauuuccauaauuuuuacuauaagauucaggggaacauucgauuuauauauguuuuugaaaaguuguaaugaauuacauuuuaaaaaauuaaccuccuuaauuuauuauaacucagucucuaaucaauuuagacguuuuuuccuaauuuagaauucuuaauguggaggcaaaaaugccaggauauuuccauuuuuauuaauauuuuaaaacuacuaucugggaauauuaggauuauuaaaauuacuuuuuaaguguguucuauacauuguuuuaugagaaaacuugguugauucuauuuuguuuuugaguuuaguacaguaaaauaaaaucuuguuaaagggacuucuaucagaaggguacguaacuagaaaucccacuuaacagaauccaguaauauauaucauuuaucagcuaaaacaaccucguugaaaagaaaacauuuuuuucuaagauuuuauaauguauaaaacuuuaaaaguuaaauuaggccuggugcagccuguaaucacaccuguagucccagugcuuugggaggcugaggcaagaggaucacuugaggccaggaguuugagacuaggcugggcaauauggugagaucucugucucugcaaaaaaaauuuguuuuuaaauuagcugggcacgguggcacacgccuauaguuucaguuucucaguaggcugagauggaggagcucuugagccugggaggucaaggcugcagugagcugugauugugucacugccccccagccugggcaacagaacgaaacccugucucuaaaaaaguaaauaaaaaugaaauuuaaaauguacauuuuuuuauauuuaaaaaauuuuauugcccaccauuuguucugcauaaugcauuguagauauauauauuuagauaaauccaaaucaccuaaaagcaaauuuuguagauuaugcuuuucugccuguugaccauuucauuguucguuagcauaauauuuaaaagugaaucauucggggccucacugauuuaaaauuuacaaugacugagucacuggacugaagccuagcuuuuuacagccccuugccuagauguugccuaguaaauuaaaauaacauguuuacaaaauuacaaggggaaauaaaacuuuuagugaccuuuauguacuuaaauuauugcuguauuauagauuuguugauuauaagucaugccuuuaauacauacuuguugauuaaaaaccaauaguaauugcaguuucuucaaaaagauucugaauuaauaagguauguauacuauagucagauuuaugacuuuucccuuuggccaaauauagcauauugggauuaugcuuggaauuauuuuaucuauuuuguccccauugccuuaaauuuuuaaaaauuggaauguucucugaucucugugucaguguuguacauaauuagaaugccaugguguaccagugagaaacaaaguagaauaguuuaauuccauugacugauggaaauugaucguaaaauguuaaaaaugguuaccuaaacucggaaauggguauauguaguuaguagauuuauaggaauaauagcaagucgcauauuuaauuugauaaauuuuauuugaaaauaguucccuuuuguacuuuuauguuuuuauaaggaauaauacauucaaaauugaaaaccaaaggauaauagugauuuugcucauaaaucuauuuuucagcauucauuuacuacaaacauugucaucuguucuuuuauuucauaauuaauuuaaaaauucuucauuuuuuuaucuaauuuaacauuuucauauuuuuaaagguccccaggugcauccaauuuuucaacuuuaccaaagaucucuccuucaucucuaucaaauaauuauaacaacaugaacaacagaaaguaagcacugaaucuuaaaaacucuuuguuuaauugaucacccuauuaugguugcaaaaaaucucuuguaucuaaaauuuaggauaaaagucuuaaugcauuaaaauugguuuucuuuuaaauuaccggucaguucuuccaugaguaacaacaaaaaagaaagcaauuaaauugcuucuugauuuaauacauauacugaaagaaauaaaacacuuaaauuuuauauacuaaacacuaaucauuaaaauauauuuagaaguuuguuagaacacaacuuuuuaggaagaauuuaaauucagaugucauuuuagaacuagauguguaaucacauauaauaaaguauuuuuaaaaaguguguaucagugauucucaaguggaaagcacacaauaaauuuuuguuuaugaaaaaggcaaucacuuuuucuugagaaguucagaaaaacaauuuccuuaccucuugccaaauaaaauuuagaaucauggaauuuauaaaaauuuuauugaaguguguguuauauugcuauaagaaaaacaguugaaagucaagguuacacagcuucacucugaguguauuaucuuguauugacucuuaguguauuaccuugaacauugacauguuuuuuuaauucaaaaaggaaaaaagaaaaccuuuauuauuuguaauuagcccaaauugugggaagaacauugaucuagagaugauuauccuuuuauuuuuuuuugacauguauagugccuuuuauggauuagauugaaaguauuuagauauuugcacuaacauauuaguauuagauauuuaucuaauacuuauacuaauuauguauuacuauuauacuaaucaaaaauuuuaguauuuagauuuuuuucaguuucuaaauggcaucugauuaucucagugaguaaauucuaaaagacuaaagcuauuugugaaauaaucuuuaaaauuaaaacaccaauaauuaaauuaaaacaccaauaauuaaaacaccaauaguuaaauuuauuuucuaacagcucagaaacagaucuuuguauaaaaagaauuuaauaugaucaggaggcauuguagacuaauacgaaugggcagauuauccaggaaauaugguugagaaaauuggcucauaucugagaauucuucucuggaauuuuaaauccaagauaauuguuaagcauauuuaaaaaggaaaaauaaauggaaaaaagaacuuguuacaaaugauaaaggauuuauauucuaaauauaucaagcucauaaaaaucagaaauuuucuaagacagucuuagaaacacugggcaauacaaguaaaggaauuaaauaagggacaaacuuuuuuugagguaggaucucacccugucacccagguugaaguacagugucacaaucacagcucccugcacccaugaccucccaggcucaagugauccucccaccuuagccucuugaguacuuggauuacagcacacgccacuacacccugcuaauuuucuuuuuauuauuuucauagagacagucccacuauguugcccaugcugguuucgaacuccugggcucaagcaauccuccugccucagccucccaagugcugagauugcaggcaugagccaccuugcccagcugggauaaauauuuuacauuuucacauucacuacugauuagagauauguaaauuaaaaccaugaaaaaccccauuugcuuucccuuaccucagucacauugggaaaaauuaaacaaugacauguauuuuuauaaugauucugaguguuuggaguacuagaauaauuuuuucuagcaaaauuguuuaccaauaugaaucaagaacauuuaaaacauuuacauucuuauuucaguaauucauaaaaagauaugugcacuauguguaauaauauuacaacauaguguaauacuaaaauacugaagacacugaauauucagaauuacacugcaguaucuucucuucuauuuaaaaauguaugugcacaggccaaaaaaaaagagugaaaauaaccccucguaauuugguuuguauuacaugagagcuuuaaguaaacuuaccaaaagucauuuuuucauacuagauaaaauauuacuuaugauuuacucauugcagauggcucucauacuuacuguaagagaauucauuuacagguauuuacagucauucuuuggagagauuuuuaacauuguauauagacuauguugaauguagacuauauuuugaccagaauuaccauauugguaugaguggucugguguguuucugguuuuguucuguuugcauucuuaguaaauacgugacaguauaaucuaaucucaaaaccucugacugcagaaacuauugagagaaauuagagucuuaaguuugaaugauucuaucauaugacuacauuauauuuuuagcuauuuauauuuuuuuaauucaaacacuaaaauagcccugucauauuauggaauuuuaauagcgaauagucacugagguaccaugaagcugugaaccauuuugagcuuaaaaauacauuuuuauguaaggauuaucuuucuuaguaaggaacagaacuuaagcauucguaaaauggaaaguuuuuuuuuuuuaacuuuaaaaaacuugaauucuaucguauuuaaacaacuguuuuacauacaauuuauuucuugaauuuccauucagcuugugggaagacuucagauagaaauagcauaguuucuuuaaaaauauguaaaauagguaaugaccuuuuuggauuaaguauguuuuugaaaccuuauguauguggaaauagucuacaaguauaaguaauauauuaaaaucaauaguuuaugaaauuuauuuauaaauucaagauuuaacccuacacugauacauuucuaagauauaaaauuuuuauuuccagaaauaagaauauuguuauaaaauaauuccaaguaauaaaguauacuuggaauuauuucauuuaaguuuaauaaguuuuuauuaaaaaccaguauuaugaaaaauccauuacuguaauauaguuuguuuaccuugugucauaauuuuaccuauuagucccuuguguauuugguuuugccucaguuauaauuuaaguacauuuuuaaauaucugucagauugucuuucugguaauaguucuauaaccuguauuuuucugcccugcuauauuugcuuugguauauuacuaauacugccuuuuaaaaauauuuuuaacguguuuauugucucaauuugacauuccaaaugcagaacacuuuuuuauuuuucuguuaauucauuuauaucuuuuucuuugaaaugaaaaugacucccuguaugagauugagccucaacaggaacugugaauuuuggaaacuaccagagcuagccaucuggcucuugauaaauuuguuagcuaaaagcaucauuucauuaacugaaaaaugggcauaauuauaguuuugaggauuaaauuauauauuuauaaagucaggugucagugcuaguuuaaaagucaaucugacaucuuuuauggaaagguaagguucaauuucacaaaaaaaaaguguauuuuuaguguauuuuuauuaaagaaggauauaauacagaauuaaucuaauauaauauuacaauucccauuacuauuacuguaaauuuauuuuugcaaaguagcauagccuuaaaagaugaugacuagcuuaagaucuuuaggaaauaauuaguagacauagucaugaaagguacuagaggcuaucuuuagggcccagauuuucauauauuuuuugaauuauauaaacugcuaguuuugauauuuuccaugacaagccuuaauauuucauuuagagcacacauaauauguggauuauaagugaccgaucaagauauuaaaguaucuuaaauugauugauuuucauuaucauuuugagcaucuagacuaucucaaucuuugagcaaaguuguagauauuauuuagggauuuagauuuuuuuaaaaacaaaaccaaaaaacugcuuugcaaguaaguuuuuuguucaguucucaguaaauagcaauuucuaucccaucaaauuccaucauguugcugcaaagaagaguagagcuuccagcaucccuuuguguuacacguggggagagacaggauaucugaauauauacuuauggaaugagcauguaaaugugcuuuuagucuuuucacguguguguguguguauaggcaugaccaugcauuugggcauacuuuccugugugcucuggcugcuuaaauuuuacuaugauuuuacagccagaaguuuuuucuucucuguaauguguagaauguguagaaaaugaaagccuugcuuuuuuuaaaauaauauacagcagaucuucauuuuuagcacuacuuaaacuuauaaaagaaaaacaggauuuuuuuuguacuucagcuuuuuguuguguguacccaaaguuagauucaauaauccaauuaugagcgaaaauacuuaaaauugcuaauaggcgcuuuguacuuuauuaguuacuaggaauaugaaauaaaaugugaaucaugggcuaaugauuugccaaagaaagaugcaugaauuauauuuuuuguguuuuguuuuaguuuaagucaaguaaauagcuauaagucuagcaauuccgaauuugaauugauuaauguuacauuucuuuggcgccugcuguuuuuaucucaggguggauuauuuuuucagaguugaggaguugaccucuuuuguuuguagaagaaaggaguguuuuuuaaaaaaugcaaaaacauuaguaggccaacauuguauguguaauuuuagguugguuugguuuuguguguuuucucuggggguggugugugugugugugcguguguguguguguauguguguuuacuaaagacuuucuuagaacagguaguauaguucacauaaacuuuuauaauaauaaagugagagcguccuauauggaauaauaaagugaaguauuuaaaauuauaagaaaaaacuacuuuaaaaaaguaauaccaggaauaaauuauagccaguugugaauugcuagagauacugauuuaucaugcucauuuauaaagcuguucuauuuauagcaucauuugcuuuuaggaaagaucucauucagguuuuuucuaauuaauaaaaacagauugaaagcaugcuuuugaauuauauccaaaauauucaucauacauauuuuauaagauaaccuauuaaaaaauaagaaagaauccauucuuuuucacaaaauuauuuuuuauuauaugccaaaggaagagggaucguuuaacuuauuuucuucuuucuaaaaauuauacugauuuuguaacuuuuagaauauuacaguuuuuuaauauuaacauuuaaaauaucuugagguuauauuuaucugauuaaauaaacuacauuguucugagaaaccaaaagaaagaaaaggcaaauaacacugggauauacuugcguggaaucauuuuugcauuccuguucacccaggcuuuuuucugcauuugaauacuaguuuuugcuggucucgcauagaaacuauaaauggaaucuucagugcaucauaacagugaggucacaguggccuuggaaaucucugcucuuaccuguaacuuuuuaaagcauaacucuuacuguuucuaccauuuuuacucuauuacaauaacagaaugcaaagggucauaaaggagaugauuuguugcugcgggugguauuuaaaaucugaauguuuuaaauuugauggagcaauggggaauggagcaaacuguaaagcugcucuaguuaaucaaagguaggaagauauaauagugcuuuguauugguuggugugguauaugagaguuauuuuguugauuggauaaggaguaucuuaauucagggugaguuauuuuuuugagguucaagucuuuaaaaaaguaucugaguugaguacuuuauaaaagaaauguaaugaucaaccacauaucucauaaauaggccuaaaguacucuuuauuauaaauauguuguaauauaauuggcugcauuaugaaaauuuuuuuucuuccagugugaaaaacucaaauuacugucuuccaucauauaccgcuuauaagaacuaugauuauucggaaccuggaagaaacaaugaacagccaggccucuguggccuaaguaacuugggaaauacguguuucaugaacucagcuauucagguaggucuuuguaaacaaaaugaaacucauguuucauggaaaucuguaauacaagaagauaaaguuggguuuuucaugccagaacaugaguauauguuuugaaaguucauuuuucauggaagauuuaagcauacauauuugacuuauucauucuacuacugguaguggaauauauguuucucaauuaggugaccugugauugauuaacauaauguacaagauuauauaucacuuugcaaaaauauaauaucagacagaaaacuuaagcugucuaaaaagggagggaaaaaaaagcaaaacuaaugaguucccuccauuauucaguagaagucuguugcacuuuuuuuuucuuuuuuuuuuuuuuuugucuuaaugggaaauuaaaauuuuaaaaaggaaaaucuugggaacuucuuuuuguauacauacuuuaacaaaucacuuucccuuaaaggucuuuuaauuuggggauauaagagauaacuacuuuuccccugcccccacccccuuuuucuuuucuuucugcucuagucuauauccucaacuuguuaaauauuuaugucuuugauugauucugaaguaaugagagagauauauuuuuuaauaucacuguuacuguguauaaacuuagggcugguuauuuuauuccccuuuuacagauaaaauuucuguguuuauaaaagcucagaauaauggcaaaccauuuuugauauuugaauuuuaaccuuuuuuucgucagucucuugugaauucuggauuuuuaguuuuaaaucuaaacuuuucuguucucuauucuuauuuuuuuguugaaucuccuaugcccaggaggcagccucaaaagauauagauuaaaugcaggguauagauugauaaggacauuauuagacaucuuucucacuaucugagaaaaggaugacucuucaccauucaguauucuaagugaaucuuuuuguacaucaucauucauacagcuguuuccuaaauuaaccauugccuuuauagcauucuuggaaauuagaaucugucauacacuauaggccaggaguuagcauccuuuuagaaauugaauagggaaggcauaaucgauuucugguauuuugcuuuagaguugaaccacuugggaaguggccuaucugccuaagcagauagguuaauauauagguuaauaaacucuuccuuuaaaucuucaaaugaguaauccugcucauaguauagugugaauuacuuuauucaaaauaguuuuucaagaauucuagcacuaguuagacauagagacaauuuaaauuuuuaucuuuauuuuucuagaugaggaagaaagccaaaauguauuauuauccuaauaguuaaauaacaaaguaaaguacaugggugcuuagcuuucagagauaggaaugggacagacaaauuauaauaucuguuggaccaucucuggaacauguuuuauguaaauuguguuuauaccaguacuagaaaacccuguucucagaucaccaaguuauauuaauuuuuauguaccucuuuauccuugaacugccaaaauuacuuugguuccagaugcuugauaucagcuagaguuuuuuuuccuaguuuagaaaaccaaucuuggugcuuuuucauaaauauuaauaaaauauuucaacaacauagggauucaaaauuugaaucugucaggagagcacaagaguuuguguugaugcuaaucauucaugggaggcuugggccagcauucagacuaaauuccuucuaaagcaauacugcauccuaguuuucugugccuuugauacaucuguuuaguauugucugcauaugguuaacugcaauuucucagaaauagguauucaaauugaaucuuuuaaccagcuagguuaagcuagauuuggcaucguuuagcuuucuugcauguuauguuuaaggugugaggaucuucaguuuauucauuuuugcuucuauucaaaacuauuuuauuagaauaaauugauagcucuauugcagacacuccuaauauauuuuaccaucacguauuccauuucaucugagacacagccgugagcgugaugguuuauaauuuuaugguaauagccauaaaauuuuuugacaaaaauuuuagcagugaguauuuuaagcaguggauauuauuucaucauuauagcuuuauuuaguuggaaacuauauugucucuaaaauaaaauucuucaaacaauuuggagaagagaaaaaugaguuuuuacuugugcggcuuuagcuuuuaguucacaucuggaauuagaaaagcuaggccuuuaguuuuauuuucuuaaaacuuccaugauuuuuaauugauuaagaugucagcucucgagcugaaaauugacuguaagagggaguacaaaaugguggcaguagccuuuacuccucuauuucacaaaaauucauguaguucauagauccaaaaauaaaaaggguaauagauaacuaauagaauagauucuuuagguuuugucagauacuauuucuucaguaugcuuuuuucaaguuuccuuguaacuucuuugaaauugaagacguucaugaauuuuagaaaauauuaucaaauauuaucucuacugacaauuugaauuuuaauguaaccucuuaaauuaauucaguguccuccaaauuuaagugaucauuucagcacaucaggugguauaguauuaacauauguuaaaaaaaaaagaguguaaaaaguauacuuuuuuaauguaagcguggguuauacuuagcccaucaguagccuugagauagugaaaucuuuugaccacacaugauuaaaaacuaagcagcaccaaucugagugugauuuaacauuauuacuguuauuauuuaauuuaaugauauugguacuuaagauuuucugauguaaugguaugaguauuaaccuuguuuggugaauaugguacugccauauagcacaguaaaaaauaacaauacaacaguuuguccaggcauggugacucaugccuguaaucccagcacuuugggaggccaaggcgaguggaucaccugaagucaggaguuugagaccagccuggccaacaugaugaaagcucaucucuacuaaaaaauacaaaaauuagccgggcaugaugguggacaccuguaauccaagcuacucgggaggcuaaggcaggagaaucgcuugaacccgggaggcagagguugcagugagccaagauuacaccauuacacuccagccugggugacaagagcaaaacuccaucucaaaaauaaauaaauaaaugacaauuuaaaauaaugugaauuuuaaaacaaugcaguauaacaauuaacauagcauuuacauuuuauuaaguauuauaacaaaucuagagaugauuuaaaguauaugugaagauauauguagguuauauacaaauaacaacaccauuuuauaucaagaacuugagcaucuguggauuuugguauccccaagguggagagggggcuccugugaccaauccccuguggauaccaagaacaacuguauauccugaccuuaugaagauuauagccuagauauugugauuuucaaacucuuuguauuuuagcaucaaaacuuuuuuuuaaguuaccguggaaaguuuaauuguauccccaauauuuaaguagauaugguaaaauugcuuugguugggugaaguucccagaaccccaucugcuuuccuuuacuuuccacaauggccccagaagcuuucucauggaucccaggacucugaggaacaguuugaaagccaaagucuggcuugaaaaaaaaaaaaaaaaagaaacacauaaaaaacuaauaauacagauuaagaucacaguuuauggaguuacacuacuuggauuaaaaacauggccuuccugcuuauuauaauaacuguauuucccuagacaaguuaauuccacaauucauuuuucucaucgucugacaagaaaauaauaguacccuaucuuaggaguuuuguaaggguuacgugaguugaugguuuuaacucguaggaugcugacuggcacauuauaaauacugaauacauauuauguagaaauuaucucaucuuuuuuuaaaauucaacaaguuaagcagaaugacucuggaaagauucuguucuccauaaccguucuaucuguccucuuuucuugagucuuuuuccacguggaccuuaguggacuaagaagaaauaauugaguguacuuuuauuuuucauauaguguuauuguaggaaugguauuuaucaacccuuuaauuucugaacuaugcuaauuuaacucuuccuaggcaagcugauaaggaagggauauaauagcauagaauuguuuaugaauauucuaucuguagggcacuaggaaauucaaaauuguugaguuugguuaccccuagccccugccuccugaguaguuaugauuauaggcauauaccaccaugucccauugguucaaauaauauaauaagauaguuuucuaguucccuaaaucuguuacuccaucuagagaaugcccaguuuuuaaauuuugcauuauuggugauaauuuuaauuagcauuaguucaguagauucaagagcacuucaacccuugucuuuuucauugucaaggccuaccuaggaggcucaugguuaguuuccuggaugaagcaucuccucagauggauuugaagcaggggaguaauguggucuuuuccauuggaaagcagcauggcauaagaugguuauuuucaaaauauuuacuuggacauaauagagcuccuuagauagauucuaggaagucauugaaaaaaaugauacuaaucaaagacuuauucauuauuccugucauaauauauaaaauaaauugggauuucaagcauuuuuaaggucagcuuuuuuuucuaugaucuguuuauuaggaaaaaacuuaauuucaaaaauuuagaagaauguuaaauagaaaguuuaaacuuuuuuaaagauuuaauuuaagagaauaaguaauacuacacagaaauaacauuuuuaagaaacuagauagaucuucauuacauuguaaaacagagaaaaaguuauuucugaagcuguuauuucuauguuacauuacuucaacuagccuacucuuaccuugagacuuucuuuuugcauuuauuggaacucaguuucuuagaaguccaguuuaacacuaaaccuucuaguuuuauuuaaauuaccaaccuuauauuuaaaugaauauacuuuucaucguaaaaggaaaaaccucacuucugagacacaaaacacuuuuuaaaaaauaguuuaggaucuuauauuuguucugauaaacugagaacguggcuaaugaaaaauuuaaaacuacuacuuucuaggucagguuuucauccuaauccaggauguuaaacucaauuaugugaguuccuuucauguuaugugccagaaauuacauagcaaauugucaucaaaaauauauucaauccucugucaaaugacaacucagucaggucaucuauccauuuugauaaaagcaaaaaaaaaaaauguaaacaaccuuacuugcauuagaaccauucauuuuucucaacaugaauaccaauguuuuuacuuuucccuuuggacuagaauagcccuuccuuuuugaaagagaacagaggugggaaagaagaaccuacguucucagacagauuauuuuaagaaagaguauauaugggauaguucuguaaaaauuuaguguucacaacuaggggaaaaaugguaucucuaaaagaaugccuugcacuuguguaacuuggcuaauaaugauuuguuaugaaaacaugccuuucuuaaucucagauggagacaugagauuugauuugucgcuguucacauucuucucagugaauaagcaaaauucccuaagauuagugccucuuucugaauuaaguuuuuauguguuuaucugucccuaauucuguaguaggaaaaugacauaauagagaucuuagagaaauagagagguucuuuuaaagaguuguaaauuauuacaucuaauucuaaaauacaaagugguuuuacuauccuggcuaggaaaggccaacaccaauuuaauaauauacuuauuagauaguauuguagugacuacaucuuauaacagaaguuauuaauguaauuaggcugaaguaucuuguaucaauuauuauaauuauuucaaggauuuuuuuuguaauuaaaagcaaaacaaaagaaaugucaaucuguagucuguaaugggaacuacagauuugcucccucccuccaagaaaauaaaaggaaagaaaaaccuauuucagauuuacuucucuuacuuaaaaucaagcagcucauuuuuuugaugucaaaauguuuucuaaaaguuuaccauuuacuucuuuacaaugauuuauaaacuauucugggcaggggagagggucagugaguugguuacuuaaaccauuguucgauuaauaguaauaucuaaaucaauuacuaguucucauauaaacccauauuaaaacauuaacagcccuguauugaaccugcagccucuguuaagagugguacccuucuuugcauaaugcagguuauuuuuuuauauuguuuuucacuuaauuuucucuucacagaggucugugaguuagggcauaagaaucucuauuccacuaaugaggaaauugaagcaaggaaaguuugauuuccagucacuaagacaaguuauuaugaguuguuauucaguacauuuugagauaauguauuuuuuugaaauuaugccaaucaaccuauaagaaaugcuuauguuuuguuuuuugugguaaaauauaacaauuugccaguuuaaccauuuuaaguguauaguaacauuaaguauauucacauguuguacaauuauuaaaaauguuuuuauguuuaguucaaaugauuggcccccauaauacaagaugcucucauuaaguagcauuaauguugugccauuuaaaacaguuucccuaggaggugauauacacacuuacucauucaauguucagaauguuaaaaacuauucaaguacuccuuuuggaauugcuuuuauucuucugaguaucacugguggauauuuuucauccuucaaugacaaaguugauuuuugaaagccagaaguuauucagagcacuauuuucagaauauuguagauuaucaagcuggguaauuuuuuucaaguaauucauaaguaaugaaugacugaugaagucauuuacucagcaaauauuuauugaaggucuauuaggugacucucacucucauaaucacuaauuaugccaugaugaacaaaacaguuuuuucccauggaguuuacagucuaaugagggagacaaauauuaaaucaaucaugaauuaugauaaguaucaugaaagagaaaguagagugcuaacaggaacuuggagagcaccuguuuuaagcugggugucauauuuacgaaaaguaacaugagcuuugaccaaagaauauguaugaguuuggcaggugaaguuagaaggaccaaaaacaugugcaaagccacuaagaagggcaaguuugaggaaucagaaguguaguuuguggaauaauguaugaaggggagugagacaaaaugaguuugaaggaguaggcaaaagccagaucauauagggagaauuuagauuuuaauguuacaaaggcacuaaagguuucaggcuacuaucuucuuaacugguucauuccauuugucugcuagcugguuucuuugcuucuauccuuacccuccacaaucuguucuuaaaagaacagccagcaauucguuucaaaccuaaggcauuuucuauuacuuaggcaauaacacaaaaugccuucucauuucacucaacgaucaaugaaagccagaguccuuaaaaaaaaguacaaagcccuguaggaucuggccccaugcuagcuuauuuccuaucacuuaccuccaugcuuaccuuguuccauccucacccucacaugugccaagagcgugccugccuuagggucugugaacuugcaguuuccuauaccuguaauguucuuccucuaaauauauauauucuugcacucucacuuccauuaggucgcuauuaucuaucagugaggugcuucuucagucacccuguaaaaaauaaugacugccccacauuccacacaguacucauaaccaucuggcauguuuuauuucuauuaggguuuuuugcuugucuguguaucuuccccuacucccaacacagacacccucuccccgcguccccaccccgugcucucucucucccucucucccucucucccaugacugcuggaauuuuguuuuagucacuguuguagccccauugccuggaauagugucuggcauguagaaggcacucaaauuaaugaaaggugaagggaaucacaagugucucucuaguuuuuggcuuauauaucauaaugauagauguaaccauuuaaugaaauuccagaguaguaggaagaagaacauaguaggagaaguaaauuugggguggggaggagauuaugaguuaauuuuaggcauguucaguuugugaugucugugaaacauccaagcagauagaucauagacaguuggauauucuaguauggaauguagaucagaggccuaagcuggaaauaaaaaucugcgugucguagguggugguuaaaaucauggaaaugguuguuucuaaaugaggguaucuaugaaaaagacguccgagaacuaagcccugcaauacauuugaauggaggaaugagacuucguuugcaauaggaggaaagaaagggauuacggaugcaagcaaugucuagauucucugacggcuuccauuauccccaaaauacaagacuagaucauuagcuaagaaugaaaggguaagaagauugcucagcaguauugaggucucauuugauauuggagaucaucaauucagaauaguauaaauguauucacuugaaauuuuuuuccaacaauguucaguugcauggugcauaaaacagaugccuagauucaucuagaguuggaaagagaaaggggcaaaggaguuauuaauaaaaagcaaccaaacuuguuuucuuguuuguauuuauuuauuuauuuagugaauggaauuauuuuuuuaauuuuucuuuuuuaucauauuauuauacuuuaaguucugggguacaugugcgcaaaaugcaguuuuguuacaaagguauacacgugccaaggugguuugcuguacucaucaaccugucaccuucauuagguauuuauccuaaugcuaucccuucucuagccccccaacccccaacaagcccuggugugugaugucccccucccuguguccauguguucucauuuuucaacucccacuuaugagugagaacaugcaguguuugauuuucuguugugauaguuugcugagaaugaugguuuccagcuucauccaugucccugcaaaggacaugaacucauccuuuuuuauggcugcauaauauaccaugguguauaugugccacuuuuuuuuaugcagucugucauugauggacauuuggguugguuccaagacuuugcuauugugaaaagugccgcaguaaguguaugugugcaugugucuuuuuaaucaaauaauuuauaauccuuuggguauauacccaguaaugggauugcugggucaaaugguauuucuaguucuagauccuugaggaauugccacacugucuuccacagugguugaacuaauuuacacucccaccaacaguguaaaagcauuccuauuucuccacauccuuuccagcaucuguuguuuccugacuaaugaucgccauucuaacugguauaugagaugguaucucauugugauuuugauuugcauuucucuaaugaccagugaugaagagcuuuuuuucauauguuuguuggcugcauaagugucuucgaguagugucuguucauauccuuugcccacuuuuugaugggguuguuuguuuuuuucuuguaaauuuguuuaaguucuuuguagauucuggauauuagcccuuugucagauggauagauugcaaaaauuuucucccauucuguagguugccuguucacgcucaugguaguuucuuuuccugugcagaagcuuuuuaguuuaauuagaucccauuugucaauuuugacuuuuguugccauugcuuuugguguuuuagacaugaagucuuugcucaugccuguguccugaaugguauugccuagguuuucuucuaggauuuuugugguuuuaggucuuacauuuaagucuuuaauccaucuugaauugauuuuuguauaaguuguaaggaagggguccaguuucuguuuucugcauguggcuagccaguuuucccaacaacauuuauuaaauagagaauccuuuccccguugcuuguuugugucagguuugucaaagaucagauugauguaaaugugugguguuauuucugaugccucuguucuguugcauuggucuauauaucuguuuugguaccaguaccaugcuguuuuggcuacuguagccuuguaguauaguuucaagucagguaacaugaugccuucagcuuuguucucuuugcuuaggauugucuuggcuaugccggcucuuuucugguuccauaugaaguuuaaaguaguuuuuuccaauucugugaagaaagucaguguagcuugauggggauagcauugaaaguaaaucacuuugggaagcauggccauuuucacaguauugauucuuccuauccaugagcauggaauguuuuuccauuuguuuguguccucucuuauuuccuugagcagugguuuguaguucuccuugaagagguccuucacaucccuuguaagugguauucguagguauuuuauucccuuaguagcaauugugaauggaagugcacucaugauuuggcucucuguuuaucuguuauugguauauaggaaugcuugugauuuuugcacauugauuuuguauccugagacuuugcugaaguugcuuaucagguuaaggagauuuagggcugagacgaugggguuuucuaaauauacaaucaugccaucugccaacagagacaauuugacuuccucuuuuccuguuugaauacccuuuauuucuuucucuugccuaguugcccuggccagaacuuccaauaauauguugaauaggaguggugagagagggcaucccugucuugugccaguuuucaaaggaaugcuuccaguuuuugcccauucaguaugauauuggcuguggguuugucauaaauagcucuuauuauuuugagaugcauuccaucaauaccuaguuuauugagaguuuuuagcaugaaaggguguugaauuuugucgaaggccuuuucugcaucuauugagauauucaugugguuuuugucauugguucuguuuacgugauggauuacuuuuauugauuugcauauguugaaccagccuugcaucccagggaugaagccgacuuaaucaugguggauaagcuuuuugauguggugcuggauucgguuugccaguauuuucuugaggauuuucacgucgauguucaucagggauauuggccugaaauuuucuuuuuuuguugugucucugccagguuuugguaucaggaugaugccagccucauaaaaugaguuaggguggagucccucuuuuguauuguuuggaauaguuucagcugcucuuuguaccucugguagaauucggcuaugaauacaugugguccuggaauguuuuugguagguagacuauuaauuacugccuugauuucggaguuguuuuuuuguuuguuuguuuguuuuuuguuuuuuugagauggagucucacucugucgcccaggcuggagugcaguggcgugaucucagcucacugcaagcucugccucccagguucaugccauucuccugccucagccucccgaguagcugggacuccaggcgcccgccaccacaccuggauaauuguauuuuuuaguagagaugggguuucaccaguuagccaggauggucucgaucuccugaccucgugauccgccugccuuggccucccaaagaaauuucagacuuuuuuaugggccuauucagggauuugacuucuuccugguuuagucuugggagaguguauguguccaggaauuuauccauuucuuccagauuuucuagguguuuauaguauucucugaugguaguuuuuauuucuguggggucaguggugauaaccccuuuaucauuuuuuauugcgucuuuuugauucuucucucuuuucuucuuuauuagucuggcuagcagucugucuauuuuguuuaucuuuucuaaaaacuagcuccuagauuucauugauuuuuuugaaagguuuuucgugucucugucuccuucaguucugcucugaucuuaguuaucucuugucuucugcuaucuuuugaauuuguuugcucuugcuucucuaguucuuuuaauugugauguuagggugucaauuuuagaucuuuccugcuuucucuugugggcauuuagugcuauaaauuucccucuacacugcuuugaaugugucccagagauucugguacguuguaucuuuguucucauugguuucaaagaacaucuuuauuucugccuucauuucauuauuuacccaguagucauucaggagcagguuguucaguuuccauguaguugugcaguuuugagugaguuucuuaauccugaguucuaauuugauuuuacuguggucugagagacuguuuguuaugauuuccguucuuuugcauuugcugaggaguauuuuacuucuuauuauuuggucaauuuuagaauaaguacagugaggugccaagaagaauguauguuuuguugauuugggguggagaguucuguaaaugucuauuaggucugcuucguccagagcugaguucaagucccgaauauccuuguuaauuuucucucucauugaucugucuaauauuaacagugggguguuaaaaucuuccacuauuacugugugagagucuaagucucuuuguaggucucuaagaacuugcuuuaugaaucugggugcuccuguguugggugcauauauauuuaggauaguuaguucuucuugaugcauugauccuuuaccaguauguaaugcccuucuuugucucuuuugauccuuguugguuuaaaguauguuuuaucaaagauuacgcaaccccugcuuuuuuuucuugcuuuccauuugguugguaaauauucuuccauccuuuuauuuugagccuaugugugucuuugcacaugagaugggucuccugaauacagcacauucaugggucuugacucuuuauccaguuugccugugucuuuuaauugaggcauuuagcccauuuacauuuaaggugaauauuuguuaugugugaauuuguuccugucauuacgauaguaacugguuauuuugcccauugguugaugcuguuuuuucauagugucaauggucuuuacaauuugguauguuuuugcaguggcugguacugguuguucuuuccguguuuuuaguagcuaauuuauuuagcugacucaacaagcauucauugagucucuacuaugugccaugcauuauucuagacauuggcauacccaguuuuaaaagacaguacuuguccucuagaaguucauguuuagugaaugagguagacauauaaauaagauauaauauguuauauaauagaaaacaugaucagcaaaaugucauggaagcaaaguucuuucuuugagucuaugggacauaagugaggcuguaucaggagggugaaauuugagucacauuuuuauuucauuuauuagagcacauuacuguccauuauaacuuauauguucauuuggucauaaaauagagaauuaccagggaugcaaauuaaaacauuauagcuuaugcuaguuucuacauuuuuuucaccucagaaauucccguaucagaaauccguuuugccacagcaaaaacacauuguucacacacucaauaaaaacauauuggaauccuuuauaugccaacugguuuuuuuuuuuccugcuaccugauuuuuuuauuuuuucaugugccagcugucgaugcuuuuucacacaugugccagcucuaaaaagaggaguaccuaaaauaucuugagcaauauauaaugcuuauucuuaaugccucaauuauauaccggauuugguguauaccacauaaugcugcuucuguuauuuacuauauuugauacguaauugaggcauuaugaauaauuucuagggcuuuucuaagugcaguuuucuauacuuugccaggagaagacuucuaauaaguauuuuuaaaaugaaacaaauuugugacaaaaauguuacuuuuuuaaauaaggaaauccuuaauauuaauaguagaaugaaacauacauuuagcuuccuuuuauacuuacaguaguaucauuguauaauaacauaccaaaaauauaugugucaucaugaugauaccuggaaccccucuuaccaucccugagaccuguucccuuguuuacucuuuguuuuauucuucuuuuuuguuugguuuuuugagacggagucucgcuguaucaccaggcuggagugcaguagcgcaaucucagcuuacugcaaccucugccucccggguucaagcgauucuccugcuuuagccucccgaguagcugggaccacaagcgugcaccaccacucccggcuaauauuuguauuuuuaguagagacagggugaucugcccgucucggccucccaaagugcugggauuacaggcaugagccaccacgccuggccuuguuuuauacuuuuaaccucaccucuucacugucuuucuuccuuucagcguauauacauagucaagucuuuuuucaucugggaaguagagugagggagacccaugaccuugaacaggaugaucugugcuuucccccuacuuucccaucucccauucaauaguccuuaucucaccauagccugucagcugcuuagcaugguaggucaaagcauggauuuuggaacuagacugccuguauucaaauccuaauucugccacuuacaaguugugugaccuuggauaagaaacuucguaguuucuucaucugugaaaugaagauaaagugcuuaggaagugcuuggcacauguaaacauauaaaaauaucaaauacuguuaucauuacuguugucaugauaccacccuauagaaauugcuuuugauuagcucacucuugaccuccuguuugcuagguuccuuguacccccuuuaccuuugagaauuugacauccaucuauauacuaauauccaaaauuucccucauccguaauucucucuucugaauuucccuccaauauguaacuguuaaauggacauuccugccaaguuaaacuacauguaacuuaaacucaagaugccuacuuacacuaaucuugauuauuuuauuuccuacacuuucuuauagguacaacccaguaacccaagucaaaaaccgaagacuuaucccaaguccuguucauucuacuucuuauauagcacauauuuuucccuuuccucuccuguuacauuauuucaaugcuuaagcaucuuuuuugugaacuaucaaaauauaucugugucaucucuuuguuccaucauuuguccucuucaaauccauugaauacagugcuuccaaauuuauuguuuuauaaggcaaauaugauuauuauguguuuaaaaccugugccccaucaccuaaaggauaaaauucaaacuggauucugucuaccuguuuagccaaaacuacuuucaauucuuagaauuuauuauguuucaaaacucuuuguauauacuguuaccgcuucccuacuugcguuuuucauacuuucucucuuucuucuauccauuucucauggacaaauacguauuauguggugagaauugugaaagcagaggcuaucuuugguuuucuuuuauauccccaguguuaguauaguaccagauaaucguaagcacaguagaacaguguuuuuuacaaugugucuauggacaagauaauucuggucaacaauaaaauaagcacagaaauuguaagugaucaaaagucucuauagcaauuugauaggguaauuuuauaucaaguuuaauaauaaaaagcaagacuuguuuuuuauaugaguguuuuuaauuuuauuuuucuagcgguucauuuuuauuauaucuuacacaaguaccaaucugugguggaauuuuuaaaaaauuaguccuuuccauguaauuauugcacuuucacacccacaauaaagcuucuaccugaagugccuucuaggucauugagaaacauggaaaauuaucuuccauauagauuuagaggaaaguguauuuugcuguggagcuaaucauuugaaaacugggaauagcaucaggagguaaaaauagcucgagcggaaauauuuggguuuguauauuagcucugcaacuucuucugugugugugaguaagcagguuacuuaucuauuccaagacuuaguuucuucagcucuaaaacaggagauaacgcuuacuaaauuuacuuuucagagcuguugcaagaauuagugaaauguacaucaagauguauuuuaauaaaaauaauguguucgguauuuuaaaaaaaauuaguucuuucacacaccugguuugcaaaacacugcauuagaaaaaauuauuuaccagagauauuugaaacuugaccugagcuaucuaaauucccaaagauugcacaguaauuuuaguaagaauuauagcacauaauauauauauuuauuucuugcaacuggagggucagagagcuaccuauauauguauaauaacucuuggaccauauacgguccugcaaaugcagucgaucugauagcacuugaauugagcuggcauguuagucacagcugggcagaucauaucaguaccaccauggaaauaguuccuugaaagauuucagugaaugauaggaaaaaaauucuuuuagaacauuauuuguauacuuacagagacucuugaaguaaugaucucuuaauauuuguugaacaauuaaaguuuuuuuauuacaaaaauggcuuguuucucuuaaagaauguaacaaaucaauaaacuuuaaaaaaaaauucugcuguccuuuccuguaugccuuugcagaagaacuaagaucaguaaacucacacaauucuuaauauuuauuuauucaaaauuguuucuuuacugaauauuaugugcaagggacugaacacauacaaaauuauaaagaaccauuuuuucauaaauccuuugacugucuugcuugccuaaaaaguuaauucuuuuaaauuucauugugagucaguuuugaauuauuaaugggauaggaaauaacguaauuuaacauuaaaauugaauuccauucaauucuucuauuuaagcuuccauucuuuaaaauaaauauaacuuacaccaacauuucuuaauguuauuagaaccuucugguuuuagcauacuucccauaaagugaauauaugaaaaaguuuuaaaauucacgaauagccuguuacuaaaaauaaaauaaugaagucagacaacugcugacauaaucuaguauuaauaguuucaaaaccuuauuuaaaaacaacuuguccuagucuucuagccuuuuugcuggugaaauaauuaucacagagacuuccacuuuuaucugugucauaagugaauccucuauccauauuuuuuuuggcuuucaauaugaaaauuaauggucuucacauaaucauggcuuuuuuaacauugacaucuguaguuacagaauuuacucacugcaaguaauaggguagucuuuuugacaaacuuagaguuuuccuuccuugguccuguguagaugagggcaaaaaaggauugacauuucuuugcuagccaacaaaauguuucccaucagugucaguauuuauacuuccuagaacuuugauaauucuucauugaauucaaauaguaugugaagaagaaauaccauagaauuucaaagaagggacaacaguggggacuuuaaaugaaguuuaauuuuauucaugucuuaagcacagggaccagauuaaugauauauauucaaguguuaggacaacauccuuguccaguucaaaaaccuugccuuuaaaacuaccuuuauuuaacauuuuaauauuuuaaguagaguaugcuaguucucucuucacugacgggggaaaaaaagcaguuaaaagucuuaaaaauauaagaggaaaauuauauccauuucuauuuuacuugccuaaguuuguucuuuuuuuaaaguugaagaaaaauggagauauaaaguaaaacagagcuguagcuguauugcugucacaaaauaugugaucuucagaauugaucucucaaauuuaaugagauuucccuuucuuagaaaaaauauaacaaaaauaagaacaucaagugacuuaaaauauaucauuuuaaaaaucugcuugaugaagaaacaggccuauauuuguaguuuuuaauugaaaaaguuuaccucaaacuuugcuguguuauccacuuguguagcauuacagaacuagagccaauaucccaauauuaguagauugcuuuggaaucauacaguaccuuuucagaaugcuuauacuauugucaugauuaauuagaaaacaauugacauggcgaauaugaaaauucuuuuccaucuaaccuuaaaauccagaaaaaaacuguuuaaagguauuccaagaugacuuuaaccauggauuacuucaaguuuuauuuuuuaaaucauaacaaacuaagaaugaaucccuuauuuuauuuagaaugggcuuuuauuuuuaguacuggucaguuagaagguauagccauuuuuuuaaggguugugagugguauuaccuuuugauuaguuauagaaugaguuacacaacucaaaagcuuuagguaaucaaaaauuaaguuuguuuucuuuccuguucuaguuaccgguuuacuaaaauagugagcauacaugaucacuugagaauugggcuucuggagcaccugaacagaaagggagugguucauauucagcauuacaaaagacaacuuucucuuuuugaaggggauuacuuuggcuauuuuccagguacuggggaaauuccaaaugcauuacaaguuauugggauggcuauuaauuauucauuuccuaaaauauguugacugaagacuugagauuugguuauauaauagaacauuauuugacuucaucaauuuauaaaaaacuuauguagaaauuuagcaaaauacaaaauugagacucuuacaugcagcaguuauauuuuuucagauaacucuagaaacaucaggcuuauuagucagaacauacuuaguagaaguacuuucugaaaauaauggaagagcaauagaauuugugcauguguauauaaagaaaaguuaugugcaaugcauugcaucuuuccaaguaauuacauaacaaaagaaaaucauauuuugcauaauauuucaguuuuaggauauuagguuaaggaaggguauuuauaacuagagaguuuuuaauagagaauuaguacuuuaauaaagaaugcauaaaccauucaaauauuuuuauaaauaauucuucaagguguaauuaauggccugaauauauugaaccauaucacagaguguccauuggaugagacauuugauuauuuagaauaauucuucuuuagaauuuuuaugucugcuucgagguugaagauuuaggggaaaugaucuucauaaaaauauauuuccaaacauauuuccuuugcauaccuuuuccuuacggauuuaucuugauaguuguuggggaaaucauaaggguuauuuuccuucauuaggaaaaccucuuuaggcaucauuuggacuuuuauuuuugaacauggagaacuuugggcugcauuugaauuauaacagagugcaauucagaucucauuuuagucaaguuuuuucucacugcucuaagucucucuaaggacuacuucuaaucuuucuacuauacaaguucccauucauuccacauaccuguuugagugugcccgauauugugauagacccugagguacaagggugaauaagacauagacucugcucucaagugcgguguaacggaguucgagguaucaaguuagcccagagaaaggaauauucguucuuccuugauacacagaggaagauacgacauuuagaagagauguugaaauaaguguuuaagaauaaauaggaauuucuuauaggggaugaauauucuaagaaaggcaagagugcaugcagucucaauacauuaaacuaaggaauaugucuuaagacgccuaauucaaauucgaguacucuuauuacuugcaguuucccauauaaaauauauaugaaggcacaaguagagaaccacaaagccaguucaaaaccacaaaaccacuuagcagucauuucucacuaaauaauugucuugcacauacaauagccauuguuaccuuuccuuguggaucagcuuuucauaauagcucauguccuaaacuuuccaacagucauuauaucauagugaauuccaaaagucuaccauauauuaaauaugaaauuuaguuuuuuaaucauuacucauggaucaacuuuucauaauagcucauguccuaaacuuuccaaccagucauuauaucaugguuagugagcuccaaaagucuaccauauacuaaauaugaaauuuaguuuuuuaauccuuaaauuuucaaaugcuguugucaguuuugugugcuaauaacuuacauaggagcauuugaaaauauuuaaauauaaaaauaaccuaguuaauaaguacauuuacuuguuaauauaaauuuuuuucuuuuucucuuuuucauuaaaaauuggaacuauuaguacaaagucuuuuucuuuagucuggcuauugcuuuauuuuuaacauauuuaaauucuacccaauuuuaggaccaacaguagguaccauuaugauauaaacaaaaauguggcuuaagaaauauguuuuaugaucagucacauagccucauauuuggaccuuguuauauuagugauaaauuuuaagaucuaguucuccugaaacacugaaguuuuggcauuuguuaaugucaggcaguugaacuccaauaaauuaacaggggcauagcuccaaauggcaugagacugguagacaugucacaaaacuuauaaguagccacaaaaauaacauacuaacuaauacuguuuauauaaucucuuucauuugucaugauacauucauauauauucucaguuuuuauuaagaacaaccauggcuguugcagaaaguuuuguccuguuuaacaguccaggaagcauugagaguaagagauauucacguaggcacaacacauauccgauuuuuaguccauauuauaaugcaucacucaguaaagugucuuacaggauaaaagggaaguuuucuacugcuaccuacacauggaagauuuuuaaaacauauaugucuuuaagaaaagaauuguuuugggauagucucaucugauaggaaaaugauuuuuuuauaguagaagaaucuucgagauagauacuucagaacugauuauuauuuuaauuaccuuauaaaaauuauacauuuuuaauuuuauguauuuuuaauuuuuauggguacauaguagguguauacauuuaggggguacaugagguauuuugauaaaggaauucaauguauaauaaucacaucaggguaaauuagguauccaucacuucaagcauuuaucccuccuucauguuucaaauaauccaauuaugcucuuuuaguuauuuuuaaauguacaauaaauuauuguugacugaaaauuaucuuuguucauuaaaacaugguauuuaauugcagccaguccaaguaacuaguguucuuauaauugucaaaaauguucauguucuaagauagccucaugugaaaauguuaaauaaugaauugcauaaaguaauuacuaaucaaacuacauuaugaccaacuuuaagaaacuggcuucagccaggugcgguggcucacgccuguaauccuagcacuuugagaggccaaggugggcagaucacuugaggucaggaguucaagaccagccuggccaacauggugaaaccccgucuccacuaaaaauacaaaaauuagccaggcaugguggcacgugccuguaaucccagcuacuugggaggcugaggcaggagaauuucuugaaccugggaggcagagauugcagugagcugagaucacgccauugugcucugcacuccagccuggacaacaaagugagauuccaucuccaaaaaaaaaaagaaaccggcuucuuuuuucugccagaaugaugacauugaauacugauauaacaucacguggggcguggcaauauuuuuaauugcuugauuuuuuuuuccauuuaugccuugaaauuuagcaaaaauuaugagaacuuuuaauauuuuaaccggucuuuaugcuauuuuaagaacauacuaacucaaggucuggugcaguggcucaugacuguaaucccagcacuuugggaagccaaggcgggcagaucaccugaggucaggaguuugagaccagccuggccaacauggcgaaaccccaacucuacaaaaaauacaaaaauuagccaggugcgguggugggcgccuauaaucccagcuacuggggaggcucaggcaggagaaucgcuugaacucgggagguggagguugcagugagccaagauugugccacugcacuccagccugggugacagagugagacuccaucucagaacaaaaaauaaaaugaacauauugacuccuaaugguauuuucaagaugaggguggaaaggaugguauuuuuaugagggagaaauaucggacaucaucuuaguuuuuaaacuaauaugauuuguguauuaguagaacaauuauauugacuauugaauuuauguauuuauauguguuuauacaacuuguuaggaaguguagcuuguuagaauauauguuuaacaaauagaauguuuauuugggcccauuuaggacuaaauagcuuaaauuuaaauauugguuaugauaucuucacagauaacacaggcaaauuaucauuaaaaugauuuguguuuuguuguuauuuguuaacauugaauuauaaucaguuugaaaccagcauguaucacugugaaaauaaaugcuggucucuguuucaaggaguuuuuaaaaaucaaagcagaggaucauuuacaaagcagauaguagauugaaugaaaaaucagacaaaggggcagaaaaauuuguacugcccguaugguuuaguauuagguagaaguacuugaagauauuuuugagauuauucuuuagaaauauauuuuuccuccauuuaguaaguaguauuucauucaacaaaaauuuauugaacccucuaugccaaacauugaaggaaaagaguaaaaaucaagaggauaaaugcauuaguaaauacaggcaaaaauauuuuuaguaagcauacauuuauugugaacaugaucagugcuacgugacauagugcucagugcuggaaauauaaauaagaauacccugguaccugcuuucauggaggucucaguucauuuggcaaaacaaacuaaaaauuaaaguuacaguauauuaucaaauaagugcuguaauaaaaguaagcaguaagcauuaaggaaacauacaggagaaaacacuguaaggaaaucuaagggaggcuucccagauaggaugccagaaucuugauggauuuauagaaguuaguaaggccaaaaaaaaaaaaaaaguacauuuccaaguagaugaaguaauguugcagacuuucagauugagagaguauguggaggaaugacuaauuaaauaaagcuggaacaguugaaaagaaaaggguauugacaaaggaugaggcuacauagaugagcaaaagacagacccuucuaagaauuugggcuuccaaucuguaagcagggagagccguuaaaggauuuauagcaaggaagcaacaugaugagauguacauuuuagggagagcacucuggauacuacuggaaagcuaaaaaauguucaguuauaccuuuaagcucuuuccaagauaagaguauaugugaauaauuaaguuauaacaaaguuuaagaauuacucagguuugugcaacuugguucuuuugagauauuuguaaauuagguucuuuauauaauugcauuaacagacaauaauggaauguuacauucuuagcauaacccugagcugaucaaauauaagaagcggaaaacuauugauaauuguuggaaauuccuaucugaccuguccuuugucugacuauuuaauguugaucuuauuuuguacuaaaucagaugauacuaagugauggcauuuacccucuguguagcuaugaugcauucuaaauugccuggaucucccuuuagugcuggguuuauaauuaaaaggacauauaauacaaaggaagaagagaaacugaaacucaaaaggaguauaagauuaugagagagguugagaucuaagagguaaaaaguuagggaagcauccuuucucuuaauugccuccuacacuguagcauaccucucuuucuccugcucacauauauuaaaaaguucuacugcugaaaauauguauaugacucuaaaggccuauauagcucacuccaaacauuuuagcuguuuuuauuauuuucguugccuaagaauuauauaaucguaaauuccaugauauuauaaccaguugucccuuuugccuugagguaggggccaggcuagcaauuuauaauaaauaauauuauuuuuauuauauagaaaguuucuaaauagauauuauugacuacuucaguaaacauguugauuuauaauugaaaccacaaaauugaguaccagaauuauucuaaaaaacuaaguaaauguugacucugcuuauuuuggaauuuuagcuaaacaaugcauaguauauagucguaguuuauggcauguaaguuaucugugugaauucaacaggcugaaccuuucauagcuaccaaaccugucuaacuuaauacaaaugacuauaagcaagcuucgaaaaacucugauuuccauuaaugugaauccaggcucucauaagagugaguuucuacuauuuuccaugcaagcaacuagcuuccuugcagcacuuugccacuuaauuccaacacaaauaucauccuacagcaaaaaaaauuuacuuaugugaccauaugucuguguuagucguugcauauuauagacaucuaauugauaauguaauacuggguuuguauugaggucaaauuauauggaucaucaccuuaaaauuauuccaacuugagauaaaauguugaaaaauuguacgucugccauguuuuauuuuaaauaugaaauuuuuuaauucggaauuggaaagaguuggaaaauuaacuuauuuauaguuuuuauuuugccauaaaggaaaauuguaucguuuaugaaauuaaagagcuggaagugagaacacacuuaccagaguucacauacuaaaguuuguucucucaggcucaaguaaucuguacugucucuucuaaaaaugguugaccauauggaagguuuaaaggcugcucuuucaugauaaauaauugacaauggaagcaguaaauaccucuauuaaguuaauuucuugcuugcacucuaucucaguuuuuaccuacucaggcuaauuugcaggugccugggaugaguagacaauccauaauuucuaccaaucaaguaaaagaaggaaagaaaacugagcuucucucccaguuaccagguaguuugcugugguuaaaauuaaugcagauuuuacagcagcggauauuagcauuuuuauuuauuauaaguaauuauuuugaaauuugggaaaugaauaguugaguacaucauuugaguguuuauuugaccaguuauuagugcaagaaaccaucauuuaaauguucucuguguuauagcaaaucaauuuguuucucucuucauauuaauguguuuuaagaaaaauucauuaugauuacuuuuacuugaaaauauauuuuauuuuuugcaguguuugagcaacacaccuccacuuacugaguauuuccucaaugauaaguaucaagaagaacugaauuuugacaaucccuuaggaaugagaggugaaauagcuaaaucuuaugccgaacugaucaagcaaauguggucuggaaaguuuagcuacgucaccccaagagccuuuaagguuagugugguaaaugcauuuuagcaaggguaccugcaaggguacaaaaguugguucuuggggauagggggagugaaaaauaguagcuauuacaaugguuuguggcccuccaaaggaacacaguacauaaauagauauacaguacaucugugauauaaaauuuaggugggagggauauggaacaguuuaucuguuuuguuuuuguuuuuguuuuuguuuuacaucuaaaucuggaauggagagaauaaugaaaaaaaguugaaaaacacuggugugguacaagaaugaguauagagacagcaaugagcguuuguauaguuguuuuggaauauaguacaucucuggaaaaccuaugugaauauucuauacaaauguaaaagacuaaauuugggcauguuacugaacucuaagaacccauuuuacuuugagagucauuaugaauuugaaaaauuaucaaaaugaaaauagucugcaaaccaagcauuaaaaauuaaauguacuuucaauauaguucuuaaacuuuuaagguuauucacaugugugaauuguuacuuaucaaauaauuuauuguucaaauaagaauugagcugaaauuuagcuuuauggcugaaauuuagcuuuauauuguuaaaaaaaugccuacuuaauuauauaggugaaacuuugagaaguuuuaaacuuguagagagaauaagcaguuuuaagucguuauuuauacaaguaauuuaaauggcauugauagaggacaucuacuggacaacauuuuuuauuagcuauauacuaguucuuagaaaauaaaaaaccagcaaaucaaaaugccucuguauugucuuccuuaacauucuaaacuuuggacaaacuaguccagacaaaccaucucucagcucuuacuagcauucuaauugguuuuauuuugguagauuuucucucuuaaaauuauguguaaauagguucuuuaugugugacuuuuuuucugucagaugaugauucauacuauuacauuuauuuucagucucauccaaaaacaaaaauacuuagugaugaaagauuaggaaaauugaauaugaacauuaauguuucuguuaucucugugauacucauccuccuuuugcgcauagaaacuaagugagagccuagaguaguuaucuuaaaaaugcuuucagauacguaauuaucuuuaugugguaauauagcaaggaugagaaccugccucuuccugucuaccuaccagacauuuauaggaggaggcaauaggaauaccuaaagcuaagaauuaaggacaucuggaaaauccuuugacaaauagugaaacaacaauuaaugacaaugaaaucuaugaccaaacaaagaucaauacauuuuuauauauuaaagauuacauguguugaucuauuuugucccagauaagcuuuguugagugcuuacuaggaaugcaaaacaaaauauaauucauauauauuccuguuguucguguauacaauuuuuauuauucacaggaguuauguucaaugaagcugccacaaacacugaaauaacaacuacugaaccauuacuccuagggaaacuauaggguuugauuccuccaagccuuuguucacaacauuuucgucaaccagacaauguauaacuuuguuuugcauguguuucuguuuaaaaacaacuuguuuaauauauauuguugaguccuuaacauugaacucacagcaaacagugcuauaacucaugucuuaaugaagcauaucuaacacauacuuuuucuccauaaagcacaucacagcuuucuugcauuuaggaacacuagcuggcauguuuguacuucauuuagugaccauuuuaaacacugaaauuaacaacaaaacaaacaaaaaugugaaaaaacauaacacuaaauaaacuacaaaggacacuuguuuauagauucagagcugaaacaacaagccaaagcaucaccuuguucaaccccagcugguaacaugcauaucaggugacucaaauuuuuugccacucugaaaauaucuacaaaugaccaugaauugauuuugggguuacaaauacauuuuagaaagcaggcaaauucacaaauguggaauccaugaauaaugagaaucuauuguacauauguuuaaaaaucaacccuguuccuagaacugauuugaugguuuugcauuucuuacagacacagguaggacguuuugcaccucaguucucuggauaucagcagcaagacugucaagaacuguuagcuuuccuauuagauggauuacaugaggauuugaauagaauuaggaaaaaaccauauauacaauuaaaagaugcagauggaaggccagauaagguaaauuucaugauccuauugucaccauuguuauaauuuugugauaccucuuucuaauuugugucuauuauccuuguaggugguugccgaagaagccugggaaaaccauuuaaaacgaaaugauucuaucauaguagauauauuucauggccuuuucaaaucaacuuuaguuuguccugagugugcuaagauuucaguaacauuugauccuuuuuguuacuugacacuuccauugcccaugaaaaaagaacgcaccuuggaaguuuacuuaguuagaauggauccacuuaccaaaccuaugcagguaaaucauggguugguuuguuuuguuuuuuuuuuuuuuuuuuugcauuuguuauuuuuauuaaaaaauuaguguugaguccuuauuauaaaaauuaaguauugaauuaucaagcccaaucaauaauguuuauuuguauaagagauuuuauaagcugaauacuuuggaaaucaguguaacuuuuuacagucuugaaagagcaacgugugucuuauaaaaaauucucaaaaggcuuuuuauagagguuuauuuuuauaauauuggggugaauauuagcuuaugaagaucaacauaauauuuuuaauuuuuuuaaacuucaacuuucuuuaguguuaauuguaauuuuuuuuuacuaguggcuauuggaaguaaagcuaauacuuuuaauucauagugugauaguaguguauuuaaauaccuguaauuuuuaggcauuuuaggaacuuaaaagaaaguagaaauucaguuagacuaaaaauauuuuguucagugauguucucuaauuucuaauacuuugaaguaucacauauuguuuauucugugcaaaaguccugugguaagucuuacugucaaauugucugccugauuccguuaccuaguguuauaauuggauuauuuauauuuuguggguaaagcacuaucuuuucucccuuauuuauuaaucaguuaauccucuucugacacuugacccaucccagugaaaguaacuucuucuuuuucuaccucucuuucccuaaauucuaacacuuaacuaauuuuguuauaacuuuuggcuuacuuuuaucuuuuaucccuagacuacaagucuuugaagacagagaccuuguaaaccuuuguauuuccagcuuuuguggcugguaaauauuaaugcacaagaaguauucaaaaauuuuauucaucaagauacuuaacuaugcaccuacuaaguauaaagcucuuuggcuaaacaaaaaagauaugauuccugcuuuagaagauuguuuucuguaaauuuuuagccaaauagcucaguuuguuagugcauaauagucacgaugucuauaugaaagcuauauuugaacaaaauuaugaucuuaccauucagggauguauuuggguuuauugucaacaaagacaggguauauguaguguucauaaacacacaguccuuuuauucaaaguaauuaaagucuaguagauacuagguauguacucaguuaugcaaauuuaagcaauuuguuuuucugcugcuuuauguuuucuuuaugaacucauugaacacaaugcccucauaucaguauuucacuggagagugcuaaguacuaucccuuaucugugagcagagccaauaaagaccugcuuuuacuuuuggccuggggaauauguguucacauuuuuaaaguuauauccuuuagauauucacuuauucacucguuuauaaguacaagauugucaacauucuuuucaauggugagaaacuauaacagugccaaaccacauccuuaccucucuaguuuauaacuuugcagauauacaccaaugaguguaauggagcaagagagcguagaauaauaaguauaaauuuacugcaacaaaaaauaaauguagauguuuuauuucucuacagcacauuuguuagagauaauauucucccaugccaauaauauaagguaaucuauaucaauaguggcaaauugcauuaauuuacacauuaguccauaagguauaugauaagugcucuuccauaaauugggcucuaaauuauuuuuccagcaaugugaauuucauugacuuaucacuuuucucauuuggugacaauaauauaaauuugcggagguuagagccaugguuagcacagagaaauucguuuguuuuuguguuuuguguuuuuuuuuuuuccuuuuuuccauuuagaggcaguaacaacucaaauacaaaaugaucaccucauuucauuaacacuaugcuuugaccagcuuguaagaaaagugaaauuagcugaguuucccuauuuguugaguuuucccgucauugaaguugauuuaggucauggaagcuuauuaggaaaaauauugaauauauauuauaucuuaggcucuuaugcugugcaaggugcuagaaauauaaugguguuucuaguccuuguucuucaagaagcuugucauacagugugaaaauugcucugacagggugcugcaagagaacacagaguaaccuacccaaacugguuaugaggccugugauaaauucugaaggacaauuagguuauaagcaggugaaaacuagaaauaaaagcauuauaggccaagauaauggcauguacaaagaacuuaugggagaagaggacauggcccacuucuguaaucuacaguaguuaauauggcaagcaggagcuagaucacgaagaacuuugaugccaguauaggaaguuugaacuucauccuaaaaacuagggaagccauuaaagacuauuaaguauagauauuauauggccacaauuauguuucagaaagaugauucuggguagcacagagaucaguuagaaaaggcuuaguacuaagaccagguaagaagcuuuuaaugaucagacgacagacaaaugacaaacacuucaacucugucaggauggcaguuugaagaaccaguugaauguaggaagugaaaauguguaaguauauucaaagaugaugccaaguuuacuugacaggaaaagaggagacagcagugcuguuuuaguggaauauauaggaagaacaaguugaagaaggaauccauuuuaguauugaacgugguggccuaacaugacccaaaccuguguuuaguauuggauaugcugacuuacagaugcaugaggaacacuuagguagagauauccaguaggcauugaauuuguguaucuagaccaaaggagagagacugcuuuagcuauaaauuggacaaucagcucuaugaaaaugauaguguuuuagaaggaugagauuacuuaaggcuaaggugaccccgugauuuaucaucuaaacaagaacucuugaaaauagaagggacugucauuaauaauuauacuaggauagcaggcuaauccaggacuggccaaagcaaaucaggagacacuguugccucuuccaaggagagcauauaaaauugagaagaaggcuaaagacaacacucuaaagaacaauguaggagaacuucaaaagaggaauaugaucacagcaauagaaaagaauuaaaaguagucguguuauaaggaaagggaauuuuuuaaggagaaaguggucagcagucauauuacaaagaggucaauaaaauaaagacugauaaguuguacaacauuauuggcaaccuuggaaacaaguuaaauaaagaggcgaagacaagccagcaagaggguugagaaguaaaugggagauaaggaaguuaugauaauauagauaucauuaauaaaguuauuuauaaaauagaggagaaggggagauaauuagagggaaagcaaugagguacccuuguuuuuugagagacuuuauauuccaaugcuuaugcaagaguugagauaaaauggaagaaagaauaauugcuugguuuaggucccagagaaagcagaagagcaugggauuuagaacauagacgcuaagguuagcuuugaauaagaagagagacaucuuucuuuccauguguugcaagagacagaaaaguaccuauguggauucaaagaaguuaguagaacaggaaguuggagauuuucccacccaguaguuucuguuuuugagaugaaauagguauucugcugauauuaagggagcaguagugaaauaggaagccuaaagaauggugaagauuuuuuuuuuuuuuuuuuuuuuuuuguuaaugagacagggucuugcucugucacccaaguuggaguacauuagggugugaucucagcucacugcaaccuccgccuccugggcucaagggauucucccgccucagacucccaaguagcugggacuacaggugugcgccuccgagcccagcuaauuuuuuguauuuuuguagcaacaggguuuugccauguuauccaggcuggucucgaacuuucgggcuuaagcgauucaccugccuuggccucccaaaguguugggauuacaggcgugagccacugggcccagcccaaugaagauuuuaaauaguuauugagauaaaugagagaauaaccacaugugugauaugcagaauuauuucugaguacugucaaaggaucaauugauauugggcacuguggauuuguagcacaccagccucuaaaauugggaaauucucuucagcacaugugaacagcucugagaaaguuuagcaagaguggaaugaauagaauugaguaacaaagacauuaaagguucgugauaaagcauguagggccuggauggaagggcuagaagacaguagggagcugguaaacugggagaaaacaagaguuaaaaggaauagaaaucucugugcaagacaagaagagauaagaaugaauuuccaggagaagcaagaaguagugguuagacaguaacccgaguuuaagauacuaaaaguggggccgggugcaguggcucaguccuguaaucccagcauuuugggagacugaggcagaaggucacuugaauccaggauuuugagaccauucugggcaacauaaugagaccuugucucuaaaaaauaaaaauuagccagucauggugucacacgcauguaguccuagcuacgcaagaggcugaauucggaagauggcuugagcccgggagguugaggcugcggugagccaagaucaugccacugcacuccagccugggcaacagagugagugagagccugucucuaaacaacaaacaaaaaaagauagcaaaagugggagcaguuucaaguaaugacaggaucuaauaaguugacugagguugaauuaaugcaagugucuuugaauugaggagccaaggaaugauaaaacuaggacaaauuauccaugugggcauugucacacaggacccaggauaguggcaagauuggagacaaacacuaauccaaaugccaaaugaaugugagauagcaaccaugaggucacucucauuuacugaauuuuuuuuccaaaauaauaaauucauuacaauuuuuuuuguuuuuuaguacaaagugguuguccccaaaauuggaaacauauuagaucuuuguacagcauugucugcuuugucaggaauaccugcagauaagguaagauguuucugggguugaaguauauaaguugguauuuaguuucucagugcuguaaaaccagcuuaauagaaauucguuuccuuuuagaugauaguuacugauauauacaaucauagauuucacagaauauucgcuauggaugaaaaccuuaguaguauuauggaacgggaugauauuuauguguaaguauaaaacucauugugcaaaauauuacuugaaaaaaaauuaauagaaguaacauaaaauuuugagaguuuauggucaguuuuguccuuguagguuugaaauuaacaucaauaggacagaagauacagagcacgugauuauuccuguuugccuaagagaaaaauucagacacucgaguuauacccaccauacugguucuucacuuuuuggucagcccuuucuuauggcuguaccacgaaacaauacugaagacaaacuuuauaaucuccugcucuugagaaugugguaagugccagacaauucuacauugacaaaauaaauaugggaauaaaauauaaaauagcuaauaaaaauaaacacauaagguacuauuggaauauaauuauucaagucuguauuaucucaauuuuguucauagucagauuauaguccuaauccacuuucuuauucauguaaaacauauuauggagguaauuucaaacccaggaagcacgaagucuguagcaguuuuaaaccaaaaguuuacaguuagaaggacauaggaauuuauguuauaauaauuauguguuacauguucauucugugaaaucauaacaaaugucaaaugccauauguuugcacugugaaauaacaaaugucaaaugcuucauuucuuuauauacauuaccaguucaugauuaauaguauuguaaggcagccuauuuuuugccuuccugaauaaaucccuugauuugaauuaugaaguuaucaagaaugucauuugaucccuuuuauccuugaaagcugguauauuuaguauucuuucuugcauaucuaauuauuauaguuucauaacccauauauaaagaucacauuauacaaauauaaguguuuuuagcaacaauauauaccaucuaaauaggguaaguugagaaauuauuugcaacaaacauuuaacauuuaaccuaaaagguaacauauuaauuauuuuuauaaagaugagcaaaacaaauuacuagucaguuauacuuaugguacuaaaaguuugaauuuaucuuugaaucuacuaagugaccacuguuacugcauuaaaaaguuuuguuuuacugauagaaggaaaacuuuuuaaaaguuuuuaucuuuguaguacugaacuuguuugauuuuugauuuuacuuaagccgauaugucaaaauaucuacugaaacugaagaaacugaaggaucccuacacugcuguaaggaccaaaauauuaaugggaauggcccaaauggcauacaugaagaaggcucaccaaguaagacuuuucuguuaaauuguacaaauguuucacuuagauaauugccucagagaaaaaguuaagaaaaugggaauuaaagaacuaaaaaauaccuggaaaccuaggauuaauaauauuaauaauuuaaaaauauagcauuggguuuauuuaaagcucucuaauaucuaaaauuaggugaaauggaaacagaugagccagaugaugaauccagccaggaucaagaacuucccucagagaaugaaaacagucagucugaagauucaguuggaggagauaaugauucugaaaauggauuauguacugaggauacuugcaaaggucaacucacgggacacaaaaaacgauuguuuacauuccaguucaacaacuuaggcaauacugauaucaacuacaucaaagaugauaccaggcauauaagauuugaugauaggcagcuuaggcuagaugguaaguauuugugaaaaauggcuugaacauuaaacaagccgagcauguuauuuuuuuuuuaggugaaaaccaugaaauucagcucugucaagaaauauaccauuuacuuuucuaucucaaauuuuacaugaaaggacuuaauaucuaaguagacuaaaauguguguuuguguuucauaaauggagauugaacucaugcuucaguuuucuaucuuuuuuuaaacucuuaaauuauuucaauggcuuggaaacugcuguuugcccuaaucaccaguacaaguagaaaagauugcuguuuguuuauucugguguauauccuaacauuaaaauauacuuuaauacuaagacauauuaaauuuuaaagaaaaaauauguuuuccaccuuagaaagaucuuuucuugcuuuggauugggauccugauuugaaaaaaagauauuuugaugaaaaugcugcugagguaagucaucacucacucacuuauuuaccuuuccuugauuuacuuuaugugauuaccagagauaaucauacuguuguguuacacucuuugcuuccaccaaauauguuuauuuugccaguaaaaaauuggucaugaacuagaaaaaaaagucuuugcaaaaauaccuuuuuuuuuuaaagguucagaguucauuuugaacguguuuuggucauccauauagaaguguacaggaauuauuuagaaguauauaaaucucaacugaaauaagcuuuaugauucuuuugagaaaguuuaggaguuuucauuauuauucauaguaagaugguaucacuaaaaugaguuuuguuucauuuguucucuuaacucaagaaauacuucucuuuaggacuuugaaaaacaugaaaguguggaguauaaaccuccuaaaaaacccuuugugaaauuaaaagauugcauugaacuuuuuacaacaaaagaaaagcuaggugcugaagaucccugguaagagacaaaauuaaauaauuguuuuuguuuucuuuaaggauuuauucugagauaugugccacaucaaguugaaaaaguaauuacuaaauucucuuugauguuuuaaauaguaaaggauucuuuauauaaguuguagccuauuaagagggaugggaaugucuuaaaaaauacgauuacaguguugccuuaauuuuauuacuguguuuuucauaauagccauuauacuauuaauucauuuuaguuaccuuuuuuccaagaaauuuuagcuauguaaucauuuugagagaagcuuuuuaggaaaaauguagugauauauuuugugguguuauuccauuagagcccagauuugagauuuucuaauaccugucuuccagcacagauuugugaccuaugucuuuuuugcauacuaaaagagaaauaaucuagcccucauuaugucuuuaaguauuuauuuguauauuaauuuguaaugguuuaaccuauuuggaaaaugucuugaaaauaaaaauaauaagaguugcuuucaaccugguacauauuaggcauacuauaauugcccacugaauaaauguagaacuuuccaaacauuuuuguuuauuauuuucauuaauggggguuguuuguaccucuaucaaguguuaaauacuucuguuuauucuuagguauuguccgaauuguaaagaacaucagcaagccacaaagaaauuggauuuauggucccugccuccaguacuuguaguacaucucaagcgauuuucuuacagucgauacaugagagacaaguuggauaccuuaguugauuuuccuaucaaguaagcuuuaauuguacuuuauaagcauugggcaacucuucuuucaaacuuauuugaugcuuuuuguuauuauccuuuaguaaacaucaggugccauuggacccaauuucagcuuucaaguuuguuuuugaguaguucuaacaguuuauaaggaucaguguuucaaaauuuuuauuuuuucuuagagauuuuccaaagaucaaagagaaaauauacuuuaaaaaaauaaaaacaauaaaaauccuucuguguuauauuaccuauggguuaauuggucucauuuauaaaucuaagauacuuuaugguacuuagugauuuuguuuauccuaggaauuacuucaucauuacucaucacuuacuccuaaauauguugggguuuuuugguguuucuuuuguuuguuuuuugagacagggucucacucuguugcccaggcuggagugcaauggugcaaucucggcucacugcaaccuccaccuccuggauucaggugauucuccugccucagccuuccaaguaacugggauuauagccacccgccaucaugcccggcuaauuuuuaguacagacgagguuucaccauauugaccaggcuggucucgaacuccugaccucaagugauccacccgccuuggccucccaaagugcugggauuacaggcaugagccacugugcccagcccuaaauaugcuguuuucaaaaagacuaaaauaaaacaacaauggaauugcuuagaaggauaacacaguagugaaauaaaucaucccuauugcauuauccuucaguuuuccuauugccauuauaugacaucauauuuguaaaaagauauaucuauggccauaccaccuugaacguacccugaucuugucuguaaaaagauacaaagaagucuguauacaucuucacacuuuaucucucuuuuuuucuuccccugcuuuuaacaguugagaauucagaaugacaaaaagggaacauuguauuccccgucacuuaguuauucagcagaaggacuucaucacacaauauuuuguacaaguacuugguacuaucccauuuugcaaaaagaacuuucagcgguauuauuucauauccugugauauuuguacaccaaaauguacuugauacaguuaguaaguagacaauugcuaaaggcagguguaucuauaaagguaacuagaaggaaauagauuacauaaaacaaaauauucacuggauuacucauucuaauugguggcuauaaauuuaaaauuuaaaauuauuuguaauuauugagugaaaaaaagaucauuuucucuuuaacaaaauagugagccauaaguuuucaagaauauagcauuuggcaauguaaguauaagaaaaagaaucagggcugggcacaguggcucacgccuguaaucccagcacuuugggaggccgagguggguggaucacaaggucaggagagcaagacuauccuagccaacguggugaaaccccaucucuaccaaaauucaaaaacauuagccgggcaugguugugcgcgccuguagucccagcuacucgggaggcuaaggcaggggaaucgcuugaacccaggaggcggagauuucagugagcugagaucgcgccacugcacuccaggcugccuggcgacagagcgagacucccucucaaaaaaaaaaaaaaagaaucagaaguaaugacaaacuagaaucuaucagagauguauuuaaaauuuagaaucauuauugcuuuuuaaugaugcaaauacaagaagaacaaccagaaauaauaauaagcuauuuacaagaagucguuuuccagguucuugaaugauagauuuugauuagucaguuacauucaaaggauguugcccauuucggguauauaggucaucaaagacagcaaauguagaauaaaaauuaagguuugauauauuaauauuuuuuaaaacuucuaaggaaguuuucacuauuccuguauuuuucuucauauaaaucacuuccucuuuuuuaaucucugacccugcccauaaauuacuuucuaaaauugacuguaaaauaaagaucuacuggacccagauggucaauagugaugacuguuuuuccugguauacugagaguuaaauguguuagcaugaaaacguuuaucugaaugacaacauuccacauuuuuauuuuauuuuauuuuuuuauuuuuguggguacauaguagguguauauauuugugggguacaugagauguuuugauggagugugaaauagucacauuauggagaaugggguauccauccucucaagcguuuaucguuuguguuauaauccagucacacucuuaguuauuuuuaaauguauaauuaaguuauuauugacuauagucacccuguugugugaucaaauaguauguuuuauucauucguuuuuuuuuuuaacccguuaaccauccccaccuuacaucuccccuaccuucccaccacacuugucauccucuaguaaucauccuucuacucugucugucuaugagcucaauuuuuuuuuauuuuuagaucccacaaaugagaacaugggauguuugucuuucugugccuggcuuauuugauuuaacauaaucuccaguuccauccauguuguuggaaauggcaggaucucauuccuuuuuauagcugaauaguacuucauuguguauauguaccagauuuucuuuagccauuuaucuguugauagacacuuaguuccaucaacauugcaacacauaguuucgucaaaucaacaagauuugguuguuuccaaauguuagcuguugugaccauugcugcgacaaacauggggagugcagauaucucuucaguauacucaaugaagcauuuuaaaauuuucaacccauaaacaaauguuugccaaaacauuaauaucucagagguacauguaugauuuguuuuguaaguuauuugacucaugauaauuuccuuagugagauauauauauauauagauagauauauauagauggauagauauagauauauauauguaugucaaacaacaauggcagaagggaauagaauucauugcauuuagggacaacauaaaaauuaacuugguuucuuuuuuaaacagugacuuggauaugucggaauucuuaauuaauccaaaugcagguccuugccgcuauaaucugauugcuguuuccaaccacuauggagggaugggaggaggacacuguaaguugacaguuugccuuuuuacccaaaucaugguguuugaagaacuccagacuuuuuucuuuaagauauuuauuacuucuuaaggauaaaauaucagaugugucuugcauauaguaguucaguauugauuaaugaaugagucagcuuuugaaccuuuuuuuuuucacauaggguauagagaauugaguucaucauacuccucaguucaaggccuaguagggaauguugucccauuuagagugcauuucccuccacguucuccuuccccuuugcuuucuaacauguuugaugcauauacucuuguaaaucauuaauauuuauucauuuauauaauugguacugugcuguagauaucacuaggucucgacacuuaugaagacuuaucuguguugcuuuguguccauuuagucaguuguuucucacugcuuaugauuuacaucugccauauuuuaucucuccacuuaccucaugauagacaucuaaauucccuuucacuuccuaccacuguaagacugauaaaccauuguuuaugguaucguauguaagaauuuauuugggcugcgugcccaaaagugaaauugcugaguuuaagugaguaaguguugccagauugccccccaccccccaggauggcucuaacacucgacacucugcaagcaguugauuuuucuguugaacaguauuuacauuccuuggauauauccuacuuaucauuauauauuuuuagacacacaguuggauucagucagauuuauuuaggguuguuacaauuucauucauaagugaaaugguuuuguaaguuuuuuauauuuucauuaucuuaguuuggaauaaagauuagagucauaaaacaagcugagaugcuuuauccuuuuucugguuuuuggaacagcuaguacaauauaggaauuaacuguucaucaaagucuaguagaauuaaccuguaaagccaucuaggcuuugcagccauaauuguuuuuauuuaugucaugcauauuggucuauucaguuuucuuuuuccuuuucuguauauuuugauguucuguuucuaaaaauguauccauuucauuuagguuuuucaauuuauuuaagaauuguuguuuauaaugcuuauauuacacuauuuuuguccuuuuuucauucuuuuucucuuuuuuuuuuaaaucaaccuuccuggccaggcacaguggcucacgccugugaucccaacacuuugggaaguggaggcgggugaaucaugaggccaugagaucaagaccauccuggccaacauggugaaacccugucuguacuaaaaauacaaaaauuaguugggugugguggcacgugccuguaaucccagccacucgggaggcugagguaggagaaucacuugaaccagggagccggagguugcagagagcccagaucacaccacugcacuccagccuggcaacagagcaagacucugucucaaaaaaaaaaaaaaguaucagucuucccagauuucuaucuuguuagucuuuucaaagaauuacuuuucaucuuauuaaauuuuuauuuuuguuauuguauguauuuauacuuuauauuauuauuauauuuuauuuuaucuauacguuuuuuuuuugagacuggcucucucucugucaccaggcuggagugcagucgcaugauauuggcucacugcaaccuccaccuccuggguucaagcgauccuaccaccuuugccucccgaguagcuggacuacaggcacaugccaccacacccagcuaauuuuuuuguauuuuuaguagcagugggguuucaccauggugcccaggcuggucuugaacuccugggcucaagcgauccuccuaccucagccuccugaguaucagggacuacaggugcaugccacgacaccuggcuuguauguauuuauucugucuaauugauuucuucccuucccuucauuguaugguuccucuuguuacuuuggguuucuauguuacucuucuuacaacuucuugaauugaaugcuuagcuuugcuuuucauuguuucuccuauauugaaggcuguaauuaaaaggcuauaaauuucugcuaaguacugcuuuagcuguacuucagauuuucauuaucuuucaauuguauguauguuuuaauuuccuuuaugauuuccuaauuagcacaaugucauuuaaucauaugcuuaguuuucaaauguagagaguuuugucacuucauucuuaccuuuauuacauagcaguugagagcauugucuauauuaaucuuuaggaguccgaaaguuguaacaugucuuaauacauggucaguuccuuaaacguguguaugcuuggaaaaaaauauacauuccccauuuagauacagaguucuuuauaucucugauaauuuaagcuuaucaaguguauucaaaccauuacuaucccugguuauuuuuuguguucauuuuauuccugagaggaauuugucaggacuccuacuaaaguguugauugaccugcuucucccagcaguuuuauuaguuguuauuaauauuuugcauaauuauacuuauguucauaauggguagcucuucuuucucuguuccuuuuaacaccaggauuugacauucuuugccccuuuuuuuuuagguauuacaaguguuacucuagcuuucuuuuugguaucauuuaauuuacaaacucugugccuuuuuguugaaugugucucuuauagaucacacagaucuaagugcagcaucugcucugcacugaucuuggguugagaucaacaaacucacagcacgcaaaagcauucacccagcaccagguuuacuuagauuuaagaaaggauacaggucaagaaacaauacagcaugcacagcaacagcuuagcagagguccuguguagcuggaaggagagaaaauagggaaaagugugcucaaaggaagcuguucaucccauggcuauuuccuuccacuccucaccaaggcugauuuuuaaccagaguucaugggguacagucauauuaguugucaaauauuuuguuagcccaacaggacuuuuaaacagcaauaagacucugauucagguagccugaguauugcugauuucugugacaaaaauugaagcaagaaauuuaaacgcuuucuucuagauuguuuucucauuucugccuccauccauucugucgcauucuucagccauguugcaugcacacaaauauucuugaguucauauauugagaacaggguucucaauuuuuuuuuguuaguuccuuugacucuaacuuccaucucuuucuacgguuucucuccaugguugauauuugaggagagggaaccaacaacagauagaauaugaaacauuucuuccacaugguaguuacucaguaaaauuguuaaccaaacaacuuagaguuuaaaccauuauuuuauugugauugguugguugguuggcuggucgguugauuggcuugucuuuugaauuaucuucugaccgccaguggaguuucaccaaagauaaugcuuaccuuacuuucaaaguauugccauucccucugaacaucauccaaacagguaacuuaauagaaagagaauauugcccuuugauuucagccuuauuaaggauaauaccucaauuucuuauuuauauacaaaugggaagaauaauuacuuuaggaugggaagaauuauuuagaagccguacccuacaaagugucacuuuuuagaaacaaugaccacauauaauuauuuuggaaacauugugcaacuuuauuucuucaguuauugaguaguuuauacaaggcaugggauggggaaaggggcauuuuuuuaacuuaaagauaaagcagaucuuuaaaaauuauguggauuaaugaaucacuuuuugccuuuuucuugcuguguacagucaucccuuuguaucaguggauaccacagauguucaaauuccuuauguaaaauauuguaguauuugcauauaaccuaaccacauccucucauauacuuguauguguagauuauuuauaauaccuaauacaaugccugcacgucacuucauucacauaaauugaacauaguacucagcacguggcaaauucaaguuuuacucuucaggacuuuguggaauuuuuuuuuuuccucaaauauguuugaucugugguugguuggguucagggacgcagaacccauguaugcacaggaccgacuacacuuuuguuaaagacuaaaagagauucugguguuaaaaaaaaaaaaaaacacuauagcauaaugaguagagguaucagaaaagaaaucgucauagaaaauuuaauaauaaguugaaauuucaaacuaugaagucagaaacagaucuagguuuaaauccuaacugcuagcuaacaguauaguaccuugaguaaauuauccuucuuuugaugccuuaauuucccaucucucagguggggagaauaauaaugauaauaccuucuuuaugagacaauacauguaaagugcauaacacuaugccugguacacaguaagcacuacaugaauguuaauuaccauuuauuaucauuaguguuauuaugugaauuuaaaaauaaucuguuuuuuccugagaugaaaaaagaauguuucaacuuacaugaaaauuauuuuuggcaucuaauuguagaaauuagaaaucauuugaaucaauugaauauguaauaaauaagccucauagaugauuaucaguguuaauagauauuccuuauauagaugauuauagaguuuugaggaguccccagaaaaccaagaucauuuucgucacagugauuauauuuuuuucauuagauacugcuuuugcaaaaaauaaagaugauggaaaaugguacuauuuugaugacaguagugucuccacugcaucugaagaccaaauugugguaaguuugucuuauauuuccugagaacuaugggauucacugucuuaaggagugaauauaaauuaauaaaaggggcucauggaacacuguagucuauauucuagcagcuugaguagcuaaaagacacuaacucuuauuuaaagaaaugucaaauuguccccuaaauggaaauuugucuucuaaauuugcccacuaacaaaagcauaaauugcaaggugaaaaaauuuuugguaguuuucaacauggaguuucuaauaaaaauaauuaaguuuugcuuuggaaaguagauucagcucuuaacuuucuagacauugaguacuuaaagccagaauguuuaaacaagagaaaaaaaauccuugaaguaccuuaccguaccugugaucuuuaaagucauauccugccuuaugaaaauuaacuaaacucaaaaugacauaauuagauaaaacaaauuacagauuuauaaaagauuaauacuuguguacuuacuacuuugauauuuucugaauaguaaaaaaaaugaggaaguuccgucuguucacacuuacaucaguuuaucauccaccgcugacucucaguauggguuuguguguguguguguauauguauauauacacacagaugcauacauauauauguauauauacauauauauauauauauacuguuauuucucucccuauaucuaugacaaaaagagacuugaauacuauaaauuuuuaaaauuguguuaguuuuaauuaaccacauuuuuuguuuauauuuaaacuccuaauuuuuuuucugcaaaagaaaaucaauucuguucuccucaaauugcccaccuccuccaucagucuuuuuaacaacacugcccuaaucuuggcuucaaauaaacaguuaucuuguuuauauauaguauacaaauuugagguugccaugcauuuuaacaaugaugauucuucauuuagucaacaaauugaauaugauauauauagagagagagagauacacaaaagacuccauucuaaacagaguuaaaaagauagcugucacucaguccagaguuuaaaagauagcuaucucugauuuauaaaccaaagaagauaaguaaauuaacaauuacagcaugauaaguacuauuaaauaccuuacuauggccacuuagaaagggaacuucugucucaacucagauuugggguuugaggggacaauaaccagcacagggaaguucaugugguaaagaugaugucugaccugagucuaguaaaaauaagaguaaauuaaacaaaagguguucuaagcaaagaaaacgguaucuacaaaaacaaggaggcaugacaaagcgugacauuuuaagggaacagcacauaauuggaugugacucaaaggaaaagcucuuaaagggacauggggaagaaauuagucuggagauaaauuuagcgcuuagaucaagaaaaguggcauucuaguuguuuagacauuuucuuacagacuaugaguagccauuagauuguuaaacaagagaauaacauuguucaguuuguaucuuaacauuucucugagaacaucauagaagauagauuggagacacugaguaaagaaacagaaaagccauacaggaggcugucacauaauuuaagcaauuaaaauaguaguuagaacaauacaaacaaggggagaauggauuuaugagauauuuacuggacagaauuaauauaacuugauaaaagauauaauaaggauaauagauguagagauccagagaaggagaaguuuaagaugacuuuuacuucaccauucaccaagauugggaauauaggaagaauaguugcuguugaaguuugagaugccuguaugauagcuguguggaaauuuccauuagguuguuggacucauaagacaggaguucaggggugagaacugauuuagguuauacauuugaguugucagccucaggcagcaguugaagccauagguuuaaaugagucaccuagugagaggauucagguugagacaauggugggcugaggacagaacauaguauguuuaaaggucaggauuuaauaaguccacagaagagccugagaagaaaccaaagagauaguaggagaucugaguaguguugucacagaagcaaaaaauuguuuguugauaggaaaagaaauagugaagcauuaaaugcuacugagagauugaccaaaagaacuggaaaggucacccauuucaguuguuuauuagguuauugacccugcugaaagccauuuugcuagaaugguuuggggaaaagcuagauuacuuugaguugagaagugugcaugagagugaaugaugaguauugacaacucuguuuaucacccugacuaugaggaagaggaagagagguauauggcagcuagaaggggaaguagaauggagagggacuuaugauaggaaaaaccuuagguauuuuuuaaugccaaagagacaaguccaguggauaaggacucauugaagauacacagugaugauugauggaacagcauccuuaagaugguaggaaaaguuggacucuacagcaaacaugggaugaagugacuaguauuagaagggaggaauuuaccuuuuccuuaagagaugguaggaaagaaagcauagaauucuauuuuuacguuagaauugugauacaguuuguguaucacaguuagaacugugauacaguugcauuuauuucuuuguccaaauaauuuagaagcacauaaaaauuuguaauucuaauaacgauucuuuauuagaaaucaucuuauauuuaaugaauuuuaguaacuuccauuugaccaugcaugguuuuucuauuugauuuaugcccucuuaccaaaauuggugaccagcuaaaaauucauaauguauuuaacgugaucuuugagaaucauaacuguuuuaacauccuuuguuuugacaguccaaagcagcauauguacucuucuaccagagacaagacacuuucaguggaacuggcuuuuuuccucuugaccgagaaacuaaaggugcuucagcugccacuggcaucccauuagaaagugaugaagauagcaaugauaaugacaaugauauagaaaaugaaaacuguaugcacacuaacuaaugaaaguccuagaagccauaaaagagacacuuuccugcuggugguaucuauggaaaugaugaaguuacccaccacauuaaaacaaaagucugagauggggaguuucagauaaccgaauguaaauccuuuaucagauuuuaacuugugcaguacuugaagugaaacacaaugaaaacuuuaacagaaauugucucuuaauacauuuacagucuuguauuuacaagcuaaauauauauaggaaaucacaaauaaaucccuuuuaaguuugcugcuguuuugauuaauuauguuuccuuuaauuuuuuggaugugaguugaugacaaauguuaaauuuguggauguuggucauuuauuuugcucuaauaauacugcaagaaaacuauggcugaacuuaguuuuuggauaaucuaguucaugugcauuaggcugccguauauacuacuaugauauuuagcugcaguaucaauguggcauaaauacugcggcagcauucuucgaaaaccgcauuuucaaauuuauccccguaaucaaugugggccuauuaaaaaaccaaaucaugauacaagaaacaaccuuggaaaaguuauuucccuuuguaauaccuuuaaaaauccagaguauuauauucauuuuacugccacuguggaaacagguucuagauuucauacuccaucuaaagucauuuuucaguuacauguaaguauuauuuacugcuauugggaucuauucuucagauauucaaaaacauuuuuugcuuuaaaaugcauaucuuuaauuggguguugguccaaaauuaaaauuuuugcugucuguuuuucucuaccccauuuugugguaauuuggcaacuugagcucucccaauuauuguaauauaaggacagacauaauaguauucuguacccauaguaauaauugcaucaagcuuagaugagaaauuuuuuucauauacuggccuuuaaaucauuaauggacaauuggcuauaaagguaggucuguuaacuuucuuuguguguuccugauggaauucaccauagccuuacagcuuuucucagaagguaacuuguuauaagagaaauggcauuugcauguuccagagucagaaccuguacaguauauaaagcauaaacaccuugaauuugauuuuaguucaccacauucaaggauccaggaugccaaaaauaugugugaacauuugaaacauuuuuauuugcugcuuuuucccuuugauauaguugaaagaauguauuguaaauuggcauacaauacugccuuuaauagaaaaccuaaaugcuggggcacauuucacauaucgacuaccugagaaauugcuuugugucccacuguuauuaaagcaaaaaguauaauguucuucacuugaacuaaucaaauacaauagauuauaaauuguguauuguaaauaaaaguucacucugugagugcacauuuugguaaauuauuuauuuauguuagcauuuaaaaguuuaaaaaaaaugcauuugaccaggauaaaugagguauguugaucauggcuuugcuuuauaucuugauauuaaagcugguuuaucauccugguauuuuaaaagcugcuuugggguuuuuuuuuucuuuuuuuuuuuuuuaauguaaacuaaccuccugcaugacagagguuaaaauuuugucugcacuugaguucacuugaguuuacauuugaaaugugcauguuuauuuauauagauuucaauaaagcuauucaaggccuu

SEQ ID NO: 192965 - RNA, 81189 nt, Homo sapiens
uggaaguguuugcuaccaaguuuauuugcaguguuaacagcacaacauuuacaaaacguauuuuguacaaucaagucuucacugcccuugcacacugggggggcuagggaagaccuaguccuuccaacagcuauaaacaguccuggauaauggguuuaugaaaaacacuuuuucuuccuucagcaagcaaaauuauuuaugaagcuguaugguuucagcaacagggagcaaaggaaaaaaaucaccucaaagaaagcaacagcuuccuuccuggugggaucugucauuuuauagauaugaaauauucaugccagaggucuuauauuuuaagaggaauggauuauauaccagagcuacaacaauaaacauuuuacuuauuacuaaugaggaauuagaagacugucuuuggaaaccgguucuugaaaaucuucugcuguuuuagaacacauucuuuagaaaucuagcaaauauaucucagacuuuuagaaaucucuucuaguuucauuuuccuuuuuuuuuuuuuuuuuuugagccacagucucacugucacccaggcuggagugccgugguaugaucuuggcucacugcaaccuccaccucccgggcugaagugauucuccugccuuagccaccugaguagcugggauuacagguguccaccaccaugaccggcuaauuucuguauuuuuaguagagaugggguuucaccauguuggccaggcugguuucgaacuccugaccuccagugaucugcccaccuuggccucccaaagugcugggauuacaggcgugagccaccaugcccagguuucaaguuuccuuuucauuucuaauaccugccucagaauuuccuccccaauguuccacuccaacauuugagaacugcccaaggacuauucugacuuuaagucacauaaucgaucccaagcacucuccuuccauugaagggucugacucucugccuuugugaacacaggguuuuagagaaguaaacuuagggaaaccagcuauucucuugaggccaagccacucugugcuuccagcccuaagccaacaacagccugaauagaaagaauagggcugauaaauaaugaaucagcaucuugcucaauugguggcguuuaaaugguuuuaaaaucuucucaggugaaaaauuaccauaauuuugugcucauggcagauuuccaagggagacuucaagcagaaaaucuuuaagggacccuugcauagccagaaguccuuuucaggcugauguacauaaaauauuuaguagccaggacaguagaaggacugaagagugagaggagcucccagggccuggaaaggccacuuuguaagcucauucuugggguccuguggcucuguaccuguggcuggcugcagucaguaguggcugugggggaucugggguaucagguagguguccagcuccuggcacugguagagugcuacacuguccaacacccacucucgggucaccacaggugccucacacaucugcccaauugcuggagacagagaacacaagcagagauuagugucaauucauucuccuggacuaggcucuaaucaaucgacuccaggguccugguuguaugaguucuuaggauuaaugagguagaagcuaauuuuuuuuuuuuuuuuuugagacggagucuugcucugucgccgaggcuagagugugauggcgcaaucucggcucauucaaccuccgccuccuggguucaagcaauucuccugucucugccuccugaguagcuggaauuacaggcacaugccaucacacccagcuaauuuuuguauuuuuaguagagacggggguuucacaauguuggccaggcugcucuggaacuccugaccucaggugauccacccaccuuggccucccaaagugcugggauuacaggcgugagccacugcaccuggccuuuuuuuuuuuuuuuuuuuuuuuuugagacggagucuugcucuuguugcucagccuggaaugcaauggcacgaucucagcucacugcaaccuccaccucccggguucaagcaauucuccugccucagccucccaaguagcagggauuacaggugccugccaccaugccaggcuaauuguuuuuucuuuuuuuucagauggagucucacucugucacucaggcuggauugugauggugugaucucagcucacugcaaccucaacauccuggguucaagcgauucuccugccucagucucccaaguagcugggacuacaagugcgugccaccaugccuggcuaauuuuuuuuaguauuuuuaguagagaugggguuucgccauauuggccaggcuggucucaaacuccugaugucaggugauccgcccugaggcugaggcaggagaaucauuuaaacccaggaggcggagguugcagugagccaagacugggccacugcacuccagccugcuaagugacagagugagacuccaccucaaaaaaaaaaaaaaaaggcaaugcuucaggacauaaggccuugcucugaagaggcccuaggagugacuccuggugacagugaaagcccacagccucuggcaacuguauuaacaugaacuucaaucuguuaaaggaaagccaccaggaaaacagcacuguaauuuaacgauguggaaaaauguauguaauaucuuaaggaaaaaagcaaaacaguguaauuaugaucacauuuuauaaaauacacguguauauauacgcacauaugccugguggaguuuuauggugaucaucuccaagugguggaauuacugggauuauuuuauuguuuuuguguaaauuuauacuuucuuuuuucuuuuugagacacggucucgcucugucgcccaggcuggaguacaguggugugaucguggcucacugaagcaucaaccuccugagcucaagugauccucccaccucagcuucccaaguagcugcgacuacaggcaucugccaccacacccagcuacuuuuuaaauuuguuguacagaugaagucuccuuauguugcccaggcuggucucgaacuucuaggcucccaccuugaccuccaucuugaccucccaaagugcuggaauuauaggcaugagccaccaugcccggccuugauuuauguuuuugugaugaacauucauaucuuacucccaccccauggaaacaguucauguauuacuuuuacaauauaaaacaaauaacaauaaaaacaucaaaaagacauuuuagccauucauucaacaaauauuuaaaaugugccaagaacugugcuacucaagcaccagguaaugagugauaaaccaaacccaugcaaaaggaccccauauagcacagguacaugcaggcaccuuaccauggaagccauuguccucuguccaggcaucuggcugcacaaccacaauuggguggacacccuggauccccaggaaggaaagagcauucaaagugucaaaguaggacuacuggaacugucacuucaucauuuuuuuuguuuguuuuugagacagggucuugcucugucacccaggcuggagugcaguggugugaucucagcucacugccaccucugccuccugggcucaagcaauccuuccaucucagccuccuaaguagcuggaacuacagacacguaccaccaccccuggcuaauuuuuuuguauuuuugguagagacaggguuuugccauguugcccaggcuggucucaaacuccugggcucaacuucacccccgggauuauaggcaugagccaccgcacccagccuuggcuaauuuuuaauaauuuuuuuguagacaugagguccuacuguauugcccaggcuggucuucagcucccaggcucaagcgauucucccaccuuggccucccaguguugugauuacagggguggggcacuggcccagcccaucauuucucucucucucuuuuuuuuugagacggagucucgcucugucgcccgggcuggagugcaguggcgcgaucuuggcucacugcaaccuccgccuccgggguucaagcgauucuccugccccagccccucaaguagcugggacuacaggcgugcgccccuacgcccagcuaauuuuuguauuuuuaguagagacgggguuucgccauguugguuggccaggauggucucgaucucuugaccucgugaucugcccaccucagccucccaaagugcugggauuacaggcgugagccaccgcaccuagcuuuucucucucucucuuuuuuuuuuuuuuuagacaaagucucacucugucacccagucuggagugcaguggugcaaucuuggcucacugcaaccucugccucccacguucaagcgaugcucacaccucaacuucccaaauagcuggcauuacaggcaugcuccaccaggccuggcuacuuuuuguuuuuuuuuuuuuaguacagaugggguuucaccauguuggccaggcuggucucaaacuccugacaagugauccaccugccucggccucccaaagugcugggauuacagacaugagccaccaugcccagccuccagcccaucauuucuugaugauuuguugaaacacaguaugcuggggcagucacagagaggagggggagggacauaugggaaaaagaguuagagggaaaaagucuucccucaguauauuuaauaugugcaguucucaaauccuuacccaucccuuacagauggagucuuuuggcacagguaugugggcagagaagacuucugaggcuacaguaggggcauccauagggacugacaggugccagucuugcucacaggagagaauauuguguccucccucucugacagggcacccaauacuuacugugccaagggugaaugaugaaagcuccuucaccacagaagcaccacacagcuguaccauccauuccaguugaucuaaaauggacauuuagauguaaaaucacugcaguaaucugcauacuuaacccaggcccucuacccuacacucuccggaugaaggcuuauagcaagaccucucaaugggagagucugucucucugcuccaaaggacaauggucuuaaaauaguagggguauggauuuuaagucaauuugccacugauaugccauguacucugguuaucagucuccauaaggccacuugguauaagguuugauagucucucaaauaaaaugcuugaaagaaaaaaaaaucaaagaucuaauuuccauuaauuugcuaaauugcuggcuaagacacugugugaaaaaacacccaccuuccuucccucccuuccucccuucauccuaauucuguguugguaacugauaaucacggccacugaaaauaccauacuuggugguaauuacuguaaaugucaagagaugggaagauaauucauccagucaaaaaaauacauguuauccugguuagagacucagcagggaaaggcuacaugcugagcuggaauccauauacucaggggaauaaaaaucagaagagacuguggagaugcuguguaccuggaaaaucagaacugcccaaugggcucuguuggcuguguucuucaagacauucauguauguugcucuuucccaucagcccguuucugggaauugcugaggugcuccugucugucugacugaacgaagguugacuaacucacccccaaaauaauacuuucuggcaacccugguuuccacuauaccaaaguaaaaaaacacugagaaauccuugaguggaacuuggaaauuucauaaaaauccaauugauaacuaauaaagaggauggaaacaaaauuacauugcagccagguuuucuugcugucacucaucugccugugaccagaugcuaaggccuuucucuaagguguaagaggaccuaagucccugggcagaagcaggcacaggaggcaaagguggguagcuuuugcugugaaaagaacaaaccaaauuuauacacacaccaaggccuuugugcugcgcaacuccagagguaagcuuuauagcaguccuaagcauaacauuguauuaagugucaaguuuaauuagaaaauguucauggagagggcugggcacaguggcucaugccuguaauccuagcacuuugggaggcugaggcggguggaucacgaggucaggagaucgggaccauauuggcuaacacggugaaaccccgucucuacuaaaaaaaaaauacaaaaaauuagucgggcgugguggcacacgccuguagucucagcuauuugggaggcugaggcaggagaaucacuugaacccgggagguggagguugcagugagccgagaucgcgccauugcacucuggccugggcaacagagacucgaccucaaaaaaaaagaaaaaaaaaaagaaauguucaccgagaaucuuccccugcucugggcccguccguggugggccagcugcugugcuuucuucuauguaaguaaauuaagaugguuuaggaagaggagaacuccuccuugauuuuuaccuauccaaagauauuuucucacuaacauguuggcacuaacagcagcucaacgccaucugaacacauaacauacugaauccuaacuauuaaccaccuucaugcucuugagaagggggacaagguauaguuuuuuuuugccauaggauaacauuuaggugcuguuuuguuuggagagugguagagaaauagaauagccucuagaacauuucagcaaucugaggaacccccaucgugggaucuugcuuauaauacuccacuauguaagacaaaggcuggugcuggaacucugggguucucccaggcucuuaccugugggcauguuggugaagggcccauagcaacagauuucuagcccccugaagaucuggaagaagagaggaagagagagggacaggggaauggagagaaggaaaaucuaguuauaaaagaauauuggcuuuuauucaaaaaacagacuuucaaaaaggaagagcuuuucuuuuucuucuguucaccaccugaugauuucugcugcuacuucccagggacaagcaguccaauguccagaacacuacuggauuucagaagaucuucuugaagugcauauguaguugaccugcacucuacaggcauucuuugucauucaaggacugagcaucucacuuuugucaccaaucaggccaaggcuccucccuaaugaucucugcaggugcuuuaacuuguuagaugcaagggaaaaaagguccuucuguauguuuaauaagaggcuuggauggcuagaaacucaaaguuauuggcugaaguuugauguuuauccagacuugguaccucaaguacucacuaugaccccaucaacagaggggucuauguugauuuuagguguacaugcuccuugucuccucugacuuuuuuuuuuuuuuuugagacggagucucucucugucaccuaggcuggagcguaguggugcgaucugggcucacugcaaccucugccuccaggguucaagcgauucuccugccuuagccuccugaguagcugggauuacaggcgcgcaccaccacgcccggcuaauuuuuguauuuuuaguagagacaggguuucaccauguuggucaggcuggucucgaacuccugaccucgugaucugccugucuuggccuuccaaagugcugggauuacaggcauaagccacugcgcccggcccucucugacuuucuucuagcccccuaaacaucuguuccuuccuucucacuacucugagaauggccauuguaucuuuaggccaccuaagcaguuuuuaaucuagaagugaagccagguucugccucuccucauugaacuagucugacuaccugguuuccugaagacacagaucacacugcacugccucuuccacuuacagggcuuggcaacacuguucaaaacaacuuucugugauagucacaauguucuauaucuaugcuaauaagguagccaugagucacauauaguuauugagcacuggagaugugguuagggugaaugaagaacuaaacuucauauuuuaauuuuuuucuuuuuuuuugaagagaugaggucucauucugucacucaggcuggaguacaguggcacgaucauagcuugcugcaguauugaacuucugggcucaagcaauccucuugccucagccuccuaaguagcugggacuacaagugcacaccaccaugacuggcuaauuuguaaaauuuaaauuuaaacagucccauguggcugguggcaacagugugggacagugcaaauucucauaaacacacuggcauagguucuuagcaaauaacuuggguaucacuuaaaaauaaacccuaaaauuguaucauuuuggauggauauguuuugggugacucucagugucuugaccuucccauugcaauaaaaagaaaauugccaaggccuaaaauucaccuggcuucaaagagacugcgauagagaaaaaaaucaggaagcuaaaaauacacggauggccuuuuagaaaguggucacccucccccuugacagacagacggacagaaacacacacacacacacacacacacacacacacacacacacacacucucuuacuuuaccgccagagugaaaagaaauggcaguaggacaagucuguguguuuuuuuuuuuuuuuugagacgcagucuugcacugucgccugggcuggagugcaauggugccaucucggcucacugcaaccuccaccuccuggguucaagugauucuccugccucagccucccuaguagcugggauuacaggugcacaccaccacacccggcuaauuuuuuguauuuuuaguagaaacgggguuucacuauguuggccaggcuggucuugaacuccugaccucaugauccacccgccucaggcucccaaagacaagucuguuuguuuuaagggacagcauccaucugugccacucucacuaccuguaugaauaaaccgcacccccaaccuguugauaggaccugcaugcucauaaugcuagaaguucuccccaggcagccaaguggagccaaaugcugacaugaaaaguacaaaagauuaggaauguuuauauccaggcuaacacucagugaugaggaugccuaguuaugagauaagaaauuugaaguuucgggcuuggcguaguggcucacgccuguaaucccagcacuuugggaggcugaggcaggcggaucacgaggucaagagauggagaccaucccgucuaacacagugaaaacccgucucuacuaaaaauacaaaaaauuagcugggcaugguggcgggcaccuguagucccagcuacuugggaggcugaggcaggagaauggugugaacccaggagguggaguggagcugguagugagccgagacggcgccacugcacuccagccugggugacauagcgagacucugucucaaaaaaaaaaagaaauuugaaguuucaggccgggcgcgguggccuguaauccuagcacuuugggaggccgagguggguggaucacuuggggucgggaguucaagaccagcgugaccaacauggagaaaccccaucucuacuaaaaauacaaaaucagcugggcgugguggcacaugccuguaauccuagcuacuuaggaggcugaggcaggagaaucacuugaacccuggaggcagagauugcggugagccaagaucacgccauuguacuucagccugggcaagaagagcaaagcuucgucuuaaaaaaaaaaaaaaagaaauuugaaguuucaccucuacauauacauuucucuuccagagaaaaauacuauggugacauuuaguauuuucagaaugucauuacuuugaccacauacuuuccaucauugcuauucugcauggaggaaaaaauccaaagcacuagaauuucuuuuuaaagaggggaagaaucuggugcuaauacugccuagcauacaguggaggaaaaacagaggacuggcucacauggcgcuccccugugguaaaggcagaagcagaaauaaggccagcagcuuuucuuggcaucuggaacaauuacuugauaggcucagaagguaaaaacaggcugaccucagcaguucaaaacuccaggcuucauuugugaucaugucccaaagcaguuuuccuuaggaaauuaccucuacugguucccucuuaaguuucuauaaagggacagaaagugcucaguagaaggauguuuuguuuuguuuugagacaaggucucacaauguuggccaggcuggagugcaguagcaccaucauggcucacugcagccucgaccucccagacucaagcauucuucucaccucagccuccugaguagcugggaauacaagagugugcuacgacacccaauuaauuuuuaaauuuuuuuguagagacagggucuuacuauguugcccaggcuagucuugaacuccugggcucaagugauccuccugccuuggccuccuaaagugcugggauuacagaagugagccgcugugcccagcugggauuuuuuuuuuuuuuuugagaugaagucucccucuuguccccaggcuagagugcaguggcgcaaucuuggcucacugcaaccuccgccuccuggguucaaccgauucucuagccucagccucccgaguaauccugagcuaggauuacaggugccuaccaccacgcccaguuaacuuuuguauuuuuaguagagaugggguuucaccauguuggccaggcuggucucgaacuccugaccucaggugauccacccgccuugggcucccaaagugcugggaucacaggugugagccaccgcgaccagccugggauguucugaaaugccugguagugcacacuugaaaaaggaagaaaagcagacugggaacauagcacuuagggagcugagaaagcagccagcucaggccugacagguaagugugaaaucuugcagacuuucucccugugaggaagucagaguucuggcuaagucaucugcuacaauaugaucaggagaaagucauugagucuucuugggucucaucugcaaaguuguuagaaugcuccauuuuuuuucccuccgugaagccuucaacaacuuuucaagaaacuauaguauuguuguuaagaguuuagaauuggaggccgggugcaguggcucaugcuuguaaucccagcacuuugggaagccaaggcggguggaucacuggaggccaggagaucaaggccagccuggccaacauggcaaaaccccaucucuaauaaaaauauaaaaauuaaggccgggugcaguggcucaugccuguaaucccagcacuuugggagccugaggcgggcagaugaucugaggucuggaauuugagaccagccuggccaacauguugaaaccuuguuucuauuaaaaauacaaaaaacuaucucggugugguggcacgugccuguaaucccagcuauuugggaggcuaaggcacgagaaucacuugaaccugggagcuggagacugcagugagcugagauugcgccacugcacuccagacuggccaacagaaucagacaaaaaauuagcuaguuguuguggcacaugccuguaauccuagccacuugggaggccaaggcacaagaauugaacaagguuugaacuugggaggugaagguugcagugagcagagauaguggcacugcacuccagccugggugacagaguaagacucuggcccgaaaaauaaauuaacaaagaauuuagacuuggagcuagacuuccugaguucaacuucuaguuccaucacuuauuaccugugugacuuugagcaacuuauucaaccucucugagccucaauuuucacaucuguaauauaggcauaauuacaguacauagcucauagaguugucauaaaauuguuaauuaguuaaaacaugguugggccuuuagagcagucccagcauaaagugaucuuuuuuuuuuuuuuuucuuuugagaucuucugucugucgucuaggcuggagugcaguggcgcaaucuccguucacuguaguccccucuucuugggcucaagagauacucucaacucagccuuccgaguagcuggaacuacaaguacaugccaccacgccuggcuaauuuuuguauauuuuuuuugguagagaugggguuuugccauguugcccaggcugguaucgaacuccuuggcucaagcgaucugccugccucagcuucccaaagugcugggauaacaggaacgagccgcugugccuggcccagugaacauuauauaaauuuuagcuauuauuggcugggcacgguggcucacgccuaucccagcacuuggggaggccaaggcgggaggaucacaaggucagggguucaagaccagccugggcaagaugaguuuucagugagcugagaucgcaccacugcacucuggccugggcaauggagugagacuccgucuugggaaaaaaaaaaagagagagagagagcaagagagagagagagaaagacaccccagugaagugaaaagagcaaagucuuuagauucucaucugcuuaaagucccagcucuuccacuuaucagcuaagaucugaacccgagacgggaauccaaauuacacagccucucuaaaucucuuaguuuuaucauucauaaaguagagacaauacuuauuuaugugguugggauggaagagugaaaaaagaaccugugugaaaguaucuagcacuguguauguauguaauaagucuuacaaaaugaagcggcccaucucugcaaaggggaguggaauacagagugguggggugagauuuuugucaacuugagggagggagcuuuaccuuucuguccugggauucucuugcucgcuuuggaccuuggugguuucuuccauugaccacaucuccucugacuucaaaaucaugcugaaagaaaccaaacacaacccaucaggauaagagaaagagaagcuuccuucaauggaaguggagcagacacgucauauuuaaggcauucaggccaggcgcaguggcucaccccuguaauccuagcacuuugggagacugaggcaggcagaucacuugaggucaggaguucgacaccagucugaccaacauggugaaaccucaucucuacuaaaaauacaaaaaauuaguugggcgugguggcaggcaccuguaaucccagcuacuugggaggcugaggcaggagaaucuuuugaaugcaggagguggagguugcagugagcugagauggugccacugcacuccagccuggguaacagagcgagacuccaucucgcaucucaaaaaauuaaaaauaaaauuaaaaaaaaaaaaauuaggccgggugugguggcucacgccuguaaucccaggacuuugggaggccgagacaggcggaucacgaggucaggagaucgagaccauccuggcuaacacggugaaaccccgucucuacuuaaaauacaaaaaaauuagccggguguaguggcaggcgccuguagucccagcuacucgggaggcugaggcaggagaauggcgugaacccgggaggcggagcuugcagugagcggagaucacgccacugcacuccagccugggcaacugagcgagacuccgucucaaaacaaacaaacaaacaaacaaaaaaaccaaaaauuagcugggcgugguggcaugcaccuguagucccagcuacucgggaagcugaggcaugagaauugcuggaauccaggaggcagagguugcugugagccacgaucaugccacugcacuccagccugggugacagagugaaacucugucucaaaaaaaaaaaaaaaaaaaaaaaaaauuuaaggcauucagaauugccaggcaggcaguagcugggcaccaauggcucacaccuauaacccuagcacuuuggcacuuugggaggcugaggcaggaggacagcuugagaccaggagcuggagacccagcugggcaacacagugagaccccuucucuagaaaaaagauacauaaaaccucagccaggcauaguugcaugugccugcagucccaauuucuugaaaagcugaagcuggaggaucacuugagcccaggaguuggaggcugcagugaacugugaucauaccaccacacucccgccugggugacaaagugagacucugcuaaaaaaaaacacacacacacacacacauaaaacaaaaaaaagaaagaaagaaaaagaauugcugggcagagauuugaccaaaagcaaguaaaaucauucuuuuugguagaccaggugaaaugacuaggaucucagcuguugaaaucaauucacugaagcaaaucuuuugugugcagaacuuaacaaucggcuuuucaccucacugggacuuaauguauuuuaauuuucaacaucuaucuccucucaaaacauucacuuagcauuuagauuagacugcuaauacugugcuguuauaaagguaacugaaaaauucccuaucuccuaaaucaauuguauauuaucaucuaaggaaauaaaggcuuuucagauuuccacugagagauuuacaguuaacacaaccaaaaugauaaaauauacauucaaugcacuaaagaaaguuagagguuuuucauaauuacuauuaugacuggucauggacaugagaauaaagaauaaugagacuggggagaaauuugaggaagaacgcucagaaacaauucugacugaaacucagauuguagggaaggccuuauguguugccaagaguauugugaagaaaacuaaaggcaagaguauaaccacuggcuauuacuaggggaagaauaucugacauuuccuaguuacuugaaugaggagucuagugauaaauuugucagaagacucccauguucauaguccuccuuguaccccugagcuucauacaauguguccaacugccuacuuaacuucucuauccagaagucuaguauacaucucaaaauucaugcaucuggccgggcacaguggcucacaccugcaaucccagcacuuugggaggccgagguggguggauuaccugaggucaggaguuuaagaccagccuggccaacaugguaaaaccccaucucuacuaaaaauacaaguauuagccaggcauuguggcaggugccuguaaucccagcuacucgggaggcugaggcaggaaaaucacuugaaccgggaggcggagguuggagugagcugagaucgugcuaccgcacuccaugcacucuagccugggcaacagaacgagaugcugucacaacaacaacaacaacaacaacaacaacaacaacaacaacaacaaauucucacaucuaaaacagaguuccugguuccauuccugcuuccugccuuucccacucccccauauucccuaccaugccuucuucaucuaauuuaauauuacuaacaagaucuauuguucaagccaaaacccaagugucacuccuucaauuucucuuuaccuuauccuccaaauuuaauccauuagcaaguccucucuucaaacccaucccaaaccaaccuuguuuuuaaccaucuccacaccaccaauuaccacaaggauaaaaucugaauuccuuaccaccaaauacuaugugaucuggcccucaucuaugaccuucucccauuccuuguguaaucucugccuccacacauaauuugcaaauuacuccagcuacacuggccuauuauuauuauuauuauuauuuuugagacggagucuugcucuuucgcccagccuggagugcaguggcgcaaucucagcucacugcaaucuccgccuccuggguucaagcgauucuccugccccagccucccaaguagcugugauuacaggcacaugccaccauucccagcuaauuuuuuuuuguuuuugagauggaguuucacucuuguugcccaggcuggagugcaauggugcgaucucagcucaccacaaccuccaccucccggguugaugaagugauucucuugucucagccucccguguagcugggauuagaggcacgcgccaccacgcugggcaaauuuuuguauuuuuaguagagacaggguuucuaccucagugaucuguccgccuugaccucccaaagugcugggauuacaggaaugagccaccacacccagccgugcccagcuaauuuuugcauuuuuuaguagagaugggguuuugccacguuggccaggcuggucucaaacuccugaccucaggggaucugccugccucggccuccuagagugcuggaauuacaggugugagccacugugcccgaaccuuuuaucauuauuauuucuugagacaggagucuugcucugucguucaggcuggagugcagugaugcgaucuuggcucacuguaacuccuaccuuucgguucaagugauucuccugccucagccucuggaguagcugggauuacaggcacugggauuacaggcacacaccaccacaccaugcuaguuuuuuguauuuuuaguagagaugggguuucaccauguuggccaggcuggucucgaacuccugaccucaagugauuugccugccuuggcuucccaaagugcugggauuauaggcacgagccaccacacacgaccaacauuggccuaucuuuuaaaaaauaaaccaagcucuggccgggcacaguggcucacaccugugaucccagcacuuugggagguugaggugguuggaucacuugaguucaggaguuugagaccagccugaccaacgugguaaaaccccaucucuacuaaaaauaaaaacuagucgggugugguagcacgcgugccuguaauaccagcuacucaggaggccaaggcaggagaauugcuugaacccaggagacagaguuugcagugagccaagauugugccacugcacuccagccugggggauagagggagacaccaucucaaaaaaaccaaaauacagaaaucaaaaaaccacacucauuauuaccucaagaccuuuauguuugcuauuccucugccuauaagaugcauucccuucauuuuucaaggacaauuauuucuuguuauuuaggucucagcucaauuuuuucagaaaggcuuucccuggccuccuuaaacgaaaguaaucaacaaccuuugacagcuaauacuauuccacuguucuguauauuucuccauagcauuuauuguuaucuuaaauucaucuuuauuguguaucuccccucgacagaaccugaauccuaccagggacuuaguuagucuuauuuacuguugcauuccuagugcccagaacacaguaggcucccaauaaauagccacugaauaaaaguuaaaaccaacaaaaauaaucauuuaauuaauuaugaauacaucgaauugugcacaauaguuuauaaaauuacuuuuuuuuuuuuuuuaagacagggucucauucugucucacaggcuggagugcaguggugcaaucuaggcucacugcaaccuccgccucccggguucaagugauucuccugccucagccuccccagcagcuaggauuacaggcacaugccaccacgcucgacuaauuuuuuuguguuuuuaguagagacaagguuucaccauguugaccaggcuggucucgaacuccugaccucaagugauccaccugccuuggccacucaaagugcugggauuauaggcaugagccaccacgccuggccuauaaaauuacuuucacauuucauuuugccugaucuguugucacagaaguucucagauggcuguucugaaauuauuccuccuccuacacucuaucuuauuuacuucucacuguucucaguaucauaaagugcaacaucuuuuugaagcaaucugaauuauaaacagauacauuugcauguauauauauguauauaugcauaugcacacacacacuuuuuuuuuuuuaagagacagggucuugcucugugcaagugcaagagugcaaugguaugaucauagcucacugcagccuugaacuccugggcucaagugauucuucuggcuuagcuuccucaguagcuaagacuacagaagcacacugccaugcccggcuaauuaaaaaaaaauuuuguggagacagagucucacuauguugcccaggcugguuucaaacuccuggccucaaguaaucuuccugucucagccucccaaagggcugagauuauaagugugagccacugcaucuggacugcauauuaauaugaagagcuuuucuucaacaacagugaacaguuuucuacaaagguauaugcaagugggcccacuucuuguucuuaugaaucuuuucuuuccuuuuauaaaacuccuuuuccuuucucuuuuccccaaagaaaggacuguuucuuuugaaaucuagaacaaaugagaacagaggauauccugguuugcgcugcaaaauuuuuuuuuuuuuuaagacggagucucgcucuguugccagguuggagugcaguggcacgaucuuggcucauugcaaccuccaccucccggguucaagagauucuccugccucagccuccugaguagcuggaacuaaaggcgcaugccaccacgcugaguaauuuuuuguauuuuaguagagacaggguuucaccauguugcccaggcugaucucgaacuccugagcucaggcaaucugccugucuuggccucccacaguguuaggauuacaggcaugagccacugcacccgauuuuuuuuuucuuuugauggaguuuugcucuuguugcccagguuagagugcaaugaugcgaucucagcucacugcaacccccgccucccagguucaagugauucuccugccucagccucccgaguagcuggaauuacaggcaagugccaccaagcccggcuaauuuuguauuuuuaguagaaacgggguuucuccauguuggucaggcuggucuugaacucccgacaucaggugauccaagcgccucagccucccaaagcgcugggauuauagguaugagccacagugcaggccugcauaauucuugaugauccucauuaucauggaaaauuugugcauuguuaaggaaaguggugcauugauggaaggaagcaaauacauuuuuaacuauaugacugaaugaauaucucugguuaguuuguaacaucaaguacuuaccucauucagcauuuuucuuucuuuaauagacugggucaccccuaaagagaucauagaaaagacagguuacauacagcagaagaacgugcucuuuucacggagauagagaggucagcgauucacaaaagagcacaggaagaaugacagaggagagguccuucccucuaaagccacagcccuuuaauaaggcuuguagcagcaguuuccuucuggagacagaguugauguuuaauuuaaacauuauaaguuugccugcugcacauggauuccugccgacuauuaaauaaaucccuagcucauaugcuaacauugcuaggagcagauuagguccuauuaguuauaaaagagacccauuuucccagcaucaccagcuuaucugaacaaagugauauuaaagauaaaaguaguuuaguauuacaauuaaagaccuuuugguaacucagacucagcaucagcaaaaaccuuagguguuaaacguuagguguaaaaaugcaauucugagguguuaaagggaggaggggagaaauaguauuauacuuacagaaauagcuaacuacccauuuuccucccgcaauuccuagaaaauauuucaguguccguucacacacaaacucagcaucugcagaaugaaaaacacucaaaggauuagaaguugaaaacaaaaucaggaagugcuguccuaagaagcuaaagagccucaguuuuuuacacucccaagaucaaucuggauuuaugauucuaaaaccccuggugacagaaucagaggcugaaaacaccacuaauuauaaccagcagguauggauauuuggaagucuaggggaggcugauaugaaguuaagaccagaggaaauaucuguccacucccucuucucaacacccaucuucuagacgccaaggcuagcuauagaucuccauuauaguguucaaggaauuaggaauuauccaugucaauaguuuugauuaauguggacggagaacaucuauauuacuagauggcaauaugugaaagaagaaaacaguauuguugaaaaccuaaaucugaaaugucaauguaaugacaaauuuucaccccuagaaugucuaccuggggaguccuaacccucuaauauuccccugagagggaugggagaauacagugcagagcuuuuauauaaguauuucagaaagcaguagcuaaagaaucacuuguuuauuucccaguguuucaaaggcccuucugaagaacuaagcaaacuaaggaaagaccauuuaguuuuaaacaggagaaauguauuuaacuaaauccuaaacacagcaggcuaucugcaagcagcagcagcagcagcagccaugcucccucacagaauccuuacaauuuuugaaguuuuuuguuuaacugcuacaaaagccgauuuaguaacauuuauuacacuuaaaaacuucaguucauuuguaguucaaagcaaauguauuggcuuugaguuuaaagacugaacuacuuuagauuugauuugcauuuuuuuuuuuuuuuuuuuuugagaugcagucuugcucugucagccaggcuggagugcaguggcuggaucucagcucacggcaagcucugccuccuggguucaugccauucuccugccucagccuccugaguagcugggacuacagaugcccgccaccaugcccggcuaauuuuuuguauuuuuacuagagaugggguuucaccguguuagccaggauggucucgaucuccugaccucgugaucugcccgccuuggccccccaaagcgcugggauuacaggccugagccaccacgcuuggcaucuuuuuaccuuucauuaacuuugaugcaaaccuauagcuuaagguaucuuaaacuuuaaugacauuuuucucuaaaauaguaguuuguaauaacuuguucuggcaccuggcuccaaugaacacuacccucugacccugugguauaauuuucaugaguaaguggaaaccuaagaucuuagaaguucaacggcaauguguccaagggguuuagauccucuccuuaagugccuguaucucugugaaaagaaucaucauaggcuaggcgcgauggcucacaccuguaaucccagcacuuugggaggccgagguagguggaucaccugaggucgggaguccaagaccagccugacugacauggaaaaacccugucucuacuaaaaauacaaaauuagguaugguggugcauuccuguaaucccagcuacucgggaggcugaggcaggagaaucgcuugaacccgggagggggagguugcagcaagccaagaucgugccauugcacuccagcagccugggcaacaagagugaaaaacuacaccucaaaaacaaaaacaaaaacaaaagaaucaucaucaagugaacuggaacacauccagagaacuaauuuuguuagaaagauuuuagaguugagccacacaaucugcaucuucugcguccuccaugcacucgucugcuuucuggagccccaugagugagucuuaauccuguuccagauaacaguucucuuccggguaacgguucuucagauacuugaagacagugucuuauuuccuuaaaucuucucauuucuucuucaaaagacaguauuucaaguuacuuuuauguaucuuuaccaucuaccucuggauaaacacucuccaauuugucagugaccauguuaaaaaccaagcacggugcuuaaaacugacaucaucuuucaggcaaucacuccauuggagaauacaguggggcucuggaucuguacuucacuugcuccagagccucugcuuguguuaauacggcccaguuucaaauaagcauuuuuagcagcccugaaauguguacucagauuuaguuuauagucaacuaaaaacacccagaggucuccuguauuacacaaguuauaauuaaaaccuuaaaagagaaagguauaggacaaaugaucugucuccucccuuuuuugcuuuuucauauguuaagacuaucucggagcuguuaucagacuuuuuuccugaaaaacucucaacaauacucaaacuagguguuacaugaagcuggggucuccagguuuugccucacuuguucuuucuuuuguuguuguugagacagagucucacucugucgccaggcuggagugcaguggcaggaucucagcugacugcaaccucagccuccagaguucaagcaauucuucugugucagccucccaaguagcugggauuacaggugcacaccaccacgcccagccaauuuauguauuuuuaguagagacuggguuuuaccauauuggccaggcuggucucgaacuccugaccuugugaucugcccgccucaggcucccaaagugcugggauuacugaugcgagccaccgcguccagcugccucacuuguuguuuuaggacuuaggcuccaccucaccaguguagucccagcagguagauaggaguuaauaguugacuaucucagcucaccacccuccaaaccuuuuuuuuuuuuuuuuuuuuuugagacaagaaucucgcucuuguccccaggcuggagugcaauggugcgaucuugggucacugcaaccuccaccuccuggguucaagcgauucugcugccucagccuccugaguagcugggauuacaggugccugccaccacgcccaccuaauuuuuauauuuuuaguagagacgggguuucaacacguuggccaggcuggucucgaacuccugaccucaggugauccacccgccucggccucccaaagugcugagauuacaggugugagccaccgugccuggcccacacuccaaaucuuaacccaaaacaaaaggagguaaggaagcagcaaaacuauuauuugucuuucauaaaguaauugauugacuauuagaagacuaucauccaugcuaugcucaacaaauauucuuauuuuuucacguuuuuuuuuuuuuuuuuugagacggagccuugcucugucgccaggcuggaaugcaguggcaugaucucggcucacugcaaccuccaucuccccgguucaagugauucuccugccucagccucacgaguagcugggacuacaggcgcacgcgaccacacccagcuaauuuuuuuauuuuuuaguagagacgggguuucaccaugcuggccaggauggucucgaucuccuaaucucgugaucugcccgccucggccucccaaagugcugcgauuacaggcaugcgccaccgugccucgccucaugugguuuuaugcagcagaugcaagguauucuguaaagguucuugguauaccuguuuucauaacaacaugaguagucucuucaguaauuagauuaguuaaagugaugugguguuuucuggcaaacuuguacacgagcaucugaaauuaaaucaaauauuccauuaucaugaguuaccucuagcacacagcucagaauacuaguuauuccaccauggcauauguuuaccuauguagcaauccugcacguucuacacguguccuggaacuauuuaaagugaauuuuuuuuuuuuuuuuuuuagacagagucuugcucugucacccaggcuggagguaaaaaaaaaaaaaaaaaaaaaauagaauaccaguuauccuagcuuuaagucucuguuuuucucagaaaggguacauuuaaaaaauucuaagacaccugaagucucggcugggcgcgguggcucacgccuguaaucucagcacuuugggaggcugaggcgggcagaucacaaggucaggagaucgagaccauccuggcuaacacggugaaacccugucucuacuaaaaauacaaaaaauuagccaggcgugguggcgggcaccuguagucucagcuacucaggaggcugaggcaggagaauggcgugaacccaggaagcagagcuugcaguaagccgagauggcgccacugcacucuagccugggcgagagugcgagacuccgucucaaaaaaaaaaaaaagauaccugaagucucaaauaaauaguuuaauaaaaauuauguacacaucagcagacauaaaauuacaacuaaggauucaaaauaauauuauaaaccuacuacguaccacaaaacuuaaaacuuaaaaaauauauacugggccagacacggcagcucaugccuauaaucccagcacuuugggaagcugaggugggaggacugcuugagcucaagagucugagaccaagaccagccugggcaauacagugagauuucaugucuuuaaaaaaaaaaaaaaguaaaaagaaaaaauauauauuaauuuugcuuuaauagcagauaucauucgauucccuaagaucguuucuuugcauagugacacucuacuguacuauaaauuuaucagccuacacuuuauaagcugagagguaacuagccuacacagaaaguuaugcuacagauauacauggcuuaaaaccaagacucaacccucugauaguuacaaaacacugaaaucaggauguuacuaaaggucagugcaaaagcgaucaauucucucguaagaaggcuuagaagggguucauguucuuccccaaagaaauuuagaguccucuagcuauuaucuaucaaccaaauaaaaaucaauaggcagcaaaagaaauuaaccagaucaauuaugggcacaguugaccuagcugguagguauugucugauaaauaacuuuguuuaccaagggccaucauuuacuagccauagccacagccacucacaccaguauuuacguguugcacaauacugccaugaaggucaggccaucuuucuuucauguugccucacuccauacugccacagggcacugaaaaaaggcaggcuagagaagcuaaugacauccucccccuuuugcuaccacccuccgccaggaucauuagcaauucugaacugauuaauugcugaaaucccagccuugaaacuguucaguuagaagagcaaugcugaacugcugaaaagaucaucuuaauaugggcuucagaauuaaucauguguaauacagucaguagcuuucaucauaaauuuaccacacuucaccaagucugaauagagcucaaaguuuuccucuucgcuuguuuaaagacaacauguacccaagccacuuguagucuaaucugcagcucagaauugccuuugccaagaaagauuagaccauuuuagccaucucuaaaaagcugaacuugcaaaacaaagggauaaagaacgcuaauuuucaaugaauaaauaaggaauucuggacgugcaggcaagugaucaagagccauugaaacagacacagguaagagcuuucagagcaaauugcuggucuggacaugggauuaugagaugaaaacauuuauagccaucacugugcacuuacucauuguaucuaccagggcagccacagcuuacuuugcccuuuuaguagugggauacaucuggccacagagauguuaugcuaaguaacuaccuauggagaaguuaggaugaaaaauccuaggaaggauauauuaauaaagauauuucagaaugacuuggucaucucucagugugcaauaaauggcacacccacuacugaauccauuugauaaucugguauguuaucucaucauaguuuuaaagaaauauucacgcaauucuucuucuuauuauugagacagaguuucgcucuuguugcccaggcuggagugcaauggugcaaucucggcucaccgcaaccuccgccucccggguucaagcaauucuccugccucagccuccugaguagcugggauuauaggcaugcgccaccacgcccggcuaauuguguauuuuuaguaaagaugggguuucuucauguuggucaggcuggucuugaucuccugaccuuaggugaucugaccaccucagccucccaaagugcugggauuacaggcuugagccaccaugcccggccaugcaauuauuuuuauuaugaagugaugacaaugacaauuaauuacaggggugguaaacuucucaggaugucugaaauccacaaauagcccaagcagaaacgagguuuuacuggucuuaauauuuuaauggguauuuuuccacaguaugaagcaauucccauuucuggcauuaaggacccaaggugaugccaaaauccuaauagcaagggauauugcagggcagaaguggcagggcauucuuacaagccaggaugaaaacaaacacuagagaaaugcuacuaucuggcaguacauuuggaaccagucugaauuuaguuaaauaugcugguaaauucacccaugugagacaagggggagaaaaagaugccuucuggggaauaaaacuauaccuacuugcuuuuacagauagaaaggaaaauuccaauucgaaaguccuauaucauacccaaaguauagcuuuuccacuaauauuuaauaauuauuuucucaaguaaauauacauaaaauaauccacacuauagcuuuaucuagaucuaaauuuucagaaauuaguaaucgaaauuaaauuacacagaacugugauuguuuucuagauuucuuccucuagguuauuaauugacaauaccuacauaaaacucuuuccagaauguuguuaagucuuagucauuagggagauacauauggauacacucacaaauucuucuggggucaggccagacaccaccauggacauucuuuuguugacccuuucuguugaagcugucaauucuggcuucucccugcucacacuuucuuccauugcauuauacccagcaguaucaguaguaugagcagcagcuggacucugggcagauucugcaacuuucaauuggggaacuuucaaugcagagguugaagaugguauguugccaacacgagcugacucuggggcucugucuucagaaggaucagauucagggucaucagagaagaggcugauuccagauuccagguaagggguucccucugaaaggaaugggagaaguuuaauuuacacaacgaugaauguugaauuacaaaguucuggucucuguuaagaauuaaaaagaccaauaaaguuagguuaagagaaaaauggguacaugaauacaguguugguggaaauccaaaguagcuuaguuuccuaaaaaggaaauauggcauuauguagcaaacaccuuaacacguauuuacacuuucagucaacaaugcuaguuuuagaaauauauccuagggagauaaaagauauaugcaaagguuuagucauaggaauaguauaauuuuagaaacaauguaguuguccaauaauaggagauuaaauuacgauauaccuaguccaauggaguacucuucacccauuaauuugaauauaaauguugauguacaauaaaacagaaauguuacuaauauauuaaagacaccuaagcaauauuauuuaucaugacauuauuuuaaaaauaaaaguuuaugggccgagcacgguggcucacaccuguaaucccagcacuuugggaggccgagacggguggaucacgaggucaggagaucaagaccauccuggcuaacacagugaaacccugucucuacugaaaauacaaaaaaaaaaauuagcugggcgugguggcgggcgccuguagucccggcuacuagggaggcugaggcaggggaauggcguguacccgggaggcagagcuugcagugagcugagauugagccauugcauuccagccugggcaacagagcgagacuccgucucaaaaaaauaaauaaauaaaaauaaauaaauaaauaaaaguuuauguaaaaugacuaaagaaacacagaaauauuuuauuauuaaagaauaagaguacaggccgggugcgguggcucaggccuguaaucccagcacuuugggaggccaaggugggcggaucaccugaggucaagaggucgagaccagucugaccaacauggagaaacccugucucuacuaaaaauacaaaaaauuagccgggcgugguggugcaugccuguaaucccagcuacuggggaggcugaagcaggagaaucgcucgaacccaggaggcggagguugcgcugagccgagauugcgccauugcacuccagccugggcaacaagagugaaacuccgucucaaaaaagaguacggguaauauuuuuuuuuuugagaagggucucggucugucauccaggcugcagugcaguggcacaaacauggcucaccugcagccuugaccuccuggacucaagugaucuuccugucucagccuccugaguagcugggaccacagguguuugccaccuuccagcugauuuuuuuuuuuuuugagauggaguuucauucuuguugcccaggcuagagugcaauggcgcgaucucagcucacugaaaccucugccucccagguucaagcgauucuccugccucagccucccgaguagcugggacuacaggcauaagccaccaagccuggcuaauuuuguauuuuuaguagagacaggguuucuccauauuggucagguugguccugaacuccugcccucaggugaucugcccgccucggccucccaaagugcugggauuacaggcguaagccacccaccacgccuggccccagcuaguuuuuuuuuuuuuuuacuuuuuauagagaucaggucucgcuacauugcccaggcuggucuugaacucuuggccucgagcaauucucccaccuuggccucccaaaguacugagauuacaggcaugagcaguggcuguaaucuguccuuauuuuaucuuuuaagagguggcaucucagcuuggugaaguggcucacaccuauaaucccagcacuuugggaggccaagguaggaagauugcaugaggccaggaguuagagaccagccucggcaacauaacaagacccgugucuaaccccaccccaaauuaucuuuuuuauucccuauauuguccaauuugggggcaaugagcuuauagcaauuuuguaagaaaggaaaaaaaaguugaaaaauguggcaaaugcuuuauuuuuguuucuucauccaagguaaugacaccauuacuuuuuucacuuaauaaaucagcagauaucauuaccaaauuaaaaacagcagagaugucauccuugaaacauuucagaaaaugccaugguaucaggaauuaagcauagcuaaguagaauguaugagauuccuaaaaugacccuaaugaacauggccaaauaccacauuugaugccaaacagugucuuuuaugauaacguguuuuugaggauuaaaaacuuucuuuacugauuaaaacucugauuuacaagccauaaaacaccauucauuaaaagugauuuuuaaggcauaaaauauguagucauuuauauucauuaacucauaaaaaaaacuugcuuugggauuugacucauuuucuaauaaaggacuggccuaaaacuuuauucuuuggccuuuggacucuugucuaacaguugaaauaaaauauauguguguauauauauauauauauauuuuuugagauggagucuugcucugucacccagacuggagugcaguggugugaucuuggcucaccgcaaccuccgccucccggguucaagugauucugcugccucagccuccagaguagcuaggauuacgggcaugcacuagcacacccaguuaauuuuuuuguauuuuuaguagagacaggguuucaccauguuggccagacaggucuugaacuccugaccucagcugauccaccugccucggccuccuggaguacugggauuacaggcgugagccacuaugccuggccugaaauaauacauuuagaguacaccaagacucccucauccucaaaaucauuaguuaaaccauuaauuaaaauauagauggauuaacaguuucaauaauuuucaaguaaaccuugauuaacacuugagcuauuuuucuaaagugggcuuaauuaaguauaacaaaaguguccaugauagacuaguacaucuaaaaguugguuaaccagaauaucuuuauguaggauucagaguaaaaucaaaguguuuguuccaauacagcagaugaaauauuaccuagaucuugccuuggcaaguaagauguuuccgucaaaucguguggcccagacucuuccagcuguugcuccuccacaucaacaaccuuaaugagcuccucuugagauggguaguuucuauucugaagacucccagagcaacugugcauguaccaccuaucaucuaaugaugggcauuuagaaggggaugaccuagaaagauaaauggaaggagaaaaccaucgccaccaauugugaaaggacaaaucauacuugcugggcagccaaagcauaaaugaaacagcucaugucagagagaucagaaaugacuggcaaaaaagagcccgcaagacagccuagaagucuggauucauguugccugccaauaugucaggguugacauauaacaugggguuggguuggucugaggcaccauaucucccagcuguuuaaaagcaggucaguagcugggugugguggcuggcgccuguaaucucagcuacucgggaggcugaggcaggaaaauugcuugaaccugggagacagagguugcagugagccgagaucacgccacugcacuccagccugagugacagagcaagacucugucaagaaagaaaggaaaggaaagaaaggaaagaaaaggaaaggaaagaaagaaaagaaaaggaagggaggaaggaaagaaaggaagaaaggaaagaaaggaaagaaagaaggaaagaaggaaggaagggagggaaaggaaaggaaaggacggaaggaaggaaggaaggaaaggaagaaagaaaggaggaaagaauaaaagcaggucagcaaauuuuuaccaaauuacucacugccacucacucuauacacaauauucuacuugagucuaaauggauauguuagaaucagaucucuuaugaagauagaaaguugaucaaugucgacaucucuacacucauucuuucuacucaguuuuagcagaauucacagaaucaucccuauugccugccuuuucaauguucaaauucauucuaaaaacaaaagccagcuauaaaauauuguuagaaaagcauacacacccaguaaauaguuccucugcucuuccaagugcuuaggacuuugcaaaauaagauacuuaucaacagauuuaaagggccucagagguuaauuaauuuaaacaauuauugggugcuuacuaugggucaaauacuaaggcuaggcccccuggauugaagaugggugagaccugaauuacugcucucucucucuuuuuuuuuuuguuuugagacggagucuugcucugucgcccaggcuggagugcaauggcacggucccagcucacugcaaccucugccucccagguucaagcaauucuccugccucagccuccugaguagcugggauuacaggcaccugccaccacgccuggcccuccaguaaggaaaagaauaguacuggacuacauaguccaguacuggacugcuauacagcccuguguuaauagugguguaaauacacaucucugaaagauauucuaaauguuuucuggcuuugggagggcaaggcgggcggacuacuugaguccaggaauuugagaccagccugggcaacaagguaaaacuccaucucuaccaaaaauacaaaaacuuaguggguguggguggcgcaugcuuguggacccagcuacucaggaggcuaaggugggaggauugcuugagccugaaaaacggaggaugcagugagccaugacugcaccacugcaaucuaggugacacagggcgacccugucucaaaaaauaauaauaauaguaauuauuauuauuauuuucugugguaaaucaacagcuagacuuuuucuagaaagacaagaauuuuaauuagggcaagggcugccuugaagaagucuaccaucaguuuccaagcuuguucagguuuuaccuccauuauauuuuuuucugaccuucagaagggacauaucuaucuaaccgcacauuucucauguuguagcuuauguuauagguucaaaaaaccuauauaggauuaaacaaaagaaguauccuagagcaauaaaaguguauaaaugccuguaugcaaaaaacuggagaaaguauggugaaaaaaauuaacaaucagaguucaauauaaauaaagaugucagauaccacagcaucuuuacauugauguuucuuaccuuuccacuccugguucuuuauuuuuacugguagaacuaucugcagacaccucaaacuugucagcagaaaggccuucuggauucuggcuuauaggguauucacuacuuuucugugaaguuaauacugcuuuaaauggaaugagaaaacaaaucuacuuuacugcuuuguucugauagugauaauucagguuagaauacugauuuuuuucaaaagcaucaaucuaugauacacaaauugguuuuuaaacaaguauaucaggcagaauuuuauaaacacaagcaaugcaacagacagaugcuagcaccaaauggaauucaaugauuaaaaaauaauaaugauaauaaaaggaacacuuuaagacagaguaaauaaagacacccagcugagacaaggcugaaaaaaaaaaucuauauuccuuggcccugaaugauaaaaaauauauauaacaaauuuuuaucucugcagcaaaauaaauuaugcccaaauccccucagacaauaggaaagaaagaguaccggagagcacaaaguacauuauuuucuccaucccuacugccuccacauugaagacuguaugaaauggggauuucagcuucugcaugucggggguaaacaagacaugagugucagacaugaaagaaaaaacaggugacauuuugcuucacauuuucaauuaccgaaaaaaaagaaaaaaacaaauaaacccccuaaaccaacacauacacaaaaaaaucccaaggugcugguugauaagaaaucuuaaauaauacauggaacuaaugaugaaauggcacaagaagggaaaaaucacaaaacauacugaaggcaaaguucuggcauguuaguucuuuuuuuuuuuuugagacggagucucacucuguugcccaagcugaagugcaauggugcaaucuuggcucacugcaaccuccaccuccuggguucaagcgauucuccugccucagccuuccuaguagcugacauuacaggugccugccaccacgcccagcuaguuuuuuugguauuuuuaguagagaugggauuuuacccuguugaucaggcuagucucgaacuccugaccucaagugauccacccgccuuggccucccaaagugcggggauuacagacaugagccacugcgcccagccuaauucauuuuguaauauauuuacuccuccaaauguaucacuuugugccacugccuucuaggaaguggcuuaaaggcagaaguacuuauuuauuuauuuuuauuuauuuauuuuuuuugagauggaguuugcucuuguugcccaggcugcagugcaauggcaugaucuuggcucaccacaaccucucugccucccagguucaagcuguucuccugccucagccucccaaguaguugggauuacagguaugcaccaccucgcccaacuaauuuuguauuuuuaguagagaugggguuucuccauguuggucacgcuggucucgaacucccgaccucaggugaucugccugccucggccucccaaagugaugggauuacaggcgugagccacugcgcccgaccguuauuuuucaacgagaugggugucuugcuguguugaccaggcugguuucaaacuuuuuuuuuuuuuugagacagagucuugcucuguuacccaggcuggaauacaguggcaugaucucggcucacugcaaccucugccuccagguucaagcgauucuccugccuuagccucccaagaagaugggauuauaggugcccaccaccaccccuuggcuaauuuuuguauuuuuuguagagaugggguuuuaccauguuggccaggcuggucuuaaacuccugaccucaggugauccgccaaccuuggccucacaaagugcugggauuauaggcaugagccaccauacccagccuggucuagaacucuuaaacucaagugauccuccugccuuggcaucucacagugcugggauuauaggcgugagccaccaugccuggccaaggcggaaauauuuaauaaguaaaaacaaauaguuaaaaauugcaaaagucuucuauucauuaaaaagucacugaugacuguaauucauuuugagcuuuuauuagaaaagcuaaaagccauaaauauagguagaaaauugaaacaaaagauuguauuaauuaaacuguuuuuuuaagacacuggguagccuggggggaaauaaucauugauuuccugaguuagucuucaaaugcauuauuuauaguuuccuuuaugcuugucuuuucuggaccugugaguuucuaggauuguuaagaacucuguugaaaguaaguaggaucuaacuaugaagagagguaucauccuccccacccccaauacagggugauaauugauaaaggguaaugugcaaguuccaaggaaccauaucaaacggaauuaaccauuggaaagaguuaaaaaaguggccaggugauguggcucacgccuacaaucccagcacuuugagaggccgagguggacagaucaccugaggucaggaguuugagaccagcccggccaacauggugaaacccugucucuacuaaaaauacaaaaauuagcugggcgugguggcgggugccuguaaucccagcuacccaggaggcugaggcggacauuguaaugagccgaaaucacaccauugcacuccagccugggcaacaaaagugaaacuucaucucaaacaaaaacaaaacaaaacaaaacaaaaaaaaugaaaggcagagggaaggcucagauacaaacacagcuauuaaaaagucauuccuccuuuuggccagaaccaccaucuuucaguaauuugccaaaaugacgaacacaaagggaaagaggagaggcaccugauauauguucucuaggccuuuuagaaaacauggaguuguuccuuuggccauguauaugcgaaucuguaagaaaggugaaauuguagacaucaagggaacggguacuguucaaaaaggaaugccccacaaguguuaccauggcaaaacuggaaaagucuacaacgugacccagcaugcuguuggcaucgcuguaaacaaguuaagggcaagauucuugccaagagaauuaaugugcguauugagcacauuaaacacucuaagagccaagacagcuuccugaaacgcgugaaggaaaaugaucagaaaaagaaagaagccaaagagaaagguacguggguucaacugaagcaccagccugcuccacccagagaagcacacuuugugagaaccaaugggaaggagccugagcagcuggaaccuauucccuaugaauucauggcauaauagguguuaaaaaaaaaaaaaaaagaccuuuggacuguaaaaaaaaagaaaagucauucuaucaccagaacauuuagcauauaaauuccucuucuuacuacaaugggccucaugcaaugaagcaaauaagauaacuuguuagaaguuaacaacucaauagaaccugaaaaacagagcaaaaccuuucugcuuuuuuuucuccuuaauccuuaauucauucucugaacagcaagcccaaccuaagccuugugacaugaugaucuacuugcuggcugguuuaggaaagucuaaaugcagagauccagaguccaaguuucagaauauuauuguaguuccucuuaaaucauucccucaucuagaugucuuaacauguuacauucuuuguggauaggaaguaugggccacaccaaacauuuaauaaacuuacagacugcccacugugugcuaagcauuguacaggguauugugaagaauuaaggaagacacuggaagacaacagauauuaagaaauaauaaacuaggccaggcaccguagcucccaaguaggugggauuacaggcaugugccaccacgcccggcuaauuuuuuguaguuuuaguagagaugugguuucuccauguuggucaggcuggucucgagcucccgaccucaggugauucgccugccuuggccucccaaagugcugggguuacaggcgugagccaccguacccggcaacaauauucuuuuuacuagaaguucuggccaggugccauggcucacaccuguaaccccagcacuuugggaggcugaggugagaggacugcuugaguccaggaguuugagaccaacuugggcaacauagggagaccuugucucuacaaaaaauaaaaaaaaaaauuagcuggguauggugguggacgccuauagucccagcuacuugggaggcuaaggcaggaggaucgcuugaggaggucgagaggcugcagugagcugugauuaugccacugcccuccagcuugggcaacagagcaagacccucucuauaaggugaggcucaggucggggaggauggcucaagaucaggaguucaagaccagccuaguuaacagugcgucccugucucuacuuaaaaaaaaaauuaaagaaaagaaaaaauuauuuuuaaaaaguucauuugaguuucaguuagacucacaccagauuuagggagaaaaaggcucaaaacuuauguugguauuaaguugugauauccaaaacaauucagaaauuaagcauuucaguuacagaucuccagaaaaaaauaaacacacguauauaccaaagaggagauaguagauuuacacagauauucaaagucacacaauaauaacauuuuaaaucuuacacauuauaauugaaagucuagucuguguuuagacugaagauggugaaaguacccuaaagaagaguauuauacuggggaugggacucugaucucucauuaucugagagaugaacuaaaugaagauaguuacaaagaaagcauuuaaggaaauacauuuugaagcacugccauagcaacagaguuucuagcuagcuucuuuauccaagagcuacuguuucuuccugaacacaaaaauacugcaaggcacaacuggggaccaaagccacuguucuguauaaguagcagacuugaguuccuagaaagacuccaagaaaggucuuaaaguucccaguuggacuguggaacggggugcugaagaaggaacuuuaacacucagauaagaaucacugagcuaggaaugaaguguacuuugggaguacucaccaccccugcauguuucuaagcagcauccuaguggggaccccaugccuagcaucuccuaugugucuguuuguuugccccuauuuaaaaaucugccugauguauugucuuuccaauuaaaaacucaaauuuccaucucacuuuccuucauuuaugccauuauuccucagcucagugcucacuucuuauaggaagucagcucugaucaacugcaucugccugguuacuccaauggcauccucucagagguccaucuggauuuuuuuugauaacuguaacauugcuauaaagcacuugacucuauugcauaauuaggcuuucuguguuguucuuuucuuuuccuuuugaacuaacaggagcucuacaucacuaggcuuucuguggaucaaagugcaguuccugaaguauaggaugucucucccuauaaaucagaagcacauuaaauaggucuuugugaugugacaccaguguuauaaggaauaugucugaguacuuuuucauagcuuucugaaauuaugggguugccugucaccaauuucucccauuccacuuagcuuccaauagagcaagagcuauguuguauaccauguaucuuccaugggcuccccauagcaucuacuuguuguagguacucagaugacaacaugaaugacugccuugggucccucugacugguauauuaguugugagcagggacaagaaccaaggcuccauaauuacccaugugcugagcaaggaucauaaaauguuggagcuagguccuuacucuucagaaggagauaaaggggaaggaaagaauuuugcuuaagauaucaguguuuggccaacaauacacaccuuuuucugaugugcuuuguucuggauuucgcagguccucaagggcagaagagucacuuaugauggaaggguagcuguuagaaggcuggcucccaugcuguucuaacacagcuucuaguucagccauuuccugcuggagcuuuaucagguuauguugcaugguaucccucugcuucaaaaacgauaaauggcaccaagaaaaugaaauacuuugagaagcuuuccauuaaaugaaaauauaucauacaaauuaauuuuagcacaggaauugaaaucaccuaguauggaacuacaaguucuagcugaacaccuuuuaaucuaaccacauucaugcaauuaaugcccaugaaauuauuuccaaaugauguuagugagggaaaaaauccucaaauucccccaaauagacuugauguuauugugauguccuuuugaaguugguuauuuucuuuuaaagcuagggagugaaaaaauaauuaaggcauuuaaacacuaucgauauuuaaaauuagcaugaaucuguuaacauuuuauuuauaugggcacauuucaaagacuugguguugugagauucaucagacauuuagguuaguucauauaaaaaugugugauuuuuagacugauguaauguugaaaaaagcccucuaucuauggcauuuuauaaaaauacaacaaauauaaaaauacuaucaguaauccugccuagauuacuggcuugugaggacucuuccuuuucugggauucuuugaaccuuuaguuucuuuucuuucuuucuuucuuuuuuuuuuuaagucucccucugucacccagguuggcaccaucucggcucacugcaaccucuuccucccagguucaagcgauucucccaccucagccucucaaguagcuggcauuacaggugcuugccaagacgcccggcuaauuuugguaauuuuuguagaaacaggguuuuacuauguuggccaggcuggucuugaacuccugaccucaagugaucagcccgccucggccucccaaagugcugggauuagagacaugcgccauugugccugaccugaaccuuuaguuucuaacagaaaaagcaaaaagcuaauucaugaaucuaucuguuugcucaguuaauuagacaacuauuuacuaucuauuaagcaccaggcgcuguccuaguacugaggauauagcccucauggugcugccauucuagacagggacaucucaucuagaauguguccaccuagagaucauuagcaaggaccugugagagggaaggauccaacagaaagagcccugagaaagccuguaaggauaguuacuguuuuuaaaauaaugaguucuuuuugcuuaugggcuccuguuguuuauugguccauuucaaagaagagugugcuaaguccaaguauuugauaaacaaagaauuuagguauguaaggaguuuuccaaaauauccuucuuaagaauuuauuuuauuuauuuauuuuuuuugagacagucuugcucuguugccccaggcuggagugcaguggugcgaucuuggcucacugcaaccuccgccuaccugguucaagcaauucucccugccucagccucucaaguagcugggauuacaggcaccuguuaccaugcccgacuaauuuuuuuuuuuuuuuuugagacggagucucacuuuguugcccaggcuggagugcaguggcgcaaucuugguucacugcaagcuccgccucccagguucaagccauucuucugcuucagccuccugaguagcugggauuacaggcgcccgccaccaugcccagcuaauuuuuuguauuuuuaguagaaaugguguuucaccguguuagccaggauggucuggaucuccugaccacaugauccucccgccucggccucccaaagugcugggauuacaggcgugagccaccacaccuggccuaauuuuuguauuuuuaguagagacgggguuucaccauguuggccaggcuggucuugaacuccugaccucaggugaucugcccgccucggccucccaaagugcugggauuacagacgugagucacugugccuggcuucaaaauauacauguuuaaaaaucacuuuuagaaggaacagcaaugguugccaaaaaguccagugggggaguagggcaggaacacauuguuucacucuccguuucuucuucugauccuuaaaaaugacuuugcccuuuacuaaaaacaagccaucuucuuucuccugcuacacugaguucacaauuuucaggagguuuuuaugaccagaaaauguauuccuagcuucacaaagguuucuacugcuacucuaacacugcuuugcugccaaggucugcagcaaugccauugccaccacgugguacucgugaguaguuacaucacugaucaaacccuagccaaagucuugccucagucaaccuggaaugaaagcacauagauaucugaccaaaaugcuucacaggcuguauuagucacuacugucacaaccaucacaucuaaccucuacguggccauuacauaaaucagaaaaaguagugggguaauuauuaauagauaacuuuccuuuggguuucccaaaggaauuauuuuuuauaacuuagacaaauuccccagcagguaaguggccaaauacauuagggagaauaaaaccaauagguuucuaagacuucuugauucuaauucugaagugcuccuucaauuagcucuagccuucuacuucuacuaugcugcucugaucucuacuuuuaauacagcuacauuacuguagaaguucccuaaaagccuuguuuaucaugucuuuuucuuccauaaagacccuuagugcuccauccuggccaucacagugaaacacuggcugaggcagaagaaucacuugaacccagguggcggaagugcagugagcugagaucgugccacggcacuccagccugggcaacagagcaaaacucugucucaaaaaaaaaaagaaaagaaaaaaacccuuagugguauaccacugcugauuuauacuuuuugaacacuauauaauuguuagucauuacugccauuaggauaaaauuccucaacauagcauucaaaaggcccuuuauacccugguauuaucucucauuucucccaacaccccucacacaaguuguuuuccuauaacacaugacaacuuuacguuuccugggaauuccaugacucuguaccuuuaccuuacuugcugccacuccucuuuuuccacuuggaaaaauucucaucuuucaaggccuaguuugaaugucuccuuaaguccccaccaggaggaguugugaaauaugagaaguaagggcaagugggcagaauguggcuaauucuaauaagacuccugaaaugugcagcagagcagccggaacuggucuggagggaagcagaguguauaucugacccuuguuuguucacauucauuacauauaaauauauauauaaaaccuucccauaaaacauguguauuuaaugaguuaaaacuauuucuaauguuccuacuacuacauaauaagccuaauccagauacaagcugaagucuuagcacaaauaguggcuuuaucaugcuaguuuugucgacauguugugaauauuuucaaauauacagaaaacuugaagcaacuuugcaaugaguguuuauauaucuacuacuuagaaucuauaauuaacauuuccuauauuuauuuuaucacauacauacacacacacacacacacacacacacacacacacacacagaaguccccaccaauaauccaucuccuaucgggaacagaugaucucucacuacuugauuuacauugcuaaugcauuaguauacccaaauggaacacaugaccuugauaggaggaagcuucccuuaaucauauuugucucccuaaugccuagcagacaguaagcacucagcaaguguuuauuaaugagaagauaaauuaauaaauaaguauaguuaaucagucuucuguaaaaacaaacaaaaacccagauaucaaugauaccaaauuaggaauucucuaucaucuauauacuuuuucucgguucaguacaaaaagggaaaaaaaaaucccacuucaauaguuuuuccugccugugcuacuuuagacguaagacagccugaaaucugacuucaacgguuuuggguagaugcuuaguaaaaacacguugcaaaaugaauccugaacaaauagacacaucucugggaauaagauuagaaauacagaaaaacaaggacauuguauauugaaugucaaauauaauacaguauggcuaaggcagauguaaucagaaauugcaaccuuaaacuuuaaaacacaauggacagaauuagaugauggguauauugacagagucccaaacccacauucaaaaaggaucauaggaauugcaaagagagaaaaggccuccuaaaucuuuucaucaauuuaguugccauggcaauccugaagaaguggagaauacuggugacagcucagauacagaguggggagucaucucaaagguuucuugacaacuccaaggggcuucaggucuagagggauuugcucuguacagagaaugggcaguagaagauaagccuucucuaauuguaguucucauagcaaugcaagauuuagauuuuaaaacuggauaucacccaguguuggcaagguacaggaaaaugggaacuaucauauaccacaggggcuggaagagcauaaacugguuuaaucuuucuaaaaaacaauuuaguaacauguaucaaacaccaaaauccuagucccaguaauuuagacuaaggaaauaaucagggauguaggcaaauauuuagcuaucaggaugccacuauagugauguacauaauagcaaacugugccucuuacccugaaaccuccaacauucagcaauaggucaaauaaaucaugauacacuggaaagauagaaucccauauaguaauuaaaaaugaagucacuuaagaauuuuaacgacccaggcugagugcgguggcucacgccuguaaccccagcacuuugggaggccgagguggguggaucacuugaggccaggaguuugagaccagccuggucaacauggagaaacccugucucuacuaaaaauacaaaguuagcugggcaugguggcacaugccuguaaucccagcuacucgggaggcugaggcaggagaaucgcaugaacccgggaggcagaggaugcggugagccaaggucacaccacugcacuccagccugggcaacaagagugaaacuccaucucagaaaaaaaaaaaaaaaaagaaaaaagaauuuuaaugauccaguaaaagcuagauuauaaugcacagaauuaucuggauuucuuguuuuugagacagggucucaccauaucacccaggauggagugcaguggcaccaucauggcucaccacggccucaacuugcugggaucaagcaauccuaccccagccacucaaguagcugagacuacaggugugcaccacuaagccucacuaauuuuuuuuuuuuucccagacagggguugcccagaacagagugcaguagcgugaucacaacucacugcagccuugaccuccggggcucaggcaaucuuccugccucacccucccaaagugcugggauuacagguguaagccacugugccuagcuuccuggauauauuuuaaagauaaaguauauacaagcaccccugugcacacacaggaauacuaaaagaauauacaccaauaaauugcuaaccauuucuggauaacacaaauuacaauuaacuuaucauuuuaaucauuuuaaguguacaguucaguggcauuauuuucacacuguuguguuaccauugccacuaucuaucuccagaacuuuuucaucaucccaaacugaaaucugcacucaucaaacaguaacuccccauuucccccuccccaagucccuaguaaccacuauucuaccuuccauccuaugaauuuaucuuuuuuuuuuuuuuaacugcuccuuguggagcaaggcuuaucuauaggcaauguacccagaguaaccaaauguaacuauucuagguaucucauauaaguggaagcauauaacauguguccuuugguguccgguuuauuucaguuaacacaaugucuucaagguucguccauggaugauuuuuguuuaucuguauuuucuaaguuuucuaugaugcacauauauaacuuuauaagaauaucaggcuuuucucaacuucaucuaaucugacuucagaaaguucauaaaaaaacaucauucacuuacuagcagcuaaaaggguauuuaagauuuaggugggaaaaagaagccacagcaggaugaaucgagggggucugaacagcuucauuuuaagaaugugccuacggcaggucagagaacauaagcaaacugucuaagaucacauagcccaguacagaacucucaccaauauuauugccagcaacugcuguguguguauucugcauagaacccugugcugggaauacaaagaaccaaccuaauuauuagaaguugucaauuuagugggagauaaauaaaugaaaaaaauaaacugagaugagccugaauuuuugcaugagaacuuggaaaauuuuggugccacuucuacaaauaaaaauuaggaggccaggccugguggcucacgccuguaaucucagcacuuugggaggcugagacggguggauuauuugaggucaggaguucgagacgagccuggccaacauggugaaacccucucucuacuaaaaaaauacaaaaaaaugagcugggugugguggcagucaccuguaaucccagcuacuuagaaggcugaagcacgaaaaucacuugauccugaaccugggagcugaagguugcagugagccaaaauugugccacugcauuccagccugggugacagagcaaaacuccaucucaaaaaaaaaaauuaggagaaagagccugguucuaugaugaagaugauauucauuuuuagacguugugauacagaauguuuuuucuagacuauucugccuuuaguacauaaacauuucauauuacauuaucaaauggucauauauaugguaaagcuuuuauuuauuucauaggugaccaaauuauuggccuugaccauuagguccagaaaguaaaauuguguacuuucuuuuuuuuuuuuuuugagauggaguuucacucuuguugcccaggcuggagagcagcagcaugaucucagcucacugcaaccuccgccuccuggguucaagugauucuccugcuuuagccucccaucuuucuuuuuuuuaaagaaaaaagaugauuuaugagcaauuaaaaaaaaaauaggccaggcgugguugcacacaccuguaaucccagcauuuugggaggcugaggugggaucacuugagcccaggauuuugagaccagccugggcaacauagugagauguugucucuaguaaaaacuuaaaaauuagcuggagguguuggugggcgccuguggucccagcuacucgggaagcugagguaggaggaucgcuugagcccaggaagucaaagcuacagugaaccaugacugcacuacuccauuccagccuggguaacagaguaagagacccugugucaaagaaaccaaaaagaaaaaaauaacuagauuuuaaaagggaaaaaaaaaaagaagaagagaaagaaguauccacaaaacagugaaaggcuagauggucucuauuaggaagagaacccuauagucuccaacuugguaccaagaauaaacaccaaaauugcgauugcuggcaauaauauuggugagaguucuguaccuggcuguguggccuuaggcaguuugcuuaccuucucugaccugcaguaggcauauucuuaaaauggagcuaugcagagucccuugaaucauccugcuguggcuccuuuuucucaccucucuugauacaguaagugccgucauguuuuugcuauaggggaaaugauguguuuuuguuuguuuguuuuugagauggagucucacuuugucacccaggcuggagugcagugguacaaucccagcucagugcaaccuccgccucccagguucaggcgauucuccugucucagccuccagaauagcugggauuacaaggcauuggccaccacgcccagcuaauuuuuguauuuuuaguagaugugggguuucaccauguuggccaggcuggucucaaacuucugaccugaggugauccacccaccuuggccucccaaagugcugggauuagcaaauggguuucgaagguuuagcuuauucauuaaaaucaguauuuaguaugcuacaaugagcuaggcaguguauguguaggcugugugugcgcgugugcgugugugugaaauaaaagguaguaugaguuccaucaaggugcuuacagucuaauuuaaggagacaaugaaccacaaacaauugugccauuaauucaaagagaugaugucagcaaaccuaagaaugugggauacauacuacugaaugcaaaggacaccacacacacgcaugugcacacacacacacgcuuuuuaccugagugguuaaaaugucacucugagaggauagcccugagcagucuucagagacgcuuguuucacucucacacccagaugcugcuucaccuuaaauaacaaaaacagagguucagauguaaaagcagacuauaaacgcugcaacuugcugugucuuuuucuucucauuggcaggacuggauuuacuuucaugucacacaaaaugauuaaauuccuugcuuugggacaccuggauuugcuuuuauaaaaugaaaccagaaguaaguccaccaguaauuaggauguuaaagcucauucagucaaagaugacguccuagcugugugaaggacuuuuuucuaugaaaagcaccuuaggaggaacauguuucaaguuuaagaagcaguuccuuuaacuauacuuggaaauuuguaaaaugugcuccccaaaagcauaaacauuuagcucacuucuauaaauagacuggggcaaacacaaaaaccugguuccaauaccuaaguuugaauccaugcuuugcucuucuugauuauuuucuuccaagcccguuccucuuucuucaucaucugaaaccaauuccuugucacucagaccaacucccuggcuuucagacugaugccucauuuguuuggaagaaccaaucaagaaaggauccuggguguuuguauuugcagucaagucuuccaauucacugcacugugaagaaaacaagcuagcagaacauuuuguuuccucacuaaggugauguuccugagaugccuuugccaauauuaccugguuacugcagucauuuaagcuauucuucaaugauaauaaauucuccucuguguucuuagacagacacucgguagcaacggugcuaugccuaguagacugagaagguauauuguuuacuuuaccaaauaacaaguguuggaagcagggaagcucuucauccucacuagauaaguucucuucugaggacucuaauuucuuggccccucuucgguaacccugagccaaauguguaugggugaaagggcuaggacuccugcuaagcucuccuuucuggacgcuuuugcuaaaaacagcagaacuuuccuuaaugucauuuucagcaaaacuaguaucuuccuuuauuucaccaucaucuaacaggucaucaggugucucagaacaaaccugagaugcaugacuacuucccauaggcuguucuaaguuaucugaaaucagauauggagagaaaucuguauuaacagucugaacuacuucuucauauucuugcuuuuuuauuucaggaugcuuacaauuacuuccaggaagacuuuguuuauagaccucagguugcaaaaccccuaaucuaagcauagcauucaauuuuggcccucuguuucuaccuaguucugcuugaauguuuucaucacuggaaccuauuucauuaauacuggagcccacuucauuaguacuggaaccuacuucauuaauauugcuugagcuggcuucuuuaaaaacauuuucucuaauguuauuacggcuaauugugcucacuguacuuggaauguucucauuucccauuucucuuucaggugacauugaauguuccucaaaguuuuccucuagcagauuuuucuuacauuuaguuuuaacaaaugacuugaugggaaaaaguggugguauacgauauggguuuuguaaaaguccauguuuauuuggaguaaugaguccaguuucguugccucugaacugagaugauagacaaaaccuagagccuccuuugauacuacauuuggcauuaucaacuggcuuaucuuucugaccaaccacaggaaagccugcagugauauuaacugucuguacaggcuugauauuagacucauucuuuccuugauuuucuuccuuuuguucacauucaaaagugacuuuuggacuuuguuucuuuaaggacccagagugggcagagaauguugcacauuccucuucugcauuuccuggauuugaaaacggagcaaaugacuggcgcuuugaaaccuugaauguauucugcaaauacugagcaucaaguucacuuucuuccauuucuaugcuuguuucccgacugugguuaacuucaugucccaauggauacuuaaagccuucugugucauuucuauuaucuuuggaacaaccaugaauuagucccuugggguuuucaaaugcugcacacugacucacacauuuauuugguucuguuuuugccuucccuagagugcuaacuuccaguaacgagauacuuuccugagugccauaaucaguaccagguaccaaugaaauacugcuacucucuacagaucuuucaguuugcaaaacccuuucuccacuuaacaugagaucuuuggggucuucagcauuauuagacacuuuaacuguuucuaguuucucuucuuuuucuucucuuggaaggcuaggauugacaaauucuuuaaguucacugguauuugaacacuuaguaaaagaaccaggugcauuuguuaacuucagcucugggaaaguaucgcugucaugucuuuuacuugucuguucauuuggcuuguuacucuucuuggcuccaguugcagguucuuuaccuuccaugaguuguagguuucugcugugccugacuggcauuugguuguacuuuuuuuucuuuaucucuucacugcuagaacaacuaucaauuugcaauucaguacaauuaggugggcuuagauuucuacugacuacuaguucaagcgcaugaauaugccugguagaagacuuccuccucagccuauucuuuuuaggugcuuuugaauuguggauauuuaauucgaguuccauauugcuuauacugcugcuuauagguucagcuuucguuuugaaagcagauucuuuuucgagugauucuauuggguuaggauuuuucucauucugaauagaaucaccuuuuguuuuauucucaugaccacuauuaguaauauucaucacuugaccauucugcuccguuugguuaguucccugauuuaucauuucaggagucuuuugaacugccaaaucugcuuucuugauaaaauccucaggaugaaggccugauguaggucuccuuuuacgcuuuaauuuauuugugaggggacgcucuuguauuaucuguggcucaguaacaaaugcuccuauaauuagauuuucaguuacauggcuuaaguuggggaggcuugccuucuuccgauagguuuucccaaauauuuugucuucaauauuacucucuacugauuuggagugaacucuuucacuuuuacauauuaaagccucaugaggaucacuggccaguaagucuauuuucucugaagaaccagaauauucaucuaccucauuuagaacguccaauacaucagcuacuuuggcauuugauucagacuccccaucaugugagucaucagaaccuaacaguucaucacuucuggaaaaccacucauuaacuuucugaaugcugcuauuuaguguuauccaaggaacaucuucaguaucucuaggauucucugagcauggcaguuucugcuuauuccauucuuuucucucacacaggggaucagcauucagaucuaccuuuuuuucugugcugggaguccgccuaucauuacauguuuccuuacuuccagcccaucuguuauguuggcuccuugcuaagccaggcuguuugcuuuuauuacagaauucagccuuuucuacauucauucugucuuuagugaguaauaaacugcuguucucaugcuguaaugagcuggcaugaguauuugugccacauggcuccacaugcaaguuugaaacagaacuacccugauacuuuucuggaugccucucagcugcacgcuucucagugguguucaaaucauuauuacuggguugaugauguucaguauuuguuacauccgucucagaaaauucacaagcagcugaaaauauacaaaaauaacaagguacucaaaaacugaauugucauuaaaaaaauacauacuucauacaccuuggagguggaaaucaaccaacuggcuauauuagagaaacuaaccucauaaacuaccaaguauacugaagauguagcucauacucuuucauuuaauuccuauuuaccuagauuauuuccacuuaggauccauuaaauuuuuaauuucagaauuuucccuaugcagaaaccacaccuauuucucuaacgucuaagagugaauuaaaagcagauuggccaucagaaaacugguucugauguacucuaaagauuacuggccauuaagucuacuuaauacucuguucuaucuacagacuuaccacucccuauauuuaaaaaccaguagguaaaagaugaaacacaaauacaccaauuaaaaguaaagggcaggccaggcacaguggcucaagccuguaacugcagcacuuugggaggcugaagugggcagacugcuugaguccaggaguuugagaccagccucgguaacauggugaaaccccaucucuauaaaaccacaaaaaauuaaccgggugugguggcaugcgccuguagucccagcuacucaggaggcugaagugggaggauagcuugagccuuggagguggagguugcagugagccaagauugcaucacugcacuccagccugggcaacagagugagaccccaucucaaaaaaaaacaaacaaacaaacaaaaaaaaaaacgaaagggcaacaaucaguuacagaaggucuuauuauagguacauuagucuaguaccauuuaaaucuaucagaccauaccacgacauuugacagagaaugauacucuaacucugccaagagauuuuguggguuguaaaggucccaaauggucuucagaauaaucuaauuacaguacuguaucuacccacucucuuuucagugccuguuaaguuggcaaacuuugccauuacccuuuuuugcagaauccaaacugauuucaucccugguuccuugaggggugauuuguaacaauucuugaucucccacacuauagggaaaagacagaguccuaauaagaaacacuaguuacauguaugcagaacugucaaaugaccaagaucaaacauuuuagcucuuucgauuacagaaagcugaccaaucuuauuuaguuagugaaagcugcucucuccuuuagaaacuucuaguugaaaugaaaugguugcugggcacgguggcucaagccuguaauuccagcacuuugggaggcugaggcggguggaccacuugaggucaugaguucaagaccagccuggccaacauggugaaaccccaucucuacuaaaaauacaaaaauuagccgggugugguggcgcgcgccuguagucccagcuacuagagaggcugaggcaggaguauggcuucaaccugggaggcagacguugcggagaggugagaucacaccucuguacuccagccugggcaacagagcaagacucugucucaaaaaaaaaaaaaaaaaagagagaaagaaagaaauggaauggucaauuaaccgggcguggugguguauaccuguagucccagcuacucgugagauugagacaggagaaucgcuugaaccagggaguuggagauugcagugagccgagauggcgccacuacacuccauccuggcaacagggcaagaccccgucuccaaaaaaaaaaaaaaaaaaaccugggucaagcaauaauuccuaaggaagguagguaacauaguugggguugcuuguaguuuauuauauaacauacagacaaagcuugagagauauguggaaauaaggaacagaggaaagaaagaguugaaaaugaaguccuugaacauuuucaucagucacaauuacugcugugucaauauuacuguauaugaggaacuuagagaacaaucugcuagaagcaagcaugugcagaguucuacuguuauccuaaauuccuuuggacagugcuaauaacuaaauccaacaaacaaaaaggguauuuccuccacuauaaaaugagagaacuaaacuagaugaucucuaagguuucuuccaauaccaugauucuagucuggagaaacaccagccuacuugagggaggaaggugggaagagggagaaauucagaaagaaagcaaacaaaaaacugugggguaugcuuaguacccggaugaugaaaaaaaucuauacaccaaaucccaagucguguguuuaccuauauaacaaacugcacauacaucccugaaccuaaaauaaaaguuaaaauauuuuuaaaaagagagaaacaucaauccuuaauauuaacuaaauaggaaaauaccagcuucauagacaaagguucucuuugacucaccugcaauaaguugccuuauuaacgguaucuucagaagaaucagauccuaaaaaauuuccccccaaaaaauaaaucaauaaaaguuuucuuaauuaaaaggguuaaaaaaauguacuuguugaaaaacagauauucaacuagaaauauuuacugagcaucuacuguggcagguacaaugcuaguuaagcuaguauguaauacagagaagugguuaaaggcaugggcuucgccaggcacaguggcucucaccuguaaucccagcacuugaggaggccgagauggguggauuauuugagguuaggaguucaagaccagccuggccaacaaagugagacccccguuucuacugaaaacaaaaacaaaaacaaaaaaaaagcacaggcucugacaucuaacuuccuagguuugaaucauggcucagccacuuacuagguuuaauaccuuggaaaaauuucauaacuucucugugccuuaauuuucucaucuguaaaauaaguauaauaggaacaaucucagaggucugacaagcaucuaaugaguuauacaagaaaagcacaauagugccuggaauauaguuaagugcuccuaaauaucaacuacuauaacuauuuuuacaaugccuguugucuaggaauuuaugaucauaaggggggaaaacaguaaguguuaugauaaauagaugguggugccugggagcucaaaagauggcuauccuuuuuaauuauaaauauauucuaaaagaaaauccaauuugagagcccaguuugaauucugagcucagcagcucuuuuuuuuuuuuuuuuggaggucuugcucugucacccagguuggagugcaguggcaugaucauagcucacuacagccucaaacuccuggguucaauguauccacucaccucugccuccugaguagcugggacuacagaugcacaccaccacacccagcuaauuuaaaaaagaaauuuuuuuguagagaugaggucuugcuauguugcccaggcuggucucaaacuccuggcuucaagcaauccucugccacugcugagauuacagaugugagcuacuaugcuggccucaacuuuucuuuuuauaagcuuaaaaaaauuuauuauuuuuaaaaauuauuauuuuuuugagaugcagucucacucuauugcccaggcuggagugcagugguguaguguuggcucauuguaaccuccgccucccugguucaagcgauucuccugccucagccucccaaguagcugggauuacaagcaugugcuaccacacccagcuaauuuuuuuuuuuuuuuguauuuuuaguaaagagggguuucaccagguuauccaggcuggucucgaacucugaccucaggugaucuaccugccucagccucccaaaguauugggauuacaggcaugagccaccgcaccggccaaaaauguauuauuauuuuaaaaauagagacaggguuccccuauguuggccaggcuggucuuaaacucguggacucaaccaauccuucugccucggucuuccaaagcguuaggauuacaggcacgagccauccugcccagccaagauucagcucuuuuuuuuuuuuuuugagauggaguuucacucuuguugccuaggcuggagugcaauggugcgaucuuggcucacugcaaccucugcuuccuggguucaagcgauucuccugccucagccuccugaguagcugggauuacaggcauaagccaccaccccggcuaauuuuuuuuuuuuuuuuuuuaguagagaugggguuucuccauguuggucaggcuggucuugaacucccgaccucaggugauccgcccaccucggccucccaaagugcugggauuacaggcgugagccacugcgccuggcaauucagcucuucuuaaaaggcuuccucaucuaguacaauuuaucuuggaacuaaauacuguagcaauccaucauguuuuuucuuauugcuacucuccaucuuuccaaaacauauuuacacauauuuaaaaccagauauucuuucuuuugcucucuuuuuuuuuuuuagauggaguuucgcuauuuuugcccaggcuggagugcaauggugcgaucucgguucaccgcaaccuccaccucccggguucaagugauucuccugccucagccucccgaguagcugggauuacaguuaugugccaccacaccuggcuaauuuuuuauuuuuugguacagacagaguuucuccauguuggcuaggcuggucucgaacucccgaccucaggugauccacccacuuuggccucccaaagugcugggauuacaggugugagccaccaugccuggccucuuuugcucccuuuuuaaaguaagauucuucaaggugggaacugcgucuuuuacauuuuuuauaacucaccauagggcucauaaaauucacuucccaaagcugccuaccacaaauacaaauuaugaccaagauuuuuggcaaaacuauaagauaaggaauccagcaauuauuauuaaauacuuaaaaaaccugagacccuuacccaauucaauguagacagacgucuuuugagguuguauccgcugcuuuguccucagaguucucacaguuccaagguuagagaguuggacacugagacugguuuccugcuaaacaguaugguaaagaacagucaagcaauuguuggccaguucugugcuuuuccuccugaagagaaacuugacaccauggacaaaauaaauugaccaucaucagucagcuaacauguaugaugccuggaaaaaaugcccaggaauuuacacacuaaaaugucuggggcugggagcgguagcucaugccuauaaucccagcacuuugggaggcuggagcaggacugcuugaggccaggaguucaagaccagcauaagcaacagagugagacccagucucuacaaaauaauaguaguaguaauaauaaaaugugugggauaugugugauuugaauuuuuuuuucuguugucuuaaauuuuucaaaccugauuauguauuauuuguguaauuuuugaaguauuaauauagcauauuuugaagcugauacuugauauacauuccaaucacaucugauaacuuuuuuuuuuguuuugggggguguacagaguccugcucugucacccaggcuggagugcaguggcgcaaucucagcucacugcaaccuccgccuccuaaguucaagagauucuccugccucagccuccugaguagcugggucuacaagcgugugcaacuaugccuggcuaauuuguguguguguguguauauauauauacauauauauguguguguguguguauauauauauauaacauauauauaacauauauauauuauauauauauaacauauauauaacauauauauauguuauauauauauaacauauauauaacauauauauauauauauauauaauauauauauauauauauauauauguaaucccagcacuuugggauauauguguauauauguuuuuuuuuuuugagacagaaucuugcucuguugccaggcuagagugcaguggcgugaucucggcacacugcaaccuccaccucccugguucaguugauucuccugccucagccucccgaguagcugggacuacaggcguacaccaccacgccuaguuaauuuuuguauuuuuaguagagacagguuucgccauguuggccaggcuggucucacacuccugaccucaggugaucugccugccucggccucccaaagugcugggauuacagccaugagccaccgugccuggccaauaacauuuuuaaaaaggauaaaugaugacaauaaaaccccagcacuccuaagaacauuuaguauaggaacgaguauuuaaaagcccaacauuacuuuuuuuuuccuuccuuuuuagcucuauaucuuuugaaaaaugaaugcugguacugugagaacuacuuuuauuuuauuuguauuuuuuuagacagagucuuguucuguugcccaggcuggagcgugguggcgugaucucgguucacugcaaccucugucuccuggguucaagugauccucccaccucagccucccaaggagcugggacuacaugcgcacgccaccaugccuggcuaauuuuuguauuuuuuguagcgaugggguuucaccacauugccuaggcuggucuugaacucuaggacucgagauccacccgccuuggccucccaaagugcugggauuacaggcaagagccacugcgcccagcuagaacaauuacuuuuuuuucuuuuuugagacagagucucacucuacggcccaggcuggagugcaguggcgcgaucuuggcucgcugcaaccuccgcguccuagguucaagcaauucuugugccuccgccucccgaguagcugggauuacagguacgugccaccacacccagcuaauuuuuguauuuuuaguagagauggguuucaccauguuggccaggcuggucucaaacuccugaccucaaauuaucugccugccucagccucccgaagugcugggauuacaggugcaagcuacuacgcccagccccagaaugauuacuuuuuaagaucuccaucauucaugcacauauaaguaacaacagagcaaaucacuacauuuucuuuaacaauuacaccuuuuaaguucaaguaauuuucccuuuuuuuaaaagauagggucucagucaccugcgcuggaguccaguggcacagucauagcucaacugcagccuugacucucuauguuaaagcaaugcuccagccucagccucccaaguagcuaggaccacaggugcauaccaccacgcccagcuaaguuuuuuuguuuuuuuuuugagacagagucucacucugucgcccaggcuggaucgcaguggcgggaucucggcucacugcaagcuccaccucccggguucaugcuauucuccugccucagccucccgaguagcugggacuacaggaguccgccaucacgcucagcuaauuuuucuguguuuuuaguagagacgggcuuucaccaugugagccaggauagucuugaucuccacaccucgugauccacuugacucggccucccaaagugcugggauuacaggcgugaagcuuuuuuuuuuuuuuuuuugagacggagucucgcucugucgccaggcuggagugcaguggcgcaaucucggcucacugcaaccuccgacucucagguucaagugauucuccauccucagccucuggaguagcugggauuacaggcacgugccaccacacccagcuaauuuuuguauuuuuaguagagaccggguuucaccauguuggccaggguggucucaaucuccugaccucaugauccacuggccucagccucccaaggugcugggauugcagguguuagccgccgcacccagccaguucuuuuuuuuuuugcaacuagaucuugcuuugccgcccacgcugaagugcaguggagugaucauagcucacuguagucuacaucuccuggacucaagugauccuucugucucagcuucccaaguagcugggacuacaggcacacaccaccaugcccagauaauuuaaaaaaacuuuuaauauagacaaggacuugcuauguugcccaaacuggucuugaacuccugagcucaggcaauccucaagccuccuagugcuggaauuacaggcgugagccacggcacccagcuacuuuuuuuuuuuuuuaauugcagagacagugucucacuguguugcccaagcugggcucaaaggaccuccuaccucagccucccaaaggguugggauuauaggcaugagccauggcacccagcugaaguaauuuccaaaugcuuaaaaauaucagugaccuuauggcuauuuuagauaagcaucacagagcagauaaagcuccaaagcaaggaagggccuauaagagcucucuuuuuuggccgggcuugguggcucacgccuguaaucccagcacucugggaggccaaggaggguggaucaccugaggucaggaguucgagaccagccugaccaauauggugaaaccccgacucuacuaaaauuacaaaaauuagccaggucuggugucguaccccuguagucccaacuacucaggaggcugaggcaggagaaucacuugaaccugggaggcggagguugcagugagcugacaucgugucacugcgcuccagccugggcgacagagcgagacucugucucaaaaaaaaaaaaaaaaaagaaaucugucuuuuugguguaucugauggggaucuugcuauguugccugggcuggucucaaaccuggacucaagugauccucccauuucagccuccuaaguagcugggauuauagguacauucaccucaccuggcuguaaggucucucucuugauuauaucagguacccugaccuucucugaacucuaacugauuagaacacuugucuaaccacuuaauauaccaucuuuccuucuucacuaacuuuuuauauaaaucuaugagcaucuagcacauucacuaacauauucacaaugcucaauaaagagauguugccagaauaaaugaaaaugguuuuaccggccgggcacaguggcucacaccuguaaucccagcaauuuggggagccgagguggguggaucaccugagguuaggaguucgagaccagccuggccaacaugaugaaaccccgucucuacuaaaaauacaaaaauuagccuggcaugguggcgcgugccuguaaucccagcuacuaagggggcuaaggcaggaggacugcuucuagccugggccacagagcaagacuccaucucaaaaaaaaaaaagaaaaaaaaaagaaaagaagaagaagaagaagaagaaaacaaaugguuuuaccaaggaaggauuuucggguucacucuguagaagucuuuuggcacgguuucuguagcccauacuuuggaugauagaaacuucaucuuuuagauguucaggagaguuauuuuccuuuuuugcaaaauuauagcuguuugcaucuguaaaauacaagggaaaacauuauguuugcaguuagagaaaaauguaugaauuauaaucaaagaaaccaagagaaacccuauguaugcucuuuguuguguuaagacaaugcauuaagguuaccugugauuuuuuuuaaaaaucaaauuuuaaaaaaucaacuggaaauuuuacuccuaggaaacaaaaacaaauacacagaccaucaaaguuauuuagaguccuuguuuucuaccuuaacacuaagaaauuugccuaucaauacuguauuucacuaaagcuaagacaccaacaauguaaguugcacuauuauuuucuguaucacuaagaaagaaagcacacaaauuaaacaaaugacacacccucaauaguaaaauguucccaauuucagagauguuaagaugugaaaaaugugcaccuuacgauugauaaaauaaggugugagaccagugggaguaauuuuuuaaaaauagauuacagauacagaacuaaaauuaaccuagacuaaaaggucuuaucaccacgucauagaaaguaauugugcaaacuuccugaguuuucauggacagcacuugagugucauucuugggauauucaacacuuacacuccaaaccugugucaagcugaaaagcacaaaugauuuucaauagcucuucaacaaguugacuaaaucucguacuuucuuguaggcuccugaaauuaaauuguuugagaaacacacucagcaagugauuaucaaccuuuuaaggacacuaaaauaagaaaagacauguaaacaaauaaaaauaagaugcagcaacaguagaaaaccucuauaaucaauacaucauugacaucuguauaaaccgugugauggcagugauuuaguaacuuuuugucauucauuuaagccuaccaaaugccuaaaauuaucugauauaauacugcccuaaauccacagcagauauaaugcauugcauagaaaacuagaguacuuuuuuuuuuguuuaauuuagagacagggucuugcucuauugcccaggcuagcaugcagugccacaaucauagcucacugcagccucagacuucuguacucaagcuauccucccacuauagccucccaaguagcuaggacuaugggcauaugccaccauguacauuuauuuauuuauuuuguugguagugauggggucucacuauguugcccaggcugauuucaaacuccuggccucaagcaaucaucccaccucagccuccuagagugcuaggguuauaggcaugagcaaucacacccugcugagcuuacuguucuuaacaucugaacccugcccaaucccucacuuaguucugccucucaaggauuucugucaaauuaugauuauacuucuuugaaaacacauagauaacaauguccaaagggagauuuggguuuaguaaaguggaauuaaagcacaauucauucauuccuuuaagcaucugagugccuacuauguaccaaacuuaggaaaaacaguguugagacagacaaaauuacuacucucauagaauuuacauuguagcagaagagauacacaauauauaaauacauuguguuuguguaaauaauuagauagaaauaaacacacaccugugaaccccagcacuuugggaggccgaggugggcagaucaccugagcucaggaguuaccagccugggcaacaugguaaaaccucaucucuacaaaaaauacaaaaauuggccgggcaugguagcgugugccuguagucccagcuauuugggaggcuaaggcaggaagaggcugggagacagaggcuacagugagccgagaucacgccacugcacuccagccucagugacagagcaggacccugucuuaaaaaaaaaaaaaaaaagaaaaggaaacacaaucaaaaauauaaaaacaagauuaacagacaaugggggcacggcgauacagcccuacuuuacauaagucugcaaguuuuuacacuagaagcauuagagaaaggcaguaaguuucuaauaccuguauaaggcagaugucccauaaaacuuucaggaaaauaacuuuggaaauaauuuacugugugcuaaaaacucuuuuauaaauuuuucugaugaaugguuuuauaggaacgcuauguuauuaaauaauuucuacuuuuuccuacugugguugcuuccaaccuagcaucauuaccaaauuauauaccuuuugguuauaucauucuuacauaaaggacacugugaaggcccuuucuucugguugagaaguuucagcaugcaaaaucuauaaauuauaaagaaagaaagaacaauuuaauuuacuuccuuuuguagaaagaauacucaaaaggcaaauagccaugaaaagauaaucucacaacugcccuuaagagccauuuaaaaaguaauggcaggugaauuacaagcaauaguuuccuaauuguuuuuggaugcugcauaagcaaaaaccuaaacuacauaagcaaugaucuaugaaaacugaacuuacaugcauauggcuuacuguuaugaucacauaaaacuuaauaaaaguuaauauggcauauuuaaugauauauucauaauuauuucaugcugcauaaucaaauauaaacgguaaguaguucauguaagaugcuuauaauuaguuuaaaaucucaacaccucaccacaaagcuauaguaaucaagaaagugugguaauagcauaagaauagacacauacaucaauaaaauggaauugacaguacagaaauaaacucauacauacaucugugaucaagcgauuuucaacaauaauaaauaccaagacaauuuuuuuuuuuuuuuuuuuugagacggagucucgcucugucucccaggcuggagugcaguggcacgaucucggcucacugcaagcuccaccuccuggguucacgccauucuccugccucagccucccgagcagcugggacuacaggcgcccagcaccaugcccggcuaauuuuuuuauuuuuaguagagacgggguuucaccauguuagccaggauggucuccaucuccugaccucgugaucugcccgccucugccucccaaagugcugggauuacaggugugagccaccaugccuggccgacgauuuuuauuuucuuaauuuuuuuuuuuuuuuuuugagacagacucacucuaucacccaggcuggaggguagugacacaaucucagcucacuacaaccuccaccuccuaggcucaagcaauucucgugccucagccucccgaguagcugggauuacagacaugcaccaccauacccagcuaauuuuuuguauuuuuaguuucaccauguuggcuagucuugaacuccuggccucaaauugauccaucugccuuggccuuccagagugcugggauuacaggcaugagccaccgugcccaggccaaagaugauuaaaugggaaaauaauacuuuuuguguuuuuaacaaacaguguugagacaaaaguauaaccacauguaaaagaaugaaauuauacuccuaucucacaccaaauaacaaaaguuaacucaaaguggaucauagaccagaaguagagagagcaauggugaugauaauuaaaagcagcgauucacucauacaaccaauauuuacuaugucuaguacuauucuagauggaggggauucaauagaaaagcaaaauaagauccugcaaaauaaaacauaaaggacauaauauacuggugaagggggugacuagguagggaguaaauagcagacacugacaaugaagagacccaggaaagaaaagauuaaggggcuaaaaaaaaagucacuagggcugugcacggugguccacaccuguaaucccagcacuugcggggugggugaaucacuugaggccaggaguucaagaccagccuggccaacauggugaaacccugucucuacuaaauauucaaaaauuagcuggguguggugguggugcacuguagucccaguuacucgggaggcugaggcaugagaauaaguugaaccugugaggcggggguuacagugagccaauauugcaccauugcauuccagccugggcaacagagugagauugugccaaaaaaaaaaaaaaggcauugggaauugugagaaaagacacuuagagaauauuuuuuacuagccagguaauuuaacauuuauuacccucucuuggccgggugcaguggcucaugucugcaaucccaggaggcugaggcaggcagaucacuugaggccuggaguuugagaccagccuggcuaacauggugaaacccugucucuacuaaaaauacaacaaaauuagccaggcguggugggcacacgccugagucccagcuacuugggaggcugaggcaugagaaucacuggaacccaggauggcagagguugcaaugagcugagaagagugccacugcacuccacccugggcaacagaggaagacucugucucaaaaaaaaaaaaaaaaaaaaaaaaaaggccaggagcgguggcucacgccuguaaucccaacacuuugggagaggucaggaguucaagaccagccugaccaacacggagaaacccugucucuacuaaaaauacaaaaauuagccgggcaugguggcauaugccuguaauccuggcuacucaggaggcugaggcaggagaaucucuugaacccgggaggcggagguugcaguaaacugagaucgcgccauugcacuccagccugggcaacaagagcgaaacuccaucucaaaaacaaaacaaaacaaaacaaaaaaaccccaacuauaucuauaucucuaucuaucuaccuaccuaucuaucugucuacagucuugaacucccgaccucaagugaucgccugcuucagccucccaaagugcugggauuacaggugugagccauugcgcugggcuacuuucuaucuuuauuuuuguacagaugugguuucacuauauugcccagucuggucucgaacuccugaccucaagugauccuccugccuuggcaucccaacgugcugggauuacaggcaugagccaucaagccuggccuuaucuucauuuuuauagaguagaggcuugucccagaucacacaguaauuaagcaaugaagguuauauuggauccagaauuggauuguagcaaagcccacaaucuuccuuuuuucuuuuuugacauggaaacuaagucuggagagaggcacccacaaucuuccuaccagagaaagugaauguagguagguaaggucaaggagacuuggguccuucuucgccgauauagaugcuucaaguaccauauugcacucaacaaaacaaugacucuauaguuuggaagaugaggcugucaaaaagcuaccuccacuguacauaaguaccuuuaaaacucagaauagaggcucccacuccuucagaaucuacaaauacuacauauacucuaguauaauggaucaagaaggcaucaagcauuacuccagcaaauaguacaauugaacaauucagagcagggguagggaggaaauucccuuaugauaguacugcagaauauaguacaguagagugacaagcuaagcugucucgugcuguagucuauacaauuauauaaauaauucaguggaacuagauacgcaaaaaucaaccaagauaaggauucgaaucuuuuuuuuuuuuuuuagacggagucucgcucugucucucaggcuggagugcaguggcacaaucucugcucacugcaagcucugccuccuggguucacgccauucuccugccucagccuccugaguagcugggacuacaggugcccgcuaccacgccuggcuaacuuuuuguaauuuuaguagaggcgggguuucaccauguuagccaggauggucucgaucuccugaccucgugaugugcccaucucagccucccaaagugcugggauuacaggcgugagccaccgcacccggccucgaaucuuucuuuaugcuagaaaaagaauacauguauaaagguuguuaacuaaacuuaaaagaaaaugaacuuguauaugacuugaaaagacagagcuaacuaaaauacuggccaggcaugaugacucacaccuguaauccuagcacuuugggaugccuaggugggcagacggguuaagcccaaaguucaagaccagccugggaaacauggcgaaaccccgucucuacagaaaacacaaaauuuagcuggauaugguggugugcacuuacagucccagcuacuugggagacugaggugauaggaucgcuugagccuaggaggucaaggcaacaguaagccucaugaucgcaccacuguacuccagcugggacaacagaguaagacccugucucaaaaaaaaaaaaaaaaaguagcuguugaaaaauuuaaguuacauuuauugcucacauucuaucucuuugaacaaugugguucuagaucuucaaaaaaguauuacaggcugggugcgguggcucaugccuauaaucccaccauuuugggagguggaggugggcggaucacuugaggucagcucaagaccagcuuggucaacauggugaaacauggucucuacuaaaauaaaaggcugggcgugguggcuaaugccuguaaucucagcacuuugggaggcugaggugggcggaucaccugaggucaggaguucgagaucagccuugucaacauggugaaacccugucucuacuaaaaauacaaaaauuagccaugcaugguggugcacgccuguaaucccagcuacuugggaggcugaggcaggagaaucacuugaaccagagaggcagaggcugcagugagccgagauuguaccacugcacuccagccugggcaacagaacaagacuccaucucaaaaaaaaaaaaaaaaguauuacacauugcauuuuuuuguuuggaaaguucaaacuaaugcaugacugccuuaagaaauauuuucuagauugguauuauuaucuuuuuuuauaggcuucauaaaagauuucagaacuggcugggcaagguggcucaugccuguaauccuggcacugugggaggccaaggcgagcagaucaccugaggucaggaguuuuggaccagccuggccaacauagugaaaccccgucucuacuaaaaauacaaaaauuagccaggugugguggcacaugccuguagucccagcuacucgggaggcugaggcaggagauuugcuugaacccaggagauggagguggcagugagcugagaucaugccacugcacuccagucugggcaacacagugagacuccgucucaaaacaaaacaaaaaaaaacagccgggcgugguggcucacacuuguaaucccagaacuuagggaggccaaggcgggcagaucacgaggucaggagaucgagaccauccuggcuaacacggugaaacccuuucucuacuaaaaauacaaaaaaauuagcugggcgugguggcaggcgucuguagucccagcuacuugggaggcugaggcaggagaauggugugaacccgggagguggagcuugcagugagccgagacugcaccaccgcacuccagccugggcgacagagcgagacuccgucucaaaacaaaacaaacaaaaacaaacaaacaaacaaacaaaaauaaaaaaaagauuucagaacuuuaggcuugcuugggucaauaaaguuguuuuauuuuuagcaauuagaguuuauccguagaaaauacaauuaauacaacaaaagcauggggguaucgcucccaggcucccagcuuucucaucauauagaucaaaguguuauucagauuauauugauauuacagaagagauuucaugaaaaagucgaucuaucacaugggcauuauacuggacuuuuuuuuuuuuugagacggaaucuugcucugucgcccaggcuagaguacaguggcacgaucucaacucacugcagccucugccuccuggguucaagagguuccucugccucagccuccugaguagcugggacuacaggcaugugcccccauacccagcuaauuuuuguauuuuuaguagagaugguguuaccauauuggccaggcuggucucgaacuccugaccucgugauccgcccaccucagccucccaaagugcugggauuacaggcgugagccaccacacccggcuuuggacuuuuaauucuaauauaacauucaaaacacaauuuaaaauauggcuggcccaucucuacaagaaacuuaaaaauuagcugggcaaaugccauguaccuguaguccuagcuacuugaggggcugagaugagagauugcuugaacccagauugcaagguaaaagugaacuaugaucacaccacugaacuccagccugggugucagagggagacacugucucaaagaaacaaacaaaaauauauaugugucacacacacacauauauauaacauauuuauauguauacacacacauauaucuuuaugacugguucuuuccugacuaucacaauccugacuaucacaagcuugaaaccaagcuucucacucuucuccaguugccaacucuaauccucucaaucucaacagcuguuuuuuguuguuuuuuuuuuuugagacaguuuucacucuugucgcccaggcuggagugcaauggcgcaaucucggcucacugcaaccuccgccucccagguucaagugauucuccugccucagccucccaaguaacugggauuacaggcaugcgccuccacgcccgucuaauuuuguauuuuuaguagagaugggguuucucuauguuggucaggcuggucuugagcuccugaccucaggugauccaccugccuugggcuccaaaagugcuaggauuagaggcgugagccaccgugcccggccucaacagcugucuuuaccuccaacuucacugggcucaaagcaccucagcaucuuccuguagaauuacucuccuuuuccuucauuacuguuuaugaguaauaaucaacucuuucuuacauccuuuuucuauuuccaaucccuucugccuccucuuggaccuucucuuucuugcaaauggcuucccaucuuugagggcuucuuccuuuucuaacacaacuccuauacacauaugcaaaguuagcuuauuuuuccuggauguauuuucuuuucuuuucuuuuuuuucagacagagucucacucuguugucaggcuggagugcauuggcaugaucucggcucagggcaaccucugccucccagguucaagugauaccccugccgcagccuaccaaguagcugggacuacagguacgugccaccaugccaggcuaguuuuuuguguguuuuaguagagacaguguuucgccauuuuggccaggauggucuuaauuuccugaccucgugauccgcccaccucgaccucccaaagugcugguauuauaggcgugagccaccgcgcccguccucuauuuucuuuuauuuguacauuugcucguauuauuaucucugccuauaagccuauaauuuccuucuuccacaaguucucaaagcaacuauauucauaacuuaaucucucuuuuuuuguuaagagacagggucagccaggcgcgguggcuuacaccuguaaucccaacacuuuuuaaggccaagguagcugaagucaggaguuugagagcagccuggccaacauggugaaaacccugucucgacuaaaaauacaaaaauuagcugggugugguggcagaugccuguaaucccagcuacucaagaggcugaggcaggagaaucgcuugaacccaggagguggagguugcagugagccgagaucacaccacugcacuccagccugggcaauagagugaaacaccaucucaaaaaaaaaaaaagacagggucucacucugucaucuaggcuggagugcaguggugugaucauagcucacuacagcuucgaacuccuggccuuaagugaucuuccugccuuggccucccaaagugcugggguuaugggcaggagcuaccacacugggcccuugagucccuguaauaauaguauaguauguucagcauuuguuacucaagcugacaagaaaacauacaguucauuccagaaagauucucauccagauaaauugaaagccccagggcuuuaaagguuaaucuuuagcucucuguaguaaauacugggacuuuuuuuuuuuuuuuugagucucccucuugucgcccaggcuggaaugcaguggcaugaucuuagcucacucagaugaaaauuauggacuaucuucccagaaaaauguacauggccauaguuuugaauacaauuuaaauauaauucuaggaaauucauaaagacuauucauaaaccccaaguuaagaacucuggaauuuaaaaauuccucaaaggauacauaagaaauugaucauugugguugucuggggagggaacagggaggcagggguuguaggguaagagggaaguauacuuugcaucauauaccuuuuugugcuaauaaacuuuuuaccaaguacauaguuuguaccugguaccagguuauguaccagguacauaaauacuuaaaaacaaauuaguugacauuuaagguaagaugugagccauagcuuaacauaaagaaaaggagaaagcccacuuguucuacuaaauuaccuacucuacuuuuucugaaauucuuuuauuaagaaacaaacauuuucauuucaaaagacaagaucaucaaauacguaaauauaacuugaaucacugcuauaaaugaauuuuggccuaaauagaaacugguaucagguccuuuccugucuucacaaugauuacaaagcgggcaaacacugacccuuagaagggggaaugcauaaggauaugcagaaaugaacagaaaggagaaacugggaaggcucaaacacaaugugcuuauuucaaaacugcuugcaguuugcuuucacugauggacacaaaaaauacaaaacacuguucaaaaugauguuacauccuaauagauaauauaugucagucgggugugguggcucacgccuguaaucccagaacuuugggaggccgaggcagguggaucacaaggucaggaguucgagaccagccuggccaauauggugaaaccuuaucucuacuaaaaguacaaaaauuagccaagcaugguggcgggugccuguagucccagcuaccugggaggcugagguagaagaaucgcuugaacucggggggcggagguugcagugagccaagaucaugccacugcacuccagccugggcgacagagcgagacuuugucucaaaaaaaaaaaaaaagauaauauaugucaaaacuuuaccaggaacuaugauuacaaccaacuuuugauaacuauauacucucugagaaagaaugaaauggaguuggauuuuucguucucacuuaauugaagaaaguaaagcuucuauaaaguuagguguuuccuggguuaugaaggacaaaaacaaaagcuaauaauggagccacauaacacauucaaacuuacuugcaaaauauguggucacacuuuguggagacagguuccuugaucaacuccagacuagcaggguagggggggagaaaaagaaaauaaaugaggcucaauaauuuauuuaaaaauaaagcuauucuuagugaauaaguucaacuuugagcuguuaugacugagucaacauaaggccucaaguucguucaauauuuauuaaaugucugcugugucaggaacugagaauacagcagagaauacgauccuuaccuucagugagcuuucagauaucaaaacagaauuauauugaucccuucaauacucuauacuaucaucagcauuuaaaagauuaguugauaauaguucguacgaauucauuuccagugauauauuuuucugcacuaucacugugggugcacaucucaucuuuaagcuccauaaagacaaaauuuucugcuuauauuucuuuugaauuccuuccuagaacuuuuuuuuguuuacuguaaaugccuuuuuaacuuaauauggaaaauuucaaguauuucaaaauuucaaguaaauaaaauaauaaaaugaacuauauggaccaucacccugguccaacaaccaucaacucauggccaagcuguuucacccauauccaccccuaccccagauuauuuuaauuauuauuacuuuuaagauaaggucacacucugucaccuaggcuggagugcaguggugcaaacauaccucacugcagccuugaacuccugggcucaagcaauccucccagcacgggguuuacaggcaugagccaacacacccaaacccaagugucuucuuuuuuuugagaugggguuuugcuuuuguagcccagacuggcaugcaauggugcgaucucggcucacugcaaccucugccucccaaguucaagugauucuccugccucagccucccagguaguuggaacuacaggcgugcgccaccacgcccggcugauuuuucguauuuuuaguagaguugggguuucaccauguuggccggcuggucuugaacuccugaccucaggugauccgccugccuuggccucccaaagugcugggauuacaggugugagccaccaugcccagccccaagugucuucugaucuauaggugucucuuacuuuuucucccuugucauuuauuuuuaaaauuaggucauuugaccuguggaguuucccccauucuggauuuugcugauuguauaacccuauggugagguuuaacuuguuccucuagccuuauuuccuauaaacuagacuuacaggcuuaaucauucagguucaacuuucuggcaagaacacuuuacagaugguacuguguacucuuauuagaucacuucagaagaggcaugauguuugguuugugauuacuuuguaaaaacaguguaauaaguacucacuaaaggaaauuuagaaaaugauaagcuuaaggccgggcauggugccucaugccuguaauccuagcacuuugggaggcugagguggguggaucaccugagcucaggaguuccagaucauccuggacaauauggugaaacccugucuacgcuaaaaauacaaaaauuagccgggcgugguggcgcaugccuguggucucagcuacuuuggagacuaagguagaaggaucacuugaauccuggagguggagguugcagagugagccaauaucgugccacugcacuccagccuaggugacagaggaagacucugucucaaaaaaaagaaaauaaggccagacacgggggcucaugcuuguaaucccagcacuugggaggccgaggcgggcggaucaugaggucaggauuucgagaccagccuggccaacacagugaaacgcugucucuacuaaaaauaccaaaacuaacugggcaugguggcaugcgccuguaaucccagcuacuugggaggcuaaggcaggagaaucgcuugaaccggggaagugcacguugcagugagccaagaucgcgccacuguacuccaaccugggcgacagagcuggacuccaucucaaaauaauaauaagcuuaaaaauaaaaacuucagaaaauacaucacccaaguucccaucccuaccugucuauccacaaaaccaaggcauuccugagauuaguucauuuauuauacuaauauaacaaguguuuauuaaguaucuacuacuauauucaaguacuauucuaggagauagaaauguagcaguuuacaaaauaaagccugcucucauagagcucauauucuagugugguagacaguugauacggaauuaaagaauacaugggaauaagugcauuaaagagaaaaauuaagcaggguaaggggaaacagguaguucaauaucuaugugggggugagauguacauggggggagucaggaaagguuucacugaggugagacuagaggauagcuuaauaauguaaagaaacacacuaugcaacaauuaggggaagagcauuccaagaaagagggagcagagaaggcaaacccugagcaggaccaugccuguguaugcaggacaucagauaggucaaggugcuaaaauguaauaauccaggaggauauuguagggaaagacuaucagagagguagcugguaacuucugguaggaaccuauaggcuauuuuaaaucuuuagcuuuauucuggucuuuuuaauuuucuuuuuuuuuuucagacagagucucguucugucgcccaggcuggagugcaguggcaccaucucggcucucuguaaccuccgccuccugaauucaagugauucuccugccucagccucccgaguagcugggacuaaaggcaugcaccaccaugccuuggccucccaaaguacugggauuacaggagugagccaccaugccagccaucuuuuuaauuuuuaauguuaauuaauuuuuguagagacaggaucucacuaugaugcccaugcuggucuugaaugccuggcaucaagcaaucuuccugcuucggcuucccaaagugcugggauuacaggugugagcuacuauacccggccuuuagcuuucuucugaaugugaaccuuuuuuuuuuuuuuuggagauggagucucacucacucugcugcucaggcuggagugcagugguguggucuuggcucacugcaaccucugccucucggauugaagugauucuugugccucagcauuccaaguagcugggacuacaggcgcgugcugccacacccggcuaauuuuuuuguauuuuugguagggaagggguuucaccauauugcccaggcuggucuugaaguccugaccucaagugauccaucugccucgaccgggauuacaggcgugagccacuacacuuagcucuaaaugugaauuuuugaaacggauuuuuuggauaaaguccaggcaagauaucaaagaacgacuaaccuggcagugugacaagaaugugguuuuuuccuuaaauauuuaacuuuuuagaaaaggaucacaagggccaggugcgguggcucacgcuguaaucccagcauuuugggaggccaaggcgggccagccugggugacagagaauccaucucaaaaaaagaaaaaaaaaaaagaaaaggaucacaagaaaagcuuguggacaguaaccuuauugugaaggguuguaauacaacucuuguaaucaugggguuuuugacauagcacagggcagugaaaagaaaaacaaugaacuaagucaggaggcuggguuucuacuaccaguuguguauauaagcagagccaccuugggcuaaccacucuaccugaaccuguuuccuucucuugccauucacccugccagacuccuugggcuauugcaagaauaaaauuaaaugcuacuugggaaaaugcuucacaaccugagaugacuugggaaaaaugcuucacaaccugagauaacuuguaccaacauugguauuauuacugggaccaaaugugacuuuaaaaagaaaaacaaccuugacaaagaaaacucugauugguuacuaaaucccuauuucugagauaagcuacauuucaaagaaauucuccguaaaagaaaaauuggauucaguuaucauaccagauggcuuucauucucaccacugacucaauucugaaacaauuauauuucaguaugguaauuauaaucuaaacuauauaaacacacuguaaacacaaacuuugaacagaugaaaacuccgauauguaaaaagguaaugaauguugaaggaagacugugaaaagggaaaagaaaaaaaauuaaaauguuccccuucuagguccugaugagaguaaauguuuacuauaaaaaugauucaaauauuuuaaacacuuuucaaaccaggcaauauuuuaggccuacuguauauuugcauuuugagcuuccaauacggauaagugacuggaaaaagcagcuagguuuagguugaaaaacaacaacccaccggggaacacauuuuagcaaauucuucugaaagucaaaaauguuauagucauagguaaaaaguuacaaagaacuaccaauugucagaaauagcugccaauauugacuuagaagacagcagaaggaauuuuaguucaagaaaccuaaaacaggcugaaaaccuuaccuacccuauagcuaccacaaauaacacuguuuccagucaugaucauuccugaucacauauuaagacauaacugcaaauugugcuauacuguacuauauuaaaaggaagugaaauaugaucccuauccuagaacuuuccauacaaaugaauguaaaacaccauaaaaauuaaucuuaaggccgggcgcgguggcucacgccuguaaucccagcacuuugggaggccgaggugggcggaucacgaggucaggaaguggagaccauccuggcuaacacggugaaaccccgucucuacuaaaaauacaaaaaauuagccgggcguggugguggacgccuguagucccagcuacuuggggggccgaggcaggagaauggcgugaacccgggaggcggagcuugcagugagccgagauggcgccacugcacuccggccugggugaaagagcgagacuccgucucaaaaacaaaacaaacaaaaauuaaucuuaagccaggcgcaguggcucacgccagcacuuuggaaggccgaggcggguggaucacgagaucaggacuucaagaccagccugaccaacgugaugaaacccuaucucuacuaaaaauacaaaauuagccggccacgguggcgugcgccuauaaucccagcuacucaggaggcugaggcaggagaagcgcuugaacuugaaccuggcaggcggagguugcagugagccaagauggcgccacugcacuccagccugggcgacagagccagacuccaaccccccaccccgaaaaaaaaagguccaggccgggcgcaguggcucaggacuguaaucccagcacuuuggaaggcugaggcggguggaucacaaggucaggagaucgagaccaucuuggcuaacauggugaaaccccgucucuacuaaaaauacaaaaaauuagccgggcauaguggugggcgccuguagucccagcuacucgggaggcugaggcaggagaauggccugaacccgggaggcggagcuggcagugagccaagaucgugccacugcacuccagccuaggcagcagagcgagaccgugucucaaaaaaacaaaacaaaacaaaacaaaaagucugggagcgguggcucacgccuguaaucccagcacuuucggaggccaaggcaggaggaucaccugaggucaggaguucgagaccaaccugaccaauauggagaaacccugucucuacuaaaaauacaaaauuagcuggugugauggcacaugccugcaaucccagguacuccggaggcugaggcagcagaauugcuugaacccgggagguggagguuguagugagccgagauugugccacugcacuccagccugggcaacaagagccaaagucugucucaaaaaaaaaaaaaaaaaaaaaaaaagaaauuaaucuuaacaggaaacagaaaaaagcaaugaaaagcuagaaaacauaauaguugauugaaaauaacaauuuagcauuuucauucuuacaucuuuaauuuuuauguaucugaguuuuuaauugaugguuuaauuugccagaaugagaaagaacauccuauuuuuaugacucucucccauggaaaugaaacauaaauguauccaaaugccacacuauugaggauuuuccugaucacugauugucaugaguaaguuuugugcuuuuucaaaagcaguuuuuuccuacaaugucauuuccugcuucucuggcucugauuuucaauaaauugauaaauugugaauccuguuuuccucuuauuuuuguuuagcuauaauguugaagggcaagggagaggaugguuauuuauaaaucuuguaucgcucugaaaacacaacauacauuuuccuuaaucugauuaacuugacuucaaauaugaaaaacaacuuucauaaagcagaaaagaauuuacccuuuuuuauuguggguaagaggcaaugguacaacuuuucaacuuauuuuuugaauguuacucacuacuaaccaucaccauauuuaaaaaaauuaaagaacuaauuuaguuuaguuuauuauuuauuugacaaauguuuauugaguggcaacuaggucccaaguaccguucuaacuacugaacauacagauguauguaaacaaaacaaaaaucccauccuggaguuuacauucugugggacuagagauaaaaaauggauacauuacauagaaugucagcuaguaaucaguguuauggagaagcagcaggaauagaagauaaagugugugcugggggugugguaauuuuaaauaggggugucuggaaaugaaaaggugguauuucaaucaagauuuuuagaccauggcugggugcaauggcucaggccuguaaucccagcaccuugagaggccaagggaggguagaucacuugaggucaggaguuugagaccagcauggccaacauagcaaaacccuaucucuacaacagaaaaauacaagaauggcuggacgcaguggcuuaugccuguaauccuagcacuuugggaggcccaggcggguggaucacaaggucaggagaucaagacuauccuggcuaacacggugaaaucccgccucuacuaaaaaagaaaaaaaaauacaaaaaauuagccgggcgugguagugggugcuuguagucccagcuauucaggaggcucaggcagaagaauggcaugaacccgggaggcagaguuugcagugagcugagaucgcgccacugcacuccagccugggcaacagagcaagacuccaucucaaaaaaagaaaaaaaaauacaaaaauuagcugggcaugguggugcacaccuaucgucccugcuacucuggaggcugaggugggaggauugcuugagccugacgagguugaggcugcagugagcugugauagcaccacugcacuccagccucucgacagagauccuauauaaaaaaaaaaccucugcauuucauuguauguaaauaaguauguaauuucauuguauguacagagccaguuucaaacaaagguucuuccaaauaccuauccucucaacgacaccgaucauccauguuuuuuuuuuuuuuuuuuuuuuuuugagauggaguuuagcucugucgcuggaguucaguggugccauauuggcucacagcaacaucugccuccugguucaagugauucuccugccucagccuccugaguagcugggauuacaggcacaugccacuacgcccagcuaauuuuuguauuuuuaguggagaggggguuucaccauguuggccaggauggucucgaucuccugaccucgugauccuaccaccuuggccucccaaagugcugggauuacaggcauaagccaccgcccucggccucauccaugauuuuauuuugccauuucaagugauggagcuuguuuuagagcuggaagaaaagccaaaaugccaguuaaucuaaacuagauuccugccccagugcagaaccaaucaagacagagucccugucuuucccggaccacaggauuuguguugaaaaggagaggagugggagaggcagaguggauggagaacaaggaaucauuuucuauauuuuuaaaguucuucaguuaagaaaaucagcaauuacaauagccuaaucuuacuagacaugucuuuucuucccuaguauguaaggucaauucuguucauuugcauaggagauaaucauaggaaucccaaauuaauacacucuugugcugacuuaccagaugggacacucuaagauuuucugcauagcauuaaugacauuuuguacuucuucaacgcgaagagcagauaaauccauuucuuucuguuccaaugaacuuuaacacauuagaaaaacauauauauauaucuuuuuaaaagguuuauaaaaugacaacuucauuuuaucauuuuaaaauaaaguaaauuuaagauuuggaagguuuuagaauaauacaaaccaaagaacuaaugacaacguccuuuauuuuuaaagauucuagaaguugcuuuuuguaauuagacaacauaaauucugaauuuuuucacauauugcugccaaccccuugggucuuuuccuuucuccaagaaagagaaagcuacagaggagugacugaccggguagguggugguagccuuagcuuucuccaauguuucugguuguuuucuuuuucuugcauaaaaccaaaaucaacaacgaccaaaccaacaccaaucaaggccuccccgccccuaaccuuucccagugaccugcucucaucucuggauccuccucaagcacaucccugccggcagcaucuguuacuacugacgcuccucuacuucccucuugcgcuuucucaauggcgcaaauggauccaguucuuaaguucucccucccacaaaauccugucuccuccccuucccagacauauuccuggcaccucuucuuccacaaggucccauccucucauacauaccagccgguguuuuuuguuuuguuuuguuuuguuuuguuuugagacagucucgcucugucgcccaggcuggagugcaauggcgcgaucucggcucacugcaaccuccgccucccggguucuagcgauucuccugccucagccuccugaguagcuggagcggcaccacgcccggcuaauuuuuguauuuuuaguagagacggaguuucaccacguuggucaggcuggucuggaacuccugaccucaugaccagccgacguuuuuaaagacauagugucccccucaaggcauauuccaguuccuaucacgaggauucccccacggacacucagugcccccuuccugauccucagcgcuucccucgcgaccuacaaacugccccccuccccaggguucacaacgccuuacgccucucagguuccgccccuaccccccgucaaagaauacccaucugucagcuucggaaauccacucucccacgccaguaccccagagcaucacuugggcccccugucccuuucccgggacucuacuaccuuuacccagagcagagggugaaggccuccugagcgcaggggcccaguuaucugagaaaccccacagccugucccccguccaggaagucucagcgagcucacgccgcgcagucgcaguuuuaauuuaucuguaauucccgcgcuuuuccguugccacggaaaccaaggggcuaccgcuaagcagcagccucucagaauacgaaaucaagguac

SEQ ID NO: 192966 - RNA, 17423 nt, Homo sapiens
accaccugcgccaggacaccagcgggccgcuguggggagcugcacgcacagccccgcaucggcugacaagccgggccgccauggugcagaccugcgccgucgcacucagaacucccgcaggcccaccuacguagugcguccggagcagagcacuccaaucccgucccgcuuccgcggcguccucagaaccggaaauaaaaugcgcggagaaaauaggccaaucggaaaacgaaccuugccuccucgggcgggauggaucggaggcugcccuggaagccaaccagacgccaaagcuagaaagggguggacccuggccccgcauagcucucgcugccaccgcugcugccacuaucgcugucacugucgcugcugccucuguccagcugaaaugaccguggggaggccugagggagcccccggaggcgcggaggggagccgucaggugaggagagaaaagagacugcccccgggaaaggaaucccggagaggaaacuguugggcguugccuuggagacagacagcaggggcgugucacggaggggcgugggauuaaaaugagcguuuagggaccaggaggcggacucugacuuacagaccugaaccucucggacuuuauacgaggcucuugauaggcaaugucacucaguuuucgcuuauccucuuaguacucuaugaccaguaguacaauugucgucucauuuuuguagaagagaaaacugaggcacaaagagauuaagaaaauugcuccccaaauuuggccgggcguggugguucacgccuguaauccuagcacuuugggaggccgaggcggguggaucaccugaggucaggaguucgagaccagccuggccaacauggugaaacuccgucuaaaaauuuaaaaaaaaaaaaaaaauuggccaggcgcgcuggcucacgccuguaaucccagcacuuugggaggccaaggaaagcggaucaugaggucaagagaucgagaccaggcugguuuccauggcaaaaccccgucucuacuaaaaauacaaaaauuggccgggugcgguggcuuacuccuguaaugcagcacuuugggaccugaggucaggaguucaagaccagccugaccaacauggagaaacccugucucuacuaaaaaaaauacaaaauuagcuggacgugguggcacaugccuguaaucccagcuacucgggaggcugaggcaagagaauugcuugaaccugggagguggagguugcagugagccgagauugugccauugcacuccagccugggcaacaagagcaaaacucucucaaaaacaaaaacaaacaaacaaaaaaauacaaaaaauuaucugggcaugguggugcgcgccuguaguccuagcuacucgggaggcugaggcaggagaaucacuugaacccgggagguggagguugcagugagccaagauugcaccacugcacucuagccuggcgacagagcgagacuccgucucaaaaaaaaaaaaaaauuagccaggugugguggcgcgugccuccagugauccaccagccaaggccucccaaagugcugggauuacaggcgugagccagugcaccugguggaccccaaacuauuaaaggcaaaaaguagauuggcaguugcuuagggcugguggggugggguguggaggguuaggggaaauagggagugaccacuaaagcguguggcauuucuuuuaagggcgaugaagguguucuaaaauugugaugguaguugcacaacucuguguauauacuaaaaccacugaauuguacacuuuaaaugagugaauauauuguauagaaauuaugucuuaauaaaguugucuuuaaaagaaaagaaaaaacgugcccaagaucacacacuguagcagagccagggcuagggugcauacauaucucugacucuuacccuggauuuuaguaagccuggcuccucaucaaucaagugucaauucaaaauuccuccacaaugaaaaauaaaaaucagcccaggacugagaaaguauaacucagacugucauaggcauagauaaugccaacggcaagagcaucaggaaacaguguuucucucagggccauaacauaggugcaaaauuacuaacaccccuucuuccaaaaggcuuacugaucaauuacuuacccacccuacuuuauucuucucaccuuuugaauaaguauugccguugggcggggcccaauggcucacgccuguaaucccagcacuuugggaggccaaggcaggcggaucauuugagcucaggaguuggagaccagccugggaagcauggugaaaccccaucuguacaaaaaauacaaaaacuagccaggugugauggugugugcuguagucccagcuacucgggaggcugaggugggaggaucaucaccugagcucaggagguucaggcugcagugaggcaugauugcaccacugcacuccagaaccugggugacagagcaagaaccugucucaaaaaaaaaaaauugcucagucauucgcuuaacuaaauuguccccacuucaugacagcaccauuccagaguugauaccugguucccugaaucaaucagggaagccaacccuauaaaaaucacacccucaacccuaaguucccugugguuuuccguaguguccugcagcaaguuaauaagccuaacugauguacugauuacaaguacauuccuaauaaccuuaaucugauggacuuuaucaaccaaaaagcuuuccauaggcacuccaucuuuuuauaaccucacaguuguuuaugguuuucacagaauuuaucaucaucuuauauugucugucuccucuuacuacaguguaagcuucaugagaguaaggaccuuguuugucuuguucucagccaaaugcccagugcacaucaggcacccaguaaauauuuuaugaaugaauggaguacugaaaaaguuaauugugugucccacuucuuaagacauugcucuuccagccagaccauacugucugucuuguuaaucauccauuccuuuuuuuuuuuuuuuuuuugagacggagcaucacucuuguugcccaggcuggagugcaguggcgcaaucucaucucacugccaccuccgccucccggguucaagcgauucuccugccucagccuccccaguagcugagauuacaggcacccgccaccacgcccaacuaauuuuuguauuuuuguagagacgggauuucaccauguuggucaagcuggucuugaacuccugaccucaggugauccaccucccucggccucccaaaaugcugggauuacaggcaugagccacugcacccagccaucauccauuccuugacagagugcaaauuagcuagaacaugaggaaagcagaggaguagaaauaagggaagggagagaaggaagaugagcaagaaguagguuaaaacccaaguaagggagaguguggccaucaucaugggcaggauuccuggagugcaggggucagaaagccugguguaggugagguacucuguaaaagcuuacugcacuguauggcauagggaaccaacuucagcucuucacuucccucuccaucccuucaaccaagcgcacuucauagaccaaguugugaaauuucuuuagaccaagaaacacaccuuauuuuuaaaaauuccucccaaaguguugggauuacaggugugagccagugcaucuggcagaccccaaauucuccccagucccuaauauacagaagcuuauucaaagcgaaauuaaguuaugauuugaauaccuuugaaauuauuguuugacccacagccuauuucuauucuauuuuagauauuuccccccgaguccuucgcagacacagaggcaggagaggagcuguccggggaugggcugguuuugcccagggccagcaaacuugacgaguuccucagcccagaggaggagauagauucuacuucugacucaacugggagcauuuaccagaacuuacaggaacugaagcagaaagggagauggugucuguuggagucucucuuucagucugacccagagagugaugaaaaccucucugaagaugaggaggaccuggagaguuucuuccaagacaaggacagggggauggugcagguccagugcccgcaggcucugagguaaggcacugcagcuccacggcugccucacuccacaccuccacacaggucacaucgugucucugggcuucaucuuccucuguaaagcaaagagcacuucugcaaguugccauuuacugaggcucuagcugagaaucagcuuuugguuccaaacagguguucugauuccuccccaggaauccugaauuacuuugggcaacacuuaguccagugaugcacuggaauuaauuaaagggcagccuuuccucaggugcaggggcucacaccuguaauuccagcacuuugggaggcugaggcaggcggaucacuugaggucaggaauucgagaccagccuggccaacauggugaaaccccaucucuacuaaaaauacaaaaauuagccagucaugguggcgugugcccguaaucccagcuacucaggaggcugacgcaugagaaucccuugagcccaggagguggugguugcagugagcugagaucacgccacugcacuccagccugagcaacagagcaagacucugucucaacaaauaaaaauaaaauaaaauuuaaaaaugggccgggcaccguguuuacgccucuaauuccagcacuuugggaagccgagguggcuggaucaugaggucaggaguucaagaccagccuggccaagauggugaaaccccgucucuacuaaaaauauaaaaaaauuagccgggcaugguggcaggugccuguaaucccagcuacucggaaggagaggcagagaauugcuugaaucugggagguggagguugcagugagccaagaucacgcccagcuugggcaacaguacaagacuccaucucaaaaaauaaguaaauaaauaauaaaaaauaaaaaaaaauacagggaagcauuuccuaaauacacuuucccugagaaugacaacaaaguaccuuuaucuuggucaagccuuagaaaguaaauauugaaugagauaaaguguacauuaucucauuacuuuaucuuauuuaauauuuacuuucuccuccaauaaccugguaaguagacauuaauuuuugccacucuacauaggaggaaauugagguuuuaacagaacuuugcucaaaguuugaagcaagauuuaaacccaggucugucugacucuaaagcucuacucugcucauuguucucucucucauaugaaauauuagagugcaaaguggcaguucuuggaucaauucugagaagagacuuuccauuagggcugccaggauugucugugggaaggucauggacauagaggccuguggggcugugguguuaggcugagcagccagcugugaccagugggaagggaggacuggggaggaggucuggagggagcagggccuccugacugcccuguccuccacucacagaucugcuuuuuucccagguguggcuccacaaggcgcugcagcucccugaacaaccuucccuccaacauucccaggccucagacccagccacccucaggcucccggccucccucccagcacagaagcgucagcuccugggcaucauccauuacugucccucggccauuccgcaugacgcugcgcgaggcccggaagaaggccgaguggcugggcucaccugccuccuuugagcaggagaggcagcgggcccagaggcagggugaggaagaggccgagugccacaggcaguuccgggcacagccugugccugcacaugucuaccugccccucuaccaagagaucauggagcgcagcgaggcccgaaggcaggcagggauccagaagaggaaggaacugcuccucucuucuuugaagcccuucagcuuccuggagaaggaggagcagcuaaaggaagcugcucgacagagagacuuggcagccacagcugaagccaagaucuccaagcagaaggccaccagaaggauucccaaguccauucuggagccagcccuuggggauaaacuccaggguaaagacauccuugccaccuugcugccuccugccucggggaaccaaucccaccauagggauuuagucagggcccagggaucugccuggcuuggagauuugcugcuuggguggacccacuagaggcugcacgcuuagugcaggccauuggggaggguuaggucugucuauacaaucaggaccuguauggugccaggagugagaggucccacaguguccccaaggcucguccuguugacaucuaagugaaugcacaugagggccucugcaccagcacaggugcaggaauagagaaccagugagacaccugaggaccagcuugggcucaugccaccaccagcacacugcccugagaugcucccccauggcuccuucguccuggugagguagugucaaucgccgaaauuaccugggggaugauuauuuacacauuuccaaaaguauagcuccaaauaaggggcucaggcuuuauucacuuuucgguagcaugugccaugcuccaggcacugugccauggugaacacacagacauggaguuuguagauaugugaggaaaacagauaaagacaaauacauacaaauguggcgaguuauuuacaaggauuaaaaggggaagcaugggagcauauaucaaagggaccuaacccggggauuggugaagcaagggagcaguuagggaagguccccugagaaagugggcccuggggcugaacugaaggaggggcgaagagggaggagaaguggagcaggcagaauguggcauggaggggagagaaagcagagcaucugcaagggauggaaaggucgagggcugagagaagagggagugggaaggaagaggcaggcaugggccagacaugaggagcuuugcaagccacguuggcgagucuggacuucaucccaagggcacagggaagccacugagggagugaggcaggguggcccaugaucagaaauauaguucagaaggauccuucugauugcuguauagauaaucugagagggcagcaagacuggagggauguugagccaagaggaagcuauuucacaauucaguagagaaauugugcaacugguugcagggaugaaaaaacgaggauggacuggagagagguuaaagaggaggaaaugacagaacuugugacugaugagagacacggaggagucagugaugugggcaaagggccugggcagcuggguggaugguagggccuuucucucagauggggaaaccugggagaggagcagguuacuggcccacuuccucugcuucaucucugaagaagcaaucauagaaagugcucaguaaguguagauggucacugcuucugcagccugauugacacaggcagugguguucuggaugacauuuauuaacaagcucuccagaaaaaaaaaaaaggaagcugguuuguaauguuuguuauuuucuguggcauaauuacuccuauucaggccaucugcaggcaucucacaggauguuaacgugucagaauuccugaaaaguuccuacuugccuccaguaacacuuacagcuaguguguaaaagagggaaaguucuccaacccuguagguuucuugcuugguccuuucuuacccaucaccauccuuucuccacagaagcugagcucuucaggaaaauucgcauccaaaugagagcccuggacaugcuccagauggccucuuccccuaucgccuccucuaguaaccgggcuaacccacagccccgcacagccacccgaacccagcaggaaaagcuuggguuucugcacacuaacuucagauuccagccucgggugaauccuguggucccugacuaugagggccuuuacaaggccuuccagagaagagcagccaaaagaagagaaacccaagaggccacucgcaacaagcccuucuugcugaggaccgccaaccugcgccacccucagcggcccugugaugcugccaccaccggaaggaggcaggugagagcccaggcagcugugggagggucagggcugcggccugaaauacaggguggggccaggucuuccuggaaagcacuucucaacaagguuuuccuaucuuuuuuuuaaacaccagcucaguuguaagcagauucacuuuccuauaaacuccagaccacagcccagccugggcaacagagaccccaucucuaaaagaaaaauacaaauauuugccacauguggugguguguaccuguaguuccagccauucaggaggcugaggugggaggaccuucuggcugcagugagccaagaugaugccacuguacuccagccuaggcaacagagugagaccccaucuaaaaacaacaacaaaaaacaggccaggcgugguggcucacgccuuuaaucccagcacuuugagaggccgaggagggcagaucaucugaggucaggaguucgagaccagcacggccaacauggcaaaaccccaucucuacuaaaaauacaaaaauuagcugggugcgguggcgggcaccuguaaucccagcuacuucagaggcugagguaggagaauugcuugaaccugggaggcggagauugcagugagcugagauugugccaccgcaggccagccuggacaacaagagugaaaguucaucucaaaaacagaacacaacagaaaccauagggacacuucuuuuccucccuuacuguagaaggauuucacagaaauaaguccaagcaggcuugagaggcaaggaguugggaucaguuguugaugucucuauaccaauuccaaggaacucuucucauuugacuaaaaacuuuaggauugauauccaagucuuggcuugguugugaaacuugagaucucuuuauccuugccuuauucccaggaaaaaaaaugaagauucucauuuucaguccuucagugaagcugaauccuaguaaagauagaaaauggcugggcgcgguaguucacaccuguaaucccagcacuuugggaggccgacacggguggaucaccugagaucaggaauucgagaccagccugaccaacauggugaaaccccgucuguacuaaaacugcaaaaauguagcugggcaugguggcucacaaccuguauagucccagcuacgugggaggcugaggcaggagaauugcuugaaccaggcagcuggagguugcagugagccgagauugcgccacugcacuccagccugggcaaaagagcgagacgagacucugucucaaaaaaaaaaaaaaaaaaaaaagauagaaacuaaucacacaugcugucccaccaauaccaaccuuuguuucuucuaggauuccccacagccaccagcuacaccccugccaaggagucguucucugagcggccuugcuucccucucugccaacacucucccugugcacaucacagaugccaccaggaagagggaaucugcagucaggugaguggucaggcugcacgagacccaugcucugauucuggccccaaaugcuggaaaccucccugccaaggggccuccuuuccuguuaucagagauaccucaaggggucaaagggaauuuucugaucaggacuggaacaauugcgguucuccacaccuggugcuuggagaacagcuagccaucauucagcacauauucauagugggcuuauucugugccaggcacaguguuaaggcuggagaucuuagggaaccuccaguuuauuaucuagucugaaauacagaaaagcaaagaagcaauggccauauuuuuugaguagugcaaugaugggggguaaaggggacugugagggcacugggcagccuggagcaggggggucuugucuuguggaauagaugucuaaagugaaacugaagaacaaggaagaguucgccagacaaagccuggagagaaggaagguuccagacagagagaacauggauaaaagcccaugggugagaggaagggaguagugaggaacaagaauucagagaagcaugcuagcagguggcugaaguugccgcaaauaugagacauccauugcauagauuugagauucucugagauucaucuugggaagaugucagagucuguugggcagcaagagccugcuuauuuuuaacucuucaacugaccugauucuguuaugauguucucauuaagccagcccccagcaaggguucuuccaccaggcuucugagcugaaguaggcaagagaggucaugguguaacagcagcuuaggccagggagaggacuaaugucuuacugccuucccauggggcauguaggggaguacucagaaccuacuuggaucguuaagccccacagcagggauuguagaagaguauuuacgguccaagggauacuccuuucuucuucagacuucaguuagaccuacuaaaucagggcuaauuaauugcucaguauccugagggcccaagaacacaggccuccugaacaaagaggcuggccuuccuauagaggacauccacaucugcuuuccagccacagggaaucugacauauuaacagauuaaauuuucauguccuucuucccaguauguccauuugaauauaaacauccaaauauaagagucuugguugauuuuccuuuuggaagaacucaacauauuacuuuguagauaacugaacaaacuaagugcuacaaguugaacccaaauagucugcacugagggaggcucauuuccaguucucucugaaugugcagauuuguauucccaaaggaccaugaacccagacaccuuccagcccacuguuuccagcagaguggucaaggccagaggcuucggagucagagguccugguccaauaggggcuuuuccacuggcaugcuggguagcuuugagcaaggggcuuaccuccuuugagccucaaucaccuccccuauaaaaagggaauuuaguauuuaccucauaaggcaguuaugaggacaaugugaaauguaaugguacuugguucauaauaaggagcucaguaaaugguagcuauuaguauuauuuuguauccagauaggcgaagaccuauugaauguuggacuguuuaaguaaggauauauauauuuuuuuucgagacagagucuugcucugucgcccaugcuggagugcaauggcgcaaucucagcucacugcaaccucugccucccggguuuagugauucuccugccucagccucccaaguagcugggauuaccggcacgugccacuacacccagcuaauuuuuuuuguaguuuugguagagacaggguuucaccauguugaccaggcuggucucgaacuccugaccuugugaucagcccgccucagccucccaaagugcugagauuacagccaugagccaccgugcccgaccuaaguaaggauauuuuaacugacguuucuccaguucaguaaaugcacuucuaggguaggaacucacugugucccuagugcuggaaaggcuucaucugccagugcauuuaauccuagaauuuuauuauuuuuaaaaauggcaguugagguaaauuacaugccccauucauuaaaaacaccaacuuacuuuccagaaaagguuacuaagauugcuuuauuuuauuuauuuauuuauuauuauuuuuugagacggagucucucacugucgcccaggcuggagugcaguggcacgaucucggcucacugcaagcuccgccucccagguucaugccauucuccugccucagccucccgaguagcugggacuacaggcgcccaccaccgcacccggcuaauuuuuuguauuuuuaguagagaugggguuucacaguguuagccaggauagucucgaucuccugaccuugugauccgcccgccucggccucccaaagugcugggauuacaggcaugagccaccaugcccggcuauuuuauuuuauuuuauuauuauuauuauuuuugagacggaauuugaucugucgcccaggcuggagugcagcagugcgaucuuggcuuauugcaaccucugccucccggguucaagcgauucucuugccucagccucccgaguaguugggauuacaggugcacaccaccaugcccagcuaauuuuuguauuuuuaguagagcugggguuucaccguauuggccaggcuggucuuggacuccugaccucaggugauccaccugccuuggccucccaaagugcuaggacuacaagugugagccaccacaccuggccuaagauugcuuuucaguauacccagguugguaaucuauacucuuuuucugccuccuuccuuuagaagugcacuugaaaaaaagaacaaagcagaugagaguauucaguggcuggagauacacaaaaagaagucucaagcaauguccaaaucugugaccuugcgugcaaaagccauggauccccauaaaagccuggaggaaguguucaaagcaaagcugaaagagaaccggucaguguccucuaugugucaaaaggggugcuugccuugggauccaacagaccacuggccuauugccagaaaaugcaaaauagaguuaucgagguagguaggcuccuguaaucacagcagggucaugauuuuccaagucagauaggaauuuacaguguacacgagaguuacacugcuuuacuggaaaugaaggguauucuggauuagaaaagaugaaauucuuucuaaaagucuugcuaauuccaggaacaaugaccguaaaagagcgaaagaauauaagaaagaacuggaggaaaugaagcagcgaauacaaacaaggcccuaucucuuugaacaaguugccaagguaaaacuaaaccaucauuuguuuucuuucugccuuagauaaaaggacucugaaaaauuacaaaacaauuuuaauauguggguauuaaaauuuuccuugaggcccagaaauucuaauuucacuacuaccuucuuuucccaaaauaaauaguacaauagagaaugcugcuuguguugauuucauccaagaguggacuccaaaggcaucgauaaagggauauuucacuuccuagagcuuucacuguagucuaccauucagauuucaucagacugggcauuagaccccagagacacagggaccauuuggcucuuucuaugcucuggagccacuguucacagugcuggaaagguaucucuccucuggcagugcugcuggcccugggccuccccagccucuagagcugugguauauuuauaggucuccaagcauuaggaugcccacaaacacccugcaaggcuuucucuagacuaaguggcuuucaggcuggaagccugaaauuuuuuuuucuucuuuuauuuuguaugcauguguaugugugugugaguguguguuccuuauggagcagggcuaacccauaggcaguguacccgaaguauccuggaagaguaucauuuuaagauauucucuguagacuuuuagggauguuggacucagcugagaucuccguaaggauguaaggaugcucuguuucuacugcauuaggcucuguggaucucuuuccucuccaguuucagacaaguugggguuccauagugaccuaguuccaauggcagggcauuagcuccaucuuauaguuaguacauugucuaggcauuugcuggcuccacuuccuccucccuccauaaaucuuucuccucucacacacauaagcacacauggucuuggauuuacuuagcaaccugcauuguucaaaaucucaugcuucuuuauguuaauguuaagcaagcucacucuucagaucucaacagaucuuucaccucucuaggaaaaauacaaaguacucuaugauuuuguucuugaauacuuaaacaaaaaauaauauucugcugguccacaugcagaccaucuguccuuccacuaagagucuugguguagcuuauuuucuauuuuauuuuaguguuccugauaaugguuuguugcuuuaaaaucuuagguuuuuaguccauccuuuuaaaucugggucucauuugucucccaaaagucuaagucauugcuuuucaaaauugugacucccaaaucaacaguuuggcaucucuggggaguguuagaaauacagaauuacaguccucaucugacaccuaccaaaugugaaaucugcauuuuaacaagaccucaggugauuuauauacacauuaaggcuggaaaacaaggguuaaauaauuuucuugcaaaucuaugccccacaauaagggugguggugguuguggcaguauuguaacaauacugauuaaguaauuuagaauugucugguaauucauaagacagcuacaacagauuaauuuccaucccacaggaucuagccaagaaagaagcagaacagugguaucuagacacccugaagcaggcugggcuggaggaagacuuugugagaaacaagggucaaggcacccgggcuguucaagagaaagagaccaaaaucaaggauuuucccagguaaccugaaauguugcugucauucugcagcucucuaaauugucauacccaguaauaccacugggaggaaacuuuagaauagccacugguauuuugagaucauaauccuguauuuauguaacauuaauaaguaauccagagaucuccaaguaacacauuugaauuuagagagugaugcaguugugaauaaaaucugacaaauuauguuucguuuucuuccauuuugaaacagaucauuuuccaauuccaguuccaauuucaugagcugaaacuauuucuacuuuauuuuugaagaaaaaucauguauauuuugacuucuuauaaaacuauaaaacuguuuuucuagcauuccuuaaagguagcucauuaguaucaccuucuccauaaccuuuuuuuuuuuauuuuuuguauuuuuuuuuugagacagagucucacucuguugcccaggcuggagugcaguggcgcgauuucuggcucacugcaagcuccgccuccuggguucacgccauucuccugccucagccucccgaguagcugggauuacaggcucccgccaucacgccuggcuaauuuuuguguauuuuuaguagagacgggguuucaccauguuagccaggauggucucgaucuccucaccucgugaucuacccuccucagccucccaaagugcugggauuacaggcgugagugaccgcgcccggcccuccauaacccauuuugauauugagucaaagggagaaaauaguaucuucucuccauuauucucaauuguuuuguaucuuaaauccuagcagccccuacccuaauuccuaucucaguuuuauaccccuagaaauuuuccuuuacaucccauauaaaauaguaauaauguugagacuuuuuuuuuugagacggagucuugcuccgucgccagguuggagugcaguggcgcagucuuggcucacugcagucucugcucacugcagucuccgcuucccggguucaagcgauucuccugcuucagccuccugaguaggugggacuacagguguccacuaccacgcccagcuauuuuuuguauuuuuaguagagaugggguuucaccauguuggccaggauggucuugaucucuugaccucgugauucaccugccauggccucccaaagugcugggagagaccguucuuaaaccuuacacagugcuuuaagacuuucuuuuuucagacugggcacgguggcucacgccuguaaucccagcacuuugagaggcugacguggguggaucgcuugagcccaggaguuugagaccagccugggcaacauggcaaaacccugucucuacaaaaaguuaaaaaaaaaaaaaaaauuagcugggugcaguggcacgugccuauaaucccagcuacuugggaagcuaaggugggaggauugcuugaggugggaggguugcuucagcugggcuguccaggcugcagugagcugagaucaugccacugcacuccagccugggugagagugagacccugucugaaaaaaaaauuuuuuuuguuuuucauguuuuaauuuauucugcagguuccaagaaacuacaaaacucagcaucagagauccagagcaggguuuagaaggaucucuagaacagccugcaagccccaggaaaguacuggaggagcugucucaucagucaccagaaaaucucguaucacuugcuuaaucacuacacuuaaaauuacugcuuuugaaaaauauuaagcagcuaacuuggguuugagucaaggcagggaaaacuuggguuuugagucauggcuacuguuagaggauggacaaaugaagaguagcagauuaacaggccaggcgcaguggcucacgccuguaaucccaacacuuugggaggcugaggcaggcagaucaucugaggucaggaguuugagaccaguccagccaacacggcaaaacuccaccucuacuaaaaauacaaaaauuagcugggcgugaugacacgugccuguaauccuagcuacuugggaagcugaggcaggagaaucacuugaacccaagaggcagagguuguaaugagcugagaucacuccacagcacuccagccugggcagcagagcaaaacucugucugagaaaaaaaaagagcagcagauaacagagaauaguucaaggaaaucaaaguggggaggcucagguggagggaugguagccuaaaguuaaggguuccugcuuugugccucacacuuagagaauuagguacagaaaagagagcacaggcccaaaugccuauaaggggcuagugcagaaacauaaaugcguccauggaguggguguagacaguaggagauaguagacacuggaaaguaucaaauccugcuggaauauaggcucagaguuacuacaucaacuacauuuucaucaagccagaaauuuguaugcuaucaacuaauuuaaaaauuacuuagaaauauuguaugggcaaaauaaaauacaucugcauaucagaucuagcccaugggggaugaaaaacuuacaacuucuaguacaggauuucuuauccucagugcuauuaauauuuugggccaccuaauucuuuguugaggguuggggaagggaacuguccuguacauuguagaauguuuaguagcaucccuggccacuaccugcuagaugccaguaguaccccucuccccagcugugacaaccaaaaaugucuccagauauugcauauccccagggggcaaaaaugugccuggcugagaaccacugcucuaauauaaauggcugcaugaagcaaaaacuggcauucuaagaauacaaguaauugccaugaacacagucuauguacuaugugauuaugcaugucauuaacaaauuaagaauuuaaaacaauucucucccguuaucuguuuagaaugugccuguguguuuaugugagcaugagguucauuuuaaguaaacuuaaaauuucccagacaa

SEQ ID NO: 192967 - RNA, 143985 nt, Homo sapiens
ccugaaacaaccacauuuugcuuuauuaggcguuccaugguaauauaacacagaguucuuaaggaauaauaaacacgagacuuguuuuuuaccauaauuauuuugccaucaagacagugguuacaaaaaaaaaaguacucuucuggcuacacacuuuaucagcuuuagaacugaaaguuccuccacucaugggucacaaucacaauuuccaggauuaaaaaccaucuauucuuaaauccuacacuguuuuagagcaucaagucacugcaguuauucaguucugagacacugucgauuuauuuuagcauuuacauaugacauucauuuaacagacacacaaagcaagccaacagguaaacaugcuuacacagccugcagaaaucgucagguuuuaacuuguuuuuuaagaaaacaaccaaaacaaccaaaaauuaccaugacccgguacaggaaaaacaggaagacucaagugaauacuagagcugcaaguguuucuuagaauugaaacaaaaauuguuuuuuuccaacuuguucaaauuuccucuaagugcaggugagaaaaaaagcaaauauauuaagucaaccaauuauuuuuuuaaaagugcaauuuaccuuuaaaauaacaaauaaacaacaacaacaaaaaacccaaaaccccaaccagauccccaaaggcaaaauguguagagagacaaggguggugauggaaugaccuacuuugugauguuuuuacgcuuuacaaaaagcagauuugguauucagaaaagccugcaaauacaacauugcuuaagagaaccuguaaacacguuuggaauacaaugcaacacaagucagcaaggacagggguagguccaaaggagccagcuagggggaaaggugacagaaaaggagagggaaggauggagacagacaucaccuguggucucuaagggggccauguguuuaauuuauaagguuuccuccccacaggaguucugaugugaucuaucguucauaaaacacauuucuccucuugcaaaguagaauagacuuuaaguuucccaaugacuuuuugaguuuauagggccucuuucuauguagugugucuuuagaaauaauuggacaagaaaaaaauacgguuuuuccccgaaaauaaaaagcucccauguguucuagaaucucaaaagauacuuaaccaggaagcagcaggcccucgggucagacuccuauuagcuuagcacuucugaacuggugacuuugguugguucacuuggguuaaugaggcucgguguuuagguuugaccgugacuuuagccagagagcacugcacagaggaaaaucucuccgguucugcagccucauaccucuaaagcuucugggcccugucugcgguuccacgugugauacugugggugagacggcauggcccauuccugcacuuggccagggucccacacucuagcacacauccucaugauggcaggugguuagcaccaguccuacauggaccaggaugacacagcacuaugcuugcaauggcaaacgcucaaauccuuuaggcggacccaacgaccaccaugaaaugguagaccugggaggugaaaagauaauggggcaagggaggaaaacaccgucuccgagacaagggcuggaggaaacacagagagagagagagacagacacgaaaauauucaugaauuaaaaagcuagagagagaaagagagagugagagcacgcagaaaaaugguaaaagagaagagaauccucaaaggauuuaaucugcagcaaaaucuaggccaauaacgcaagccugccccuuuaucaacagcugacccugaagacuacagaauggcgaugcgggugggcauuguggagccucucaggacagacacgaugaguuugccaaccacccggaaucagcugggugaugacguaauugcaucauuaggauguccaguucaaaccccuuguauuaauauggaauuaaauguuccaauuuaguauuuaaaaaaaaaaaaaaaaaagacucucccugaccccggccccuccccagccccacaaagaaaacuucuuaaaauuuuuaaaaagaaaagaaaaaggcagcucugggcaauucacuuuaucuucccuccccccaugaaaaggaagaugcuaacagacacuaggagguugaaggcgaaggagacccucgcugggggcugcuuguucgcaugucuaaguguugggugugguucccuguaugagcuugguggguagucuugggugugauacccauagauguguagggaaguggaugagcaaaaucaguaacucuuggugagagacgggguguggggccccaagggggaccccaugaacuggcugcuccacaguaacuaucacaggcucuuaaaaaaaaaaacaaaaaaaaaaaaaggaaggaagaaagaagucucagaauguccucaggugucccauccccaguccccaguggacggcacagcccaggagcucuagcccaggcuggugauguuggcacggccaccggggggcgccacgauacgcuggguggugcggcggggaauguugucaucaaucugagcaccuggagggagaggagaagagaggagcgggugaggggccaggacagucacacaagauccugcuugaaggugaaaucucacagcucaggaggaaaagugcuagucgcauucuuuuuuuuuggagacagcgucuugcucuguuuuccagaccaaagugcuauggcaccaucauagcucaccacagccucaaucuccugggcuuaagccauccucccacucggcccccucaagaagcugggaccacagccacaggcccccauaccuagcuaauuuuuaaauuuuuuguaaagagggguuucgcuauguugcugacgcuggucucaaacuccugggcucaagcaauccuccuaccucugccucccaaagugcugggauaagaggugugagccacccugcccggccucacauucuuuguucuucucuuaaaaccucacugaaguuuagacuacagaagggagguggagagcaggcaugguggcucaugccuggaauccuacuaacagcacuuggagaggcugaggugagaagauugcuugaguccaggaguuugagaacagucugggcaacacagugagagccuaucucuacaaaaaaaaaaaauuaaaaaauuagccaggcgugauggugcaagccuguaguaccagcuacuggggaggcugagcugggaggaucacuugagcccaggaggucgaggcugcagugagcugugauugcaccacugcacucuagccuggguacugggugacacagugagauacuauuauaucucuaaaaauaaaaauaaacuuuuuaaaaaggagaugagccuaagguaaccaaagaaucagacacuguauaaagguuguuggaucuauuacuggagaaaguaaaacuauauacaaaauaucacuacaucuuagacucuguccuguccccuguucugauuagucaaauuggcuguggcuuuucugaggacauagcccucuucuggcauucuaauccccuaauccuacacauauaaucacaaguaggaggaacgauggcaccuuauauuggaacagcuuugagagaucagaaaacacagacaugauuauacacguuuuacuuacaacaaaguaaaguuccuuauuuuuaaauguuuugaaaacugguaauccauauaugggacauagguuacuuucuaaaaacccauacaaccaccaagaaaaaaaauucucucugguuuaacaauuucuuuaauacgccauaggaaucuguggcccagggagcuggaagaguggaauguucuagucaugggacaaaugaaagaugggaaagaaguuucaagcaaggaaacuuaaaaaucugaacccuuuccucucaccaaggggauaucacacaaauuacccaagcaaauacaacuaacaguucucaaauggccccauucuaagcacuguacauauauauuaacccauuuaacccucacaacaaccucacgggggagcaacuacuauuauugccauuauacaggugaggagacugaagcacagccagagcugagcccugaaguuaggcuguugaaacuccaaacuccacaagcuaaacuacaauauacuguaggagagaagagaaguccugaaauaccacaguguccuuucuuaugauggaccuaauaaauugaacaaaugucuucuuaauauauuagguaaaacacaguaugggcauugugugacacaaacugaucucaagauucugaaacccaaccagucauuaacuaugaaaauacaucuccaggccaagcuaggcugggcccgguggcucacaccuguaaucccagcacuuugggaggccgaggcgggcagaucaccugaagucaggaguucuaucagccuggccaacauggugauacuccgucucuacuaaaaauacaaaaauuagccagguaugguggugcaugccuguaaucccagcuacuugggaggcugagacaugagaaucacuugaaccaggagguggagguugcagugagccaaggucgugccauugcacuccagucuggguaacagagcgagacccugccucaaaaaaaagaaaaagaaaauacaucuccagagaucugaguccacuguauuucucacguuggagagaaagggaauaucauucacuucuauuucuguguccuuuccaaaugcaacuguagccucgccagcaccagcgagcuggcccugcagaacugugcccuccccaagccccaacccuaccagacaaacugaauccagacuggugcagguuccggacagguggggccugcugcuuggcaggagacgucuuggccgaggaggcuggagugacugucuugggcgucacagacacuucacacacagguccgucauacaggccacgaggaaccccucucagcucagccagcugcaaaacacaagaguccccccagcucaggccacagccacagaggauaccucucuagaaacccuccuggagggaggaugggccugugagaucuagggauggagggcucuccuuacagacagguggacagguguuguguggggccagcucccaccaugccaggccaaaacuccccacaagguccaguaacugguuaacucuacaaaaacuaacacaccuuacaauuuuucccccaagacacuucaacuuuaaacccuguaagaauccccuaagcaugcugugaggcggaucugguaucauguucaagaucuggccccaaacuuucuuuccaauugcauucucuccuuuuaauucccuuauagcuccaucucuuuccugcuucacaugcccugaauacacuguacauuuucuaugcucaugauacucuuaucaaauucccucaucucccuucuuugacuugacaaacuccuacuuaaccuucaaagcccaacucaaaauguccucuccccaugacacucuccccaacuacagcaguggcucccuccucuggguccuuacuccacacuccuuaucauagcauauaccaugaucucacuuugcuagggcucucuguggacacgacugacuccuucuccaguauuuuaaaugccaggaauaaaaaauucaggcucccucuuaucccuggaauccacuaaauucaucuuaauauucugucucaaggugcuuaauaaauguuuguggccuugaacuuaauucgugauuuaacaaaaaauucaucagaacaaaacuacucacccugcuccuugccuugauacgcuuguaaacaaaaucagggaagggcuuccggggaauguagcguccagagccuucggugacaugcagggugccguccuccaggacaaucuuccccuggcugaugaccaccaguggggagccgcggcacuccaugccuucaaagauguuguacucgagagacugagaagaaggcaaaguaaacucuagaacaggccacucuggcuggacucaauccacccggcagcacccacugccccaaccccacagagacaaaagagagacucagagacagggauccugucccaacugggcaccccagcaggcacuuacuugcugugucuccauuucccugucuagaauaugaaauaacuuuuucuaccucuccacauuagaaagaaaaauaauuaaacagaauaauugugugaaaagggugcauguuuguaaaugcuacacaaauauaaagaaaaugauucuuccuauuaacagagacuguguucccaccaucuccagcuccauuccgguugaauuccaaaggccuucucugaccaaguucuaaauuuaaucuugaaaugagccauccacaaguagguuuucccacuggcuagccugguuuucuagucuguuugcggugugguuaaacugaagucccuaaaugaaaggauuguggucacugaagagacaugccuccgauaaaaugauugagggcuaguuaauuuccagaacaauguagcuauguagcuauccuucugguuucaaguuuuuccggguaaaacagagacauaucugugugcccucuuggaaaauagguggggucuccauauggaugugaguuugugguugguaaugaagcaacagaacacaggagucauugcacaggagucauuccauccugcagcuucugcuaacccagugcuacuucccagaucccaaaugccucccgcuucuuccugccuguuugguucacggggaccaauggcuguggcugagucuggacuagaggauuaauagguugcuccaaccauaaaaagcacccugggcuucugggaaaguucagaccagguuaucagcacucagggagcuggccucugaacagagagcugugcuagcacccugcaguucaagaugacauuucugcuuagugcagcggcugguaacacggauucggccagcucagcagcucacaucaggcauguaaaugcacaaugccccgcauacaauguugggugaaaacaaccacgagggcugucaguacauugcucugagucucaaagcagucaugcagaagcuaccaaaggaaccauagcagagaggcgccagcagggagggaagaggacucugcacuuggauuacugagacccaagacuuaaaauugucuuucaucaauucuaagacacucaucccugaagucagaaugugucuuauagcagccggagccacgcggguacugccagccuagacuaaauccaaguucuucuagggggauauggguuuguuugugccacuggguugggggacaaccccacugagggcauuuuacaguaaauucucagcuugacauuguucuggaccacacaggcggcaugcauucagaccacaaggcuggacaagcacccacuuccaguuccaauucuugggggagacauuuuucccucuuggcaaccaaugccaaggucgaggccugcgagauuuucugccaccccugucugcacagcagauggucuccccagagaugccauaauaagcacacgcuggcccuugguggcccagucuccuaugagacuccucgucuugggcauguuuucuuucaucgugguacauaaccuaauggaauaucuuaaaaucgauggcaucucagauacgguaaaauccagaaguugugugacucuggggagauugcuuuaauccugucucagcuucaguuucuucaucugcacccucccgagguguaugugaagaugacaauacaaaaagccucaucccuggucaucucagaaacaaccuuugaaagggugugagucauccuuuaaggccuggaucaagagccaucucuuccacaucacuccacagcuaacaguuuaugcccugacaaccuccucuugugcccuacuggguagaguaugggcgcagccucggccauggagacaucugcccuggguucacaccccagguaugccauucaccagcuaugugacuuuggaugcaucccucacaccccugagccuccaccuccucaucugugagggguaaguaggucccccuuugcaggacucaugugagaaucaaaugaaauaaaaugaacaaaagcaucuagcucacuauuuggcucacaguaggcauuuagaaaaucuucacucauucacugucuggcucuuuauugcacuuugcuaacacuugccagcccugcagcauccaagaucucacacaaugcaugcguugagucuuguugcuuauaaaugagcaccuagaagaccucuggggccaucuaucauuuuuaaaagauggaagaaccagccccaugacucucagugacuuaacauugacaaguccaagggucagaucacaauucccagauacucagagccuacucuccaucaaaccaugaugcagggaggcuuccucacucaccaugcauagacauuuuuaaccuacauccacacaggcucccuaaaauuacucaucgggccagaugccuggaaaauccaagcaaaggcuuagcaacagggcugucgauaauaguuagcuagaugcucugaacuaaagcuaauuagccucaugguaggaaacacuguacuaugcagggaaagucuccugguugcauuuucccagaagaugaacgaacaggcacaugcuuagugcuggcucuuuaaaacagguggggauggaaaagcaccgcuuugaaagucaacauuucuuccauaggucaccuggagguaaaagcaggguagguuggggugaaaaugucuggagggcagaaucugucuucccaaaucuucucuccuucccacugucucgucuucuagguuaagaacuccaaaugcaaguuccccagcuaggucauuugugucuuaaauaacgagcccagccagccauuuauagcaccucugggggaagcaaccuugcaagagaggggaagcauuuuccccgucuaagccugaccaagaggcugcauaugcagucuggcagggaagaguccugaacaauuuuggguucuaauucuggcucaaccgcaaaaucgcuauguaacauuagacuggucacuuaagcucucuaagccuccguuuauuuauuuucccaaauugggauaauaauaccagucccuuuauugagaaggucaaaugaaagagucaaugagaaugugaaguuacaggcacaugaauagggagguucauggggcagggcccuaggaucccugaccauaaaauagccagucaggacacccaagaagucaugaucugggcuguaaggggcgcgaucauaaggcugcgcugccaggcugagccagugagugguggugggagagggagaaagacagcuuuaaacacagacuugaacagucuucugagaaacacccaccacccugguccucacagguggcagaagccagagcugagccugagcccauugcagcccaaacaccucugugugugcaaaugagagaggacugggacagggcaaagucccaggguugucccggagaaaugccagaaaccugcccuaagcugucguggugugugggggaggugucagugcuugcuggccugagcugucuucaagauucaaaugaguuccugacacgaaacucuucugcccgaggcccauuucuuuuccaaagcucucccucugggcauauuccuucaguuuuucugccuauaccauguugcuugugaggaaucggcagugucuaacaacucugcuuaaugucugcugaccucacagaaucacaggacacuuggagaccucgucugaaccccucacucucagcugaggagcguaagacauuaacagacuugcccuggguccuguuaacaagagaggacaucucuaagcucuaaagcccagacccagagggaagagauacccaaagcggcagauccuaaaacaacaaucaaauggcugggggguacuucuguuagggagaagucagucaaucaauuccuuuaagauaauaagaauggcugucauccaguuuucugcauggauacuggccugagaaaacaauggcuuaagaggaucaaaguccccagugggcaucucaggagaggacaucucacugcuucauugaggucccuugcaccaaguacugccaugagaagugcugugccaaccuaugaaaauggagcggugccugacuucuggaagcuuugcacauccugacaucacuuuagaggcucuaaaggucuauagauagagaggcugugguauuccaaaaugauuaugagaguaacaaucuuauugaccucacuaaagaaaaugaaauaacuauucuuuucccagcaaauugcaaaucauaacauccucagucgagcgcauucccaucacagcaaguucuuuuuagaaacccuggggcucucccuccgucugugucucugugacuguaauucguuuggauggggucugcacaguuaacaggucuuacgcuguugugugucuuggcagagaugguuuuaacgcugucggggucccagaugaccaggucggcaucggaucccacagcaaugcggccuuuccggggguaaagguugaagacuuuggcugcauuggugcuggucacagccacaaacugguucucauccaucuucccagugaccugagggagacagcauaggugugcacaggaggcacacagcagaaacgaguuaaaaaguuacuuuucaauaacaaacuauugauacacacgacagcuuagauggaugucaagagcguugugccaagugaaacacaaaccgucucaaaggucacacacuguaugacuccauuucuauaacauucuccaaauaacaaaaugguagagauggagaacagaugaggggcuagauggguucuuccaggguuagggaggguggaggggaggagcagcaagagguuggucucugaaaugcuggacuagaccugcaucuugauuguggugauggucacaugacuccacagguggccacacagccuagagcuauacccacacauugugacacugucaguguccugguuuugauauuguucuacauuuauauaagauguaaccaugagggaaacugggugaaggguacccgggaccucucucuguacuaucuuugcaacugcuucuuaaucuauaauuauuucaaaacaaaaaaaaauucguuuaauuugcagggguggcaaucccucuuuaggaaauaucauuuggcccaauuggcuguccuuuucaacaaaauacagccacagaucuaggcuuccuuuuuuuuuuuaaucuuuuuuuugagacagggucuugcugucauugaggcuagagugcaguagagugaucacagcucacugcagccucggccucucaggcucaagcaauccuccucuuucagccucuugaguagcugggaagacaggcaugcaccaccauaccaggcuaauuuuuuuuuaagagacagaucucacuauguugcccagcugggcucgaaguccugggcucaagcaacccucccaccucgcucucccaaagugcugggauuucaggcaugagccaccaugccuggccagaugucaucuucuagucuagccaaccuagaagucuccgccccacaucugguuuuaggugccaaucacauuuccucaagugcuuccccucccaaacccacucuaaauccaguaaaaaacuggucaaaggaaauaagcugguauuaagagggagaaaaaaguacaaauggccacuaagcauaggaaaaaauuuucacucuaaucaguaauugaauaaauuaaauguaaaacaauaagacacaaaauucaccuaucaaaucagcaaacaauggaucuuugcugaugacacccaggugguagaagacacuggggaaugacauauauuggugguggcguauaaagcaguacaaacuuucuggaaggaacuuugacaauauguaccaaaaauguuaaaaauauaugcauccuuugacccagcaaugccacuuguagaaauuucuccuacaaacauaaucaagaaugugucuauuauaaaaaugucauucaaguuaaaaaaaaaaaaaaaccagaaacaacauaaauguucaaccaaagacauaaauguggcugggcgugguggcucacaccuguaaucccagcacuuugggaggcugagguggguggaucaccugaggucaggaguuugagaccagcuuggccaacauggcaaaaccccgucucuacuaaaaauaccaaaauuagccgggcaugguggcaggcaccuguaaucccagcuacucaggaggcugaagcaagagaauugcgugaacccgggaggcggacguugcagugagccaagaucacgccauugcacuccagccuggggggaaagagugaaacugucucccccagccaaaaaaaaagaauuauaagugaguccuggccaggcaugguggcucacaucuguaaugccagcacuuugggaggucaaggcagguggaucaccugaggucaggaguuugagaccagccuggccaauauggugaaacccugucucuacuaaaaauacaaaaaucagcugggugugguggcacacgccuguaaucucagcuacucagggggcugaggcaggagaaucgcuugaacccgggagacggagguugcagugagcugagaucgcaccacugcacuccagagugagacuccaucucaaauaaauaaauaaauaaaugagucccaguuuagcacucacauggaagagucuguuauuauaaaucaacuuuuucaaguauauuuaagcagguggagauauuuccaugauaaaauuuuuuuuaaaaaagacuacaaaauaguauguaugaugccaauauuauuauuauuauuauuuuuugaaacagggucucacugugucccccagucuggaguucaguggcccagucauggcucacugcagccucaaccucccaaggcucaggugauccuccugccucccccacaccgaguagcugggacuacaggcaccugccaccaugccucacuaauuuuuguauuuuuaguagagacaggguuuugccauguugccagacuggucuugaacuccugggcucaaauaauucacccaccucggccucccaaaaugcugggauuauaggcaugaaccugggagugggcccagcuguaugaugccaauauuauuuacacacucacgcaugucacauauacaugugugugccuguguaguagcaaaaaauggaaagacauuugccaaaauguuaauugugguuauaucugaaacacagugacuuuuauuuacuuccuuauucuucuggaaauaaggauauauucuucauauaaucuaaacaauucacuaaaaaacagaaaaccuauucuguuaauauauuuuaaaacauuaaaaugaaaaagcccaaagauccucuaaaggucaguguauguucauagcaggccuacuggaagcuggcaguagaagacaugcuaaguccagagagcccuaaaagacacuuuuaaggaaauugagcccauuuccaagaguagacgaggauuaacugaguaagucaccugguugcuaaggaaguuuguuccugacugacccagagucacaucuaaagcuguguagguuuucagucuuuacuguuccauugaugauaaugauaagaaauauacagguaagccaggcgugguggcucacaccuguaaucccagcacuuugggaggccgaggcauugcuuaaacccgggaacucgagaccagccugggcaacauagugagacccccaucuccacaaaaaauaaaaaaaaaauuagccaggcaugguggucugagccugugguccuagcuacucaggagacugagaugggaggaucaccugagcccaggaguuugaggcuacagugagcuaugauuguaccacugcacuccagccuggugacagagcaagaccuugucugaaaaaaauuuaaaaauuguuuuaaaaagaaauauauauguaauauuuaggaagaaaugaccuauuagaagaggucuuagauuuccaacccucagaaauauugucauauaaguacuggcuucuaggauguccuccacugucugucauuucaaggccuccaugagccccauggcccccagaugaggaggacaaggaaggcugagagccaccaaggagugaggccaucgcuccuuaccacagccuugucccagaugacggacauccgcuccucagugccauuggugcccuccggaaucagggugaaguuguccuuuccuacagccuucugggcaguguuaaacgugcaaugggcacugcccgugaccuggaggucuccacugcaaagaaaaugcauaacguggugcugcagcuucgucaagaugcugugcgccuacaccuauuuggugggcugucucaugaauggcaucacaccaacccaaguggaguccuuuugacgccuccucucccuucuuggcuugacuuucaacauggcccagguuuuuauccagaauccccucccaaaauggugcuagaaugacaauucccuguacucauguagccaaccuaguuuggugaacaagggucucccaguuuuauggcugcucuuggccaccauguuguuuucgccuaacaggucagucuggucugaagaaagacagaaugugaagugugaacaagucgccaggacucaccaggacagcaaggaguugagaaagucuggagugguuggaucagggcucaaggguggggaggugacaaaggcagcagccuuggcccaguucuugcuccaguaaugggagccguccguucccaagcuggcagugaugggcucgccauacaccacaguuccugacaaacagaacacacaagguucaguccaacacaaugcagggggaagggaaccaccccuaugaggagccacugccugcccagcagcacccagugcacucacuaucccuuuauaggaaauaucaggcucaucucgcagaugaggaaacugagacuuggagaaauucaguaccucugccagccugucaugagcuccccaagauuccaccuucagccccugcucuucaaacaacacacccucccuauaggaucccagacauccugaaggcuucugucuccuacguugcugauuuucaauuccauuaaucuccugcucggaugguguccaggcauccggucccaggugccaucuggacuguucuuuaugcauggccuauggcaccucaaauuuaaccuuccuguucauucacacaaucuuuucacaauuccuagcccuucacagugucuagcucugacuaaaggucugcgggaggaaaucacacaugacaucaccagggcgaaguauuucagggcaaauacauaaccccccagauauccucaagagacagccuggaucccugagucacugccuggaagaagcuguccguuacagccaccaucuucacagcugacucugugagagagaaacaaacuggacauuaugccacugggauuucagaguuucuggaagccuagccuaacuauauuaaugcaauguccaagacaaacaucaacucccugaugcucagaucauguccucuucucuguccauucagauguaaaccagaaaguugagacucauguacauucgcugaaugccaauaccuuagugccuucaauacaaucguuccuuaaaucaggcccucaucaucucucgccagcucauuccaacagagccucccaauuggaccuuagauuuacguuugcucucccaaccccgcuuccuaccucuccauucauuccgcaugacacuuccagagugauccacuauaauauaaucuuuccauggcauucucuugcauaaaaucuuccaaaggagcccuucugcauucaaggacuuaaaagaaaauccuccucaccaaagcaucagaugcucuucacuacuggaagcugaucuccuccuuuaacaucguccaaaacacaacucgggucucacacccuucaccugagaaucccauccuccccuccagucauugcccaguucugaauuuuugacuuuccaccugauggagacaccuugaagaucauuuaccugccugcacauaguaggcacuccaaaaacguguguuaaauugauuaaauggucuaauauguuauuaauuaaaggcauccaagcuggaauuugaucccaggucagcugaauucaucucucacuagcuccccccagcacagggcuaacucccaccccacaacaaugcagccaagcuucucuacuuccccaaacacagggcccucaagggcaaacacaccacagucaggaauguguuuuccuuccucuccacagccuuuccgaaggccuuaucacuugaugauacaccacaacacccucccugucggccacucugagagcuggcucugcacagcugcccccuccugccucaggaauuucacaaaggacucgcuguucagcuggggagugcuggaggccacagcaggcagcucacuccaggccaccagcaaccacgcccccacccccagcaggagggaggacuccaaacccagggaaaccuccuccagaaggaagccccaaggaagaaaagggccagugcuaggugcucggaaggccuaggaggguccccuuggcuccuggccugcucaaagucucccaugcagaagcuggugcaaagagcuaucagguggcugcacaaaccacuccgguucaucccgaaguggaaaaacaccacauaaugagaaggccuuggccgcugccaaagaccuuuauaaaaugcaaauggcugggcaggacccagcagcagucaucaguucucaaaggaucucucuggcuccccgcuuuugguucaaggaucaaacagaucugguuaagcaaaacucuccugacccagccaggccuggaggucccgcuggccacaguccaucuaagcacaaaggugagggcuguguaagucacaggaaaacaagagaugcguggcccuaaaggcuuccugcuuuuguccacaugaagaaguucaugagagcagaggcacuuggagauaaagaauggcuggauagucucugaaaaucccuggacacacauaaacauuuuccugaguuuccuguaacuugccgacgcucauccucucccugugccugcuccucggcccugccucuagaaacuuaaguacaaggaggggcugguucuuggaaaguggccugaauaccauggggaugaaugcugcugaccacaggcuuaucucucccugcgaaacacaacucagcuugggguggggagcugcucuaugaggagcuggauuccccuucucucugugcacaggaauaucuaccucacuucaagagaaugaacuuggccuucugccucuagaaaacccaaaauggggucugagcucucaacgccacugcugagcagaaccugccucuuuagacaaaggcugaguggacuucugggccacagcuaagcaaagauagggacauucaggggcaggggcaguggaugccaggggagggauggagccauccugugguucauuucuacuuugcucuguucaacuucccucagggauucagagguccuugcugucuuuuggauuuucuuucuuucuuagcccagaaucagcgacaggaguuuagccaucauguuccaggccucuaccuccacaagaguaugaucuauacauagagucucugccucccauccccaguggucuggagcucccaacccagggcuccccuccugggucuauaaacauucacaggagggugcuguggaugcacuuccggagcucagccaggccacagacacccuugaacugcaugccagaaauaauuaccacuaauaauaauaaaccacgaaaugggcuuaauuggcccuucugcacuucucuaaauacacugcugaugcuaucugggugcccguuagaccuuugugauuuucuucuccagguaaagucuaaacugaaggaugugaccaagccagccucuggcaggcucucuauaaggccaagaacugcaggggaugggagcuggugcuuauuuacaaccagucuggggcccgugugcauucaugaagaauaaauggaaggcugcgguuuaaauaugcuugauagcucccagcucuggcagucauuucccauggacgagaagcaggagaacaaauccaaagugggaacugugggaaaucaguaucuguagcuccauaugcagccaccaaagcacagugaaaaccaacugggauggacagacagacagacaguuacacacgcucucaccauucuccuuugccuuuccaagaauuuaugccagacccuaacaaacagccuggggacugugcugucagguuuucguagcaagagugguucuagaagaacaucaucuuaaaaaugaguuuucugaauggguucugagguuucugaaauucguucucagaucugauuggguugaaaggcacuaaugauucuacguccaguaguaaaaagaggagaguacagggcaugaugggacaauagagacacagaaaauauuauuaaauacucccaaaggcuucuaagaggcaagguucuagguggguguguagcagauaccuuaaacauuuuuguaaaauuaacaaguauaacgagagugguugguugcuccuaauuguacuagacaaagugggggaaaaaagaagaaugaauucagggauucaaauucccagcucaagcaccacaugaaugaaucaaaaguuucuaugucugcccuuaugucccauagaugcagagcugagauggcugaaaaccagaaguaggaucucauccuggcaguggcugaauuacaaugcaaauugaauucccaaccuugcagaccaucugccguuaaaagugagggcauagauugggaaggaauucugccuuuggacuccgaugccaacaucagcucuuccuugguucuccagucuguggccugaucugcagauuucagacuugccauccccacaaucgugugaguugauuccuuaaauauaauucuuuaaaauaaaucuucccccuuucucuacuguccucucuccucucucaucccccuuuucuguucaagauugcaacaucaagcauaagcuuaacuaaggacucauccccaagcugaggugguccucacaggcccugcgaccaugugcuucucauaacguuugagucacuccuauugacccacaggacauaagaggucuuaucucaaauugagguucccaggguuuaauguccugaauguuucugcacccggguuaugggagaggggugaggaggaggacggaaaagaauguccaucagaugaggucaucaggcacugcccacggccaccacucacacauggaaggcaucagcagucaugcuggauuucacacauggacaaaauguggucagagggagcccauucuagagaagaaauccccacaaggggcccuccauggaaagagagguggccaggagccuggaaucaugguuucuaauucccacaggcuacaugaaccagggcaagauuuucaauuucugcauuucuacuucuuccaugaaaugagccuauuaaguugaucaaugucuaaguucuuuucaagaguaaaaaugcccccaggucgucugguccuggcucuguguucauugccucagcugccaaauuggguugaugacacaccacuccccggcugaacacgccauccugcugaacagccacagagcggcugauggaagcagcgugucucucagcgugucucucagggaaggcaggaugcagucgugcuggcucaagcaggcacgugaaaacaguucucauucguuucaccucauauccucacuuccccgaacuucucuugucuuagauucuggaccagcaggucuuggcuggggagguucauguggaucacuaagagaaggagacauuacuacuccucccagggcaggauuaucauuuuucaaagcucacauuuauagcaaaauuucgagucugcuuacgcagccugaccucucugagacucccuucugggcucaaccucuccugacuuguaccccuuuuguagccccgacuaccucccaaugugacuuuccacucagcauccuuccccugcaagucgaggagcuaacugugguugggaccauuuauuuuccugguacgcaggccuaaaguaucacaucaugaaaaugcauucaaugaauucagaaucucuccauucacagaggaagaaaugcagcaucagaaagggggcuguggcagugcacacacuugccucagggggccagaagaacccaccugaaguggacaaacaauucugagcagaaaacccuuguccagggucagcaggcaucuuuacucugcuuuccucgcaagcucaagguuagaccagccccuucauccuguagucacaauaacuggucacgcuucucaucuccaucuuuaccugcaauaucucauguacacaucaucaucacccugugagaugagucaugguuacuauccuccccuugcagauggcaaaaggacauguggagaugaugaggaagcacccagcaucacguggcugguguacaguggagcugggguuugauccaagaaugaauacugauccuggaggcaaacaauuaauacucccuuacagagcuuuccuucuuggucauuugggaauccuuguguguacauuacccauaucucugcugggugucaggccacuguuucaaucaggauucuuaaggaacuaagccccaacagacacaggucacaagcaucaccguauuaaaauaaucucaaagcaugaagguaagucagucaaacauuuacacggauauuuguggccucaaguuagaugccugacagucaagccccaauuccacuauacaugagcucugagcuucaguuuacucagcugcaaaguaaaacaaaauauaaaaauuccugccagggcugccucccaaaguugcuaggaaguuccagcaagaugggaaagagccuaagagccuaggaaguuagcuaggacuucucauuccugcucauuagcaccugaaugcacuggaaauuccuuucuggcagcucagguuugucuaaagcucaggcuuucacagauuaauggguaacaguuugaaugcaaaugccauccugggaaccauggugugggcacauuuggacucacacucagaaggcucuggaagggaacagacuaaaguccccuccuacugcucaccccauaagacacacagugugucaagguuauaaagacaauagggguggccaggugcaguggcucaugccuguaaucccaguauuuugggagaccgaggcgggcagaucaccugaggucaggaguuccagaccagccuggucaacauggugaaaccccgucucuacuaaaaauauaaaaauuagaugggugugaugggggggcgccuguaaucccagcaacuaaggaggcugaggcgggagaaucgcuugaguccaggaggcggagacugcagugagcugagauggcaccacugcacgccugccugggcgacagagugagacuccaucucaaaaauaaaauaaaauaaauuaaaaaaaacaacaacgggggcuaccaggcacugaguugggguaauagguccaaacugggcaccgcaacaacacacuccagcuccgcaacuccaccugagaagaacccugagggacagagaggaggaggccugcggcagggcuggcccacgacuccaccucccccaacuaaagucugggacauguaggaccccuccgucuucucauuuggacagguuugaauaugaaguaaacuuuagacaaggucucuauccaaaauuacguugaaauguuagccuaacucacguaucaucaucaucuagguacagcgcaguaguaaaauacagaaaauaagccgucucauucuuucccccuuucagacacuaugccaaccauccccacacuacgugggggcagcagugcuguggccggccuucuguacagaggcugauucccacaaaugcgcugccuucuugcaaaugcgugucuggguggcccaaggccaccgauuccaucgucauccacaauaucuccuagaaaacaacucaaagcucauucugaguagguuacauuauuuuaggugaaugcuuucuuauuucuaaaaggcaauuccuucaaggugccaggagaagacagaaaggcagcaaccauuugauguguagccuaaggacagaggccccaggagcacuccaaagaaccagggccaggagucgcuggguccgucuggaagucaucaucucugggacaagaugacucagucaucauugagcaauuuguuccagggcuugcagcaagucacccgccagugaaaaaaaucccacagcccaccuugauccauguggauugcaugaugcagggaaguagaaaccaagccauagaggucaaauggcucccuuccuaacagggaaagaaagacacagagagagaaugacagagggacugagaaagagucaaaugaaagauaaaaugaaacagaaaucaggaaagaagggaagagaaguggagacacagagauggagagaucccaacaggcaaaggggaggagggaacauaaaagggagaaaggaaggaagaaagaaggggacccuuuuauaauguucauuucagaucagccuaagauccaccaucaaaaugaacgacaugcccucaggcuuucuguacgaggagagaacucccaagcauaaaagaugcagugugauuaucgaaauucauguugucagcggugggugacaacagggcucagcugcauucaaaaugcaugaggugccucauggggcguccucuagaggaagcacuggaagcugcacuucaucaguuaguuacaguggacacccuaguaauaccagagacccagccccaguucagaaugcaucaagagaguuuaucaagcaccaaaacaucuggaugugauagugucuggggcaaaaugcauccccacaccccacaaagcugccuuacauaccccggcagaaaucacucccagccuuggaggggaggugcaugaugugaccaaggauucuggggcggauggaaacugacguaaucuguguaugugccuaguuuauuucaaccacaucaaaguaaguccagcucuugcacgggggcugggggacaugugccugcccaccccgccuuggcgugcacauggcuuuaaauagauacuaacaaggccgcagcaguggagcagaggaggaaacuggagcuccugccuugcccggcuguaauuagguuaaugccagaacauggugcaaguggcccacuuggcaugagggucuggaaaaggagcccucccuagugaggagccccccuccccuccaaaccuccccaccugccaucagccaguccggccacagcacucacccuucuuccgugccugggcgaugaccucagcagagcuuuugcucaucaccuuggugauauacagcgggcaguuggucugguuggcgauggugauggcacgauucacggcuucggccucgaccugcaaaacagcagcagagcaugagaauguggcucagcccaccccacgagccgcuaccuuuauccuccaccccagagagaggcuaagaugaaggcgaggcugcuggucuccaagguccuaccccaggggacaauucaaaggaguaugacuugccuugugucucucaacauugguuugguugaacuaauucccuccuguggcuggacacaguggcucaugccuguaaucccagcacuuugggaggcugaggcagguggauuaccugagaucaggaguucaagaccagccuggccaacauggugaaacuccguaucuacuacaaauacaauuaaaaaaaaaaaaaaaaaaaaagcugggcauggcagcaggugacuguaaucccagcuacuugggaguauaaggcaggagaaucacuugaacccagcaggcagagguggcaguaagcugagauugcaccaccauacuccaaccugggcaacaaagugagacuaagucucaaaagaaaaagaaaagaaaacucccuucugacccuucuccaggugcaggcagcaagccugugacaucagcacuggcccagagucuguaagaaaugcagauuuucuggcucugcccuggacuagaaacucacaggcuagaaacucugagggcgggacccagcaaugugggugauuuucacacuuacuaacguuugagaaccgccacacacagacacugauugcucucaauuccauauauucauucugcucccagggucuugagucaagauauucagugauguggaguuugugcugggcucccauuaaaugcucaugaaugaagucagcaucacccacgaaacaaugcagccucacagggcucuaggaacggagugggccccguuugucuacaccaauggcccccugugugugaagcacagacauggccagccacagccugguacgaccuucagcacaagauugaagaacugcuugaguaaauaaucuggcgcuuuaaaucggauguuccagucagugugguggcucacaccuguaaucccagcacuuugggaggcugaggaguguggaucaccugaggucaggaguucgagaccagccugaccaacauggugaaacucugucucuauuaaaaauuaaaaaaaaaaaaaauuagccaggcaugguggcgcaugccuguaauuccaacuacucaggaggcugaggcaggagaaucgcuggaacccaggaggcggagguugcagugagcugagauggcgccacugcacuccagacugggugacagcgagagacuucaucucauaaauaaauaaauacaucggauguucagaugaaugauauuucaaaucccacaugaugacuguggaauaucugaucaggcaagacucccuggaucaaguucuauccuacagaggaaucaccaaucagcaagggaaggagcaggugaaauuguggaaggcagaucucagaacaucacuggcucccucuccaucccagcaaaagggcucuggcuugaacucuuggaggggagggacuggggcuuacucacugcuuaguaucuuccaugcccugcccccaauagcucccaauguccugucugauacacagcaggugcucaaaaauguuugcuaagcauauaaaugauuucauuuuauguucaugguauuucagucuaggcugcuccacagaacacuguuauuuuucacaagaaauaacugagccccuauaacugaauugguuaccuugucuccaccagagcuuggccaaaagauuaaauucuguaauugcauuaacugguaaucuaauuuagcagagcugagacaacuucauucacauuuggccuuucaggcaucaacuaugugaaaagggaugucuagaaauccacaauccaagcaaagggcucuugaaaaagcauauuaaacacccaaauguuuuucauuccuaagacagcugaaggagaagcccucucucuccacuuacagcagagaugccuguggcccggcagcaccaggcggggacagggacgucuugcaugggugugaagugugagauggacuccacuagaacccucagcaccucccagagauacaggugacuacuccauuuauugucccaacacgggguuucgccauguugcccagguuggucuugaacuccugggcucaagcaaucuucccaccucggccucccaaagugcugggaugacagguacaagccacuacgccuaucuucugauuuuaaugaugagguaacucagaaagggaaaugaccuguccagggacacagagcagugucaggacaucugucauucuacaaggccugcuggaaagugcccgucccugugaaggguucuucauuauccucaucuccaaguccccacucucuucccagacaucagucuuacagcucagagccacugucaaauucuaucucuacacucacuuucugucuaccucuuucuccucgccuuguccacagucccuucagaaaggaucacuuucuuaucuguuuugcauccccacaaugccaggcacugcccggauugucacgcaggcucagucgccacuccucucagccacagaugguucaguuccagaugucugcacucccuaguguccuuuccaauccucuggguggaaaacgagggaaaauccuacuggguggucucacaugguggguugggaagaaaggccuaguggguuaggaacauguuuuggaaaguucaaauccaagagaaccaucaugcuagugauggauaggucaccaaacuacagagaaguuacacugggauguguuucauuccaucagcagcaccuccccaaguagacugggaagcuaaaauucacacaaaauuguuccauacuuguucucuuuaucacccacacaggguuuaacacacaacagaucccucuugacaaacucaccaugagaggagacgucagccggcaggugccugugggcuugaguucuaaucacgcucugccacuauccaagccuuucaaacccccugcauccccccuccucgccucacugggcugucauauggcuaaaaggacucagggccuggcauacaagaggggccucuaaaucagcugaaaaacugcaucccauacuggugcaucccuggaucugccagcccucaaggagacuccauaaucaguugcuggggauucugaaguucucagggcaacagcugcugggccuaaucacguaaaaaugguuucaauuucucugguugaaauagcaaugacaugguuuggcucuguguccccacccaaaucucaucucaaauuguaauccacacauguugaaggagggaccuguaggaggugacuggauuauggggaagguuucccccaugcagaucuugugauaaugagugaguucucacgagaucugaugguuuaaaaguggcaguuugccuucugcucacucgcucucuugccgccacauaagacggaaccugcuuccccuucaccuuccaccaugauuauaaguuuccugaggccuccccagccaugcagaacuguaagucaauuaaaucucuuuucuuuauaaauuacccagucucacguauuucuuuacaguaguaugaaaauggaugaauacaagcaaccagaauaacaacucucugagagcauuuuccucuucagcaaagccagggcccuuucuuucuguguuuguguacuucucugcagaaagcaggagaaagaaggaaugcaagccccucagaaggcucuaaaacuugaagagugagggucucagcaggagccucauguagcauuugcagaaguggcauuugcuuuucucagaggacaucuucucaccuccuuguacagcugguacauggcaggcagagggacuggcucccagucaccaaacgggaggaaagcaggaggaaacuuucuaauaaagcccagguccagguguggcuuuaagcugaguauguguacacugcgggagggguugggguagcaggcaggacccugcacuuucuagcucucugcuuugauaacugggcagucacuuaacuucaugcuucuggaguguccucaucuaaagagagauaaccaaggagcccacugcagcacagcucugguaccaccacucaugggcaguagaauguaaauggugcucccugaauacagccaugcagccugcaugaauggcaucccuggaguugugggaaggagauguuguaccuccugcacaggacaguuacaaaacugaaaugugggccaggaacacaguguccagcacacgugagcacuaaaugaaggcagcuuugaacagggcucacgugagaacugugucagcccuccaccucucccggacucugugcauuuccaaggcccaaucccaagacuguuucagggcggaacaaagcccugggaacaaagcccugggaacaaagcccaauuccagggaggucagggcugagagcaaccauggcuuaugcugccaugguuuaaaccacccgacagguggauccuggggaaucuggcgagggcagucacagaagccggcccagagggagaagugaaaccacagaaacgaacccuugcggugucugcaaagggggauggugccugcauaggugugugcaagcgcauaugugcaugugugugugaaaauguguguguacaccuaugcgugucugugcuuguacauguguauauguguaugugaaaauacguggguacaacacauaugugcgugucugugccugugcacaugugcguaugcuaaaaugugucuguguguguacacgugcaugucugugccuauggacguguguguauguauaugugugugaacgugagugugugcacgugugugugcuugugcacguggaucugugugcacacaaaugugcauaaaaucagccucggccgggcgcgguggcucacgccuguaaucccagcucucagggaggcuaagaggugggaggauagcuugagcccaggaguucgagaccugccugggcaauauagugagaccccguucuccagaaaaaggaaaaaaaauaaaauaaaauaaaauaaaaucagccucaggcauguuuauggucggcugaucuuagccugcucucgccugcaagcuguccccugcaaucacuguccaccagccacggucucagcauggggcuucccucagcugacacaggggcuugccugccucccucauccucgggccugugccaggccacccuuucagccuuuagcacgcaugagaagguugauagcuacaaaagggccugcaucccuggccugaagcaggaacgugcaauccugaaaaugucacggcuuccauucugucaucuggggagaggaaaauguccucagggccucaaaugcuacugaaagugucuuggagcaugcaguucuguguaucugccucugcauguguaugugucuguguaugucugugucugugucuguaugugucugugugucuauguguauguguguguguguaggugucuauggcugugucuagcugucugugugucuaugugucuguguguguuacuauguguaugcaugugugucuaugucuguugugugccuaccugucugcgugugccuaugucuguguguacaugugugucuaugugugcauaugcaugcagcaagaaggauagaacaaagcguggacccugacugugugcaaagcauuccgaguggcucccacucucgucuuucugccugucuugacuccuuucuccucuuccagccucaucccuuccccucaagucugaaaggaucccaaccacccccuccugcacccgaggcaguacacagauggugccuuugcuuccaagcccuccugaauccacuuccuuaucacagggaccggcuccccucccacacugguaugaacaugaccacaucccaaacucagggugguggcacggugcugacacucagugacucaguggccacagcccugcagggagcucuugccaagcuccucccucccaggcuucuggagccuccucacugucagccuccacucaggcccuuggugaucuucccccacugcucggcgccagucccuuuucugccacuuccucccaugaaggggaaauccuggugguucccuggagauucccugauugcacgcuucacucgaagcugcaggcugcucccuagucagggccccuagagccugacauccagccugucauuaaggaaccaacuucugaaaaguauuucacagccacaaauucuaacugaugaacacagguucuccauuaccuaagacgugugcacccucccuucgaacucacacaccucaccaagacggugagucuccaccuuugagccagcacaggccccugcucugaaucuucccuccauaauuuuaaaagauucugucuaccaaacucugcauaucaugugauauccugugcaggguuaccuuggaaaaacaauuccccacacgccuucuaggcauuuagaagagcuuuuccauccuuccaacuacguuuuggugaauuuugguaagauauuggagaccauaaguugugaaccacuaaaaucuacauugcaggaugccaaugaagaacuguuugugucuauacaagcaagggcuugaagaauuacagacagaaagaagaaucuucuggcgaaacaguccacaccaccuuacccucaggagcaaucuaacacuucacuuugccugcguagacagacagacacacacgugacccacagcuucucagaaagaccacagucagcaucagagaagcccccuucucaacaggcaggaagcagguucccugaggcucugcacagugcccaagggacacugauucacgcauuccgcuuggugaacauucaccuccucaggucggcucagcacaugucccucggggcccgugaugcccagauccaggauccucugcugcuccugcaauguuuagagaaagucaggcugugagggagaguggauuuugcacagcucugauggcagaggcccgggcaugcaguuauccgggcaagauggaaaauuaccacugccgaucguucugcccucaucccaagaccucaugaagagaaggguucacugcccuguucccagucccgccugagcaggauggaucaauuacagccucccaaaacccauucagcuguucccugggaugcugacgacuggugcauuugcaacccucagccacgguguaaaaugccugugugugacgugaggguucccguaccccacccaaggcagcugcguuacagcaccgagagaaauggccucucucugcaauaguaacugacuuagauguucuguggcacacacggagaggcacgugugucacuggcauucaugccaugggugagacugagcagagcuccagcaagggaacaccaggucccucugcuuuuccaccuugguguuaagcuacagaugcagcuucccuuucuugagccugccucucacccuccaggugaugaagaaaugacgaaaaagaaagcccuguaccucugcaaugaugucgccauuuucugcguggacuugggcuauggcgccaauaucccggaucacacucaguacuucauaaaucugagagagagacaagggugggaucagagacagggacuuccaucuuccuguucacaaagacaaucaucuccccaccagaggcauuucugggaugagaaacaggacaccuaggcgauucuauuagccugacuuuuuuugauaugaugagggcaauguuacuggccacauuugauggagaaagaccccucagaaauuaacagaggcaguacaacuuagcaggacguggaccgggagugagaagcucuugggugacaccuggcucugcaccagguuugcuaaggagguucugagugccgcucccacacacgccgugcggggcagagccucagauccagggcggcggaguggcagugcugggggccagggcacugcguucauacucucuuccaaggcucaguuacaucaguaacugcauccaccagccacuucccaggaagcuaggaaacaugcauacaucggagacugcuuucccaaacggccacagccugaagguaccaaaugucagggugccucuuccgaaaagccgacuuucuuaccuggcaauccguuagcuggaagcgaucuuugaaagccauguacacgaggaaggaauuuaccccuagugcggacaaaauagagaaguggacuuuuaauagauaaaccaaauaaccaaauaagggauaagaaagugauaauacugucuguguguguacguguguguguguguguguguguguguguguguguguguguuucaguacagagaaagagagaggagagaaauggagacacagaaugguaaaggaagcagaguaccauauaaauaaccugugaaugugggaggaagaggcacaaggaugcuuuuuaguauucuuauaaucuuccuguaaguuuacaaguauaucaaaauuaaaaguugccaguguuugcacauccauguucauagcagaauuauucacaauagccaaaagguggaagcaaaaaucaagccuccauuaacugauaaaugaauaaaccaaauguggucuauccauacaauggaauauuauucagccuuuaaaaaggaaagacacccugacacaugcuacaacauggagaaaccuuaaggacaucaugguaaaugaaauaagccaguugcaaaaggacaaauacuauaugauuccacuuguaugaggucccuagaagucaauuucacagacagaaaguacaacagcaguugccagggacuggggugaaggacaguggagaguuaguguuuaaugagugaguguagcguuuuaguuuugcaagauaaagagaccuguggauggaggguggugaugguugcaacaacauuaugaguguauuuuaaaacaaugaacugcacacacacuuaaaaaugguuaagaugguaacuugaauguuauauuuauuuuaccacaguuaauuuuuuaagcugccucuaccaaacaagucuguugcgacuguaacaagaaaaugaauuagaaguuucugccuaugaagaacugugauaaaugucuuuucuuuggcagacagacugccuuccaugcugauuuuuaagcaaaugauuuuuuaaguaagaaaagguccauuaguucaacaagcagaugucgcaauucucauccuggcgucuuggaguucuugccucccuaggcaccagaccaaacaucccugcccaacauucaucacaauuuuaaacaauuguccugacaaccucgcagccuuggaguuuaauucaagccaccuggggggugcugggagcugccugaguuaaaugccucuggacauccuggcccuucucccguugccaggcaacaguuaccaugguaacccuccugccugguuuggagcagauucagucuaaguauccacaguuaaaccacuuggagucuccgcaugaucaaaagugagaaaagucaaaguuuaccuauuuucuuuuauguggaagcuuugugcuggaaagaaucuuagaggacaucuaguccaagacccucauauaugagaaauguuuaaaaaacugagacccauaaaauuucagcaaauuacccagggucacacaguuagucuguggaagaucagagaaauaaacccaagacucuugcuuuucauuccggggcauuuucuaucauucuaguaccuagagauuucccucuugccaugucacucacagcacaugguguuucuaagccuggaaguccccagaacccuaaagcaauagguguuucccugaacacuaagauccagugaaguuaaucuggucucuagccaagcccagcgagacccaggaagaugauguggccuggcucuuccccgcaaacccccgagguucuuguugacaagagucccagaggcaccuugaggugguaaagauuccuccugccucucugugaaucuucccaaucccuggaaauuuguucuccaaaauaauucuagggaaaggaaaagcccucucagguugucacucaguuuugaagugucucauagcccucaaaucuauccuagauccauccagguuuguaggaaggggcugcccaacacucuccugagacugucaaauccucacugagauauguauuuguuaucuuuugaggguaaaucucucucucagcagccucaacuccccacccuggcuagagagcacggugcucacaaaccaauaagcugugagcagcugucaccuaagaacaggucccagcaguaagccucaucuucucuuaucaucaaugaaggcucauguuacugcacuggguaaggccaccuccaaacagcauaagcugcggcccaaagcccucucuccuucccaggggcaggcaugggcaugaggcacaaaugggaucuggaagcauuaucacuuucuucccagggcugugccaguugauggacugaagcggaaacaucugcagagggcauugacucagugcaaccuaccgugauccuucacaagcgcuuccaucuccuccuggaugcccuuaugccacucacugauguccacaugcagagaguagucacagcaggacuugcugucggcccauucccuccacuggucaaaggcagcgagcaggcuugucccaggcucaggaacaacguggucaacuagaaagaaacagacauaugucaucaucaccaagagccucaagggccgugggccagcagguauuuucccacuugaacccugaauaaggcuucuuggguucaaaaucgagauggugaucucuacaaccagcuucuaagaauccauguaacccagcugauuauccaagagggagaaagcagaaagcagaaacuuggcauuggaugaugucuccagcgaaaccacacaugcacugcccagaucugauuucccaaaaccccugaaagcucaagcuuugggugcauuucacggacaacgaguccuuauggacaauggcagugucaaauggccggggagcagccaaacccuucuuuguguugaaagcagcuuaugagacgccccccgccagacggcagggaacuugaaggugcuggagcagagccacacggaccgggccuuucaaaaguucccgggcauuaccugcucucucauuaccgcucacauuucugcagcauaauaccacuuuguaauuuaagggaaaucuuucaucuuaagaguucaaaguguuuuaaaacugcagucauuguuauauuacuauggagguacgcugaucuggaagacugaggacuuuggaugcaagcugacccgaguugguuuccuggcuccaucauucaccugcaugguguccugggguaaacuccuuaaucuccacugcccuaauuucugugcugcuuuaaaacggggauauuaccuagcacauacauuuguuaugaggauuaaaggagauagcauauccaucaaucuuaugucauucccugauuuaaauccuccaaugacuucccccugcucuucagauaaagauucaaguccccaguaagguuugcaaaaccccaaccaguguggcccuggccuaccucuauaacaugacccuggaccaccucucccuuguacccugcucuccagcuacacagaccguuuuucagcuccuaaaauaucuaccugcugccucccaccacagggacuuugcaccugcuauuaucucuccuaggucuugaagagcucucacccaguuaacaugauggcaggaggauuaccaggacuauuacuacccaucuucugcacacaagcacuaaaauacaaacugaaaugauuuguccaaggucaaaucaaacuugugcaacaauagaaauaaaaaccaggacugaacacuuaaagcaaugaauuauucuuccuaaauauuagauuuucuacacacagguaagcaguucugagcuaagaaaacaucaguccauguaaugcuagagagcucagauuucugaaaugguucaaaucuugcagauacugcuaaauucugaucaacugggcuuggauuuguauaugucagaaauauagccguugcacuuugggaggccaaggcagacagaucacaugaaucaagaguuugagaccagccuggccaacauggugaaacccuguaucuacuaaaaauacaaaaauuagcuggccauggugacacaugccuguagucccagcuacuugggaggcugaggcaggagaauugcuugagcccgggaggcagaaguugcagugagccaagauugugccgcugcacuccagccagggcaacagagcaaggccuugucucaagaaaaaaaaaaauauauauauacacacacacacacacacacauauacacacacacacacacacacacacauacaauauggccaucuaagcugaauuuucuuuugacaaaauuuacuuuuuuguaaguauuagugauuaguaaauaaauggguacacacauaucugguaucuguaauacagauaauguuaucuaauaaaaacaaaaaugauguccaguucaaaugcaagcuuauuccaucaguaaaaugcugauguagaaaaguugacaaaauaauuccaauuuuucuucuuaaguuguauguccccucaucaacacccaaaacaaaaauaaaagaaagaaagaaagaaagagagagagagggaaggaaggaaggaaggaaggaaggaaggaaggaaggaaggaaggaaggaaggaaggaaggaaggaaagaaagaaagaaagaaaaaaaagaaaagcauaaaaauaucacuguguagcaaucaguuugggcagaaucucccuacccacuccccuggcuucaucucuuguccuucuacaaaucacccuucagaagcagcuagaaggaucuuaaaccuuucaucaaacacugccauuccccuuauuaaauccuuuaguagcugucuaccauccuuagaguccaauucaaacucuuucucuuggccagucagauccgguccuaguugaucucuccaagguacucuuuaucccugaccugcucacccacaauggccaccccggccauucuucacuuugaccugcccaaccccugggcaacuccaagccugugcacaagcagcccucucucucucuggaaacccauuccccucgcucuugacuugggcaucuccucauccuucucacuggggcuauaugucaccaucccaggguggcaucguuucugaauccauuucacucauuuacucucugaccccugacuagaauguaaacucccucugagcagguacugaacgccuagaucagggaagagccaaaugaaugcucuaaauaagugauggaauauuuccuucuggcucucacauuccacuugcaaucaggucaagcagcaaaggaggggcucuccugggaaccggaccagcuuuugcugcggcaaagaccccuccccucaacacugcucugccagacccucacuuauggaaaugcauuccuuucacuggccagcaaagggaaugagcagaaauaauaauuuuuuucugaugauaugauucuuugaguagaaaauuucaaaaauacagaaaauuuuagggaaaguuaauaaucccauuaccaccaccaccccaaaaucaaccuauucaaauuuggguguauuuuuacugccuuuuuucuauauauuauaccuuauucuauuucuuuaucuauaguccacuuucuucccccaaaaaguuuuaaagugguuuauagagauacauaaaauacaagaaaaugugauaaaccagaaagaguaaugcaagauaaagcggaagaaaaauaaugguaaaauaaaaucaggaaagaggcauguauguauguguauguauguacguguguauuuauauguguauauguguauguaaaauauguguauguagauguggaugcaaguguguacauauguguguguuuguauagauaaauacuugacauuuagucuuauacauuggcuaaauuuagaguuaggcucucuagccaauguaaauaaggaagccugauagguuuaacauaucuauuuccuuuaagauuaaaaaaacaaaucccuccuaagaagaaggauaaguacuggugacacuaagacccacaugcucauaguuacugaauaauccuuuccuucuauugauucaugaugacuuuaaaaaauacuuuaucauuauuauuacuagauaacauaucuaauaauguuuuaaauucacucauacuuuacagagagacaauaccagguucuguuccugggcuauuuugcuccauucaucucaaucaguacuaaauagagcagcuuuuugauacauuuuaauaucugguggcaaaagaucacuugaggccaggaguucgagaccagccugggcaacaugaugaaaccucgucucuacuaaaaauacaaaauuaacugggugugguggcaggugccuguaaucccagcuacucaggaggcugaggcaggagaaucacuugaacccaggaggcggagguugcagugagcugagauugcaccacugcacuccagcuugggugacagagcaagagacugccucaaaaaaaaaggaaaaaaauaaaagcucauuuccuccacaagauuuucuucccuucuccuuaggccaaggcacucauucccauugcaaggcucaagcaagccaucuaaagccuuacaaccaucaccacaaucuagauuuagaacaucaccaaaaaagaaaggcuguacccaccugcagucacuccccauucccuccuagccugcuacucccagccccuggcaaccacuagucuacuuucugucuguuccacucacccuuagacaaaguggggagggugacagacaaggacaacuucaggcuggugacuggaaccaugacuccacaucccaaugaugugucgucagaucaucuggugcuagacuccucagacuucagggugcacaguaaugaucuccaguguuccuuaaaacacagguucuggccaggugcaguggcgcaugccuauaaucccagcacuuuggaaggcugaagcaagaggaacacuagagcccaggaguucaagaccagccugggcaacacagcaagacccugucucaaaaaaauaacauaaaaauaaaacacagguucccagaccuuaccccagaguuucugacgcugcagguccagacugggacccaguaaucugcauuucuacuaagcaacccgggagcuacugagucugccuugaacuaccuugagcaucauuaacugagugcaaaucuuuucccaaaacuucucccuccaccuccauucacugcucuccauuuaccacgaggggccuguuuacuacacaacagcaucaucacuuacaaaaaauagcauguucccuggcugcaaucccauggcuuccuugcauauccaaauucagcuccggggguuauaaacccuugaaaaacucaggacccggacacagcugagcacuuuggggaaauaaacaugcuuccuucaagagcucauaacacucagaaacguguccaugaaaugccuccaaauguuuucccacaguuuucuuuccacugaagcucuccugggaagagcugcuccaagggaauagggcagaaugucauacucacuuccggagggaguagaguccccacugaggacacaagccugaaaaugacuugcacagagcucacaggccuuuccucuggugaccucccugagcuaucggccccuccaagagggcagccuuggcaacccgacuauaccagcagugaaaagagaauaggcuugggggucaaggagcccccaaauucuaguuuuugcugcaguacucccuuacugugguuuagccuuuuggaaccuccauuucuuuuuucuuuucuuuuuuuucuuuugagauggcguuucacucuuguugcccaggcuggagugcaguggcgcgaucucagcucacugcaaccuccgccuccuggguucgagcaauucuccugccucagcguccugaguagcugggaucacaggcgcgcgccaucaugcccggcuaauuuuuguauuuuuuuuuuuuuuuuuuuuuugguagagaugggguuucaccauguuggccaggcugaucucgaauuccugaccucagauguuccucccaaccucggccucccaaagugcugggauuacaggcaugagccaccgcacccagccaggaaccuccauuuacucaucuauaaaaagauaggcaugagcuggguucagugacucacaccuguaaucucagcacuuugggaggcugaggugggcagauugcuucaggccaggaguucaagaccagccuggguaacauagugagaccccaacucuacaaaaaaaaaaaaaaaaaacauuacccgggcaugguguuaugugccuguagucgcagcuacucgggaggcuaaguggggaagaucacuugagcccaggaguuuggggaugcagugagcuaugacugcaccacugcacuucagcuugggcaacagauaaagacugucuauuaagaaaaaaaaaaaaggcguaaaaccacauaccaugcagggcugcaaaaaguuuacauaauaaagcguagguaaaagcaccuggcaaaaugccuggcacacacuggguguuccuucccucaagaugagugacuggaaacacccucauggucugcguggugggccugugaaucugguuuaugagagccaggaacaugccccaggacaguggccugaauuugcaaguuacaagcagucucugaaaaaggacuauuccucuuauuaugacuucuauuaaaacuaucaaaggacccuacuguuuuuuuuaacaguuuuauugagguauaauucacaugcuaugcaaucacucauuuaaaggguauaacccgguggcuuuuaguucacucacagagcuuuacaaccauugcaauaaucuaauuuuagaacaugacucaaaaaagaaaccugguacccacuuacagucacuccccauucccuccuaccccugcuacucccaaacccuggccaccaucaaucuacuucccgucuccauagauuuguuuauucaggacauuuccuaucaauggaaucauaaaagauguagucuugugcgucugucugcuuucacuuggcaucaugucgucaagguucauccaugcugcagcgagaaucagugcuuccuuccccuccugccucaagcgguucccuaauguucugcauuuuggauauuagcaaagugugagacacaaaguaaauaagcugcucccuaaaacuucaaagagaagacccguuuggaguuugccauauuuaaaugacccuacuuuuaauuuuuuuuucuuuuauccuuuuucuuuuguugagaaggcgucucgcucuggcacccaggcuggagugcaguagugcaaucacagcucacugcaguccugaucuccugggcucaagcaauccucccaccucauccucccaaauagcuaggaccacaggcgugcgccaccacacugucuaauuuuauuauuauuauuauguguagagacaauaggucucgcuaugcugcccaggcuggaacuuuuucuuuuuaaaacucacuauagacucacauggaguuuuaagaaaugacacagagagaaccuucauacccuucaccccguuucccccaaaggaaacaucuugccuaauuauaguacaauauuacagccagggagcgacacugauagagaacccaauaucaugaguuuuuaaagggcuaggcuggcaguauuucugacaaggucucaaggggcccuuuguaauuaaaaccagggaugucagaaacagcuucccugcaguuccaguucuggaauugaagcaguugagcagguaccacagucuguaagucagcuggggguuacgcacguggagcaggagggaggggagaggauguguaacccuccacccugcccucugaucccaucuugggauuacacacguggaauagaagggaggagggaggaugaggagccuucacucagccugugaucccaccuugggguuauacccauggagcaugagggaggagagaggucaccaagcccuccaaucccaccucaagguuacacccguggagcaggagggaagagggaggaugggagccaucacucagcccuccgaccccgccucggguacccgccagccccuugaagcaaggaggggcagaugcuaaaacuccuguugucagugcacacaccuuccccugcucccuggauauuuacucuaucagcacugcccaucuccaggaucuuauuccaaauagucacggccucauucuccagcaccauucccugcuuuucaaugugugugaaucagccucucccuuuuucaucucagauaaaugaaucgacuugaauuaaaagcaaaccaucagggaggcaguaacacaagccauccacuggcuuaucuauguggcuuucccgagcuggcaucuacccugcaaaaugcccugcaaaaugccaggugaccucaucaaccaggcagggaauggcuuuuuuugaaggagagauaagagccuuuguggguugugcuuggcaguuaggauaacgugguuuugcucugaaaaaaagggcauaaaaggaggagaaagcaccugccccugagaauuuaagggauacccacugaagaggcacuauuggaaagaccagagccagauaccugggguccaggucaguucuaccacuuccucaccaugugacuuuagacaagaaguucaaacucucagagcuucagauuccucagccaugaaaugggacuaauaauuaacucaggguuccaggguguuguaaacgagggaauaugggaaaugcuugaagagcaucugcuacauagaugugguuugauaaacacccccaggaagauaaagcuauguuccuuuguaagaaaaacgcccaugcauaaaacacuguguaguauuuaggugccuccaaagcacgugcugccuuacagggugaacuacuugccuuguacaaauauacuguuucucccgcaaugcuaaagaagcauuuuccuaagagcuggaacuauuuagaaugucugugccugaguuuuuucaucuuugaaacaguaaaaauaacauacaucccagcauuuuucaugaguguucaauaagaugguauuuguaagcuauaagaggcacuguucaaauaugaccaauugccaucuguguuuucuucugucuggaagaagcaagcagggggacugguauacagaaggugcucagugcacacaggacagaccaaacaucacaccugccucuagacaacuuuagccucuuccuccaagggagucauggaacuaugugacucaauauaccaaccugagaaccccagcauccacuggacacugaagucccaggaguacccagcucucccgucgguccucccugcagacucacagggccuggauuuuaaacucaagcccuccuaauggaugcggaggggccaggccaccuuugguuagcacacgccagugaaaugacuaacuguaacauaaguuuaagucacaaacauugaaaggugagagucauaguaaaaaccauucugauuuauucagcacuuccuaugugucugguacgacucuaaacaucuuccauggauucucucauuuaauccucgcaacggcccccugagcucugagccaggguuggcccuaguuuucagcugaacagacaguaagauuaaguaauccgcucacauuacuuaaaaugugccaggcagagggccugggccacagaagcugcgcaacagccacaccucccgugccucuggcagguaaggcucuuggcagaacucuggaugguggucaaccacguggccuuggccagugcagccacugacuggcagagcuggaaucugaccccagaacgugugaucaaaagagagcaagagggcuaguuaauugagaagugaaauucagucuuaucccuucauauauuauaacuaaagcaagugacccaauucaauaaacagauaggaaaaccguguccuuagccuaaggguggcaggcauauggaaacauguucuucacugcucggaccuucaggcacuugaguagcccucuccuuucucuuuccuacacuuuguucaauguaaguuugcuuuuaaaacuaaaccaguaucuucauauaaaucaaguggcaccaucggucauuguucagcaucuagaagcccugcuagaaugauuaugacuaacucugggggaaguguuaagccaagaucugguaaaacgcuuauaaaacaaacaaccuccuuuaagugaucuggugaucggccaacuuuggaggaaacaaagagguagaagauacaaacugugcccuuaaaaugccaacaauccaguuagggaaaacaaaaacucacuaaaagauacgaaagggauacggauaaaaugauccugaaggacccuccagcuaccgccuguccccaccccucucuucucaucgagcuauggagggagcugaauguugcugacgccccaccuucucgcucccauucccucuuggcccacugcacacuggcccccauccugccagugccuggaaccugucccugccacaucccaguucuguucccuuccugucuguccagcucccagacagcaaucuugcaaauuuacuucccaugucucagaagaaucuuccgcuggcucuucuuccuccacccucauuuucuuuauuuuuuaucuuuuauuuauuuuuuugagacagggucugguucugucacccaagccggaaugcuguggugcaaucuggcugaccgcagccuugauuuccaggacucaagcgauccucccaccucaaccucccgaguagcugggaccacaggcacgugccaccaugcccaguuaauuuuuaauuuuuuguagagaaagugucucccauguugcccaggcaggucucaaacuccugggcucaaaugauccuccuaccuuggccucccaaagugcugggguuauaggcaugagcuaccaugccccacccgcccucauauucaaugcucacuugggaggucugucccacucauuagauuccacucacacuccuaacaucuauucaaaaugucccaaguugggguucugaagagugcaacagcagggccuucccuggcuggcaggcauggggcuccugaucucucccucuccucugucauuuccucucuccuccuuccuggccagcccuucucccuuucuccugacuuccuuccucccguccgucagcauucagucuuccucaucacucacuggucaauggauauaaggagcaggacccucuuuagucucaggaaaaaccccaugguaugcagcugaagcaggcgggccucucuggugacuguaccugccaggaugggcacccacugcaggaagggagccacucauccugaagccuagagugggcaccuggagcugcccacaccugcagccugcaucccugcccacugcuuccuuccucauggccugggcccuggaaugaggaugucccuuccuuccaggcugcugggagaggacccugggaggccaggagucagagcuggagacuguggguagggaaggagaggcagggagcaggcagagagaaggcccagauuccaaacccacuguaauuucacauucugaagaugaugucgcagauguaucuugggcuuuucaucccauuuuccuggaugaacacaggcacaacccuagcuccccaccucagggaaacauauccaccucucuucagaaaguuucaaaaacaggaauggaacaguugaaucauuuuauaauuuccuacacguuugcauuuauugaauagcaauaauaucaaccucacauagacauaguguuuuuaagugauucacaaaguguuaucacguaccuuaucucaucugaugcucaaacaagguaggcaggacagguuuacgaucuuacaucacagaugcagagccuggaggccacgggacuugccugcugcugugcagacagaaugugggagcucaaaccccaaacugggagcacuuggcaccugccuccuucuacagcuuaaaccaccgccuccuucuaggcauuucuaugcauagcagucaccucaacgauccaucccuaaauccuuuucugucacuggaaacacaugcaauggguaacuuaagugaguaacuacugaccuuaaccuaaugugcaugagaaaaagccaauucagggcaucagauaaugagcucaagugauccacccgccucggccucccaaagugcugggauuacaggcgugagccaccacaccuggcccaugcucauuuuuaaucauggaguuuuuuucuuaauaccacauuaucuuagagucuuacuaauucaauuuuuaaugggagccauucuugcggagaaucuaccaucauuuccuuaacaauuucccuguggaagaaccuauagguuucuuccaaauuuccucuauuauacauaauguucuuaugaacauauucaugcaaauaacuuucccccuauuuuaaacgguuuucucuggagaguccuaggguugggaugacuggaugaacuaugguucuucauacagauggccacauuauguuccaaaugugucaccucuucacucugucaccagcaaugcaucaggaugucaccccagacagcgcugcuuuuuccauuuucuuugcuuacuaucugaggggguaaaacacaaagcucuuuucacucuaccaggcugucuguuucaaauaaaugucuaccuuccaagauccaacugggggacugaguccuacaugagagaucagaucaacuagccauacaaagaaguuacugacaauuuuacaaccacaugauuaaauggcucuggccaccaucuuaggucuggugcccucucaacccuucucccagcuucaucaaccugaggccuaagcgauucccagcccaggcugccuuguuaggcuaggcauccccgaaccaggccaggcagcagcagcaggucuggagccaggccccagccccaggcgccugagucccucuuuccggguccagggagaagcugugcuuugucucagcuccauguuuauguucacagacagacacuuaauaggaaaugccauccguaaagcaggaugacgaaaucguggccuggggggaaggcaaggagagccaacuugguuacaaugcaaagcuucaaacuucagguccaugcagaauuucuccaagagauguugaaauccuuggcucaguguggggcgacaucucuguuuccuguaauuagacaggcauucugcaucugaaaaaaggccacguuuacagcaccucauaucccuuccaccagugggagaaacacgaacuuggcuuccaguaagugugugguguuucauuucuggaauuccucuaggcuuuccaaagucccaagaagugacuucuccuggccccaccaccaccguguccuccagagaccucacaggcccucaagccugcuggcucucaaauacccagcucagacaagggggccucaacuccaccaucugaaaagcugggcugaaacauucucucacuaaugaaagaaaugcuagagagccaguagaaacugugcgugugagaacagcaagcacccagugauuccguaacuguccccugggaacuuucucggaacaaggacaggacagaaagccacaaggaaucuacuacagaugcucagggcuuuggcuccagagcucaccugucuggguagaauccuggcucuaccacugacuaguucuaggacccugggcaaaguacuuaacuccucagugccucaguuuccccaucugcaaaauagaaauggcaacagugccuacuucacuguauagggauuaaaaauaugaacuuuggagucagaaagccugaguuuacaccccagcucuaccauggcuagcuacagaaccuuaggacuccuuacccugucagggccucagguuucuuaucugugaaauggaccuaauaauaguaucuacucacagcauuguucugaaauaguaucuacgaacagcuaacaacaguagggccuacaaaaucguguguuaaauaguaaaaacauacuuuaggggugccuugaggagauaaaccugcugaacauaaucccugguacagaacuaguuuucuccaaguguucuagcaccuuccagugcuguuguggggagacgagaugcacccuucuaugccaggggagagcaggggggauaggcuaggacagaggauuccaaugaggaacagggcgugggaagggacuggauaaaggcgugauugagggaaggaggguggagggccccaggcauggaacuuugagucacucaucuagcuaagucuucugcaugaaacugcauacgacccaaacaaacaagacaaaucuguccuguucacacagcaagcaggcacuaauuguaacauaagaguaaaugcuagaaaaggaagaagcauagagacccucugucaacagacauaaacagacuuuucacaucccagggcagcccccaaauacaggacacugugauguaaacaaccuuccuaucaaauggacuguaucccaacagaauguaucaggaacaaaucaauucaucucucauucuaucaaaaaucaaaugcaaguaaaaccaccuaucagagcagauaacacaaacgaucccgcauuaacagacuucaugucaucccaaucaaaaggaaagaaaccugacgcuacaggcucuugcagaucccacgaaacaucacgacaguuacaucuccagcaggcuuugaaaaacugaaacucuucuuccaaaacccuuagggauaccaggagcccaggcugggguggacacccuagcuuuccccgucccuuucucaugugugugccugugugugugcacaugggugaguguguacguguguguaugcccaugugcaugugacagggaggaggugaggaaggauagcucccuacuucacuuccuggguuugaggaaaggcuguuuuaaggaaacagacacuucccaguuuugaccacaaagucugccagaaauaaauuccaggcgaugaacaaauuacagaaagagugcagagaaguaaugaguggcagggacccugggggcugggggacaagccagaggugcuuccuacaggggccagggucaacagucccugccuggccaggcugcacucuggggagcuccagcucagcgacggguggcagccggcagcguccagcccgaugagguggccagagaaacaugugaauaacgacacuuccucuguuugucucagcuuuugguugccuggggcuacgggaccacagauucagaguuggcuugccaaaaauaagagauuacagggcuguacagaacaucacaaaaaaauaacagucacgccacaagcuuccacgugcaaagacuggguuugacuucguuuuccuuccuguugguuccuugcugggaagggaauccaacuauaacuuaaggacuugcagcccccacagaagaacaucuacuuacauacacaacgugcagaacuaaaugcgccccaaaagccccaaagccauuguuaauaacaggaaagaacaaagagcaaaugaacggacagggucaugauuacuucuuacugaguucuacacacaaaccccaugauuugauuacaaaaauccuucuguacaaauauggguugaaauaaaugaggugaugcucaccccucuauuucaagacaucauuuaugggcagacaauacauaauaaagacaagagcaccucguucaaauaaaaacuagcguguacacagggugcucgucagcaaauggacacccacuccacccuuguacaaaagcugcagcaacagucccauuacauggaguaaaaaaacagauccgcuguuggauugaaacuaaacucagaaacacaaugagugaggagucgggucucuauucuguuuauuccaagguugcacaauucuugcauccccuccaaauaaagaccagcagggaaggaaaagucggugaugucaucuguugacugagaucgcucuaaagccaacauaauuugauggguguuuuccuccuaggaaccuggacugaauucaaaacauagcauaacaucugagucugaaccacggccauuguaccaucaugcgcuucucaucucgggcugagggcuaaugguucaaugggucuuuuuuguccccaguugauuaguaagacuaugaauaaaagccaauguaucugaacaauaagguuuaaggcugauaagggaccuguuguucagggagcuuuuaauuacucuuuauaacuguguggacagcugggaguccaggguccacacaaacucagcccagcaccaccguaacaaauguaaauacuuccucacagguauuuucucuucguccucaagaaugauguggguaagagauaacaguccagaugcaaaguaucccucaaagggaacuuuuguuuuuuauaaaacuccucuaaguacaaaaguacuucaaugccaaaacccuggaacaccagaaagaauggagaaaaaaaauaaaaucuuccaugacucauccaaucauccaaaaaaagucacuauuacuauguugauguaugucuagacaaucuuuuuccuaucuacuuauuauacacauauacacuuuuuacaaaaguagcaucauaauguuuuuauguuucaaaaagcuguuuuuuaaaaaaguaucaaaucagacauaaugaaaucauggucugcuuauuuccaucaauauacugugaacauggucauauuaauaaauauuuuccacaauuuuuuuuuuuuuuuuuuugagauggagucuugcucugucacccagguuggagugcaguggcgugaucuaggcucacugcaaccuccgccucccagguucaagcgauucuccugccucagccucuugaguagcuaggacuacaggugcgugccacuaugcccggcuaauuuuuuguuuuuaguagggacaggguuucaccguguuagccaggauggucucgaucuccugaccuugugauccgcccaccucagccucccaaaguguggggauuacaggcauuagccaccacacccagccgauuuuuuuuuuucuuuuugacacagggucuugcuuugugaaguucguggcaggaucauagcucacugcagccucaaccugccaggcucaagcaauccucccaccucagccuccuaaguagcugggacuacaggcacacaaaaccauguccagguaauuuucaaauuuuuuguagagacagggucucccuacgcuucccaggcuggucuugaauuucugggcucaagcaauccuuccaucucagccucccaaagugcugggauaacaggugugagccaucacgcccagccccacaaugauuuuuuuuuuuuuuuugagacagagucucacucuguugcccaggcuacagugcaguggcgcaaucucagcucacuguaaccuccaccucucagguucaagugauucuccugccucagccucccaaguagcuggaacuacaggcgugcaaccaugcccgguuaauuuuuguauuuuuaguagagaugggguuucaccauauuggccaggcuggucucgaacuccugaugucaggcaauucacccaccucagccucccaaagugcugggauaacaggcgugaggcaccacccggcccccaaaauaaauuuuaaugacuauauacuacuauuuucuagggauggccuuaauuuacuauaccagucaccaauuuucaucauucagcucauuuccuguuuuccucauuauaaauaaugcuacaaugaacauccuuagagcuaaauguuuacauauagauuacucuaggucaaggcguaugaauuuuuuuguuuacacauuuuuacagcucuuguuagauacugucugucuuauuacccuccagaaagggccaugccaauguaaauaccuauccgcaguuugaguguucauuuaaccacaaccuagccaacacuggguauuacaacuucuacuuauuuaacuccuuuauucuuccccccucagaauugacauuuauuaaguuuaucauauuugccugaaguauuauuuauauaaaagaaauuaaauaaaacagauaaaagugaauccuccaacauaguuucauuuuuuucagcuuacuuaaccccuuuuaauauuugaaaguuuaguagauaaaaacuuagcucagugaaacuucaauuuguauuucuuuuauuacucauucaguugaauauuuuuuauaguucaaugguggaauuauuuccuuuuugugaauaccuugcucauaccauuuaccuuuucuauuaaagcaugcuuuuuuuauuaaaauguuaaaauuucauauuuuaaaugcaucaacccuuuaucauauauugcaagucgaauguccuacuucguuauccuuuuauuauuaaacuguuaguaauguuuuuaauuacuauguagucaagcaucuccaucuuuucugauuucugccuuugcugaaauaucuaaauuauauggcuuuucaucuguauuuucuucuggucucuucugacuuuacuguuuaaauguaauucuuuaauccaucugggauauauuuugguauacgaacuaagguaagauguuuacuuugguuuucaaaauaguuaacuucuaauauaauacuaugaauauuuuacaauuuuaccaugagugugaaauguagccuuuuuuauauacuaaauaccuagauacaguuagucacauuugcagauuuucuacuuuaaccugcuuauauagcugucucuucuggagcuaguaccacacagcuuuaauuauuauauuuuuacaguuuguuuuaauaucuagccaguaguggucucccagccuuauucauuaugaccuuuuugaauauuuuuugguucuuaucaccuguuuaaucuuucaccuguacuuaagaaucauuuggucaaauggaaaacaaaacaaaaacucaaccaccuuuugagguuuucaauuuuaaaauuaaucuaaaguauacacuucuuuacaguauuggguuuuucuguucacuaacauagcauuucuuuuaauuuauuuaagacucuucuuggauuccauauauaagaauguauucuuauaauuccuaguaauuuuauauuuuauguugcuauuguguauggauuuuuuaaauuauguuuucugauugguuauuuaugacauacagggaagcuauuaauuuuuaauacauuauuuuuaagucagucaucuucauaaacuuucuucuuagaucaaauauuucuucauuuaauuccuuugaauggcuaaaguaaaccaucuaaaaauaguaauaaucacuuagggaggcugaggcaggcacuugaggucaggauuucaagaccagccuggccaacauggugaaaucccaucucuacuaaaaauauaaaaauuagcugggugugguagugggugcauguaauccuggcuacucuacuugagaggcugaggcaagagaaucacuugaacccgggagcuggagguugcagugagccgaguucacaccacugcacuccagccugggcaauaaaaaaaaauaguaauaaucuuauauuuucuccccauuauuauuacuucuuauuuuucguaucuuauuacacuggcuaacauauccggaaccauguuaaacaguagugauaacauguauucuggccccucccucaucagggagcaauauauugagguacuugaugggccagcccuggugcuccugcccaagucccauggccagggaccugauguuaaauggaaguucaggugacugggugacugauuuccgcacauuuacaaugcagaacauaacgccuuugagaaacauaaaagauacucucuacuaaagcagaccaaaugaugaccacgcuaacaauuucccaugguaaaugcaagacguggccaggcacaguggcucaagccuguaaucccagcacuuugggaggccgaggugggugaauaacuugaggucaggagaccagccuggccaacauggugaaaccccgucucuacuaaaaaaaaaugcaaaaauuagccaggugugguggcaugugccugcaaucccagcuacuugggaggcugaggcaggagaaucacuugaaccccggaggaggagagguggagguugcagugagccgagauagcaccaaugcacuccagccuacgugacagagcaagacucuugucucaaaaaaaaaaaaagcaagacuugacagggaguagguugagaugaagauagcuaacguccaacuuuucaucggcccugcagcaaagguauguucaaagcauaguggccauggagaccaguggcuaccuucccagcucugugcuuccucagccucucucaagaugaggcaggcagguucucacccauuccuuuaccuccucuuuccccagcuggggccacuacccccuccuccaggaagccuuccaggcccauccagauggaaacuggccacugggccuuuggaccuggcagaauacucauuggcuuucaccugcucccuggcaugacauuccaggacccaaucacaccucacuaugcaaauguggccaucugacuccucacccaaacuccacaaaagugccaaaaaggaccuccauuuaagaaccauaaacuacauuugaagagguauuuuuucauccaaauaguuaaaaguccuuuugcuuuaaaggguucacuuuucaggagaggcuagaaggggcccuucaggaugggacuuaauacugauuaugugccaggcaaugcucaguacuuuguaccuucaaucaaauuuaagcugcacaguaacccugaaauuauaugacaaaucagaaaacuguggugcagaauuaccguaugaugcggcaauuccauuuacgggcacacacccaagaguugaaggcagggacuugaauagauauuugcacacucauguucauagcagcauuauuuacaauagccaaaagguggaagcagcccauguaucuaucaaucaauggaugaauggauaaacagaauauggucuauauauacgaugaaauauuauccauaaaaaaaaggaaauucugacacaggcuaucacauaggugaacuuggggccauucugcaaugucauaagcauauauauuuacaugagguuccuagaacagucaaauccauagaaacaacuauaauagaauaggggccaccaggggcuagagaaaggugggaauggggaguuaguguuuaauggcaacaguuuagggaugaugaucaguuagggaugaugauaaaguucuggaaguggaccacggugaugacuguacaacaaugcgaauacacaaugccacugaacugcccacuuaauaauaguucgagugguaaaauuuguguuauguaugcuaccacuauaaaauaaagaagaaagagccgggcgcgguggcucacgccuguaaucccagcacucugggaggccaaggcaggcagaucacaaggucaggaguucgagaccagccuggccaauauggugaaaccccgucucuacuaaaaauacaaaaauuagccggguguggugguggacaccuguagucucagcuacucagaaggcugaggcaggagaaucgcuugaacccgggagguggagguuguagugagccaagaucgggccacugcacuccagccugggagauagagcgagacccugucucaaaaaaaauaauaaaaauaaaaacaaauaaauaaagaagaaagaaaacuguggcuccgagaaaugaaaagucacuugcccagcuagcaagccaugaagauagaacucaaacauccuauggucaaauccggagucuaaauucuaaaauacaccagacucaucuaccaaauucuucugcacacaucucucucuuggguggacacucccuucuccugcccaccccaugggugaaauccaccccaggguaaaauuugagccggcuuucaagggucagcucacauaggaccuauuggcugaagccucucuuggcucucccaggcagauuuuaaagauuucucuucucuguuccacuggaaccuuaguacagcaaucuucacauuucauuuucaucuuuucuuuguaggucuucccaauagacaagaaguuuuuugcaaagaggaccuuaucuguacuucuaaugcccagaucagcaccugccagauggccaauaaaugucagcugaauggaugaauggaugaauaaaugaauaaaugaacggaugaaggaaugaauaggugaaugaauaaacgaacaggguuuucuuagcagcagaaaccacaacacuaauucacuuuguuuaaacaaaccaaaggcugugauggugccaugaaggugaccacaugcuuucuccuugacaccccuccaucagcccacaucacugcagccucaggugucuagcauaauacucuccauucucagcucugggaggggccaucucaucgcuguuacauccaaaacauccaaaagcaaggacaaagucaccuugaauccagugcacuuaagggaaccacacuuaguguugcgggauuuaggaggacgagagagaucucggguugaaacaggagaauuuuuauauaaaauuaaaaaaaaauaaguuuuccuguauuaagcuaacuugucccaaaggcagcaaaggcauggcccagacccaaaaaagucuuaauaauauuaucuaauacgcuccuaaaaacucucgcagcacucccucaacauaaaaaaaaaaaaaaaaaaaaauuuccuuuguuuuauaaaauuuauaaauuccuguucucuauaacuaguaacuucaaguauucuguuuuaucuaaaaaauacaacaaaagucauaaaaagccuaaauaagccuaaacuacagcugccugggcaccauaauaaagguuauaaaauaagccuuugcccaggcaaaccuaaauaacaaacaucuagguugcuuggcaacagucauauacaauccugucuuuguccugccucaauaucccugcuuucgcaccacuaugagcuuauuucaagcuagcccacccccuuuuauaaaauauauauaaaugucaaguacugucuuuguuccaggcccagucuuuuaaacguaagucagcugggccugaguacacucaguaaaaauucuccuguuucaacccaaggucucucucguccuccuaaauccugcaacauuagcaccugaaguuccuauaagagagggcccaggcgcuguggcucacgccuauaaucccagcacuuugggaggccaagacgggcggaucacaaggucaggagauggagaccauccuggcuaaaacggugaaaccccaucucuacuaaaaauacaaaaaauuagccgggcauguuggcgggcaccuguagucccagcuacuugggaggcugaggcaggagaauggcgugaacccaggaggcggagcuugcagugagcugagauggcgccaccgcacuccagccugggggacagagcgagacucugucucaaaacaaaaaaaaacaaaaacaaaaacaaaaaaagagagggcccaggaacauacccagcaggauuaagugcuggccccggagccagaugaccaucaucugaguccucauucagccucauacuaguuggguaagucccucagccucucccuucugcgaugcucucauggguaaaguaggcgacauuucccacccuaucuuacagagugaggguauagcauccaaggagggagcagcugugagcaaugguuccugcaaacuacaaauguagaaggaaacuauucugauuccucugcccucuggagaucaggagggaaucuccaucagcggcaggaauggacuggcccuggagaugguccauaucauggcugagagugccuggaccccgcaggcugugugcugucagaagggugacacuggaggaagaggcuaacagggccucugccaaguucccuccccagcauggaaccaccuaucugcccaccccaucaggaagcagaaagaagaaggcucacaaaagggagcaaaacaggauuuacucucagccaugcggugagaucagagcaaaucucgaggagcggugccaggcucaagggaauggagguagccauuccagccagccacaaauggugagcccuagagggagggcucaaggguccucaguggggagagcuaagagggcugccuuucuggggaccccugguugcagguacucauucucaucucugcaaacaucuuugcacuugccacaccagaugagccagugcagaguagggaaaacacacccaaaccaaguucucacaucacaggucaagauaaaugugacuaggggucagugaaugaguacacgggccucaaaauaaagccuaaaauuaaagccacaaugacacagcaccuaacacccacucgcauggcuauaaucaaaacgacagacaauagcaaguguuggcaaggaugcgaagaaaccggggcccucccacacugcuggugggaguguaaaauagcacaaccacuuugggaaacagucugacuguugcucagaaaguuaaauauauuugccaguaacauggccaaaaaaaaaauuaaacauagaaugaccacaugaccccacaauuccacuccucgguauauacccaagagaacagaaaacacacgcccacgcaaaugcuugcccacaaauguacauuauucaugcacaauagccaaaacaguggacacaacccaaaugccauccaucgaugaaugggcaaacaaaauguggucuacucauaaauguaauauuauucgaccauaaaaagucaugaaguauugauacauauuacaacuuggauaaaccuugaaaacauuaugcuaagggaaagaagccagcuauaaaaggccacauauuguauuauuccauuuauaugaaauguccagaacaggcaacgcuauagaaauguagugguugccaugggcuaggggugcaaggggagagguggggaauggggagcagcugauaauugguaggguuucuuuuuggggugguaagaauguucugauauuagaugguagugaugcuuccacaauucugugaauauacuaaaaagcacugaguuauacacuuucagagagugaaucugaggguauacaaaucauaucuaaauuuuuuuaagauuuuuuauuuuuauuuauuuauuuuuuugagacagggucuugcucuauuacccaugcuggagugcaguaguagaaucaaaaauuuuuagagucaguauacucauguaagcuaacauaaaugagaaagagagagagcgagagaaagaaaggaaaggaggaagugggaaggggaaaagaggggagaggaguggagggaggggaggggaggggagggagauacucuuacucagaaauuuucuuucuuugaaaaucccuuaugacauuucuaagaagaagcaagaauagugugaccuuugcaaauuaccuuaaagacaaagaggagaagaaagagccaagcuaauacaugaagagggaaaacaaccagaaaaaaugacauuucagacacaaucauggacagaaauccuacaagucaguaggggccaccuuuaccugccagggggaccacaaaaauaggggauuucugucaagaaggcaggaauguucagcagaacacagcuucugaaucaucugacucucucagaaccaagacaaaacaguucaaaugccuacaagccacaggacccaggaaauaccgcagaguggacacuuucccccucuacauaaaagaaccuauuucuuuucuaugcaucagcuucuccaguccaucuuucauuaaaaggacuugccauggaaugaaaacucauauuucaggacuaagauggacaacaggccuucuccagcucuucucugaaaagugagcuuuucgguagagaacgagcuuccuucacaagaagggcacucccgcugggugugagccaaacgcacaugcacgacacuugcgcagcuaagaauacgcacaguggggaaaaggcacagaagcagcccccguccugcccgagugccacaucccuuucugggcuuucauucccccacccccaccgccugcaaaaugaaagaaagauugcaauaaacaagguguaagucucaaaccugcucuucaccuggagcuuguaaucaggugucaggcucccauccacccacaaggaacagagagauuuugguguugaagcuucaaccugcccugcgagccaaucuuuauuucaaaguacuuugugcuguaagcuaacgggaaaaaaugaucaaaugccucaaaucucccguaagcagggacugugccuggggggaaaggugcucaccaaggugggggcacaucgggugucuccuggugcuuucugcuggcacuaacauucuaaaacaugaagcauuaaguacagcaacauggaucuuccuuuuuuaacauggaaaauacguuuucauagagcaggagggaaaagaacucucuaaaaaacagagcugaauaggcuuagcaagaaaagaaauucaggagauggagaggaggagcucuaaaacauccacaaaaaaauaaaccauuucauagcaaugcugaccauuuuaauugauucucgacgacagaagaacacaagaaaagguagaugauguaaugcgauggcugcugaaggcaaaagucacaaaacaaauuuagcccuucgaauaccacaguagccacgggucaauauaaaaagcuucaacggucaggagcaaaacuggggugaaggggcuacucccccauacauguaauuuguccaagcccugccauagccaccaccucccuggauccucaaagcaacccuauuaugcaagacaugcugauccaggugcaucugacgauucagaaaaccaggaccaagccguggggcaccgagccugagcuaauaagcagcagagucgacccuggcacgaaggucucccagcuccaugaagaugcaucaucaagaagguugggccucaaauucuuuccauuacacuucauguuucucccuggauuaucuccauaaaggagaaaaacaauacccagaacacaauuccaacucugagaaauugucugaucuuccuccuugucucugccccucaaaaaaaaaaaaaaaaaaaagaggccaggugcgguggcucuugccuguaaucccagcacuuugggaggccgaggcggguggaucacaaggucaggagaucgagaccauccuggcuaaaacagugaaaccccaucucuacuaaaaauacaaaauauuaguugggcgugguggcgggcgccuguagucccagcuacuugggaggcugaggcaggagaauggcgugaaccugggaggcggagcuugcagugagcugagaucaagccacugcauuccagccuaggcaacggagggagacucuguauccaaaaaaaaagaaaagaaaagaaaaaugccaucugcccgugguguuucccaagcagacaugggaggugcugagccuaaugaaccucauaaaagcccacgccaaagcgauucagagaaaugcaaaagaugagugccaggcaagggcaaggcaaccucggagcagccuacgugacagaaaucagcucaaucuggccccgcauggaagaaggcucccgggccucccagaagaaggauuaaguucaguugaugaaugcauggcaucaguuacuccucuugauugcucuccaaaucccccucugggaugcaaggggagaucuagggcaucaacccagggcuucuguaggagagaagagacacccaauauaccaccgucuuggugagcaucuuccaugcugggugcagccucccacuuaguaggagacguaugauaucugaucauuuucugccuauauauuacagaaaaaguacuuuuaaauaacagguggauggaagggcaggauaaaacuugaacaccaaaaucuuucuguucuuccaggauggauaggagcccuguaccugagggcaaacucaaggugggugcugugucugggauuguuguaaagcaccugucacaaggcugggcacaaagcagcuuucaugagcaggcugucuaacugcuacaaaacaaacguuccucucgcauucuaggauaugcaagggccauuggcccagagcuuggauuggaaucccagcccucgcacuugcaggcucuguggcuucaggcaagucauuucacuucucuggacugcucauuacuucauuuauaacaggaggauaagccuaucuaucuucgggguugauggaaggauuagaaaugguguaugcagggcuugcgucccacagauucccgauaaaugauaucaauuaucugcucccuccaaacuccucacuuucuucuaaccaucucuugugaaaaggacagaaucacacaacuccuacccaugacucccggcaggucuguggagagguccagagagcaacugcuagggucauccccuucccgagcucacuggaggacaagaggacucaacacguguccuuguguccuuuagagugacagaugccuggguuugccuaggacagcccugguuugcacugcuguccugcaaucauuuuuaguaggauauagaaguguauucguuuggacaagaaccuaaacguucauccuacaaagagggcugaagccccaucuaacugugcaaagugacacaacaacacgccaccaaugcugugcccaagcuguggcuuucugcccaguuuccauuuaaaacucugaagcuaaaguugcacuuccuccaaaagauuagguccucccucacugggcucagaguuagcuccaaaauaucugucaaggccucagggacaguuuccucauucaacucucuccuugcuuuaaggauggacccauccuaccugcuuuuucauccccugugauuucugcagcuaaugagcuaagguacuaaauaaauaaauaacaguaauuaaaaaaaaaacaaacucccagcugaagcaaaaaggcaugagauaugccuguccacacaaagaagcugcucgccucugccagaacuggcuaauaauggguccucccuuugcuuucaguucugcuggguccauacuaucccuugguuugacacuacaaaagaggaaggagccaccagccacacccggcuggagagaagagagcucugcccucugccaggccucucccacgcugcacugcugggcaugguaggcccuacaugacuaaaugcuuccuuagccgaaacacccacuggggaagaauuugucaccaauacuuccagcagcacgacccugcagcccugccuggaagcucagcaaacugcaaggcagcggggaagagggcagaggucugguucagcgaggaaugcaaccccccuagcagacaaugcaaggaauccaccaugaaaaacggaggggcuugaauucaacagcacagcaauggccacuuauaaaguuggccucauuugaaugccaaaaaaggcugaaaauucaaagauagcaagaguuauugauuugacgggcuguuuucugggaacacugcuuuacaucugcagggccagauguguugucaagaaaaucaggcuccaaauucuccagagauuauuuggaggaggaaaaaaaaaauagcgaaaaguaaaauuuuuauuuucuugcauaagaagucuucuuacaggauuauaagcccuauaagcuacauuauaccuuuuuuuuuaagauggggucucacugucucccagacugaagugcaguggcacaaucauagcucacugcacccucaaacucuggggcucaagcaauccuccuaccucagccucccaagcagcuaggacuacagguaugugucaccacgcccagcuaauuuuuuauuuuuauuuuuaguuauugauugauugauugauugauugauuuugguagagacaaggcuucacuuugcugcccaggcuggucuugaacuccuggcgccuucaagugauccucccaccucaaucucccaaagugcugggauuacaggcauaagucaccaugcccagccaauaagaaagcuucuuauacaucguuguuuuuccugcuauguucaaaacgcaaacucauguacauaggcuugaaguugaaacaauccuugagacuucuuccugaucucacuaagugacagugaagugagauaacccaucuggaaucagguggcaugcaacugcaucuuugguauaugaaagaugaacagaugaauggucaauugauagauuagauaaacaauagauauauacagauagauuagaaagaugauagauuaaugauagauuaggauaaguaaaacagauaagugauaaucaauagauauagagacgauggauuaaauagagaugauagaccauagguacagacagaugucauaucaagauagauauagaccagauagauauauaucaauauauagauagauuagauaaaugauagguagguagggaaauagauagaugguagauuugguagacgaucauuucguaagcuucuggaggccaccuggcuauagaauucaccuaucccaggucaugcuagauagauaaauauauauuaauagauagauagagauagaugauaaaaagauaaagauggauacagacaggugugagagagagagagagggagaucuuuucacacuuguuccaaaggugucacaaugauuacuuucaaauaguauggcacaaaaaaacucacuuuuuccauagucguaagacauaagaauugauugucuccacuuuacacauguggaaauagccaucuagaaacacauuaggaugaucacgcucagacagaaagcacuagaaagggaaguuaaacuuagaucugauucuuggagcgcucccauccuguccuguugaguuacuuacaaucccauccucugaagccugguccaauaaaccgugcccagcugugggagcggggcugggaaggaggugaauggcugccuuaagaguccaugauucuauguuauuaucaggcccuuuugauuuuugucucacaggcuccccacaaggaaagauuccaguccugaccuaucauuagagagugauuaggucauaaacacuacagauucaaccuaaagacaguaggguuuucucagggaaaccagcacagcagguggccacaggcuggggacagcaguccacauuccaguuccccucugcccccggcacccacccugucccaccagccagcccugcucuugcucaucaccacuuacuccaaguccuaaccagugcccuuuuagggaauuagccaaguaaaaccuucccgaacaccaaggacagcaacugaaggaggaggcucuuucuggugacaauuagcucagccccuccaugguuaagcuucuggggagcaucuggcuguagacuccacccuggccagauagcaacagugugaucccacucccuucgugaagaggacaggacaaagcagggagcagagggcagcucuggguuucggaaaaucuuggcagacauucauucgguuucaacagaaguccaacuaucagaacaagcacugggauccaugauucuuaaucccagcuaucaccuugaggcuuucaaaacgaccaaugccaggcccaccuagaacaauuaagucagaaggucuggucucugcauuuuguuacaacuccccaggggauucuaaugugcagucaagguuuuuaaaccacugcccuaguucauugcaaaauucucuuaacuggacagcagccucagccaccgcgacccaacccccagcaacauccucucugucauuagggggaacacuuagucauauucaaagaaagcuaccucccaaauggguuaaccagaaagaacucuaauuucuacucacugucacuccccuuuaucauuaccauggcaguuaagacgcucuaaaagcaaggaauuuaagcaaauggcuucacccaacaaucacggagagucaaagacagaacccucaaaaccuaaagaaaucaguaaucacuucuuaagaagagagaaaggucagcuuggggaggaagaggaaaaaaaaagggagaaacagcccuuaaugggugacuuggggucagagccauggaugguuaagucagaaaacacaaaucccuuggccacccacagucaaucuucccuuuaaaacuaauguaccggccgggcacagugggacaugccuguaaucccagcacuuugggaggccgaggcggguggaucaccugaggucaggaguucgugaccagccugacuaacauggugaaaccccaucucuacuaaauacaaaaaaaauuagcugggcauguuggugcaugccuguaauccaagcuacuugagaggcugagacaggagaauggcuuguaccugggagguggagguugcagugagccaagacugcgccauugcacucuagccugggcaacaagagcaaaacuccgucuuaauaaaaaaaaaaaaacaaaaaaaaaaaaacuaauguaccaaacaggcacaguggcucacgccuguaaucccagcacuuugggaggccaaggcaggaggaucaacggaggccaagaguucaugaccagccugggcaacauagcaagaccccaucucuacuaacaaguaaaaaauuagccggguguaguggugcacaccuacagucccaacuacugggacaagaggauuguuucaaccuagaaguucaaagccgcagugagcuaugaucgcaacacugcacuacagccugggugauagagugagacaccguuucuaaaaaauaaauaaauaaaacucucugcaccauuaauuuuuuuaaaaagggcagaaugcucaccuauuaugggcugucauaaaaagcuaagaaaaccaacccaaaccuaggcagggaaaaugaaacaggugcucuacccugguuccugucuugaacagagagagggauauuaaacgaaacuacuaaaaacuuacagugugguuagguguuuucuuaagcgacuccguggguauaugccugcuuacuaaacacccuuuccccuacaacucaacacggaggcuacaccaggaccaaucgcauugcaagcuuugcaggggaggugggcagagggggaggcagugccaggauggguugguuuccauccugugcuuccccaagcucugggauucuccagaggcagaggggcugccauggggggaugacaaagagaaagcggagaggaucuggacucccccacagcccaccugccacccaccauuccaaccagagcaguucugcauucaucagucucauaucucagguggaggggguuccacgcaagguuucacaugagaaaggguugccccgggacaacaaugcuaaagcuaucaugaguagaaggaguaacgggucuggcucccaucagacucauugggcagcuucucuggcugcccccacagccagcuccaggcaugcaggggccuuaggaaaauggagaggccacgaucgcuguccucagaagucucugcccaacucacucagccaggacauaggacaagggcacacuuagacacaugugugucguggaagcuuucaucuagcaauaaggaacccugagacccgaccacugaaugccugacccucacauccaaaggucaggcagaacuugcuggagccuagcauucccaugggccccaccuccacucccgguuccagcugucaaucaggccagcaggaucgacaggaaguucccaauagucugugugacccagcuuuagggcaagucagagucuaggcucugggaaacccccagugcugugacucuccauguaaaacacccauaggcagaguaggaacugggaugagggcaccugaagggguggaagaucaccaccccagugagucaggcucauuuccagcacuguaacugccagcucccagggccaggugggggcaagaaacccugggacaguaugauaacugccacaauguccacgaaacagagucuagacacccacuuggggaugcccuugcuucuggaagggccuagaaguuccuaacccccacaggccuacccagccuaccuggcuagcccaacccaaugacucccuucacaagaaaagcauucgguaaagugugcgugcuggaccuuugggaagagcugugcugucucugaggaugcuccgccauccuuccccuguaccgcaccaggcauuaggagaucccuccgcucugcucagugccaggcauuagaucggcccaaacuaugccaaggggguggauggauucuuccaguccagccguucaaggccgagauucacgcagugacaccugaggguggauggauucuuccaguccagccguucaaggccgagauucacgcagugacaccugaggguggauggauucuuccaguccagccguucaaggccgagauucacgcagugacaccugaggguggauggauucuuccaguccagccguucaaggccgagauucacgcagugacaccugaggguggauggauucuuccaguccagccguucaaggccgagauucacgcagugacaccugaguggacccaggcucccggcaucugcuugcagagggcacccguguccuuaggagaaaugugugaccucaaccauguggagacugaggggacaaggggaggagcacagagaaccagcccacaccaauggcccauuggauaacguggcuuucuaaucgccaggccacaggcagauuuuguggcaacaacuuugguccuggacuuugaaacuugggucugauguggucgggcguuuuuguaaacacuuucuaacccgagucaaaugagugcugcaaagggaauaaucaaaguaucaauuacagacacauccauauuacagugugugcaugcguucacacguguguacucgccauaaggagggagcaacccacaugccacauggaugaacaaaugacaagccguggauguaccgcagugacauucaggagccacgucccuucaggaagccaccucaccuuccucccagcccuccugccuccauggggaggcucaguaggaagagccgggacaagcccaaggcacugggggaaugacugcuggguccacuguggugcugggaccaugugauuucuccauguugugacccucuguacuuggagagcaggcuuucucgcaagaggaccaaugagagagcugcuguucccacccucuucugaagaacagcccagacagagggagcugucccauccacaaccacaggccaugccugggcucucggcuuccucuuucugccacccucccccaccaugaccagaucugaccacagggacucagggagcuggggcugcagagggagccacugcugagcaagcgacagcuuccaucagggugaacacaguccacgucggauaccuaaacccuccucccuccuugugacacuaagucucuuggcaucacucagaggaagcaggauaucaaguaucgucaguguauucagucauucauucauucacucacucauucauucacccaugggcauuaacagagugccucugaggagugaggcugcccaggcggcaggaaauaggaaaauguaagagacagaggggccuugauugaaccacacgcaaggcugaaugccaccugggcugugggauaaaagcccaacguuugcgaagaggccacacagcagccacagaucacaggagaucagugaaugggaagcacccaggcugggccaccaagggugaugaagcuucuagaagcagggaaagaaagggagggcaucccuggcugagaugacaaugcaagucugggcuggggcagcaggaauaggccgcgucguggaggguucugacacuugggcugauucucugagcaagagggagucacugaaggcuucagaggaagaaggcggcacaaugaaagcugcaccagaaaaacagccuggcgagaggcaggaggugggggacagacaguaagacuccucagaggacagggccaaaauccaggaagaggugacaaaagucaaaucuguguggguaagggaaugagugcaagagguaacacagagaugaaagcaacucaaggcagcacgaggacaugaagaugcuaggaugacucugcagauaccgccagcacaaccuccagcgagcccucuccaggacugggcaccggaaaagcagcaaggagcagacagggaguccaacuggggacaguuggauggaggugccugaugcacauccagggagccacagccaggggagaagugacaaggcugguacucaggagggagggccccuuccagcccugcggcagcagcaccuccccuccuccucccugcuagaguccaguccccaucucugcugugcggugcuacccagggaccaggaagccugcuggguauguugugccugagggugcaccuccucuagagagagccuggaguucaggugagcagaaaugacauucagagcagugguucccaagcccuggagauccagagugugcagauccggcaugcaccccugaaagucaugcuuucaaaaagcuccccaagcaccagauucgaauacagagucacagaccccaccagcagauuugcuacuuuaaccagguaaggugggacccaggaaguguaauguuucaagaugccgcccccagaagcaacacacaaagcacacaguccgccagccacgccuagacagcgccugcucucagugaauacucaggucaagcccuacggcagcucagccuguuucuccggccaugcgggggagaguagagcucaguguacaagagaugggagggugucaguacccagcaaggauggaaugacaauagcuaccacaugggagugcucacuacugggcagaugcuguugugaugccaccacaguccaccuuugucaaaacuugccccauuuugcagaugaggccacugaggcugagagcaaagguggccccagggcaagcggugaggccagagcuacagguguauguuccacaccuggccaccugcaccgacgcacaggguaaguguuggcaagucgugucuguccuuccggccucagucuuccccucuauaaaauagagguaacuguucccagcugcuuccuagaaacucugagauccugaacucaaaugaccaugaaggcccugggaaguccguaggguuuuccccaagcagcaaugcggccgcccccgcaaccccucagccggucuggaugccgccugcaggguaugucugcagucucugcccacccaccacuggguggaaagggcaaagggcguucccccugcuccacacugaguccgccucauaaagaucucauugugugauucucaauagcaggcucuguuuaauggcaauaauauuaucuucugcugcugacaugccaucuccuuuuuuaaaccgagaauauuuggcuguguuuuccucuacaugcggcgccauuucagacagaaaggagucuccagggccugugaccugggaaacgcagagccagcagggaggcaggcgaggauuuacccgugagggcaggugacauggugacauggucuggagaaggccagaaagccaggaggguggagugcccaggggcgggguggcggggaguugggaggaagagggagauuuuuguaccaauucacuucaauuuuuuauuucagcaagcagcagugggccugugaaguuuucaaagugccccaggcauuucuuucuggacucaauauauuaagucaaagaaaguagcaggucuuaggugccaaugaaguggcauuaagcuauuucucuuugcaaggccuccuucucuguaaagcaaaucccagccacucacucacuuaaagcaaugcagaacgucuggucagcaaacagaaaaaggauaaaaauuccucaguuccucaccuguauuauuaccauucccucccccggggaaaggcaggcuaguagaaauucuacagaggucaguaaacauaggugguuauuugcaaaaguaguuaguacuuuucucaggcuauaaaagcaauggcauuugggggucacaaugcuaaccauacacugcccccucugaugacuuuuauuccuugagguucgcucauuggaugccccacucuauagccagaucgcaucacacagccuccgugcaaaugccauagcauucuggccaaggaagcagagcaggcggucagacuccucacuccccuuuccggaccaccugcccauaaggccaucugcugacucuucugagcucccugggccaggugcugcacucagagggggaugucccucgucccuaaacagaaggaacccaucuggaugaauggaaaaaaggccacagccucugagggggaagacgaaagagaaauucggggugguggcaagaaggugaugcuccugugguggggaagggaaggcaggaaagagucaaaaacaagaacaagagugggggccuaagcacggggcgagcguguggagggaagaggcagacccaggaaugcaggacaggagauggugggcugagggauucuuuccagcaagugugagagaaaacagggacuuucuguaucugcugagcaacauguacuugaugagaggcaaaaucucucugaguuucagugaaugaguuucagugaauggccaaauguagggggcuggaaaggacuuccagggucauguagcacaaaucccucacuggagacacacagcuagaacacagaguaggguagugacucaaggucacacggcaagucagugucagaagggggccagcacuccagacuccuaacuccuggcugggggcauuucccucuccaaugauagaugacacugaccauucacucgagaauuuuuuuguuuguuuuuuuuugagacggagucucacucuauugcucaggauagagugcaguggugcaaucucagcucccugcaaccuccgccucccagguucaaagauucuccugccucagccucccaaguagcugggacuccaggagcaugccaccaugccuagcuaauuuuuguauuuguaguagauucgccauauuggccaggcuagucucaaauuccugaccucaagugauccacccaccucaggcucccaaagugcuggaauuacaggcaugaaccauggugcccagccagagaaauauuguuuuuaauggcuuauugacugucugugaccaauccaggggccugcagggucucccugugaacuccaaacugaggcagaugaucacccugacuuggccuucccggcugacacccgaauagucuaagcuucuccaaguucaaguguuucuccacaguccgcccuggaggagaggcagaaacgcccacaggugccagugauuccccagcaaaugacaaggugcaggcucugcucucccuaggugugcaugaaaucuccccccgacaucccuggaaaauggcacccacuagguuaaagggcaacauguacagcaagacacaagucgcaaggcuuacacuuggaggcuuuucucaguggugccaagaaagcugaaacaggagagagcuguuccugaugcuucagacccugagggccaggacagagagaacgccagaggaugaguugugauuuaaaaugcggggcaacucagacuaggaggggauggcagggcaacauuccucuagcucaggcaagauagaaaagaagcuuccagauagaccccaaagccacaagcaaaaagaccaccacucggaaaaauaaccaguaagaaagguuuuucuauagcagaaacagcuaaguucuuucuacuuagacccucuucugaacugaacugcuaucuuuucauauaugacagacuccacguugacugucacucuuggaugcaaucuguuuuuuaaaauauguaucugacgggccacuaugcagcuugcccaccuccucaaaaacaaaaugacauuuuucaaaaggacaaucagugggcaugcuggaaucuagcaguucacaagcaaacucuuaauauuaugugugcugugucacagugcugugaauacaguucagauuuaguuaaacaaaaagcacaaagcggccaggcacgguggcucaugccuguaaucccagcacuuugggaggccgaggcaggcagaucaccugagguggggaguucgagaccagccugacuaacauggaagacccccgucucuacuaaaaauacaaaauuagccaagcgugggggugcaugccuguagucccggcuacucggguggcugagccaggagaaucacuugaaccggggaggcagagguugcagugagcccagauugcaccauugcacuccagccugggcaacaagagagaaacucugucucaaaaaaaaaaaaaaaaaaaaaaagcacaaagcccuuggagcaauacguaaggggcacccagcugugggugucagcaauuuucauaucuaaaagacaauuaccugugggucccccuccagacagggcugcccaauuccuuuuauguuaaacucagccuagagaguaucgucuccauuugauuuucauaucagaggaacaggaguuccugcuucagcauuucauuuguugcagcccauccucauucuaaaaagaagcacucuuaggaauuuuucugaaaaucucaaucaaauacuuaugcucaauggcuuaaaguugguggcauugaagaugacuucaaaugccguguuuucaaaaccaaaucacauucuagggucaaggaagacaaaaguccacauggagagaaagcaagaagucauucaucuuaccaaacuccuuagaaccauauucucuaguucaaugggagaacuuaaaauuugacagaaaaugagcauaaauaaauaagacaaaugguuaacacauccucacccccuuauuugguagauugaacuguggcucaggacagcaaguuuuagaaggagagaaucaaacaauagacuuauuugcaaacucucacacuuccuaagcacuacaaugaugauuuuuaagcuucuuacugaucauagugguucccccagccagggccgccuugguuccuuggaagaaaucaucagcagacgucauucccugaucaggcaucuggaaacgaguguggacgucaauuccuccggggaucaccauccgggagugggccucgauggucuucacuccuccuggcacaaucagauuuucuccuauuugccuaaauaaacaggguuggugauaaggguuguaaaugaaauguggacucaaaugggaucugacagcuacuuucacuaaccuauaaacuauccuccgcucugugccgugggcuuuucagaucauuguuacgauucauaauaaaacacuauauacuccuaccccccagcaagaggcaaugcagaguauacuagaaagcaaaaguuaaauaaggcaccagaggccccacucaaagacguuuuguucccaagaaacccccuaagaucaaaugauaacaaggccccaagauauuucuaagaacugucauuaaacuuucuuuacagcacuugcaauugagcuaauuauccuauagcaauuuucuccagaccuggccguacuuuccaaacauuuauuuuuaucauauccuuuucaccagaaggaaaauagggguggaagggugagguagaacaaaucaaagcaaaaaaaaaaaaaaagugaacacuaugauugcaaugauuuaaaauuuuggaagcguguguuuaguuauucagauaaugaaaaagcuaacagcugaaauauaauuuuaaaaggcagaaaaaugaauauucauuauguugggagacaugauucauuuccaacuuuuaaaaaauauuuuuauaucuuucuaccaauuuuuuaaaaggaauauuaaucuaggagaaguugauaaaguucuagaacaaaucagugaugaguaaaaacagcacacaggccugcacacuucugggccagugucauucuaccagaccagaucgugccaucuuauaauugggggaaaauggaacaucaaagucauggcauuugagagccuggagcugagacugucacagcaaacacacauggagaaaacauuaaacguggaaauguuaaaaucuauuuuagguucauaaaucugggugugagcucccaggcaacagucacagccacuccaguuuuccacuccucuggaccgguuuacagcuaucccuugaugaaugcugcuuauuuaaaagcugucacuggcugcaguguuugucuucaaacagaugugcuauuucuccagagccccgggagcuaccccaguagaaagggcaggcagauacugggaugaacucagcuuccuuaacccucuggcguccaaaaauacccaaacucaggaacugcccuguugcuucuccuuuguaacauuaacacaauaaacacaagggcagucuuauuugcacuaguugccacuuagaauaaaaccuaaaauucccucaggauuuaggcaguaauuugucuguauuacuuaguaauuaacuugguaucuuucuuuggccccuccaacuuggauucuugaugaagaaagcagaugugcugucucaauagaggagacugucuuucacguuugcguccuuugggcaauccaacccaaacaaugacauucuaggcaaaacuuuaauauauucaacauaucacaaaccaaguauuugagcuggcaacagaaagauaucauaucaccucaguuaaaaauaguaaauuacauaauaccuaaugcaacggguguacauuaauuguugcuuugaauucccuaaauuugaguuuucaaauucacuaauuaccaccaaucaaaaccaguuuaaaacagauacuaaguuggucacucucugauguuccugaaguuugauacuuuggaugcgaaugguaucuaauacuugggaagucuggaaaguguucaaauacaucuguauaucaugaguuacacuuacuugaucaacccaucuuccauguauaugucugcauagaacgacuggucaucauuaacaauuuuaccuccuuugaucagaagacgaucgcucugaaacaaagaggcaguaaggucacaacgcguaacugaccuaugagaaacaggugcuaagauaugugagcuaaggauacauuuucacuguucaaaagugauguucaaaauaagcccauuuuggaaagguucagugacaaagguaagccuguauguggcaaccuauucaucaccugaugagucagaacacacagggacagcuuauccuagauaaacgaaccaucucuuucaauuagaccuuggacuccaaagaaaaaaaaaaagcagugaaaauuauuucauauaaagaagauagggccgggcacgguggcucaugccuguaaucccagcacuuugggaggccaagaugggcggaucaccugaggucaggaguuugagaccagccuggccaacauggugaaaccccaucucuauaaaaaauacaaaaaaugggcugggcaugguggugggcgccuguaaucccagcuacucgggaggcugaggcaggagaauugcuugaagcagcaggcggagguuguagugaaccgagaucacgucacugcaccccagccuggguuacacagcaagacuccaacucaaaaaaaaaaaaagaagauaguacuuuuuaaaauggcuuuuggcuaaaccucaauuuaaaaacaaacaaacaacaacaaaaaaaaccaccuacauauaggaaagccaugucuuggaaagacugugucaagcaagcacaauugaccaaaaagucugcugucacgggauauaccacacaaauacacuggguucaaccauagcaagguuuccauucaauauguccuuuauauuugcauuuaucuuugagguaaaucacagcaaguauagcaaaaagacuacaaaaaauacgccauugaugccauuuuaacuaggcuguuaagaaaaagguaaacucccacgaauaaguaucugagauagcaaauucuaagaugcaaugcacuacagauugcugaugcacuuauauuuuaaccggugauauuuaugcuaaaaaauaaaggacaagcagcagauaaagucugagaaugugacagaaaugcuacauuaugacucaucguuauugcaaaugcugcugauggaaggaaugcuggcaucgaguguucaguaaauaugcaccuguauuauacagaaugggcuuaaaccuggcaagcugaaccauacauugcccuuuuaauaugcaacacauuucaaagaaugacauucuuuuggcaauaguuaacucaaaauucaguuacaaaacaauauucucagcaagugcuaccucucuuuagcagcuaccaagaaaaggaaaucauagaaaaucuuuaaaaaagagauaagcuacuagagagcaaggaaaaaagauaauuuuacacauaaauacacacaccuugguucagaaaguauuuauugucucucuaacauacugaaaaccaauaagaucauuuuaauuuuguacacugcagggucccugauccucacguagacuuuggaaagucaaaggagaauagccaacaauaauuccugcaccuguauaagguaaguguaaagaccuuuacaaagccgugcacaucaugacaucagagccucgaaagaaaucugugagguagaugaggccagguucuauucccaugacacauaaggaaacugaggcucagagagguuaggccacuugcccaggucacucaaaucagugcacuuguccucugucuacaaugaccuccacuucucucccagaucucuaagcuuccauggaauaaauaucaccuggaaggcaaggagaggccucccccuucaccuccugccuccacagucacugugguaccugccccagccaucaccgcgaauaucccgagccaacaugaugccaugaaaaaaagugaaacaccacacccccguucacucuagugccuuccagaaggcucuuacauaagaggcugccaguggugagggagggaggaauaccaugcuauagguccuaugauaaugcaaccagauuuuuuaaagggugugggggggggggcgcucuuuaaaaaaaaaaaaaaaaaaaaaagucuuguugaucguuugcuuuuaauuuuuuuuucuccccacacugucaaaaugaagcugccuuguucauucacgaagacagcaaauuauuugaggcuugcugcaaaucugcuuuccauccucccuccccagagucaccacuccuuccuccugcacagugaacacacaagggugggugccccgugcccggcccuuugggaucuugggucuuuugccuucaagaagaagcuagcgcccuucuucagaucauccuagaaaauccuccgagcacacgcccccuccccuaugcauuugcuccccuucucucucccgcggaugggugugcccuugugcacggagaggaagccggggugcccauggcuaaagggaaaaccagaaccaaagagcguccuuauauccagcccuaaaaacacauccugacugcuuuaaaaggcucuuucgaucucugccucaguccuagguucuacccgggaaucagcuggccgguugcaauugcacauccuuauauaacaaugaauuucccugguguuccccccucccugggauuucacuggggauggaaagaauaggacgaacgaauuuuuccaggaaaagauggggagagggagggagcaggggagaggugggagcaagacuggugcugaucucugaggcaucgcuaauucacggcacagacguuuuccccgugguuugcaaaccaacaaguccaggccccagcacugcgccgagcccuccggccgccgcgaucauugucuggccggggccgggccaucugcucccgcgucgcgcagcgccauuagcgcccggccgcucgccgcgguccccgcgcccacccugcaguccgcuuuguaugcaccaacacggacgccuccugagcggcagaaggggcggaaaagagacgugaaaaagagcccgaauccccgccagggccccagccccgaacuacagggcgagaaaaccggggggggggcacccaaaaccgguuccuggccaacaagaagcccccgccuugccccccgccuuccuccucugcucaucaccucgucccuguuuuuccuucccguuuccacaccauuccgguacacccugcccuuuucagcaucccucugcugucauuacgccuuagggcucaaacccgcuccuuuuuccaaggacccggagaaggcuccagaaagcccuuuuugggugggggcggaagacccggggaggauccaaguccccaucuccccaucgcugcuggaggaguccagccucgcagcacgcagcccagagaacaauauccgagcuccaggcaugcauauucaaucuggcauccauuugcuugcaccccgcgggccgacgcugcagcaucucucacugacaauaaaagauagaccgggucuggcgcguuaccuaaggcuaccuucgugcacucgcgcuccuguuuaaugccuugcaaacgaugcgacuucuaauccuggaucacugcaucucccacaaccaccaccaccaucaccaucgccuccguuagcaacagaaaggaaaaaaaaaguucggucccucuccuuuccccuccuuuuuaaaaauuccuuagaccuucugugcuacaaaagguggcuggccgaccgcagauuucccaaguaccaaacucaccgugaugcguggaauauuuuucuuccccugauaagacaucucucuccugggaaaaaauuaauuucaagagggcagcuuuaaggcaaaaacugccgggaaggggacuuggguuuuuuuuguuuuguuuuguuuuuuuccuuugcaagauugaaaagggugcaaccgcuucgcuggucuugcuauuaggaaauuucaagaacguaacggaugaaugcaauccucugucucucuuucuuccucuccuccaacacagccccagcuagggcggaaaaaaaagagagagagagagagagagagagaaggagagagagaaacaggagggaaggggguggaaauaaacuacagcaauaaaagccucgguucaagucggccaccguggcgcaugcgccgccagccacucccuuuccucucaggcaaaagccauccgcuucgagagagacgagcagcgauuggccgcgauccugggauaugcaaauuuaggccgguggggcggggcgcggcgcgagagcgcgaaaugcggcagugaacggccgggggcggcaggcggcgcgagcgcccgcgcugggagcgcgccuuucgcgcgcuuucuucgggccggggcgguggggaccggguuuggcggcggccccaggcgcggccugggccacgcggggacaauggagggguggucgucgcggccggggggaggggcggcaccccgagacggcggggcuucggggccgcacgcacucgccugcgcgcgccccggucccugcccgccugcgcgccaauccgcggaggccgccgcggcagccccgcguggggugacugcgccgagccaauggcuucgcuggcggcgagcgcgcgacugcaccgccggccggcgccgcgcagcccgggagggcucccgggcccuccucccccgccguugcuggcgcugaacucgccuggcccccgcccuggcgcggcugaggacuggaacggcggcgggcgggaacccggcggggagggcccggccacgcccggccccggagagggcggcugcuucccgggagcguccgggcccggcuccugggggcggggaaugggcgcgggccggggggaggcugcagagacgggaucuggcccgcguggaggcgccgggcugcaggaaaugagagcccugaggaaacccuuccaacuccgagccgggaaggaggcauccggggaaggcugcgggguaugggaaaccccgcccugaaacauccuuuugugccuuccggccgcgaggaacuuaguagggcggaggaauggggagcagccgcagcccgccgaggccgauguggcgcgaucugcgcucugugcgcccgcuuuacagucacgcccaccucggcucccugaggggugcgugggggcgcagcgcauuucgcuggugccugcagcgcugucgggggcagcugcugcgaucccagcgccccgggguccugaggguuuacagugccaguggaugggacccacaccgcaccguggggcggagaggaggagaugagcuguggaggagcaagaaaggaagaguuuauaucccacaggaaagggaaacugagucuuggggaaaaccuacugaaucggaguuaaaaucaagaguguccugacugcccaggcagagccuugucacuucaaacggcacucaaggccccuucgugguccuagcaauugagcaggccugggaccccuuagcuuugccuguccaagccaugcugggaugcucuaacuucaggguccgugggaaagaaaaacgcugauccaguugauccucaggaaucuaccgaggccaacccccgugggagguugcccuggcagguacaauaacuaaaacaucuggaccagcccucguagcgcucgggcuucucugcuugaggucgaaggauacauagaaucccuacguaaucaugggcuggggggugggggaagaaagaguauguaauuggcucacaccugcucagcaaagcuuagcuagauaaauacggaauaauucgagcugcugugggccugacuuccaaucuuucugcccuucaccaccuuagccacuuuaggggaaugucuguccuuccagacucagagaagguguaaaauucuccuuuucacuccuauaucucuaaaaaucugaagucccagaaaguagccguagggcacgcacaaaguuucaccgaugguuaauucauccaaguucaauuuagcugugcaucugaaagagaaagugaagcacuucccccuccagcaaucugauaugccgcaagcaaggugagaugaugucggcaaguauugcugucaaccgguaaugguuaaagucacgagucugagaaagcuuaaaauacgccuuucuacuuggccucucucuacuugugaaaaaccaacagucagucccagcuuugcggaggacagggcaguggagaggaguguccuauuagcucacaaaaaaacuacuuggcaagggaguaaauaaagagacucaaauuaauuuaaaacaaaguaaccuauaauuauauuguuuguauucuuguuguauucccuacccccgucccuguuguuugagcguaauggguuuaaauauaucuuguuauuuaccaguuuaccauagaaucguuuguuuuguaauaaaagcuuccaagagcuugugucugucucauuggcuucaauuguauagccauugcuaugagguucuuaguccauaauaacugacguuuccacucguaaauauccaaaaauguaagguauaaacugauuugucuguucugacuagagccuaagagaguauuuggcacauaaaagauaccaaacaaaugguuuaaauugaccgaggaagagaacugucugcaaccugcauuucuuaccauauuuaccauucagcgcaaugaggaaaaguaaaaaagggccgaggagaaucuuccaccugcuuugcacugaugaaggugaaaaaaaaaacaaaaaaccacagguaaacaggccucacacuuuuacuucagagauccuuguaaaaauaaaugagaggcugggcacaguggcucacaccuguaaucccgcacuuugggaugccaaggcaggcagaucaguugagcccaagaguuggagaccagccucagcaacauggagaaaccccgucucuacaaaaaauacaaauauuagagacuaggcuggccaacauggugaaaccccgucugcacuaaaaaugcaaaaaucagacgggcaugguggcuggggccgguaaucccagccauucgggaggcugaggcaggagaaucacuugaauccgggaggcggagguugcagugagccaagauagcgccacugcacuucagccugggcaacaagagcgaaacuccaucucaaaaaaacaaaaacaaacaaaauaaauuagcugagugugguggugggcaccuguggucccagcuacugggggcaggggaagguuggggcugaggcagaaagaucaguugaggcugggaggcugaggcuguaauaagccaugaucgugccacugcacuccagcuugggugacagagugagaccuugucuaaauaaauaaauaaauguuucuuauacuuucuguagaaaaacacucaaugaaaauuuccuguaaaauuaugaauuauuauuugugaaucuaauauucguacccuuugucaggcaugacuuuucugaauuuuuaaacauuaaauucaugccaaacaugagaaagcaauguaaaauugccuguuccgcaaucacagccccuucccaaaccuccacuuucccauacuuuucucccagcaccauaaaagagccagaugcaguaacuaaauuagacaaugguuuagugaaaugguaacaucccgggcauucugcauggugugcaggaagggaggaucugccugagcagauccaugagugggaagaaugcauuuuaaccaggugcuguaucagagucugaucccugucuuuuccgcagcuucaacuccccucccuggacaccuacucuguccccaugcucaaugggugcacgcacacagugucagagcaaacuucucacugccccugaaaacagugugcccucccuaaucuacaucuugcccuaagccguucuuuuccccuccuucccucugaaacaacugaaauguuaccaugucuaugaaguuuuccccauccuacccccacagccuuaagcacuccuuccuguguucagcucugcuauaacaccaucacucuauaaugacuugcacauuucuuccaucaggccuugacuccuagaagcaaaaagcccccucuucucccagcuaccagcacacugccuugucucuggcaggugcccuuaacauuuugugcauaaauaagugccaucauugcuaugacgaggacaaagguucuuccaccaaggugaguuuuaaugucaaaaaaaaaaaaaaauccccaaugcaagcaagccuuucccuuaggacuaucacuuuuuuuuuuuuuuuuuuuuugagguggagucucacucugucgcccaggcuggagugcaguugcaugaucuuugcucacugcaaccucugccucccagguucaagugauucuccugccucagccucccgaguagcugggauuacaggugcccaccaccacgcccagguaauuuuuuuuuuuuuuuuuuuuugagacagucuugcucuguugccccaggcuguagugcaguggcgcaaucucggcucacugcaagcuccgccuucuggguucaugccauucuccugccucagccucugaguagcugggacuacaggugccuaccaccacgcccagcuaauuuuuuguauuuuuuaguagagacaggguuucaccguguuugccaggauggucucgaucuccugaccucgugauccacccaccucagccccccaaagugcugggauuacaggcgugagccaccgcgcccggccacgcccagguacuuuuuguauuauuaguagagauggggguuucaccauauuggccaggcuggucucaaacuccugaccucaggaucugccugccucggccucccaaaguucugggauuacaggcgugagccaccacacccagucaggaauaucacuuugccgggccuuccuucuuggcagccuccccuucuccaagccccugaaacuccaggaagaccuaauguuauuauuaacagcuuauuauucucugcggggcuguagcugccuagauuuuaagcuccgccuccacuaacaaaacugcuguguaucagcaagccugguagaacacggagacagcacccaauccuaaaaugaaggucgaagucauacaaggugucucuaguaauuuuuucucaauuucugaaacuguccuuuacuccauccucccauuauucuucguacaucccugugugaucccauucaucgcaguaaaccaccuacacaauacaauccucaccgacaccauaacuaggugagugugauuuuucuuccauucaagguuugagcucacagggaagaaaaacucuuucaaaagucuuacucauuccugaccaggcgcaguagcucaugccuguaaucccaacaccugggaggcugaagugggcggaucaccugagaucaggaguucgagaccauccuggccaacauggagaaaccccaucucuacuaaaaauacaaaaacuagcugggcgugguaggggacgccuguaaucccagcuacucaggaggcugaggcuggaaaaucacuugaaccugggaaacggagguugcagugagccgagauugcgucacugcacuccagcuugggugaaagggcgagauuccuucucaaaaacaaacaaaaaagucuuacucauuccuuauccuuacagagggccugacaaggcugggggcucaagcaggacugaaugcagggagggagguaugaguggaggcacccagccagcccuuugcacauguuugcaucauccaaacugcagggaaguggggcuggggagaugcagacauaacuccagugccucgggcggcugugcugcucucaguuccucagcaucugcccggaacguguucccucccugacuagcccacugcugcucuugguuucauguuccccuuuggggagcuagaguagccauuucugcuucuguggcgcccugggucucugcguuagugcaauguucagaauuucacagaguaggggaacuccagagcagaaacugcugacaaaacagagcccagagguggcaaagaaaauccccaaugcccagagugcugcaauuggaugccaagggcuguggccucuaacacagccugcagagaagguugaaaugaaugcggcaguaaagagaagguacuggaauccuucuuugccaaaacaaagggcauugacuaggacacuugagcuggaagugaugccuucuucacugcagauggaaucaggcaaugacgaucguuuucuuuguguguguagcucugaagggucagagacugcagauuggaucggaaccugcccacugccuuccccuguggcugcauccuuuuagcagcagugacaguggugacaaaugagggucagcagugacuggcccuccgaaacagacgcugcuuuggcuagaacuguacagacugccggccagcaugggggcucugcuaggauucugaggacacauccucccugcaggaagacaagaagcucaucuguccaaauccugcuggacaagagggcacagaggaagcaugcacuucacagaaucuagucgacucgggcuuucucuuauccccaguuagcgcacacaccuccugaagaacuccugcaaugcccacccugcaccucauucucuggguggcuacagauguucccuggggucuuucuaucccugauggggacaaagggcaccuagcucagccaucgugccucaggccugcccucugguggcgaacaaagagugugcacgugguccccugcgugcuggucuccaagccagggcagggccuuggagaucacuuguuuccguuggugugcccaaguacuccccuccaucagaaucacccugggccccagcucagacauccugaacagaauauccggagguaagguccaggaagguuuuuaaacuagucuacuucuggacacuuagcgacagauccagcccacuccacccucuauuuauagaaggaggaaaacauggacuaggaggaagggcucacucccuaccuagugagggguccacucaccacagggcaucacuggucugcucuuuguccagggggaacauuaugaaagagugguaaauauuaucccucucauuccacuugucugccuucuggaaacaguacaaucuucuaaaauacuguuauguugucagugaggaggaaauuaacauguauugagcaccuaccaugcucuaagcauagcacugagugcuuuaaauacaucugcuuuaaucuucuccaaaauccuacuggguaaaucuucagauccucauuuuauagacgaggagagaaaagcacaaagaaaccucuuguuccaggcccagauucuaauuugggucugugugaccccaaagcccaaggggcuaguucuuuuuuuuuuuuuuuuuuuuuuuccuuuucuaagacugagucucacucuguuguccagacuggagugcaguggcgugaucucaacucacugcaaccucugccuccuggguucaagugauucucaugccucagccucucaaguagcugggauuacaggugcccaccacaccuggcuaauuuuuguauuuuuaguagagaugggguuucacuauguuggccaggcuggucucgaacuccugaccucgugaucugcccaccucagccucccaguguugggauuacaggcaugagcccccgcgccuggccaaggcuaguucuuuuaaugguaagguacuuguuuaguagaaacugggacccaccuugugcaagagguaggcacaggugaucggcugucuuucuuuacuccuuccacuguccccaguccacauuccuuagauguuuccccuucucccgaaaucaauucuccaucucuuucuuuccucauaacccaguguaacucaguuucacucaguggcucuggcccuccccucauaggaaacaugacagacgaacauaaagguuuaaaugaaugauaaaugcucagugugcuacuccucugcuaaaaagagaagacccugguuaguagaauuucagacaccaagccaggcugcuugcauaaauaaaaugcaaaccguuuaucaagucugcugcgugugaucuugcccuucuuuuuuaaauuuuuuacuuuuauuuuuaguagagacaagagucucacuauguuacccauguuggucucaaacuccuggccucaacugauccuccuaaagugcucagauuacaggugugagccaccgcgcccgacugaucuuacccuucuauuccuuuccagcuucauccuguguuacguccccaagcucucucaugccauagcacacugauguccuuccuuucccugcaauggcccuuuguggcugcuguucucucuucucccaucucuccuucuugcccaugcaucccugcuucagggaggcccuccaugaccucccuccugaugccagcccauguacuccuacucuuccuugucucagcacuaucucuuuaauagcaacaauuauaauuuggaaguauuuuugugcauuuguuuacuugaguauuuccagucugucucuacuucucaauugcaaagccccuaaaccaccuaguccuccacuccaccuuacagugaccgcacaacacucaacaaacaagaguuaaaugacaaaugaacaggagaaccuuucuaaagauaccuguucuucagcccaggugaccgaggcuucaucuuccaccuguugccucccagauaugcaccugccauucucuaauccugauucaucccaggcuuuggguuuuucuuugguuuuuuuuuguuuuuguuuuuguuuuuuuuuuggagauagggucuugcccugucacccaggcuagagugccguggcaugagcauagcucacugcagccucaaacuccuaggcucaagcgaucugccucagccucccacauaacugggacuacaggcaugcaucaccaugccuggcuaagucuuuuuaucuuuuguguagacagggucuugcuauguugcccaagcuggucuggaacucuugggcucaagcaauccuccugucucggccucccaaagcagugggauuacaguugggggcccucacgccuagacuucaccccaggcuuuuaaaagaccagauggugaggauucaccugacuggaugaggucucauggccuagguucuaaugauccaaggcagagcgagcagauuccuuuucuacugggaucuguccuugggaagcaucaagccucacauucacaaagcucagcugugccuggagguccaaucaugauaacugcagccggguuccucuuuucaaucccgcacuucaggcuuguacucaccacagccagaaaauaccgcagaucucccucaacugggcccuccuugauucagaaucugugucgauucugaaaacggccaaggaaaagggguaacuaugaacucugaaaguguaaauaacauuucaggaguuuucaucucuuaaaagaauccgccaugaucaauguacugaaaacugcucacucauccaaaaacacgccaugguucuuggccauuuguccauuucgguucccuagaggacacuuuggggcaauuuauuagcuuagucugugaaugcuugaaaguaguccauuuggauauuguaaagauuuaacaaaauucugaccuuuccuguaaauaaauugguccucuuucugcccuccuuacucccccacccuguuuguuuucaaggagugagaauuuauuacugaccuugugugccagcucucaggagaccaagggggaucaggagauguuuacaaguuccccauacacagucccccucuuguaguacaacgcuguagaaagagaggucacaggugaauggcacgugaugcuuuaccaaugcuuuaccagcuccaggcaaacugugccccucuaccuaggcuugggcugggggcucuccacccccacagugucaucaacccaacgacuggucucccuccagcuucugggcacuuccacugucuugaggaaccagacagaauucuuccuaucuuccuaucaagcagauaaggaaaucauugaaagaauaaacagccgaaugcaguugugcuguuaguaaccaucagucucauuugugggcuuuaaacuaaauucuacaucugugggcaguguguaacuccugugggcacugccaaaccaguggaggaaugagugccugcauaugucccucggggcucaggaguucucucuguuucuucagagaauuagaaauggagguaggauaguaaaaagaccacuuuaaagggacagggcacugauggaagaaaauaacacuggagccuggagagacuaagugggaauugaugcccuucaucucuucuucuccccaucuaaggccacuaccucaccgggggcaccaucuucgcauucccugugcgugccgggcuguuugcagcuccacacuugugcucacaugccugccucucccagcaugcccaggcccucuuggaccccucacaccaucacuccucugugcaaccauuccugagcccucagguccagcugaccacuccuucucuuaugcccccacugggggcuguacagacucuuggcagagugccaaaacagucuccuggacuauuuccuuauacagugucuccuucucuuagacaguaagcaucuugaagacagagacuauacuuucucucuccucaucacccaccguaaggccuugccuguaauaggcaaacaaauucugaaaggauggauggauggauggauaguagaugggugggguggauggaugaauggauaguugggugggcagauggauggauggaugggcagauguauguauguauguucauauggauggaugaauagguggauggaugugugguggguggauggauggauggguagguggauaaaugaaugggugguggauggauagauggaugauggauggauggauucuuggguagauggacagacagaugauguguggauggauggguggauggauggauggauggauggaugggcagauguauguauguauguuuguauggauggauggauaaguggauggguggauggauggauggauggauguguggguggacaaauggauggauggauggcugaguggguagguggauagauggauggguggguggaugaauaauggaugauggaugaauagauggauagacagaugacggguggauggauggaaaagugaauggguggaagaguggauggaauagauguaugauggcaggauggaugcucagguagauggauagacagaugaugggugaauggauggauagauggguggguaggcgggugcacaauggauagaugaauaaacccauuacacaaauguccccauuauaaaauacagcccaaacacugggacuugagucuaacauagacucacugggacuugagucuaaaauaaccuuccaaagcaugaaauuuacaaccagguccugucuuaggccucguccauuuaguuaaaguuucuagaaggacugugggugucuucuuuuccauucucuuucuucucaucaucuacuccuuucccuccugucaagccugugagagguuugccuuaaggcuguugucaguguccuuccugcccuucaguccuaugagccccaccgcuuugucaaccacacucuguucaguuuguaaucaaguccaaagaggacaugcaugccacaaagcccuauaguccaagaguuaguauuagguauuuacucuuugagcauuuacucagcauuucacaguaagcaacgggauaauucccucagguuuccaauucccuccuuucuccugcagggccccuuuagggagggggaucccgugauuuuuuuguaucugagcccaggccccuuccaagagucaucaaccagagccuguucauaccccggguccuccucuaagaucugucugacuucucuguacuccaucugcccacccugcaaggucauuuccagaccaucacuuucucagcagcuugcagaagcccugcccuucuguguacccucaucucugucuccaagacacuucugcacauuuauucaggacauaaucagcuggguccuuccaugucuaucuggcacugagauguagcagaggccacuagcucuucaugaaauccaggcucuccucuucuucuaggacacacaacuggacuacauuucccacccucaucggcagugagaugugacagaguucuagccaacgcagugcaucucuucaaggccuaggacauagacaauucccucuuccuccuccaggcuuuuucuccaagcugacgggaugaugauugcccagacaaccuugggagcuguguguugaagauguuagaaccaccagcaguuugacuuuccaguuaauugcauggagcggggacccuguaccuuucucugcccacucaacagaaacacccaccuugaacuauuaugugauauacaaauaaacuccuuuugugcucgagucauuauacauaguggagucuauuuaucauagcagcaguauucuuucuaccacaacuccuaacuuaauccuguuugaauuuaaaauuugugugaaauacacacauacccucaguuccuucacuuugcugacccaugaccuuggccugcccuuaucuuuagccauucacuccaagggcuaucugagcccucauccccuaaccacaucaucaagaugugaugagucaaccucuucauucacagcugggcccccaugguccauuuccuggacuacucucaccagcagcaucauucugcuacucuuacccugcaaccucccaauccuggggcagcccuaaaauucacuauucccuaaccacuucugugggagcagccacagaacacucauacugcauuaaagauugggacaaaaagaagucaugauaucaaaaagacaccugcacuccuauguuuauugcagcacaagucacaguugcacaaauauggaaccagccuaagugcccacugaccaaugaguggaugaagaaaaugugguacauauacaccuuggaauacuacucagccauaaaacagaaugauaaagaaugauauaauaucuuuugcaguaauucggguggagcuggaagccauuauucuaagugaaguaacacaagaguggaaaacuaaacacuguauguucucacuuauaagagggagcuaagcuaugaauacacaaaggcauacagagugauauaauggacuuuggagacucagaagaaggagggugggaauggggcuaggcauaaaaaaaaacuacacauuagguacaauguacacuccuugggugaugggugcacuaaaaucucagacuucaccacuauacaauucaucuauguaaccaaaaaccacuuguaucccaaaagcuauugaaauuuuuuaaaaaaaaaauucuuuuaaaaagaaacugggacagaucacuccagaagagcuuccccugaagacuucccacugguccuugaucuggccacccucucacaccucucagcagcugucaccaccuuugccaugcuuccugggucauccucaaucguguucucaugagcucagucuggcuggagagcccagugcugaaugaggaaucacaaauggaauaaggauuuguagcagagcaucacacacaccccucuuuucuccuucccuaggucucacaggaagacgucagcccauucaaggauuauucccaaauccaugcuguuucccaccccggccugcucccaaaucucaaagucuuccucuccaccucucagucccuugagcuuggaaaacuccuccagccguucccaucucccuggcccugugcuccucaccacgauugcccugccuugcuguuccuacaugguuaagcuucaggaauggguagcguacacuccuggccuccacuuccucaacuuccacucccauuugcuucucaacccacuacaguuggccucuucgccugacuccauuagaaaagcuugggcaaacagcaugcuaauuggaagcuaaugcgcacuuugugaucuuuauuuuaacugagcucauugugauacuuaacauuauugccucuaccuuuuuucuuccaaauuccccucccucgcuucugugaugccuuuuuuucuggcucuuuucacgcuuuuaugacucuucuuucuaaacauucauugaguuccucuuacccagucuuaaauaucaaugaucccuuagguugucuccuaagccucuuucucugucaugguuucaacaacuaacuaaacguuucuaacuuccaaagcuuuauuccugacucuuuccacacuucauucauucauucauucauucauucacucauccagcaagguuacauuaagugccuucuaugugccaagggauaugauaguaaaaaaaccuacaacaccucugcccucauggaaguuaccuucuacaaggggguagccauuuaauuaauggggaaagaaacaaauacaaaggauaacuucagauugcagucagugccaucaaggaaauaagcagaggauagagagguggaaaggcacuuuagacagaguggucuaggaaggucuaggaaggggagcugacauuuagguagagauuuagucccaagagcaaaaaucugacuuugccucuggagggaaaauucuggacuuagccucaggcagcagaguucuagacuuagccucuggaggaaguagcagaacguggugucugggagcuaaguucaggacuucaugucuggaaaaagauauuggggcuucaauucaauuuuugcagcaaaguuucugacucaauguguuaauuaaaagggaagacuuagucuuuggacaaagaugagaaggaggaagccaucugggagaagagaguuuauguaagagaaaacaaaaacaugggaagacugagauuaggaugagguggaauguuuugggaacagaaaggagucuagugugacuggagaacugugagcaagagagagugauagacaugagcguggcccuuuaaaaacagugccacaaauucuuuggcauccuccuaaugaaagguggggucuacaugcccucccuuugaauucgggugggcuucuggcugcuuuaacaaguagaguaugacagaagagaugccuuccaaggacaggucacagaaagcauggucugaguucagacacaggugugggaaauccagcuacccuaacgccaccaugcuguaaagaagcugaagccauguagagaccaauauaggaauuccagcagaguccccccaagcccagccuuccugccauggugccaaggugacagacguaugagugagaaagauucuggaggacuccaccccgguuguucaagucacccaaagccauucaaguuuucccagauacggcccuagacaucguggagcagagacaacauaucccugcucuacuguguucaaaucccugauccacaggauccaugagcacaguaagaguguuguuggucuuugccacuauauuuuggggcuauuuguuacacaguaacaucugcuuuguacaaccgaaguuaaagcagcaggcagggaccacaucuacaggacugugggccauggaaacagauucggauuuuauucugucuuuaaaacgaaaccauuuaagcauucuaaucgggaacaacaaaaucugaccaauacuuuuuauauauuauuccagcuguagugugguggugcaagggucaaacagaggcaaccaguaagaaggugagaguggauuguggcuaggaccagggcaagggcacuugagauaaauggacagaugugucauuuauguuggaggcaauaauaacagcuaccacuuuugcagcaauuacugggccaggcauuguucucagugcuuugcaaguauuaacucugguuaagccucauaauacauuuaauccucacaacaacucugugagguagaguggaaacaaagugagauuaaggaacuuuccccaggacccaaaacucacacguggcagagccaggaaucaagcccugcagucugaccaguguguguccuuccucuuauccacucuuguuucugcugccaauaaaagucacuaauagauuggauguggaguaaguaggagaaaacuaucaagugugaacucuagauugggggauugaaucaaggugaauggugguauguaaauaaaacuauaauaucaagugugaacucuagauuuggaaauugauucaaaguugaauggugguauauuaacgcagggguccccaaccccugggcugcagaccaguacccguccauggccuauuaggaacugggccucacaguaggaggugagcagcaagugagccagcauuaccgccugagcuccaccuccugucagaucagccagccaguagaucuucauaggagcucgaacccuacugugaacugcacaugggagggauauagguugcaugcucuuuacgagaaucugacgaaggcccugaugaucugaggugggacaguuucaucccaaaaccaugccccagucccucuuuccauggaagaauggucuucuaugaaacugguccauggugccaaaaaaguuggggacugcuguauuaauggauguaagaaagaccaagugaguagcggggugaagugggggugugggauuaugggggagcugaucaggauuuccacucgguuagggggaugguuuccauuggggccaugguaauuugagaugccuuuaagauauccaaguggaaauaauaaggcacucaagugagaaguuggggcuuaagaugugaauuuaggaacauccacucauggaugguaauuaagucaaauaauucuacgacaccagcugaggaggagguaaagauggagaggagagggucaguccugauaccucugauucaacuaaagaaaggguggucugcaaagaagacucaggaguggccagagagaggcagaguagcauguauuggacaccaagaauggagaguacuucaagaaagcaggagugguugucugaggcugcugagaggcaacuggauauaaccacucccacauccgaugggcaucaacucagaaaugcccaaugaccaacccuaguagagucuugcauuucucauacucaccccccucccaucccucccccugcuucuuucaaggcugcugacggcagguagagggugagauaauggauguggcagcaacuguguaguguaagguaccauuaauaacuguggacagcugcucucuuacaacuucccuuccccuagcucaauuuaaauucuucuuuagacuuggaggccugacaaacacucaucauaugauuaaugauguuucuuuccuuucugguuggaaaauggguggaaccagcacuuuguaacugcuggugauuauacuuacauagaucauacuaauguccacaugcaccuuuacuaaaaggauaaaauuauacauauugcaaagacagaggauguuagugauuggaaaauaccaguaggauaucucccucugcccaaaaaugauggcugcuuacuguuuuaaugcuucuauuaaagcauagagaugaaccugguucaagugagauauuggguaucaccaagacccauuauuucugcuugggagagaggaagcccucaaauccuucaccuagaauuucucauggggugcagcccacagagccuggcugugagcugugagcugugagcuguggacaaacucauuuaugucugccuucaacaucgaguaaauggagguccagaccuucccagaccugcagauaggugcaucccaccagcagagggcugcaaucauuguaauaaaagcuaaauguuaucuuaaauagagaauaaagugaaaauaaauccuuugauugggcucugucuaaaaguauucuaaggcuugucuuauuccucauucuguaaauaauccauggaaggccugaccuggagaauggaaauauacccuguuuugugaaaguucuaaacaugcagccccugccacccagguucaggcagagugagcugccaaggccgucgggaauggucgcgucugcuccugauuaauuauuacacccugucuucugcuaaaccaacucugcuuagcauaucugcauuauuucuuuuaacagauuaucucccauggacuagccauggcagagcugggaugugaggcaaaggaaaguggaggaaggacuuuugugcaauguuucagcucagcauaaugagaugggaacguggucuccaggugugguugaugaguuuaggaaugagcagugggauuacugagacaucacagggggcuccucccugcaacccugacuuccuacugaaacuugugaauuuaaugcaagccagaguauaaaagaucuugggguaguuagagggaaccuugagaagcaugacuucaaagcaagaaaccaucaaggaaaagaucaauagagcugaugauauagaaaauuuaaaugucuuaauauacauaacauuuaaaaguagacgauaaauuaagaaacaaauauuugaaaccuacgaguuaauauccuuaauuguuuaugaaucauaaagaugaacauuccaaauuacuuaaagaacuaagaaaagcacaugaaccagccacucauaaaaaaagaaauuaaaugcucaauaaauacaagaaaauauguuuaacuuuacuaaaggacaauuuuuaaaaauugagaucuuauauuuuagauguuaaauagauggaggcugaaaagauugaaaauacuguacuaaguauuaaccaaagugugaagcaaugggcucucucauuucuuucgcaagaauguaaauugguacaaucuuuguggaaggaaauaugauuaaaauuuuuaaugugcauaauucuugauacagaaguuucuuuucuauaaauuuauuguaaggaaauaaugggcaaauauucauguuuaugaauguucuucauagcacuacuagaaauaguuuaggccggacgugguggcucacaccuguaauccuagcacuuugggaggcggaggcgaguggguugccugagcucaggaguucgagaccagccugggcaacacggugaaaccccaacucuacuaaaauacaaaaaauuagccaggcgugguggcgugcgcuuguagucccaguuacucaagaggcugaggccagagaauuucuugaacccgggaggcagagguugcagcgagcugagauggcgccacugcacuccagucugggagacagagcgagacuccgucucaaaaaauaaauaaauaaauaaauaguuuuaaaaauaguaaaaacaauggagaauuguuuaaauucauguuuuaucuaaccauauaacuauuaauuuuuuaaugugugcaacauaguauuaaauacaaagagcaagauacaacagaguuuauacauuaggaucccaucuuuuuaaauuaauagacuuuauuuuuuagagcaguuuagguuuacagaaaaagagcagaaaguaacaagauucccauauaucccuuucucccuccaccacaaggcaaacacuguuucuccuauuacuaauauauuaacaucuugcauuagugugauacauauguuacaagugaugagccaauauaguuacauuauuauucacugaaguccacaguuuacauuagggcucacucuugggaguuuguauauuccaugguuuuaaaaagguaauaagauguauccaccaccacaguaucuuguagaagaguuucacuguccuaaaaauccccugugcucuaccuacuauugcucucuuccacucaccccuuccccaagcccaugguaaacacugaucuuuuuagugacuccuuugccagaaugucauagaguuggaaucacauuauguagccuuuucagauaggcuucuuucaaucagcaauaaauacuuaagguuccuucauuucuuuuaauggcuuguagcucauuucuuuuuaucaccuaguaauauuccagugucugaauguaccacagguuguuuauccauucaccuacucauggacaucuugguagauuucuaguucuugcaaucaugaauaaagcugcuauaaacauuucuguagagauuuuuguuagaaauaaguuuucaucuccuuugaauaaauaccaaggaguaugauugcaggaucauaugguaagauaauauuuaguuuuguaauguacugccaaacugucuuccaaaguggcuguaccauuuugcauccucaccagcaaugaaugagaguuccuguugcuccacauccucacaagcauuugguguuaggauguagagcgacaggaacucuccauugcuggugaggaugaaaugagaugccacuacacaugaaaauccaggaugaauguuggccauccuaacagguguguagugguaucucauuguugcuggguuuguuuguuuguuuguuuguuuuagaaaaagucuucuuugucacccaggcuggagugcaguggugugaucuuggcucacuacaaccuccacuuuccagguucaaaugauucacaugccucaggcuccugaguagcugggauuauaggcauguaccacaaugccuggcuuuuuuuuuuuuuuuuuuuguauuuuuaguagagacaggguuuugccauguuggccaggcuggucucaaacuccuggccucaaaugauccaccuagcucggcucccaaaguucugggauuacaggcauaagccaccaugccuguucuaauuguuguuuuacuuugcaauucccugaugacauaugacacagagaaccuuuucacaugcuuauuugccgugaguacaucuucuuuggugaggugucucuuaagaucuuuggcccacuuuucuauuggguguuuguuuucuuguuguuggguuuuaagaguucuuuguacauuuuggauaacaguucuuuaccauaugugugucuuuugcaauuuuuuuccucccagucucuggcuuaucuuuucauucucuugacugugucuuucacagagcagaaguuuuuuacuuuugaaguccagcuuaucaauuauuuuuuucauggaccaugcuuuugguguuguaucuaaaaagucaucuucuauguuauauucuaggaguuuuauagauuuccauuuuccauuuaggucuaugauguauucugaguuaauuuuccugaaagaugugaggucugugucuagauuuauguuuuugcaugggguuggccaguuguuccagcaucauuuguugaaaaggcuguauuuucaacacugaauuguccuuguuccuuuaucaaggauaugucaacuauaucuguguggguccccuucugggcucucugcucucuucccuugaucuguuuaucuaccacacugucuuggcaacuguagccuuauaguaaguuuugaagucagaugguaucuaauuuguuuuucuccuucaauuucauguugcccauucugaacuccuuugcuucuccauauaaacuuuagauucaguuuguugaugucuacuaacaacuugcuggcauuuugauuguaucuaauguguggaucaaaccgggaagaucaugacaauccaucuaucuaugaacacaaaaaaucuuucuguacauauauacauauuguuagauuuauaacuaaguauuuuuuguacacaauaguauguuuuuaauauaaauucuaauuguucauugcugguauauacaaaagcagcugacuuuuguauaauaaccuuauauccuacaaucuugauauaaucauuuaauaguuccaggagauuuuaauguuguugauucuucgggauuuauuacauagacaauuacauauaaaaaugugugugcauguauguguguauauacuauauauauauacuauauauauauacuauauauauauacuauauauauacuauauauauaguauauauauacuauauauauacuauauauauuauauaaauacuauauauacuauaguauauauauacuauauauauuauauaaauacuauauauacuauauauaguauauauauaguauauauaauauauauaguauauacuauauauaguauauacuauauauaguauauacuauauauaguauauauaauauauauaguauauauauacuauauauaauuuauauaguauauacuauauauaguauauacauaauuuauauauacuauaaacuauauauauacuuauauauauauuuauauauauaauauauacuauauauuuauauauacuauauauacuauauauaauauauaauacauguauauguauauauaguauauguguauauaugcuaauauauauaacuaccuauacaaguacuacauauacaaguauauauauaauuuuuuuuucacugucacccaggcugacaaucauggcucacugcaaccucugucucccaggcucaagcaaucuuuccaacucauccucccuuguagcugggacuacaggugcacgccccccaaccaagcuaauuuuuuguauuuuuuuguagagaugagguuuccccauguugcccaggcuggucucaaacuccuugacucaagcuauccaccugccucggccucuaggauuacaggcaugagccacugcaccaagccuuuccauauauuuagaucuucuuugauuuugugcauagggaauuguagauuuccucauacagaucuuauacauauucuguuagauuuauaucuaauuuuuuugguguuaacauaaacaauaguauguuuuuaauguaaauucuaauuguucauugcugguauauagaaaaccaauuggcuuuuguacaauaaccucauauccuacaaucuugauauaaucauuuacuaguuccaggaguuuuuauuguaguugauucuuugggauuuauuucauaggcagugaugucauaugcaaacaaaguuuuauuucuuccuuccuaaucuauauaccuuuuuuuucuuuucuugcuucuuguauuaccuaggauuucagugcaauguuaaauacaagugcugagaagggaaaucauuggccuuuuccuauuguuagcaggaaaguuuaugguuucucaccauaaauaugauguuagccauuuuugcagaucuucuuuaucaaguugagaaaguuucccuauauacuuagcuuucuaucuaucacuaauagauguugaauuuugucgauaguuuuacugcaucuauugguauaaucaugugaucuuuuuuucuucuuuagcgugcugaugugauuguacuaauugauuuugaauguugaaccacucuuguaaaccuggaguaaaucccacugguucuaauguagaaacucuuuguauacauuguugcauuuuauuuguuaauauuuuugaggauuuugacauuuauauucauuagagauacuggucuauggauuucuuuucuuauaaugccuuugucugguuuugguauuaggguaauuuuggccucauagaaugaauuaggagguauccccacugcuucuguuuucuggaaaagauuauagagaauugguaugauuuacuccuuaauuauuugguagaucaagauggauaaaaggcuuaaauguaaaacccaaaacuauaaaacccuggaauacaaccuauacaacaccauucuggacauaggaacgggcaaagauuucaugacgaagaugccaaaagcaaacacaacaaaagcaaaaauugacauaugggauggaauuaaacuuaagaguuucugcagagcaaaagaaacuaucaacagaguaaacagacaacuuacagaaugggaaaaaauauuugcaaacuacgcaucuggcaaaagucuaauacacagcaucuauaaagaacuuaaacaaauuuacaaaaaaaaaaaccauuaaaaacugggcaaaggacaugaacagacacuuuucaaaagaagacauacaggcagccaaaaagcaugugaaaaaaagcucaguaucucugaucacuagagaaaugcaaauuaaaaccacaaugagauaccaucucacaucagucagaauggcuauuauuaaaaagccaaaaaauggccaggcacgguagcucaugccuguaauccuagcacuuugggaggccaaggcggguggaucacgaggucaggaguucaagaccagccuggccaagauggugaaaccccaucccuacuaaaaauacaaaaauuagcugggugugguggggggcauguguaaccccagcuacucagaggcugaggcagagaauugcuugaacccggaaagcagagguugcagagaucgugccacugcacuccagcauggguggcagagugagacuccgucucaaaaaaaaaaaaaaaaaagcccaaaaauaacagguacugaugagguugcagagaaaauggaacacuugugcacuguuggugggaguauaaauuaguuuaauuacuguggaaaguaguguggucauuccucaaagaacuaaaaauagaacuaccauucgacccagcaaucccacuacuggguauauacccaaaggaauauaaauuguucuaccauaaagacacaugcauguguauauucguugcagcacuauucaaaauagcaaagaccuggaaucaaccuaaaugaccacuguacauuggauaaagacaaugugguguauauauaccauggaauaccaugcagucauaaaaaagaacgagaucauguccuuugcaagaacauagaugaagcuggaagacaucauccucagcaaacuaacagaggaacagaaaaccaaauauugcauauucccacuuauaagugggagcuaagugaugaaaacacauggacacaaagaggggaaccacagacacuguggccuacuuaaggauggagggugggaggagggagaggaucagaaaaaaauaaguauuggguacuaggcuuaguaccugggugaugaaauaaucuguacaacaaaccccccacgacauaaguuuaccuauauaacaaaccuggacauguaccccugaaccuaaaauaaaaguuuaaaaaauuauuugguugaauucaccagugaaugaaucugggccuggugcuuucgguuuuggaagguuauuuucuauuguauuucuuuaauagcaauaggucuauuccgauuaucuauuucuucuugugugaguuuagguagauugugaauuucaaagaauuggccaauaucauuuacauuaucaaauuuguggacauagaguuguucauaaucuuccuuuauuacccuuuucauguccaugggaucagcagugauggccugucuuucauuucugauauuaguaacuugugucuucucucuucuuuucuuagccuagcuagaguuauaucaaaugcuaugguuugaauguuugucccuucucacaugaaacuucauccgcagugcagcaguguugagagguagaaucuuuggaaggugacugggucaugagggcucugcacucaugaauggauuaauucauucacagauuaaccaauuaauggguuauugagggagugggcuacuuaucacaagagcgggucuguuaugaaagccaguuuggcagucucuuguaagcacucucacaugugaugcccugcaccuccucagaacucugcagagaagacccaccggccagaaggcccgcaccagaaauagcacauggacuuuggacuucccagccuccagaccuguaggaaauaacuuuccuuucuuuauaaauuacccagucucagguacucauuuauagcaacaguaaauggacugagacaucaauuguacugaucuuuucaaagaaucagcuuuugguuuuauuuucucuuuugauuuccuguuuucaaugccauugauuucugcucuaauuauuauuauuucuuuucuucuguuuacuuugaauuuaauuugcucuucuuugucuagucuccuaaaguggaaguuuagauuauugauauuagauauuucuucuuuucuaauauaugcguuuaaugguauaaaucucucauuaagcacuguuuuugcugcgguccacaaauuuugauaaguuguauuuucaucuucucauaguuaaaaaauauuuuuaaaauuucuuuugagaugucuuccuuggcccaugugcuauucaaacauauauuguuuaggcugugugcuguggcucacaccuguaaucccaauguuuugggaggcugagacaggaggauugcuugagccuaaguguuuaagaccagcauuggcaacauagucagaccgcgucucuauaaaaaauuuaaaaauuagccaggcaugguagcaugccucuguggucccagcuacucaggagacugaggcaggaaaauugcuugagcccaggaguucaaggaugccauaagcuaugauuaugccacuacacuccagccugagagauagagcaagaccucauuucuaaaaauaaaauacaauaaaaguauauucuuaaaauauuuggggauuuuccagcuaucuuccuguuacugauuucuaguuuaaguucauuguggucugagagcuuacuuuguaugauuuuuauucuuuuaaauguguuaaggguguguuuuauggccuggaauggugaauguuccaugucccauguaagcuugagaagaaugugaauucuacuguugcugggugauguauaauauaaauuucaauuagauccauuuaguugaugguguuaguucuguuauguccuuacugauuuucugucugcuggaucugucaguuacugacagagggguguugaagucuauaacuauacuggcagauuuguuuauaucuccuugaaauucuaucaguuuuugccucauguauuuugaugcucuguuguuaggcacauauacaguaaagauuguuauaucuucuuggagaauugacuucuuuaucauuacguugugccccucuuuaucccugauaauuuuccuagcucugaagucuacuuugucauaaauuaauauaccuauucuaacuuuccuuugauuucuguuagcauggugugauaguagauuggggcugucaacuugacuggauuaaaagauacucagauagcugguaaaggaucaauuauucucagcgcgucaguaggcacugagaccaucccucuucugcucaaaggguuuggcuuuugauuagaauaauuggguugucccagguaugucuaugaagguguaucugggggagauuagugugugagucaguggacaaaguggggaagauccagauguaaugugagugggcaccauccaacugacugggggccuggauggaaggcagaggaaggguaaacucucucacuuccagaggcaagauauccauuuucuccugcccuugggugucagaacucugaguucuccagcucuugcgcucugggacuuacaccagacccccucuccccaccagcucucaggccuuugguucagccugagaguuauaccauaggcauccuugcaucugaggccuucagacuugcacugagccagcuaccagcuucccugguucuccagcuugcagacagucuaucaugggaauucucagccuucauaacagagugagcuaauuccucuaauaagccacuugucaucuaucagucuaucuaucucccaucagucugcauuucuggagaacccugacuaaaagacauaacauaucuuucuccauccuuuuaaucuaucuguauuuuuauauuuaggguggguuucuuguacacagcauauaguuacaucuauuuugcuuuaauucacucugacaaucucuaucucuaaacugguguauuuaccauuaagauuuaagugauuauugauaguuggauuaauaucuucuaugcuuguuacuauuuuauauuuuuguccuuguucuucguuucuuucuugucuuucauucuuuuucugccuucugucauuuuaauugauuacuuuauguaacuccauuuucucaccucucaaaaaaucaauuaugucccuuuuuagcuuuuucuggucauugcccuugaguuugcaguauacacuuacaacaaguccauguucaaauuacacuauaccacuucaucgcaggugaugcacauaccuuacagcagaguauucccaaugcucccaucccuuguaauguuacuuuuccuuauuuaauuuacccauaagcuauaacuaccuaauacauuauuguuguuucuauuguuauuuuggacaaacagguaucuguugggucaauuaagaaucuuaaaaauacuuuauuuacuuuauuuuaccuugauuuauuucucucuaacacucuuccuuucuuuaaguagauccaacucucuuuuuaugucauuuuccuucucucugaagauuuuuuuuuuaacauuucuugcaaugucaccagugacaaauucucucaacauuuauuugucugagaaagucuuuauuuaucauucaguuuuaaaggacaaucuugcuggauacaaaauucuacauugguguuuuuguucuuucagcacgaaaucuuucacuucacucucuucuugcuuguaugggucucaagagaaauccgguauaacacuauccuugcuccucuauauauaaagugcuuuuuacuucugacuucuuucaagguuuucuuucugucuuugauuuucugcagcuugaaugugauaugcccagggauagauuuuuguaguacugauccugcuugguguucucugagcuuccuguaccugugguaugcuaucauuaauuuugagaaauucgcagucauuauggcuuccaguauguccccugucccuuucugucuuucugcucccucugauaucaccuuuauacauauauuaaaucuuugguaauuuucucguauuucuuggauauucuguuccgucauuuucauuguuuucucucucuucauuuccauuuuggaaguuucuacugacauuucuucaagcucgcugauucuuucuuuggcuggguccugccucuugaucaaucaaauaaaaggcauucuucauuucuaguauaguguuuucuuuauuucuagcauauccuuuugauuauuauuauuauuauuauuauuauuaacuuaauuuuuuugagacagucuucccucugucaccugggcuggagugcaguggcaugaucucagcucacugcagccuccgccuccuggguucaagugauucucuugccucagccucccgaguaacugggauuacaggcaccugccaccaucccuagcuaauuuuuguauuuuuaguagggacggggcuuccccauguuggucaggcuggucucaaacuccugaucucaaaugaucugcccgccucagcuucccaaagugcugggauuauaggcgugagccacugcgcccggccuauuuuuuauuugguuugguuuuguuuuugagaugaggucucacucugucacccaggcuggaaugcaguggcgcaaucacagcucacugcagccuugaccaccaggcucaagugauucuccugccucagccucccaaguagcugggaccacaggcaugcacuaccaugucuggugacuuuuuuuuuuuaagagaggaggucucacuauagugcuuaggcuggucuuggauuccugaguucaaacaauguuccugccucagacucccaaagugcugggauuacagacauaagccaccacacauggccugaauauuauuauuauuauuauuacuauuauuauuacuguuaggaguuuaggaguggagguuuaauagguaaaaaaauaggaaaacagcucucugucuacugugagagaggggacuucugagaggaaaaggccuugauuauugucuuuuaauccacacaaaguauaagucauuuauuucucuucuagcccugggcucaguauauagacggcuucucuucacccuuuggguuaacaauuuucuccagguugcuucugaaauuaugauaaagcucagcauagaaagcccucaguucaagcacgguguccccgaucuccccauaggugccucaucuugccugugcaccaaggccugguaauaauccauuacaugaauuuccuuggaggccuuggccacagcaucuccauguucugagaaguacuuggacgugguugucuggaaccacuuuggucuugacugccuuuauccucuccagcaccuucucccggagugauaucccaaaauaauguccauccucaaucuuggggaucagaugcuggauccaugugaucaccagaaugcauuucucuuugagaguccagacuucugucuuauccaggggaacaggaaaaggaccuucucaugccagggagacuucuuucuccuccugcuuaucuguuuccaacucaucauccuuggauagagggucugggauggggauuucaguggcacucagagggaggucagaucagccacauugaaggacuccuuuugcaagagcugauucagauauaugacuuucuguggcaagaaucuguaggggaauuccucagccuccuggaaaagauuuugccugaagaccuccgccugcuugcaggccuucccgcucagaugcacuccacaaggcugggccaugcugcuccaggugcuacaucucuggucuccuggcuaguccugauucuuuauuaaaguccccaucucucugcuuauauuaugcaucuguucuugcauguuuuucacuuuuguccauuagaggccuuaacacguuaaauaguuauuuuaaauuccugucagcaauccaaaaucucuacaauaucugggucugguuaugaugcuuguucugucuccucaaauuguuuuuugucuuucaauuugccguguaauuuuuuguugaaggguggauacaauguacugaguaaaaggaaucugcaucuugcugcugcagugggcuucugcuccaguaagcaauuuuuuuuuuuucaaucagggucucucucugucaaccaggcuggagugcaguggcacaaucuuggcucacugcaaccuccaccuccuggguucaagcaguuuucuugccucagccacccgaguagcugggauuacaggugugugccaccacacccggcuaauuuuugcauuuuuaguagagacaggauuucgccacauugcccaggcuggccuccaacuccuuggcucaagcaauccacccacuucgaccucccaaagugcuggcauuacaggcaugagccaccgcuccuggccucuaguaagcuuugauucuguguaugggcuugucucaccaauugcaggugaagugucuugccuugugaccucaaucaucugacugauaaagaguuguugauuuucaguuucugcaggauuuuucuuuucuuuuuuuuuuuuuuuuuuuuuuuuuuuuuugagacugagucucccucagucgcccaggcugggagugcaguggcgcgaucucggcucacugcaagcuccgccucucggguucacgccauucgccugccucagccuccugaguagcugggacuacaggugcccgccaccacgcccggcuaauuuuuuuugaauuuuuaguagagacgagguuucaccgugugagccaggauggucucgauuuacugaccucgugauccacccgucucggccucccaaagugcugggauuacaggcgugagccaccacgcccggccucugcaggauuuuucuuguugugagaauaaaagucuagcaucucagauaagaaacuagaagcuuucucacugaaucccaauuauguaacauuuauguuacauacaauuauguguauauacacacaauaaauauaaaggugucuaauuuauuuuuaaaagacucuagaaagauauacaccaaaaugcuaauauuuuugauauuuguugagcagaugguguaaucaucuauguagaaggucuaaaacaaucaacaaaaaaacuggaacugauaagcaauuguagcaaaguugcaagauacaagguuaauauacaaaaguccauugcuuuccuguauagcaacaaugaauaagugggauuuauaauuaaaaacacaauacaauuuacaugagcacccacgaaaugaaaucuuuagguauaagucuaacaaacacauccaagaucuauguaaggaaaccuacaauuuuuuugaugaacaaaaucaaagaagagcuaaauaaaugaagaaauauucccaaguucauggauuggaagacaauauugucaagaugucaguucuucccaacuggaucuauacauucgacacaaucaaaaucccaaucaaaaugccagcaaauuguuuguggauaucaacaaaugaaaucuaaaguuuauaugaaaagccaaaagacccagaauaggcaacgugaaauugaaggaguagaacaagucagauacuuccugacuucaagauuuacuauaaagcuaugguugucaagacaaacagaucaagggaagaaaacagagagcccagaaagaaacacacauaaauauagucgaauuaucuuugauaaaggagcagggaaauucaaugcugagauuauuuuuuuuuuuugagauggagucucacucuguugcucaggcuggagugcaguggcauaaucucagcucacugcaaccucugccucccggguucaagugauucuccugccucagccucccaaguagcugggaucacaggugcaugccaccaugcccagcuaauuuuuuguauuuuuaguagagaugggguuucaccauguuggccaggaugaucuugaacuccagaccacguuagccaggcuaguuuggagguccugaccucaagugaucugcccaccugcuucccaaagugccgagauuacaggcgugagccacugcgccucgcuaagacacuuuuuaaauucccuuuugauaccuucuuugagccaaugguuguucuggaguguguuuuguuuccacauauuugugaauuuuccuguuuucuugcuguuauagguuaguaguuacauuucauugugguugaaaaagguacuuagaauuauuuugaacgucuuaaauuuguuaagacucauuuuguggccuaauaugugaucuaucccagagaauguuuugugugugccugagaaaaaugugcauacuucugcuguuggauaagaaguucugcauauggugguuagguccaucuuuuccauaguguuguucaagucaguguuucuuuauugauuuucugucuggauguucuaucacuuauuguuaagugagguaucaaaguccccuacuauuaauguauugcugucaauuccuguccucagaucugucaauauuugcuuuauauauucaggugcucugauguugaguguguauaugauuguuauauuguuauauuuuccuguagaacugaccuuuuuaucacuauaaaaugaucuuccuugugucuacagacaguuuuagaccuaaagucuauuuugucugauauaaguauagcccccucugguuucuuuugguuacuauuugcauaaaauauccuuuucuaucccuuuacugucaaccuacaugugucuuuaauucuaaaguguaucuauucauuuuguacacuuuguauuaaaauucacagaaaagcugucuucucaaaaggacuuuuagaaguaaaaugauaacaucacguccaagugacacauguacuuauauccaucagauuggcgguggagaggaacuggaagaaauggaggauucuagaccagaacaauauagaugauacuuucagauauaaccguuguuacauguguagcuuauucaauacuacuguguauauaguagacgaacuuaaguccuuauaugaaacaucuagucuguccagguguuuagaagugcacaaaguauauuaaacguagugguaauaaagaacacacuuuguaaauauccuuuuguaaaauucauaugaaauauugucuuuuggaaauugaaugaucacaccacuucucugagcaguacacauuacuauauucaugcugguucagggagaaaggaggagaaggaauuccaaaggguuugauaccaguguguguauggugaggcacaauuggcuacugucccuuauguccaugcauugucuuuuacuuggcuauguuuauaccauacauaaaggacaagcaaguccugauuuaaaacaucuaguccuucuagauguuaaagaggucgccagcauaugacaaaaguaggguuaguaaacuaauacauugagucuguuuuguguuaaaauucauagaaaagacuguucuuuuguuugugaaaaucccugcuaaguacuauagaugcuuauaucuguccauuggguugacagaaguaggaaggaaaaagguucuaggcuagaauguuccuauuuaaaagauacuuucaggcuggguacagggcucaugccuguaauccuagcacuuuggaaggccaaggcagguggaucaccugaggucaggaguucaagaccagcccggccugaaaguaucuuuuaaauaggaacacccugagcaaacaauguaugauaaaaaguagagcuaguggccaggcgcgguggcucacgccuguaaucccagcacuuugggaggccgaggugggcagaucaccugaagucgguaguucgagacaagccugaccaacauggugaaacacugucucuacuaaaaauauaaaauuagcugggcgugguggcacaugccuguaaucccagcuacuugggaggcugaagcaggagaaucgcuugaacccuggaggcagagguuguagugagccaagguccugccauugcacuccagccugggcaacaagagcaaaacuccaucucaaaaaaaaaaaaaccaagguagagccagugaauuagccaauucauaaauaucuucuuauaauugauacaaaaaaugaagcuuggauacagaauuguuaaccuaucccugagcaguguauaucaggacuuguuagguaggcagcagaggagcagaaggaagugugaagggagagauguaugcagauguguucauauuuacauuuugacuguagccaacugacguaugugcaucucuuuggcugaacugcaagaguaaauugaguaauucaauggaaauauaccuccuugcuaacauuugaaugguauagaucugauaaugaauuaucuuagacacuauacuugguguacucuguugcuuuauguuucaguuuaaauugaacauuaaggaaaugcaguauuuuaauuggaauucugccaauaccuuuaucuagaggagcguugccauuuuugucuucuaugaaauuuuugucccaaaagaggugggauuauacuuuuuucuaacagauugagcuggugucauguauuuuuaguuaucaaaauauucauaucacuuuggaauuuuaaauugguaaauauucaugaugugugaaaaagcaugauacauacauacuguaugcucucaauccaauaaaacuggauguugugucuaaacacacacaggaccuagaaggacacagcaaacuguaagcugcuugugauuguggacaacuuuguucuuugcuucuuguguuuuucacuuuccuauaaugcauguauuaacuuuuuaaaaauaaaaguuaggccaggugugguagcucacuccuguaaucccaacacuuuaugaggaugaggcagaaggaucaccugaagccagaguuuaaaacauaccugagaaacagagugagaccccaucucuacaaaaaaauuaaaaauuguaauaguugggcacagugguacaugccuguagcccgaacuacucagaaggcagaggcaggaagacaacuugagcccacgagguugagguuccagugaccuaugaucaugccacuacacuccagccugggcaacagagcaagacugccaccucaaaaaaaaaaaauuuuuuuaauaugggaauuuuuaaaaaccuggaaacaauaaauaaaguguaucuauuauagacagcauaugacuugaucuuguuuuuuauacauucagucacucuauaccuuuuguggguuuuuuguuguuuuguuuuugaaacaaggucacucagacugucacccagacuagaguucaguugcuagcuuggcucacugcagccucaaccucccagccucaagcgauucucccaccucagccuuccuaguagcuaggacugcagacaugcacaaccacaccuggcuaauuuuuaaaauuuuuuuguagauaugggguuucccuauguuaaagacauaguuugagcccagacuggucucaaacuccugggcucaagcaaucuucccaccugggccucccagauuguugggauuacaggcauuagccaccacacccagccucuacaccuuuugauuggugagauuaauccauuuacauuuaaguaauuauuaaugaggauuuaccauugccauuuuguuaauuauuuucuauuugucuugcauuguuuuaacucuuguuuucucgcugucuuuguuguuugaugauuuuuguaguaauaugcuuugauuuuucaucucuuguguaucuguuacagguuuuuuucuuugcuauuagauaaaggcuuguguaaaauaucuuacaguuuuuaaccuucuauuuuaaguucaaauguauaaaaaaacacuaccauuuuacucccccacacaagcacuuuguauucuuguagacaaagaaugcuucuuuuuauaucauauauccauuagcgacauuuucucuauuaacuuuuacauugggguuaaaaguaauuuacauaccaucuuuacaguguuacaugaaucugucugcaucuauauauuuaccuuucccugugugauuuaugcuuucauaugcuuauguguguguguugcuguuuaggauaauuuuauuucaauuugaagaagucucugaagcauuguuuguuucagauagaagaaacaaaaagacaugacaaguaaaugauaaguaaguuaggucuagugguaaugaacuccucauuuuuguuuguuugagaaaaacuaucucuccaucaauuuuaaaggauaauuuugccuggcauaguacuccugauuaaaaguuguguuuuguucaauauuuagaacauaucauccaacugucuccuagucugcgaaguuucugccaagaaauccacuaauauucuuacagaaauucucuuaaaaaugacaaaucacuuuucucuugcugcuuugaaaauucuuuauuuguccuuaacuuucgacaacuugaauaaaaugugucuuggugugcagaagauucccaacaugguguuuugacuuaagauuuuuugacuuuaugauggguuuaucuggacuuaacuccaucacaaauugaggagcaucuggacuuaugaugguucaacuuacaauuuuuugacuuccugauggcuuuauuggguauuaaauauauuuccuuuuuuuuuuuuuuuugagacagagucucacucugucaccaaagcuggagugcaauggcaugaucucagcccacugcaaccucugccucccggguucaagcaauucuccugccucagccuccugaguagcugggauuacaggcaugugccaccaugccuagguaauuuuguauuuuuaguagagaaaggauuucaccauguuagccaggcuggucucgaacucccaacuucaggugaucugccugccuuggccucccaaagugcuaggauuacaggugugagccaccaugccuggccuaaauauauuuucaacuuacaauauguucaacuuacaauggguuuaucaggacauccauuguuaaggagcacuuguagucuuccgugguugauccuauuuggggaucuuugagauucagaaaucuggauguccauuucccuccaacaaucuguggaaaguuuucagccauuauuuauuuaaaugagcuuucuaccccuuucucucuucuccuucuagaacucuuauaauaugugcauugguucacuuaaugguguccuauaaauccuguagucuuuuuucacuuuuuucauuuuuuuauccucugacuaaauaguauuaaauggccugucuucaaguuuaccgauuuuuuuuucuuaugcuugaucaagucuacuguugaagcuguuuacugaauuucucauuucauucauugcacucuucagccccagaauuucugagguuuuaagauuauuuuaucucuuuguugaacuucccauuauguuugugcauuguuuuccugauuuaauuggguugucuacuuguguucucuuguagcucacuaagcuuccuuaaaacaauuauuuugauuucccugucaggcaauuuguagauuuucauugcuuuagggucaguuauugaaaaauuauuguguccuuuuggugguuuuauguuuccuugauuuuuuguuuguuuguuucuuauagccauauguugguguuggugucuaugcacuuguggaaacagucacuucuuccagacuuaagacuggcuucaguggggaaagaccuacaccugcaggugggugugaggguguuggcuggguggaguguagcgauccuacucuggcagggcggggaagguagcaauaguucugccuucaggaagggcauggugguguaguuuccauggagcucugucugcugaggucagacaaaaauuagccggacgugguggugcaucccuguagucccagcuacucgggaggcugaggcaggagaaucacuugaacccaggaggcagagguugcagugagcuaagaucacaccacuguacuccagccuaggcaacagagugagacucugucuauaaauaaauaaauaacacuuucaaauuagagccuuuauuacauguguaccauuuauucaacguuacuguguauguaguggaaaacuuaggcacuauuugaaaaaucuagucuuucuagauguuuaaaagugcacaacguaugcuaaaaguagagggcuacaguaacaccguuuaaauauuuuuuuguuaucucacaggagugguugaauuugggaaaggaauugugaaacuggauguuuugaugcugacuauucacuggguggugcugggcagggggagagggaaccaugcagagagaaggguucuguacccauaagcuaaauuaguucagauugucuaaccaauuguuuuauaugugcauuuuaguuaauauuccuguguauuaaaggcuaagcaaguccuaaugccuaaaauauguuaaaaguagagguagcuaagcaauuuaaugcagaaacagaaaacaaaauucuguguguucucacuuauuagugggagcuaaacauugaguacaaguggacauaaagaugggaacaacagacacugggaacuacuagaagggggagggauggaggggagcaagugcugaaaaacauuguuggauucuauagugguccuuaguggccaagguugcagagggcuguugaugugaugaggguuguugggguccuugguguuaaaggcuacuggggcccaguggucuucuuuuaucucacugggggaaugucaugcccaagaaaaucccucuuugcaacaggucuggcauguaaauacacucacugcagugacugugcuggugucugaggcauggaacaugcacaguagccacagagcuaggcucuggagcaugcacgugauugugggaaggagguaguggcuuuggcccugaaggagggcaggacacaguggugguucuuacuccuguggaaacauaauagcagcuccuuccucaaggcaggaacaucuuuguagacuccaggaagcuucauuacacgggcucaacaucacugaagaccauggggagaaagcuguuaguguuccuuggcagugaugaggaccacugagguccucccgcucccuuuuucccccacagggagaggucaugccaagggaucgcucuugguaccuaccuauaccagacugagggagggguagcauagguuaaaaugcuuccuacacuuuucuauguggucauccucaguuuucaugcuccacuggguuacuauaguuccuuuauuguacuccagagcucucccauaacuauuuucauuggcaaguagcuguuuguucauuguuuuuguuggggagauaagcacuggugccuccuaguccaccaucuugcugacaucacuccuccucaauaaguauaaaauuuuucuuaauugacauuacagugaaucgaucugacagcuaccuccuuuaucaagugaccagaguuaagaugacaaguaaugggauaaauugacauccugcacuucaugauaggauucucccagaagauccagcauugcuucagauauagucaugacaaaaauguauaaaucaugaagcaacaucggaugauuccaaacugagaggcagucuacaaaauaacuggccuguaguuuucauuaaguguuaagguuauaugagccaaggaaagaugaacgcuuccagauagaaggaaaaaauacacgacaaguaaaugauaauccugacuugaauguuggaccuacuaaagaauguuauuggauaauuggugaaauuugaacaaaaucuggggauuagaggguaguauuguaucaaugugaauuuucugauuuugaugguuucacuuuggucaugaagaaaaguaaucuugucuuuuaugaaauauacacugaaguauuaaggggaaauggggcaucauaucugcaacuuacucucgaaugagaaaaaauauacaguuguguguguguguguguguguguagagagagaaugauaguaaggucaaugcaguaaaaugccaacaaugcaggaaacuaggugaaaggucuacaaaaauucugcaucauuuuuguaacuuuucuuuauauuuuaaauuucuccaaaagauaguuuuuaaaaagcuuuaaaagcacaagcaauuuuuuucuacacaauauuggauaaauaauagcaaacguuauagguagauaugacaaaaacuagcaaaugacuggaguuugggaccccaugcugaaucauccugcagcuccugaacuugucuugauuuugcagcaagcgaaggcagccuucccagaauaggcuccacuaaauaggaacguggagggucaaagccauuccucagcuucucccagaacauuugacuuugauuucauuacccaaauauuuaggcaguaauaaugauaauggcaguaauaauauuaccuaaccaacucuguaggaauuaccuauacuuccuaauagcccuuugacauuaauuuagccauaaacuaaucuauuuaagucacucaucagaaaaucaaauuuuuaaggcuuucuacuuaaaaaaaaaaauccguauuauuuaccauaaccuccauuuauauacuugucaguugggaaggaagugucagauucaguagacauuuucucaccuauucccaaauagagucccucugguggccgagucaagauguagcucauuugcaucacccucaccauucucucacugccuuucccaucaauacagcugcaauucagaaucuugcccuucauuauuucucuauaauuugcaaaugucucucuuuugucucugguaugcuuccuuaagacuuacuuacagauuccucuucauucaaacacaauuuauucccuuucauaaauucacuauucaugucaugcccaccuaauaauuuacuguuuuguuuguuuguuuguuuguuuuugagauggagucucucucugucacccaggcuggagugcaguggcauaaucucggcucacugcaaccuccgccuccuggguucaggcgauucucccuuuucagccuccugaguagcugagauuacaggugugugccacuaccccuggcuaauuuuuguauuuuuaguagagacggcguuucaccauguuaaccaggcuggucucgaacuccugaccucaggugauccaaccgccucagccucccaaagugcuaggauuauaggcaugagccaccaugccuggccuauaauuuacuuuuuaaaaaacacauuaugagccaaacacaguggcucaugcauguaaucccagcacuuugggaggcugagcccagaaguuugagauaagccugggcaauaugcugaaaccucaucucuaccaaaaauacaaaaauuaagguugggugcauuggcucacaccuguaauccuagcacuuugggaggucgaggcaggaggauuacuugagcccaggaguucaagacuagccugggcaacuuagcaagacucugucucuagaaaaaaaaaaaaaaaggaaaaagauacaaaaauuagcugggcaugguggcauguaccuguagugccagccacuuggaaggcugaggcuggaggaucaccugagccugggaaguuggggcuguggugagccaugaucacaccacugcacuccagccugggugacagagugagaccccaucucaaacacacacacacacacacacacacacacacacacacacaacccauagagagcuuauaauuuugaugggaagaaagucguauuaauuuguaacaauacuuuacaaggacaacgccacuguuuguuaacaugaguuucuguuguugccacagaauauacugcacuauguccuggcacguucauuucaaagcaaugucagcaaauuaacaauaucaucuugaccagcucaucuaaguagauaauaauuaguuugcaucccaguucauaacacuguugcacaugcucccuacacugaaaaaaaaaauauauauauauauauauaucagucuguuuuguauaaacgggcccaaacauagcaugcuuuucuguuuauuguuuccacugcaaucucuguacuuacguuccgugaaaugaauucaaguuucaaaugagagcagaaaaaggucaugaaacaucagaguaugaccucuauggaaaaucucuaguuggguuuuucuuaugugccagcccgugcuccaaaacuuuauauguaugacauauuuaaauccccuaaacaauccucauguuauggacuggauuuucauguuccccuaaaauucacauggccaaaucuaaucccuauugugaugguaucuggagguagggccuuugagaggugaucaggucaugaggguggggcccucacacugcaguuaguucccuugugagaagagaacaaagagcuaauucacacuccuucugucacacaaggagaaaagaaguacaaagucugcaauguggaagaaguccuucaacagaacccaaucaugcuggcacccugaucucagacugccauccuccagaacugugagaaauaaauauuuguuguuuaagccacccaaucuaugacaauuuuuuauggcagcuuggacuaagacacauaaugauguagacacuguucuaacccuaauuuaagugaugaggaaacagucauagaaaugcuguagcuagauaaaauacaagauuugggaugguugugguggcucaugccuauaaucccaguguuuugggaggcugaggugggaagauuacuugaggucaggaguuagagaccagcuuggacaacauagaccccaucucaacaaaacauaauaauaaaaauuagccuggcaugguggccgaugccuguaguccuagcuacuuaggagguuaaggcaggaggauaacuugagcccaggaguucaaggcugcagugagcuaugauugugccacugcauuccagccugggugagaaugagacccugucuuaaauaauaauaauaauaauaaauaaaauaaaaaaauacaguguguccuauauuuucauuugauaaaaguggcaacccuacauagaaaaaauaaguaaguugaccaaggccacacagccacacagcuguuagcagugguaacuggcuccagagcucacaauuuuaucuuggaaauccuguaagaaguaaaugagaggcagggcaugguggcuuaugccuacaauccuaguauuuugggaggguaagggggguggaucauuugagcccaggaguucgagaccagccuggacaacauuucuacaaaauguagccaaguguggugguaugccccuguagucccagcuacuugggaggccaaggugggaggaucacuugagccuaggagauggaggcuccaaggagccaagauggcacuacugcaauccagcaugagugacagaacaagacucagucucaaaaauaaaaaaaauauuaagugaaauaguccauauaaauggcuuagcacggugucugguaucuaggaaggauucacccacuaguugucacuaauaauuccaauaaccagucuuguuguugcucauugaacuccucuguuccuaagaucuucaauauccuuaacagcccacuaccauuucauuccuuggaccuucaaagcccauggacuucccagcuucuucccaauuccuaacuccuaagcucuuccauuccucuccucccacacuguuacucauucucaccagaccugcuuuucaguugcauuaauuaagacccucuugucacuaggcugucacuggguucccccaucagucccugccaccgcagcagcacgucacuucuugcaagccucaauucuucuaccaucuuuucuccaucugggaucuccaggaguccucucaaccucuucaccugagaacauuugacagcuguggucauugacuucacucccgaugcagccuuuuuggcaccagugguuucucuaaugcuguguggcaauguuuugucucuaguuucuugccaucuccuaaaaugcuuuugcuaaucaauaaauggagcugggacaacuggacauccacaggcaaaauaaugaaguuagaccccugucucauaccacauagaaaaauuaacucaaaauggauccaaaaucuacagguaaaagcaaaaacuaugaaacauccaggagaaaacacagggguaagucuuugugaccuuggaauaggaaauacgcucuuaaauaggauaccaaaaguacaagcaacaaaagaaaagauagauaaguuacacuuugucaaaauuaaaagcauucauacgucaaggacacuaucaggaaagugaaaaacaauccacagagcaggagaaaaaaauaauauauauuaaggauguaguauccagaauauauaaagaacucuuacagcucaaccacaaaauggcaaauauuccaacuuaaaaaugggcaaagaauuuuaauagacaguucuccaaagagauacaaaugacauaagcacaugaaaagaugcucaauggcaucaagucaucagggaaauacaaaccaaagccacaagagauacugacucauacccaguaggauggcuggaaucaaaaagacagacaauaacaaguguagacaaggaugcggcgaaguuggaaaccucauacacuaacccucauacacugcugaugggaauguaaaguagugcagccacuuugggaaacaguuuggcaguuccucaaaaaauuagggauaccaaauaacccaggaauuuuacuccuugauacauaacuaagagaaauggaaacauauguucacacagauucuaccaugaauauucauagcagcauuauucauaauagcuaaaaaguggaaacaacccaacuaccugucaacugaugaaugaauuuaaaaacagguauuauauccauacaauggaauuucauucaccacgaaaaggaacaaaguacugauacauguuauaacaccaaugaaacuggaaaacauugugcugagagaaagaagccagucacaaaagaccacauaguauauguuuccauguauauaaaaugugaaaauaggcaaauccauacagauagaaagcagaucaaugguugucaggggcuagggguggaagaaauggauagcgacuguuuacuggguuucuuuuggggaugaugcaaauguucugaaaguggacaaugauaaugggugcacaucuugugaauauccuaaaagccacugaauuauacacuuuaaaggggcaaauuuuaugguaugugaaaaauauuucaauaguaaauacuuguaccaaaguucauuccucuccugaaguagacccugcuaccacuugcccuuggaagaaacucugccccucuucuuuuaccuaaaaauuaacuccaccagacauaaagucccucaaauccaacucugaccucaucccuggguucacagaaguucccugccacaagagaaagcccugaucauccuccagcaacuguguccuccucuguacuugaagccaaucccuccuuuccugucagggaaccacaccugccuccuaucucuaucaguccugcucucccuucuggggccuuccucucucuacacaaacaugaucauggcuuccacaucuuaccaaaagcaaaagaccuucaaaaggcacaagugcccucccugugcccauaucccuggcaaaccaccugucuucccaaaggacaccaagaugaguuuccccaaguacccaccacucucccaaccucacagcacauggcagcugccacucacccgccaucaagccugcucccaccaagaccggcaccuaagcccaaccagugguguccuuucagguuucauccuacuucauuuuuuuucugccuuuaauacugcugaccaucauguaccucuugaaaugcuguugucucucuucccuggcuugacuuuuaaauauucauuaacauaaaaucgcccuuuauuaagcaccugcuaauaccaggcccuguacuuucaccaguccucugggccagugugaacaaugcuguggaacagagguucugucuauuugucuuauguggcacuggagcccagaucaguuacaucuaaggcccagaauaaaugauucaucccagcucuagauggcuccaacauccauguucuuucuaccaccucgcacauucucccugacugaucucauccaccucauggguucagacaccaccuccuugccaauggcacccuaucucuaucuccagcccuaaaaucucuucugagcucacuuccagcugguugcagagguugagaggugaucucugcauacccaggaguguuacugcugggccugugggaacuuccaugagcccccgagcugcccuuccacagggauuaaugccccuguguucucuucagaccuccguugugggccuccucaauuuccucugcuguuuccuuauuuuguuuucuguccuugcuauggucugaaugugucccccaaaauucauguauugaaaaccuaauccccaaugcaauaauguuaagagguggggguuuuggagaggugcuuaggucauagcagcugagcucccucaucaccuuuuuuuuuuuuuuuucuuugagacgaggucuugcucugucacccaggcuggagugcagugacacaaucagggcucauugcagccucaaacuccucggcucaaaccguccucgcaccucagccuccuguguagcugggacuacaggccugagccaccacaccuaacugggaagucauucaguagcaagaccucccugucaagaccuagcauauaaggaacuggucaugauacccacuuugcaaaggagguagcagaucuaaaagaaauaggugauuugcuaaagccaccaucugguauaccauaagagcucacuauaacuggugaaacucauccuaaucuucugcacaccacauucuccagugacuuuccaggaaaucucaagaaugaaguuugaaaaacagcaucggaacgguuuccucacagaaguacaucuuacguaacuaaauggccagaaggaaggacaaagaaaugacuggugaucauguuaaauuuuuuaaaggguccuaaaaacaguccagaguccuauuggaaauugaggaauuuguagaaugucugcacauuucucucuaugguucuaagccuggauaacuucaugcaggcuuaauuccugaaugcuccaugacaauuucaaaguccacauccaauuaagaugugacggaaaugccauggaccaauugaauguuaucacaagaaaucauaugucaaagauauacauuugcuggugugcugugaugaagcuaagacagccaagacaacacagugacuacagugcucagcgucacagggugaucucaugggaggaagguaaaacugacccuacuuggaaauccugcuuugcuaauucugucacgucacugaaauuggaggagauuuagugaacagaguuguagaugauaguuguugguuuuuuuuucuuuucaguuaauucuuuucuuucuuuccuuuuuuuuuuuuuuuuuuuuuuggagacggaguuucccucuuguugcccaagcuggagugcaauggcacgaucucggcucacugcaaccuccaccucccgggcucaagcaauucuccugccucagccuuccaugaagcugggauuacaggcacgggccaccaugcccagcuaguuuuuuguauuauuaguagaaacgagguuucagcauguuagccaggcuggucucgaacuccugaccucaggugauccccucaccucugccucccaaagugcugagauuacaggugugagccaccgugcccggccccaguuaauucuuuuccagccaucuucaccaccagcuuuggcacaaucauauguccugucagaaauauaauucauuuguaaaaaaaaaaaaaaaaaaaaauuacgguuaaaauuuaaaaauccagcaguuggaugggcaguuuuggacuccauugguuuuagugaugugacuauaacucugaacaugcaucaaguuuuuaaaagaaaaauuauaggcagcacaguggcucaugccuauaaucccagcccuuugguaggcugaggcaggaggaucccuugagcccaggaguuugagaccagccuggagaacaaaaugaggccaugucucuacaaaaaauuaaaaaaugagccagguguggugguacacaccuauagucccagcuacucaagaaaaucacaugagcccaggaguucaaggcugcaaugagcuaugaucacaucacugcacugcagccugggagacagagagagauccugucucuaaauauauauauagauagauagaugauagauagauagauagaugauagauagauagauagauagauagaugauagauagauagauagauagauagauagauagauagauagauuuaaauuuauauauauaugaggccagaaucuuauaacgaucuuaggccuacuauugccagcuaguagugccauaugaaucaugccuuucuauucuguuuuucugaugcuuugccaucuggggccuugccgauccuggagagacugcaccucccaagcuaaccaauuccuagagauaguaaaaugacucuccugcaggcaugucuuucauaugcaaaccaacuaauccagagcucacacuccauccuccuccuucaggaagcucuuaaacucagggccaauauccaccuacccuaaucaccccagggucaggaaccagacauuuagggacagccacuaugcuccagggcccaucaauguuauccaaacuggccucccuaaaccuguuuacccuuccucuccuauuccuucccugaaaccacaauaaaggcucuuggccaccuauuucccugcucccucugccuccugcccaacguggugcuucccagaguggcgcugcacugcuuucagugccuccuguuuccagggaucugugaguauuauuucuuucuuuuuuuucuuuuucuuuucuuuucuuucuuuuuuuuuuuuagacagagucucccuuagucgccaggcuggagugcaguggcgcgaucuuggcucacugcaaccuccacccaccggguucaagcgauucuccugccucagccuccugaguagcuggggcuacaggcgcaagucaccaugcccagcuaauuuuugugauuuuaguagagaugggguuucaccauguuggccaggauggucucgaucucuugaccucgggauccacccgccucagccuccaaaagugcugggauuauaggcaugagccaccgcgcccggcccauuucuuucuuuaugacagucauuuacauaucugugugucucaccauaccugaucccaggugcauuuugaaacaauugcccauacuggucugccaggggcccugucucucuauucaacagaagucacaacuccuggaaagggaccgugcaggaagugggauuaggggcagacaaggagaggcagaggugccaccucaccagugcuguucuagcagcugaugccagguugcgugaggcaguguucacaaaucugggucaaaaugagacacugggcauggaggcuuaugccuguaaucucagcacuuugggaggucgaggagaaucacuugaggccaggaguucaauacaaggcuggccaacauggugaaaccucgucucuacuaaaaaauacaaaaauuagcucugugcugugucgcgugccuguaaucccagcuacucaggagucugaggcaagagaauugcuugagucugggaagcagagguugcagugaguccagaucccgccacuauacuccagccugggugacagagcaagacuccaucuaaaaaaaaaaaaaaaaaggauaaacaaauaagaaccauacauucaguuuuuuauaaggcccaaauuauacauauuuuuuuaauucugggauuaauuucccuuuaugauuucagugcuaagauguuguuuauuuuaugaaauaauauugugauaauuuuuuaaugucuuuauuuggcaacauaaaaaguuggcaacagcccccccaauucauuuuugaaaugugcguguaaaaacccaaaccagaaaucucugcaccagaaaauaagaauuggacaaggaccuggugcuugaaaugaccaauguauguuaucagagugaggccaaagacaauuuacacacuuuucugccaaaaacauggauuccaaagggauuucaccugaauugaagauaaauacaaaggaaaaaaauaagcuuacgaaaaauuacuacaccacaagggauaggacagaucauccuuaaaaaaauuuucaggaaauuauuuagcaucuucaaugaaggguaggaagauaucucuaaaacaaaaauaaaauaccagagaauauaacuuaucacaucaaucccugauuuuaacagcauauugagaaacaaaaagagucaccaagagcugaccugccagucacagcaggguugggcauucuccuguugaacagaaaugauuucagggaccgucagcagcagccaggccacucuuguccaggauggaccaagacaaaacuagcccacuccccagucauauuuaauaaaaucugaauauuggcucaagccacaaaaugccaaacucccccauucuaacuaauaggagugaucacugcuucuuugucaacuacagcauuagccucagucucaucugcccugcucugcagaagaugcacugagaugcccagucauaggauuguccccacuuucugauaucacccaacccagaggacacccucacuuccuugggccuccaaaaucaaccaaccaaagcccagauccuucucauacccuuggacagaggcgccccauggaucccccguggaacacaccaaugggggucacugcaacaaggcacaaacccaacuggaucgacuacaguuguguuccugguagucacucacugaaggacauugacaauaugcucaaguagcaauuaaaagaugauucuuuaacaugauagagagcaucgcuuucaaacaaugacaaaagaggccuuuucaucagucagaaaucaaacagggaacccuaauauuaucaccaugguucuagaaguuauagucaauguaaucagacaaggaagagaaauaaugaauaaagccuuuggcaaaaaacgcacaagacuauuauuagccacagauaauaaaacugucuaaaaagaaucaauggaaaacuauuagaaccaagagugaguucaauaacaugaccuauugcuaauuaauauaaaaccccagaguuggcaagguggcucacuccuguaaucccagcacuuugggaggccaagguggguggauaacgaggucaggaaauggagaccauccuggcuaacauggugaaaccccgucucuacuaaaaauacaaaaaguagccgggcaugguggcacauaccuguagucccagcuauuugggaggcugaggcaggagaaucgcuugaacccaggaggcagcgguugcagugagccaggaucaugccacugcacuccagccugggugacacagcaagacuucaucucgaaaaaauaaaauaaaauaaaccccagagucucccagaaaauaaacuaccaaauauaacagggaaauuucccguucacuauaguaacaaaacaucuagaaauaaaucuaacaagaaaugucacagaaauaaaacgaaauaucugaauaagagguaagacauaauauaaacuuaaauagaaagacuauuuuaaaaauacaugugucuuaaaauaacucaauauauaaauuuaauauaauucugguuaaaaaaucauaucagguuucuguaacuaaaaauaucugcaauggaaagcacauuugagugacggggaaaacgaaaacuaaagauauuaaagagcuacaguaacuaaagcaguauugaaccaccguggauuuaguaaacuggaucaaugaaacagaauagagagcuaaaaaacugauccugguguauauaagagguucagcauauuaaaauauaagugguaaaaacaucaauuguucaauaaaugccauuggaaaaacugucuacuugaaaaauuaacuuacauguuacuucaaguuaaagacaaaacuuaauuaucagauuaaaauguagauaaaaaugaaauucaggcugagcaugaugacuaaugccuguaaucccaguacuuugggagacaaaggcaagaggauuucuugagcccuggaguucaugaccagccugggcaacauagugagaucccaucucuacaaaaacauuuaaaaguuagccagccaugguggcaugugccuguagucccaacuacucagcaggcugagaugggaggaucgcuugagccuaggaggucgaggcugcagugaacuuaugaugaugccaccgcacuccagccugggugacagaguaaaacccugucucaaaaacaacccaacaauuucaaaaacucaugaaauucaaaaagauuuuaggagaaagcacagguaaauaauuauauaaucuuaaagucagaaugacuacaaaggcaaaaaauacgucagaaaaaauggaucaacuuaauuuguaaauuuuaaauuugcaugucaagagaucaaagccguuuaaaaauuagaggaaaacuaagaaaaaauauguagcagaugacauuaaaaugaauacauuuuaacauguaauuuuuacaaaucacagucugaaauaugaacacagauaggaaaaccgucaaacaauaggauacuauuugccaccuauaaacuugggaaauagcuccaacaacuauaauaucuagugaugucaggaauauugaaaaacaguaauucucucucuuuuuuuuuuuuuuuuuuuuuuuuuuuuuuuuuuugagacagagucucucucuguccuucaggcuugagugcaguggugcaaucucagcucacugcaaccuccgccucccagguucaagcgauucuccugccucagccucccaaguagcugguauuacaggcacacgccaccauacaugcccggcuaauuuuuguauguuuaguagagacgggauuuugccacguuggccaggcuggucucaaacuccugaccucaggugauccgcccaccuugaccuuccaaagugcugagauuacaggcaugagcuagcgcgcucggcccucauucauuuuuaaugggaauuuaaagccuggaaaauauaaugcaacaaaauacuauccaugguuauuuuuacgcaguaagauuauggaugauuuuuuucuuuuuaaaaauuuguuuaccaaugucaucuacaauaaacaugguacuuacuuuuguuauuauuucuuuaaaaaagaacaaaauaaaaauugaaaucagaaugucuguucagcaaaggacauaaucuuuugugaaaagaugcucaacaaugagacaaaaccacaaugagacaccaucucccauucaguaggaugaugucuaucaaaacaaacaaacaagaaaccuaccaaaaaauaaguauaggcgaggauguggagacacuggaaaccuugggaacuguuguugggaaugucaaaugguauaaccacuguggaaaacuauauaguaguuuccuuuaaaaauuaaauaguuaucaaauuaucuagcaauuccacuucuguguacacacucgaaagaauugaaagcaaggucucagauagauauuugcauagccguguucauagcaacauuauucacaagaacuaaaagauggauaacccaauuguccacugaugaaaaaugaacaaauaaacaaaauguggucuauacauacaauagaauaucuucagucuuguuuuuuaaauucagccuuaaaaaggaaagaaauucugggccaggggcaguggcuuaugccuguaaucccagugcuuugggaagcugagacaggaggauugcuugagcccaggaguuugagguuacagugggcuaugauggcaccacuacacuccugccugggugacagagcaagacccugucucuuaaggaaaaaaagaaaaaaaaaguaaggaaauucugacacaugcuacaacaugaacaaacuuugaggacauuaugcuaagugaaauaaacuaguuaaaaaaagacacauacucuuugauuccacuuacaugaggguccuaaaguagucaaauucacagagacacaaaguagaaaggugauugccaggggcugggaggagaggggaaugaagaguuguugcuucauggguacaaaguuucaguuuugcaaaaugaaaauaauucugaugauugguugcacaacaaugugaauauacuuaacgucacugaacuguacacucaaaauuguuaagacaguaaauuuuauguuauguguaguuauuacaauauaauuuuuuuaauugaacucauuuauuuucccaaauuuauuaguuuaaaacucagcuuguugguugcugccuuccucaacaccaucccugccacucccaaaucauuggauuagaaagcaaauuuuaaauauuauuuaaaaauauauauauauauauacauguaugucuguauacauacauauauaugcacacacaaagaaggaguuuuuuacauaugaacaagaucuucagauagaagaaucaggcuuauucagugcacaaaacacucaagaauacugagcuacuacaaaugcuauucuaaaugaauuucaaagcuccccaaggauuuaguuacaugauucuaggaaauuagguacuggaacucuuucaguagauuucagaugauccagcaguuuuuaagaacagccggggauaguauaauaccaaaagcauaagcaacaaaagaaaaaaauagauaaauuggauuucaucaaaauuuaaaacuuuugcauaccaucaaaaaaguaaaaagauaauccacagaaugggagaaaauaucugcaaacuauagaucugauaagggccuaguaucuagaauacauaaagaauucauacaauuuaacaauaugauaaauaacccagcuaaaaaaaauguacaaaguuuugaacagacauuucuccaaagaagacacacaaacggcccauaaagcaggagaaaagaugcucaacauuauuaguuauuagggaaugcaaauuaaagccucaaugagauaccaauucccacccacgugaugguuauaaccaaaaugaggaaaauaacaaguguuggcuaggaugugcagaaguuggaaccuucaaauguugcugguggcaacgcaaaaugguacagcuucuacagaaaagaguguggaaguuccucgaagagcuaaacauagaauuauuacaugaccagcaauucuacuucuaggcagaacacaagaaaacugaaaacauuuguuuguuuguuuguuuguuuguuuguuuugagacagagucucacucgguugcccaggcuggagugcaguggugugaucuuggcucacugcaaacuccggcuccuggguucaagcgauucucaugccucagccuccugaauagcugagauuacgggugugugccaccgugcccggcuaauuuuuguauuuucgguagagaugggguuucaccauguuggcuaggcugaucucaaacuccugaccucaagugauccgcccaccuuggccucccaaagugcugggauuacaggcaugagccacugugcccagccuuaaaaacauauguuuaaacaaaaacuuguaaaaaaauguuaauagcaguauuauuccuaauagccaaaagguggaaacaacccaaauguccaucaaauaauuggaaaaacuaaugaauaggauacauacaaaacaauggaacauuauuuggcccuaaaaaggaaggaagcacucauacauguuacaacauagaugaaccuugaaaacauuauacuaagugaaaaacaaaagcagacacaaaaggccauauacuguaugguuccaugucuaugaaauguccagaauaggcaaauccacucaggaaaaaaaaagcagaaugcagauuagugauugcuaggggauggggggaaugggaaaaggaaagugacugcuuaaugguacaaaguuucuuuuggaggggugaugaaaauguucuggaauuaaacaguggcaaugguuacacaacacugugaaugcaguaaaagccauuaaauugugcauuucaaaccugccaaaauaagaauuuuauguuaagucaauuuugccucgauuauaagaaaaaaaaaaaaagaacagccaugggcagcauagcuuucuuucagagccuucaguggaaauggauagaaggagcauuagagauuccuaggacagcccaaugaccacugagguuagaugacugugcaggucacacagucagucaauggcagagccaggacuaccagcuggcuucacucagugcuuucugcagagugcccucagaaucagagcccaugcagguuaucugcauauucucaaaaacaaacacaaaccaccuuuaagaccaggcacuugcacguaagacaguauuugugugcaguaccuaugguacuagguuaccaccagcugcaaccaacuaaaucaaguguccaucagucccaccugccaaugcuuuuauugaugacucuuucauuaguuucauuugcuuguauuucaugauuguuauggacuuuguguuuguguucccuucuccaaaauuccuguguugaaauccuaaccccuaguggaaugguauuaacagguagggccuuucggacgaacauaggccaugaggguggagcccucauaagcaggauagugaccuuauaaaagagaccccagagaccucccuuggccccuuccacuauguaaggacacaaggagaagauggcaaucuggaaaccauaagguggguccucaccagacaccagaucugccagcauauugaucuuagacuucccaaccuccagaaccaugagaaauaaauguuucuuguucaagccaccuggucaugguaauuuguugucacagccuaagacaaugauuuacaucaaguagaaaaauuacacugucaucucacugcucuaauuucuaaucuuagaaaagcaugucauucauacuaucacaguuggcuuuugucccagggauauuugaagacauuucuuguguuuuaaaaaaugauagacagaaugucagcaauuuagggcacauucauaaagacagaucaacaguccauuuuauaaauggcuccaaagaguacacugaaaaaaaaaaaacaggcauucagaacuuuuuugcaagaauacauuauuuggagauaaaaugagaaaaaauaauuaauaucaaaagcaaaucaguauauauuagagugauagaaaaagcucucuagucacauauccccgggguucaggcccugccucuggcuuuucauuaguagguugcuuuauguauuagucuguucucacccugcuaauaaagacauaccugagacuggguaauuuauuaagaaaaagagguuuaauggacucacaguugcacauggcuggggaggccucacaaucauggcagauggugaaaggcaugucuuacauggcagcaggcaagagagaaugagaaccaagcaaaaggggaaaacccuuauaaaucuugugagacuuauucacugcaauaagaacaguaugggggaaaccaccccaacaauucaauuaucucccuccaggucccucccacaacaugugggaauuaugggaguacaauucaagaugagauuuggguggagacacagccaaaccauaucauuuuacaauuuacuuuuaccuuuauauauuucauuugcaaaauaagaauaagaguaacaucuacuuaauagagucaucuuagaauuaacaaaaucguccauaccaagcauuuagcacaugaccuacaccauagaaaauauggaguuuaaugggauguaacauauuuugccugcaaaauuaaauuguacccuuauguuuacuacauaucucuggcaguguaacugagccacguaauugacuauuggaagaaauacgauacuagauuaggaaauauuaguucaaauccuaguuuacauacuuacuaaauagcaagaccuuaggaauuggcuaaguaaauaucacuaaaucucgguuuccuuauuuacaaaaaguaaauaaugccuguaucagacaguguuggggcaagguuuuauuaauagaauaauauacucuaaacauucuaaaauguagaaucuagaauuuaaaagcacauucuagaguuauauaaugcuacauaaaucacauggcuuuacugauagaggacugcagugggacugaaaacaagagaccucucucccaguccugggacuaucaccugggcuccaaggaaugaaguaguuuucaggacaucacuuucuucacuucuagaaugagguaauuaaacaaucauuaggucucuugcaagcucugacauucaaugauaguacacauuugaaucuauaaucaauucugacuuccccuucuugcucaagaaaguaaagagggaugcuugcaucaaaggacccuggaauacguggccugucuuuaccaggcuggaaaaacuccccagccucacccugauuuccaugguauagagccaugaguuugugaaccacauaacauugcauaugcaauaugcaaaggucauggccagaaguugucacuggcgguccaaugacagcaauucuccucucuauccuugagcuccaaggagaaagaugguagaugcugguuagcugguaggaguuuucuucuaguuagguuauaggccccagaccuggggaagccuauuucaucccaaaucuaauccuucuuauuuccugccacaauuaauuauugcaggccaauuaauugaauagcaacuuuuuaaaucauuaaagacuuguuauaauuuaacuaauuauagaaauauuauucagccauaaaaaggaaggaaauucugucacauguuacaacacagaugaaccuuaagggcauuaugcuaaguaaaguaagccagucgcaaagaacauaaacggugucauuucacuuauaugaggagucuagaguagucaagcuggcagagacagaaaagagaauggugguugccaggggcugggaagagguggaaugagaaguugguguuuaauggguacagaacuucagcuuugggggaugaaaaaguucuggagauugguugcauaacaaugugaauacacuuaacaccacugagcugcacuuaaaaauggguaagguggcaaauuuuaggcuauguaaaaauuauuuuaauuuaacuaauuauaugauuaguucaauaaccagcugggaaaucaagagcaaauaauaauuauggauuuucauccuuuccuuccccucuccaauuaucccccacccccacuuuccuccuuuugaacccgggugggucuuagguuuuuuggaauccugaacacacaaaugcuuguaucuccuguuuugaaccaauaugaccuguaaaguaucaagguauugccuuuauuccaaaucuccaccacacaccccacuaaccacacauucguuuuguuuaacaggcuagucuauuaucagacacggaucucuggggacaacuugggcaucaguuguuugccugaggagcagauggcuuuaaucauuggaauuucucuuuaacuaagauuaaugcaaguuaagaauucugaaugggagaagggaagccaagacugauuuuagaaccuguugcccuuuggaagaagaaaggucuagaaggggcaugcuauggggauggaguagggaugacguuguacaguuagagggcagcacagcacugggcucccagggccagaagagauucaacacaggcagaagggauggggacccagauggaagggagcaccagaaagcacuucacagacucaguaacauugccaagcucagcagcacugugcaguucauucagcggcaccugcccuggagaggaggagaaucacucccugucacuccagccugcauagguuguuugcugcugggaaaagggccuagaggccccuuugaaaagcauucuuaugguccaguauugcugguggagccacugguucuggcuacgcugugucuggaguggaauggaggaaguuccuaggaggaagggaagaggcugaaggaccccugggcacugacaaggggggauugggccaacagagaugccuuucuucucucucuuccaagaggcucagagucuuucacaguggugaucaauguaaccucacugaagcccaaaguggacuuauaggaaaaagagaguaacaagauagaggcuuuccucauucacaaccacuaugccagcucuuuuccuccgccaaaaucugacaugccgagucaagccacacccaucgcuuucuggugcugucuggcucauacucugaauauaauuucauuuaguuccugcaaaugcacauguccaacaucucucaucuuccaugagccauguggcaugugggucaaggaagccuauucucucccuucccaaagccuuguuaggggaacagcaggccucuuagugcaacagaugagcaaagccacaucugaccauacauuaguaacacauaaauaaagcugcaagagaggagggauggugugagucagggucccaggauccacccauucucaaucucccccaccuuucucugcgucagggcuuccaauuagaaugcacagagaugcuggcacucacccaacucauucguugaaaaccaacuaaugacaagucaacucagucaaaauggugggccaguugagcuuuucggaagucacauuguuauaaauauaaacacauguauagccacagccuuuccccuuuucuaaagacaugaaauauugaaacauugcaaguacugauccagguaaaugcucuuagucgugaaugacaaaaucucauugaguaggccuuauaugauaaggcaagauuaaacaugaaaauucaggggaaggugcugcagaaaggccaagcuagaaucgcccucuguuacuaauaacugggcaacugaaaucaaugugaauugcaaucuaaaacucccuugcaguuuguuugaguauuuucucuucaaaucucccccucugcgugccuuaguuuuacaauuuagaauuucauauaucuaagcuucuaaauggccaagaaaaaagaaguguuauucaacccgauaaaacuaugccuuucaaacuugaguucuaauucaugauaggggugggccacuuucaaccccuauccucugaucugccacuuuuuacaugauuucuucuuuauucuccaguuguuuuucugcuuucucuaggacaucacaaucaccagcacaacucgccaugcaugaggcuacucacucaaccaagaugcuauaugauuuuggcccucacucaauguacucacacagggaaguguuucacacacacucacucagcuuucaguauaaguuacauuauuagaaacuuuuacuucaauugucugaucacuuggaacaaagcaaguuuuuuggauuuaguuucuucugguugacucauagugaaauauggauaugagacacucccuuauaugaauaaauuagagggcagggcugggguuggauauaaauuauuaguugugucaccuuuuacaaaugacagcaaaugccuuguuuuuccuagacuugacccuacaaaagucaaaagcugcaaaacucuaugucacaucagcaaacagucaaaucaugccccaaccaucaucaccaauucugaauuguucucaaaggcugucacuguaaguacacaaauguaaaugcuuguggaaucccucgcugaauauguauagaccacucccaacuacucuggaagcccucugagaagaagaaaccucuugcacuuucuauaacuaaccuucccucugcccuacaaggcaaggcgcacaauagguauucaaucaacaaucauucauugauugacuuauuauuuuuaccagcaggcaugggagagaaacggaaaacguguuaaaacauuuugcauuguaaauuaucaguuaagaaauuaaggcuguggaaaagaauuacacuaguguaaggaucacucagauaaagaaagaauuguggugugagauuauuacugcgcugaaaaugcucacuguucauauuugucagaaagugacaaacauuuucuaaaaucaagcgugaccaaauuggccuuuguuucccccauuaacacaauaaaaggggguuuagucuucuucgacagucuauuucgagugcgagggguuuucccccuuuucuugucuuuuugacccuuugaacauaauccacuuaguuccccgcuuccuaaagcgccucccacauagcgguuuggggagcgcucugugaagccccggcugagacacuuauuggaacuuuguuccccacauaggcuauuuaggagcgucucgguuuccucgggugacuccacagccuuccuggcucuucucacgcugcgagcaggagucaagggcggugcggugcucggaggggguccggggggcgcugaccaugguccuggccucggagcucgggacgugagcgcagaaggcgcgggcggaggcuguagggagcggccguccgaacccccgccccucccgaccaccggggagccgcgggccuucacgcaaagccuccaccgcacgcucugagccgcucaaaaaaaggguggggcacccagccgcagcugcaaucggaagccgcccgggaggguuucagaagaauggaaccgcggccaacccccucccagacgaccaccgcccgccccagcaggggaucagcccauucccuaugcccacgccccaccucucaagcucaaggagacgcgggcagccuuugugggcgcacggccgcccaccgcccagcccgagccucgccgcacccugcgcggagaaggggcggguagggcggggugcgcgugcagaugcgggaggcgagguccagggcggggcaugaaggcgggcgcgccgggcucaggggcgagggaggggcgauccccgcgccccguccuccgucuccacccccaacccccacaccgaccuggucguugauguucugcagggcuucuuugcccgaggcccuccggaucuccaccuuccggcccgauucaacagauggcucuccgccggcgcgccggcccugccgcgaguacggcggcugcggguccgggcccaagugggcgacgucccgcugcugagccaccaccugccccgagccccggcccaccgacagcgagucgaagucgauggucuuguucuccgaggacccuuccaccgggcagaacaugccacagaauuucugccggggcuuggggcugccggagcccagguuuuuaaaaaaagcagggaccucuucguccucugccgccuucccggauugcuuucucucggccauggcucgggggcucggguaggguccucgccguccguccguccgucugccagucccuaagucucccucgcugugugcacaagcccccuagcugcugccgcggcugccguucgccgcccaccgcaaggugcacaga

SEQ ID NO: 192968 - RNA, 143985 nt, Homo sapiens
ucugugcaccuugcggugggcggcgaacggcagccgcggcagcagcuagggggcuugugcacacagcgagggagacuuagggacuggcagacggacggacggacggcgaggacccuacccgagcccccgagccauggccgagagaaagcaauccgggaaggcggcagaggacgaagaggucccugcuuuuuuuaaaaaccugggcuccggcagccccaagccccggcagaaauucuguggcauguucugcccgguggaaggguccucggagaacaagaccaucgacuucgacucgcugucggugggccggggcucggggcaggugguggcucagcagcgggacgucgcccacuugggcccggacccgcagccgccguacucgcggcagggccggcgcgccggcggagagccaucuguugaaucgggccggaagguggagauccggagggccucgggcaaagaagcccugcagaacaucaacgaccaggucgguguggggguuggggguggagacggaggacggggcgcggggaucgccccucccucgccccugagcccggcgcgcccgccuucaugccccgcccuggaccucgccucccgcaucugcacgcgcaccccgcccuacccgccccuucuccgcgcagggugcggcgaggcucgggcugggcggugggcggccgugcgcccacaaaggcugcccgcgucuccuugagcuugagagguggggcgugggcauagggaaugggcugauccccugcuggggcgggcgguggucgucugggaggggguuggccgcgguuccauucuucugaaacccucccgggcggcuuccgauugcagcugcggcugggugccccacccuuuuuuugagcggcucagagcgugcgguggaggcuuugcgugaaggcccgcggcuccccgguggucgggaggggcggggguucggacggccgcucccuacagccuccgcccgcgccuucugcgcucacgucccgagcuccgaggccaggaccauggucagcgccccccggacccccuccgagcaccgcaccgcccuugacuccugcucgcagcgugagaagagccaggaaggcuguggagucacccgaggaaaccgagacgcuccuaaauagccuauguggggaacaaaguuccaauaagugucucagccggggcuucacagagcgcuccccaaaccgcuaugugggaggcgcuuuaggaagcggggaacuaaguggauuauguucaaagggucaaaaagacaagaaaagggggaaaaccccucgcacucgaaauagacugucgaagaagacuaaacccccuuuuauuguguuaaugggggaaacaaaggccaauuuggucacgcuugauuuuagaaaauguuugucacuuucugacaaauaugaacagugagcauuuucagcgcaguaauaaucucacaccacaauucuuucuuuaucugagugauccuuacacuaguguaauucuuuuccacagccuuaauuucuuaacugauaauuuacaaugcaaaauguuuuaacacguuuuccguuucucucccaugccugcugguaaaaauaauaagucaaucaaugaaugauuguugauugaauaccuauugugcgccuugccuuguagggcagagggaagguuaguuauagaaagugcaagagguuucuucuucucagagggcuuccagaguaguugggaguggucuauacauauucagcgagggauuccacaagcauuuacauuuguguacuuacagugacagccuuugagaacaauucagaauuggugaugaugguuggggcaugauuugacuguuugcugaugugacauagaguuuugcagcuuuugacuuuuguagggucaagucuaggaaaaacaaggcauuugcugucauuuguaaaaggugacacaacuaauaauuuauauccaaccccagcccugcccucuaauuuauucauauaagggagugucucauauccauauuucacuaugagucaaccagaagaaacuaaauccaaaaaacuugcuuuguuccaagugaucagacaauugaaguaaaaguuucuaauaauguaacuuauacugaaagcugagugagugugugugaaacacuucccugugugaguacauugagugagggccaaaaucauauagcaucuugguugagugaguagccucaugcauggcgaguugugcuggugauugugauguccuagagaaagcagaaaaacaacuggagaauaaagaagaaaucauguaaaaaguggcagaucagaggauagggguugaaaguggcccaccccuaucaugaauuagaacucaaguuugaaaggcauaguuuuaucggguugaauaacacuucuuuuuucuuggccauuuagaagcuuagauauaugaaauucuaaauuguaaaacuaaggcacgcagagggggagauuugaagagaaaauacucaaacaaacugcaagggaguuuuagauugcaauucacauugauuucaguugcccaguuauuaguaacagagggcgauucuagcuuggccuuucugcagcaccuuccccugaauuuucauguuuaaucuugccuuaucauauaaggccuacucaaugagauuuugucauucacgacuaagagcauuuaccuggaucaguacuugcaauguuucaauauuucaugucuuuagaaaaggggaaaggcuguggcuauacauguguuuauauuuauaacaaugugacuuccgaaaagcucaacuggcccaccauuuugacugaguugacuugucauuaguugguuuucaacgaaugaguugggugagugccagcaucucugugcauucuaauuggaagcccugacgcagagaaaggugggggagauugagaauggguggauccugggacccugacucacaccaucccuccucucuugcagcuuuauuuauguguuacuaauguauggucagauguggcuuugcucaucuguugcacuaagaggccugcuguuccccuaacaaggcuuugggaagggagagaauaggcuuccuugacccacaugccacauggcucauggaagaugagagauguuggacaugugcauuugcaggaacuaaaugaaauuauauucagaguaugagccagacagcaccagaaagcgauggguguggcuugacucggcaugucagauuuuggcggaggaaaagagcuggcauagugguugugaaugaggaaagccucuaucuuguuacucucuuuuuccuauaaguccacuuugggcuucagugagguuacauugaucaccacugugaaagacucugagccucuuggaagagagagaagaaaggcaucucuguuggcccaauccccccuugucagugcccagggguccuucagccucuucccuuccuccuaggaacuuccuccauuccacuccagacacagcguagccagaaccaguggcuccaccagcaauacuggaccauaagaaugcuuuucaaaggggccucuaggcccuuuucccagcagcaaacaaccuaugcaggcuggagugacagggagugauucuccuccucuccagggcaggugccgcugaaugaacugcacagugcugcugagcuuggcaauguuacugagucugugaagugcuuucuggugcucccuuccaucuggguccccaucccuucugccuguguugaaucucuucuggcccugggagcccagugcugugcugcccucuaacuguacaacgucaucccuacuccauccccauagcaugccccuucuagaccuuucuucuuccaaagggcaacagguucuaaaaucagucuuggcuucccuucucccauucagaauucuuaacuugcauuaaucuuaguuaaagagaaauuccaaugauuaaagccaucugcuccucaggcaaacaacugaugcccaaguuguccccagagauccgugucugauaauagacuagccuguuaaacaaaacgaaugugugguuaguggggugugugguggagauuuggaauaaaggcaauaccuugauacuuuacaggucauauugguucaaaacaggagauacaagcauuuguguguucaggauuccaaaaaaccuaagacccacccggguucaaaaggaggaaagugggggugggggauaauuggagaggggaaggaaaggaugaaaauccauaauuauuauuugcucuugauuucccagcugguuauugaacuaaucauauaauuaguuaaauuaaaauaauuuuuacauagccuaaaauuugccaccuuacccauuuuuaagugcagcucagugguguuaaguguauucacauuguuaugcaaccaaucuccagaacuuuuucaucccccaaagcugaaguucuguacccauuaaacaccaacuucucauuccaccucuucccagccccuggcaaccaccauucucuuuucugucucugccagcuugacuacucuagacuccucauauaagugaaaugacaccguuuauguucuuugcgacuggcuuacuuuacuuagcauaaugcccuuaagguucaucuguguuguaacaugugacagaauuuccuuccuuuuuauggcugaauaauauuucuauaauuaguuaaauuauaacaagucuuuaaugauuuaaaaaguugcuauucaauuaauuggccugcaauaauuaauuguggcaggaaauaagaaggauuagauuugggaugaaauaggcuuccccaggucuggggccuauaaccuaacuagaagaaaacuccuaccagcuaaccagcaucuaccaucuuucuccuuggagcucaaggauagagaggagaauugcugucauuggaccgccagugacaacuucuggccaugaccuuugcauauugcauaugcaauguuaugugguucacaaacucauggcucuauaccauggaaaucagggugaggcuggggaguuuuuccagccugguaaagacaggccacguauuccaggguccuuugaugcaagcaucccucuuuacuuucuugagcaagaaggggaagucagaauugauuauagauucaaauguguacuaucauugaaugucagagcuugcaagagaccuaaugauuguuuaauuaccucauucuagaagugaagaaagugauguccugaaaacuacuucauuccuuggagcccaggugauagucccaggacugggagagaggucucuuguuuucagucccacugcaguccucuaucaguaaagccaugugauuuauguagcauuauauaacucuagaaugugcuuuuaaauucuagauucuacauuuuagaauguuuagaguauauuauucuauuaauaaaaccuugccccaacacugucugauacaggcauuauuuacuuuuuguaaauaaggaaaccgagauuuagugauauuuacuuagccaauuccuaaggucuugcuauuuaguaaguauguaaacuaggauuugaacuaauauuuccuaaucuaguaucguauuucuuccaauagucaauuacguggcucaguuacacugccagagauauguaguaaacauaaggguacaauuuaauuuugcaggcaaaauauguuacaucccauuaaacuccauauuuucuaugguguaggucaugugcuaaaugcuugguauggacgauuuuguuaauucuaagaugacucuauuaaguagauguuacucuuauucuuauuuugcaaaugaaauauauaaagguaaaaguaaauuguaaaaugauaugguuuggcugugucuccacccaaaucucaucuugaauuguacucccauaauucccacauguugugggagggaccuggagggagauaauugaauuguuggggugguuucccccauacuguucuuauugcagugaauaagucucacaagauuuauaaggguuuuccccuuuugcuugguucucauucucucuugccugcugccauguaagacaugccuuucaccaucugccaugauugugaggccuccccagccaugugcaacugugaguccauuaaaccucuuuuucuuaauaaauuacccagucucagguaugucuuuauuagcagggugagaacagacuaauacauaaagcaaccuacuaaugaaaagccagaggcagggccugaaccccggggauaugugacuagagagcuuuuucuaucacucuaauauauacugauuugcuuuugauauuaauuauuuuuucucauuuuaucuccaaauaauguauucuugcaaaaaaguucugaaugccuguuuuuuuuuuuucaguguacucuuuggagccauuuauaaaauggacuguugaucugucuuuaugaaugugcccuaaauugcugacauucugucuaucauuuuuuaaaacacaagaaaugucuucaaauaucccugggacaaaagccaacugugauaguaugaaugacaugcuuuucuaagauuagaaauuagagcagugagaugacaguguaauuuuucuacuugauguaaaucauugucuuaggcugugacaacaaauuaccaugaccagguggcuugaacaagaaacauuuauuucucaugguucuggagguugggaagucuaagaucaauaugcuggcagaucuggugucuggugaggacccaccuuaugguuuccagauugccaucuucuccuuguguccuuacauaguggaaggggccaagggaggucucuggggucucuuuuauaaggucacuauccugcuuaugagggcuccacccucauggccuauguucguccgaaaggcccuaccuguuaauaccauuccacuagggguuaggauuucaacacaggaauuuuggagaagggaacacaaacacaaaguccauaacaaucaugaaauacaagcaaaugaaacuaaugaaagagucaucaauaaaagcauuggcaggugggacugauggacacuugauuuaguugguugcagcuggugguaaccuaguaccauagguacugcacacaaauacugucuuacgugcaagugccuggucuuaaaggugguuuguguuuguuuuugagaauaugcagauaaccugcaugggcucugauucugagggcacucugcagaaagcacugagugaagccagcugguaguccuggcucugccauugacugacugugugaccugcacagucaucuaaccucaguggucauugggcuguccuaggaaucucuaaugcuccuucuauccauuuccacugaaggcucugaaagaaagcuaugcugcccauggcuguucuuuuuuuuuuuuucuuauaaucgaggcaaaauugacuuaacauaaaauucuuauuuuggcagguuugaaaugcacaauuuaauggcuuuuacugcauucacaguguuguguaaccauugccacuguuuaauuccagaacauuuucaucaccccuccaaaagaaacuuuguaccauuaagcagucacuuuccuuuucccauuccccccauccccuagcaaucacuaaucugcauucugcuuuuuuuuuccugaguggauuugccuauucuggacauuucauagacauggaaccauacaguauauggccuuuugugucugcuuuuguuuuucacuuaguauaauguuuucaagguucaucuauguuguaacauguaugagugcuuccuuccuuuuuagggccaaauaauguuccauuguuuuguauguauccuauucauuaguuuuuccaauuauuugauggacauuuggguuguuuccaccuuuuggcuauuaggaauaauacugcuauuaacauuuuuuuacaaguuuuuguuuaaacauauguuuuuaaggcugggcacaguggcucaugccuguaaucccagcacuuugggaggccaaggugggcggaucacuugaggucaggaguuugagaucagccuagccaacauggugaaaccccaucucuaccgaaaauacaaaaauuagccgggcacgguggcacacacccguaaucucagcuauucaggaggcugaggcaugagaaucgcuugaacccaggagccggaguuugcagugagccaagaucacaccacugcacuccagccugggcaaccgagugagacucugucucaaaacaaacaaacaaacaaacaaacaaacaaauguuuucaguuuucuuguguucugccuagaaguagaauugcuggucauguaauaauucuauguuuagcucuucgaggaacuuccacacucuuuucuguagaagcuguaccauuuugcguugccaccagcaacauuugaagguuccaacuucugcacauccuagccaacacuuguuauuuuccucauuuugguuauaaccaucacgugggugggaauugguaucucauugaggcuuuaauuugcauucccuaauaacuaauaauguugagcaucuuuucuccugcuuuaugggccguuugugugucuucuuuggagaaaugucuguucaaaacuuuguacauuuuuuuuagcuggguuauuuaucauauuguuaaauuguaugaauucuuuauguauucuagauacuaggcccuuaucagaucuauaguuugcagauauuuucucccauucuguggauuaucuuuuuacuuuuuugaugguaugcaaaaguuuuaaauuuugaugaaauccaauuuaucuauuuuuuucuuuuguugcuuaugcuuuugguauuauacuauccccggcuguucuuaaaaacugcuggaucaucugaaaucuacugaaagaguuccaguaccuaauuuccuagaaucauguaacuaaauccuuggggagcuuugaaauucauuuagaauagcauuuguaguagcucaguauucuugaguguuuugugcacugaauaagccugauucuucuaucugaagaucuuguucauauguaaaaaacuccuucuuugugugugcauauauauguauguauacagacauacauguauauauauauauauauuuuuaaauaauauuuaaaauuugcuuucuaauccaaugauuugggaguggcagggaugguguugaggaaggcagcaaccaacaagcugaguuuuaaacuaauaaauuugggaaaauaaaugaguucaauuaaaaaaauuauauuguaauaacuacacauaacauaaaauuuacugucuuaacaauuuugaguguacaguucagugacguuaaguauauucacauuguugugcaaccaaucaucagaauuauuuucauuuugcaaaacugaaacuuuguacccaugaagcaacaacucuucauuccccucuccucccagccccuggcaaucaccuuucuacuuugugucucugugaauuugacuacuuuaggacccucauguaaguggaaucaaagaguaugugucuuuuuuuaacuaguuuauuucacuuagcauaauguccucaaaguuuguucauguuguagcaugugucagaauuuccuuacuuuuuuuuucuuuuuuuccuuaagagacagggucuugcucugucacccaggcaggaguguaguggugccaucauagcccacuguaaccucaaacuccugggcucaagcaauccuccugucucagcuucccaaagcacugggauuacaggcauaagccacugccccuggcccagaauuucuuuccuuuuuaaggcugaauuuaaaaaacaagacugaagauauucuauuguauguauagaccacauuuuguuuauuuguucauuuuucaucaguggacaauuggguuauccaucuuuuaguucuugugaauaauguugcuaugaacacggcuaugcaaauaucuaucugagaccuugcuuucaauucuuucgaguguguacacagaaguggaauugcuagauaauuugauaacuauuuaauuuuuaaaggaaacuacuauauaguuuuccacagugguuauaccauuugacauucccaacaacaguucccaagguuuccagugucuccacauccucgccuauacuuauuuuuugguagguuucuuguuuguuuguuuugauagacaucauccuacugaaugggagauggugucucauugugguuuugucucauuguugagcaucuuuucacaaaagauuauguccuuugcugaacagacauucugauuucaauuuuuauuuuguucuuuuuuaaagaaauaauaacaaaaguaaguaccauguuuauuguagaugacauugguaaacaaauuuuuaaaaagaaaaaaaucauccauaaucuuacugcguaaaaauaaccauggauaguauuuuguugcauuauauuuuccaggcuuuaaauucccauuaaaaaugaaugagggccgagcgcgcuagcucaugccuguaaucucagcacuuuggaaggucaaggugggcggaucaccugaggucaggaguuugagaccagccuggccaacguggcaaaaucccgucucuacuaaacauacaaaaauuagccgggcauguaugguggcgugugccuguaauaccagcuacuugggaggcugaggcaggagaaucgcuugaaccugggaggcggagguugcagugagcugagauugcaccacugcacucaagccugaaggacagagagagacucugucucaaaaaaaaaaaaaaaaaaaaaaaaaaaaaaaaaaagagagagaauuacuguuuuucaauauuccugacaucacuagauauuauaguuguuggagcuauuucccaaguuuauagguggcaaauaguauccuauuguuugacgguuuuccuaucuguguucauauuucagacugugauuuguaaaaauuacauguuaaaauguauucauuuuaaugucaucugcuacauauuuuuucuuaguuuuccucuaauuuuuaaacggcuuugaucucuugacaugcaaauuuaaaauuuacaaauuaaguugauccauuuuuucugacguauuuuuugccuuuguagucauucugacuuuaagauuauauaauuauuuaccugugcuuucuccuaaaaucuuuuugaauuucaugaguuuuugaaauuguuggguuguuuuugagacaggguuuuacucugucacccaggcuggagugcgguggcaucaucauaaguucacugcagccucgaccuccuaggcucaagcgauccucccaucucagccugcugaguaguugggacuacaggcacaugccaccauggcuggcuaacuuuuaaauguuuuuguagagaugggaucucacuauguugcccaggcuggucaugaacuccagggcucaagaaauccucuugccuuugucucccaaaguacugggauuacaggcauuagucaucaugcucagccugaauuucauuuuuaucuacauuuuaaucugauaauuaaguuuugucuuuaacuugaaguaacauguaaguuaauuuuucaaguagacaguuuuuccaauggcauuuauugaacaauugauguuuuuaccacuuauauuuuaauaugcugaaccucuuauauacaccaggaucaguuuuuuagcucucuauucuguuucauugauccaguuuacuaaauccacggugguucaauacugcuuuaguuacuguagcucuuuaauaucuuuaguuuucguuuuccccgucacucaaaugugcuuuccauugcagauauuuuuaguuacagaaaccugauaugauuuuuuaaccagaauuauauuaaauuuauauauugaguuauuuuaagacacauguauuuuuaaaauagucuuucuauuuaaguuuauauuaugucuuaccucuuauucagauauuucguuuuauuucugugacauuucuuguuagauuuauuucuagauguuuuguuacuauagugaacgggaaauuucccuguuauauuugguaguuuauuuucugggagacucugggguuuauuuuauuuuauuuuuucgagaugaagucuugcugugucacccaggcuggagugcaguggcaugauccuggcucacugcaaccgcugccuccuggguucaagcgauucuccugccucagccucccaaauagcugggacuacagguaugugccaccaugcccggcuacuuuuuguauuuuuaguagagacgggguuucaccauguuagccaggauggucuccauuuccugaccucguuauccacccaccuuggccucccaaagugcugggauuacaggagugagccaccuugccaacucugggguuuuauauuaauuagcaauaggucauguuauugaacucacucuugguucuaauaguuuuccauugauucuuuuuagacaguuuuauuaucuguggcuaauaauagucuugugcguuuuuugccaaaggcuuuauucauuauuucucuuccuugucugauuacauugacuauaacuucuagaaccauggugauaauauuaggguucccuguuugauuucugacugaugaaaaggccucuuuugucauuguuugaaagcgaugcucucuaucauguuaaagaaucaucuuuuaauugcuacuugagcauauugucaauguccuucagugagugacuaccaggaacacaacuguagucgauccaguuggguuugugccuuguugcagugacccccauugguguguuccacgggggauccauggggcgccucuguccaaggguaugagaaggaucugggcuuugguugguugauuuuggaggcccaaggaagugaggguguccucuggguugggugauaucagaaaguggggacaauccuaugacugggcaucucagugcaucuucugcagagcagggcagaugagacugaggcuaaugcuguaguugacaaagaagcagugaucacuccuauuaguuagaaugggggaguuuggcauuuuguggcuugagccaauauucagauuuuauuaaauaugacuggggagugggcuaguuuugucuugguccauccuggacaagaguggccuggcugcugcugacggucccugaaaucauuucuguucaacaggagaaugcccaacccugcugugacuggcaggucagcucuuggugacucuuuuuguuucucaauaugcuguuaaaaucagggauugaugugauaaguuauauucucugguauuuuauuuuuguuuuagagauaucuuccuacccuucauugaagaugcuaaauaauuuccugaaaauuuuuuuaaggaugaucuguccuaucccuugugguguaguaauuuuucguaagcuuauuuuuuuccuuuguauuuaucuucaauucaggugaaaucccuuuggaauccauguuuuuggcagaaaaguguguaaauugucuuuggccucacucugauaacauacauuggucauuucaagcaccagguccuuguccaauucuuauuuucuggugcagagauuucugguuuggguuuuuacacgcacauuucaaaaaugaauugggggggcuguugccaacuuuuuauguugccaaauaaagacauuaaaaaauuaucacaauauuauuucauaaaauaaacaacaucuuagcacugaaaucauaaagggaaauuaaucccagaauuaaaaaaauauguauaauuugggccuuauaaaaaacugaauguaugguucuuauuuguuuauccuuuuuuuuuuuuuuuuuagauggagucuugcucugucacccaggcuggaguauaguggcgggaucuggacucacugcaaccucugcuucccagacucaagcaauucucuugccucagacuccugaguagcugggauuacaggcacgcgacacagcacagagcuaauuuuuguauuuuuuaguagagacgagguuucaccauguuggccagccuuguauugaacuccuggccucaagugauucuccucgaccucccaaagugcugagauuacaggcauaagccuccaugcccagugucucauuuugacccagauuugugaacacugccucacgcaaccuggcaucagcugcuagaacagcacuggugagguggcaccucugccucuccuugucugccccuaaucccacuuccugcacggucccuuuccaggaguugugacuucuguugaauagagagacagggccccuggcagaccaguaugggcaauuguuucaaaaugcaccugggaucagguauggugagacacacagauauguaaaugacugucauaaagaaagaaaugggccgggcgcgguggcucaugccuauaaucccagcacuuuuggaggcugaggcggguggaucccgaggucaagagaucgagaccauccuggccaacauggugaaaccccaucucuacuaaaaucacaaaaauuagcugggcauggugacuugcgccuguagccccagcuacucaggaggcugaggcaggagaaucgcuugaacccgguggguggagguugcagugagccaagaucgcgccacugcacuccagccuggcgacuaagggagacucugucuaaaaaaaaaaaagaaagaaaagaaaagaaaaagaaaaaaaagaaagaaauaauacucacagaucccuggaaacaggaggcacugaaagcagugcagcgccacucugggaagcaccacguugggcaggaggcagagggagcagggaaauagguggccaagagccuuuauugugguuucagggaaggaauaggagaggaaggguaaacagguuuagggaggccaguuuggauaacauugaugggcccuggagcauaguggcugucccuaaaugucugguuccugacccuggggugauuaggguagguggauauuggcccugaguuuaagagcuuccugaaggaggaggauggagugugagcucuggauuaguugguuugcauaugaaagacaugccugcaggagagucauuuuacuaucucuaggaauugguuagcuugggaggugcagucucuccaggaucggcaaggccccagauggcaaagcaucagaaaaacagaauagaaaggcaugauucauauggcacuacuagcuggcaauaguaggccuaagaucguuauaagauucuggccucauauauauauaaauuuaaaucuaucuaucuaucuaucuaucuaucuaucuaucuaucuaucaucuaucuaucuaucuaucuaucuaucaucuaucuaucuaucuaucaucuaucuaucuauauauauauuuagagacaggaucucucucugucucccaggcugcagugcagugaugugaucauagcucauugcagccuugaacuccugggcucaugugauuuucuugaguagcugggacuauagguguguaccaccacaccuggcucauuuuuuaauuuuuuguagagacauggccucauuuuguucuccaggcuggucucaaacuccugggcucaagggauccuccugccucagccuaccaaagggcugggauuauaggcaugagccacugugcugccuauaauuuuucuuuuaaaaacuugaugcauguucagaguuauagucacaucacuaaaaccaauggaguccaaaacugcccauccaacugcuggauuuuuaaauuuuaaccguaauuuuuuuuuuuuuuuuuuuuuacaaaugaauuauauuucugacaggacauaugauugugccaaagcugguggugaagauggcuggaaaagaauuaacuggggccgggcacgguggcucacaccuguaaucucagcacuuugggaggcagaggugaggggaucaccugaggucaggaguucgagaccagccuggcuaacaugcugaaaccucguuucuacuaauaauacaaaaaacuagcugggcaugguggcccgugccuguaaucccagcuucauggaaggcugaggcaggagaauugcuugagcccgggagguggagguugcagugagccgagaucgugccauugcacuccagcuugggcaacaagagggaaacuccgucuccaaaaaaaaaaaaaaaaaaaaaaggaaagaaagaaaagaauuaacugaaaagaaaaaaaaaccaacaacuaucaucuacaacucuguucacuaaaucuccuccaauuucagugacgugacagaauuagcaaagcaggauuuccaaguagggucaguuuuaccuuccucccaugagaucacccugugacgcugagcacuguagucacuguguugucuuggcugucuuagcuucaucacagcacaccagcaaauguauaucuuugacauaugauuucuugugauaacauucaauugguccauggcauuuccgucacaucuuaauuggauguggacuuugaaauugucauggagcauucaggaauuaagccugcaugaaguuauccaggcuuagaaccauagagagaaaugugcagacauucuacaaauuccucaauuuccaauaggacucuggacuguuuuuaggacccuuuaaaaaauuuaacaugaucaccagucauuucuuuguccuuccuucuggccauuuaguuacguaagauguacuucugugaggaaaccguuccgaugcuguuuuucaaacuucauucuugagauuuccuggaaagucacuggagaauguggugugcagaagauuaggaugaguuucaccaguuauagugagcucuuaugguauaccagaugguggcuuuagcaaaucaccuauuucuuuuagaucugcuaccuccuuugcaaaguggguaucaugaccaguuccuuauaugcuaggucuugacagggaggucuugcuacugaaugacuucccaguuaggugugguggcucaggccuguagucccagcuacacaggaggcugaggugcgaggacgguuugagccgaggaguuugaggcugcaaugagcccugauugugucacugcacuccagccugggugacagagcaagaccucgucucaaagaaaaaaaaaaaaaaaaggugaugagggagcucagcugcuaugaccuaagcaccucuccaaaacccccaccucuuaacauuauugcauuggggauuagguuuucaauacaugaauuuugggggacacauucagaccauagcaaggacagaaaacaaaauaaggaaacagcagaggaaauugaggaggcccacaacggaggucugaagagaacacaggggcauuaaucccuguggaagggcagcucgggggcucauggaaguucccacaggcccagcaguaacacuccuggguaugcagagaucaccucucaaccucugcaaccagcuggaagugagcucagaagagauuuuagggcuggagauagagauagggugccauuggcaaggagguggugucugaacccaugagguggaugagaucagucagggagaaugugcgaggugguagaaagaacauggauguuggagccaucuagagcugggaugaaucauuuauucugggccuuagauguaacugaucugggcuccagugccacauaagacaaauagacagaaccucuguuccacagcauuguucacacuggcccagaggacuggugaaaguacagggccugguauuagcaggugcuuaauaaagggcgauuuuauguuaaugaauauuuaaaagucaagccagggaagagagacaacagcauuucaagagguacaugauggucagcaguauuaaaggcagaaaaaaaaugaaguaggaugaaaccugaaaggacaccacugguugggcuuaggugccggucuuggugggagcaggcuugauggcgggugaguggcagcugccaugugcugugagguugggagagugguggguacuuggggaaacucaucuugguguccuuugggaagacaggugguuugccagggauaugggcacagggagggcacuugugccuuuugaaggucuuuugcuuuugguaagauguggaagccaugaucauguuuguguagagagaggaaggccccagaagggagagcaggacugauagagauaggaggcaggugugguucccugacaggaaaggagggauuggcuucaaguacagaggaggacacaguugcuggaggaugaucagggcuuucucuuguggcagggaacuucugugaacccagggaugaggucagaguuggauuugagggacuuuaugucugguggaguuaauuuuuagguaaaagaagaggggcagaguuucuuccaagggcaagugguagcagggucuacuucaggagaggaaugaacuuugguacaaguauuuacuauugaaauauuuuucacauaccauaaaauuugccccuuuaaaguguauaauucaguggcuuuuaggauauucacaagaugugcacccauuaucauuguccacuuucagaacauuugcaucauccccaaaagaaacccaguaaacagucgcuauccauuucuuccaccccuagccccugacaaccauugaucugcuuucuaucuguauggauuugccuauuuucacauuuuauauacauggaaacauauacuauguggucuuuugugacuggcuucuuucucucagcacaauguuuuccaguuucauugguguuauaacauguaucaguacuuuguuccuuuucguggugaaugaaauuccauuguauggauauaauaccuguuuuuaaauucauucaucaguugacagguaguuggguuguuuccacuuuuuagcuauuaugaauaaugcugcuaugaauauucaugguagaaucugugugaacauauguuuccauuucucuuaguuauguaucaaggaguaaaauuccuggguuauuugguaucccuaauuuuuugaggaacugccaaacuguuucccaaaguggcugcacuacuuuacauucccaucagcaguguaugaggguuaguguaugagguuuccaacuucgccgcauccuugucuacacuuguuauugucugucuuuuugauuccagccauccuacuggguaugagucaguaucucuuguggcuuugguuuguauuucccugaugacuugaugccauugagcaucuuuucaugugcuuaugucauuuguaucucuuuggagaacugucuauuaaaauucuuugcccauuuuuaaguuggaauauuugccauuuugugguugagcuguaagaguucuuuauauauucuggauacuacauccuuaauauauauuauuuuuuucuccugcucuguggauuguuuuucacuuuccugauaguguccuugacguaugaaugcuuuuaauuuugacaaaguguaacuuaucuaucuuuucuuuuguugcuuguacuuuugguauccuauuuaagagcguauuuccuauuccaaggucacaaagacuuaccccuguguuuucuccuggauguuucauaguuuuugcuuuuaccuguagauuuuggauccauuuugaguuaauuuuucuaugugguaugagacaggggucuaacuucauuauuuugccuguggauguccaguugucccagcuccauuuauugauuagcaaaagcauuuuaggagauggcaagaaacuagagacaaaacauugccacacagcauuagagaaaccacuggugccaaaaaggcugcaucgggagugaagucaaugaccacagcugucaaauguucucaggugaagagguugagaggacuccuggagaucccagauggagaaaagaugguagaagaauugaggcuugcaagaagugacgugcugcugcgguggcagggacugaugggggaacccagugacagccuagugacaagagggucuuaauuaaugcaacugaaaagcaggucuggugagaaugaguaacagugugggaggagaggaauggaagagcuuaggaguuaggaauugggaagaagcugggaaguccaugggcuuugaagguccaaggaaugaaaugguagugggcuguuaaggauauugaagaucuuaggaacagaggaguucaaugagcaacaacaagacugguuauuggaauuauuagugacaacuagugggugaauccuuccuagauaccagacaccgugcuaagccauuuauauggacuauuucacuuaauauuuuuuuuauuuuugagacugagucuuguucugucacucaugcuggauugcaguagugccaucuuggcuccuuggagccuccaucuccuaggcucaagugauccucccaccuuggccucccaaguagcugggacuacaggggcauaccaccacacuuggcuacauuuuguagaaauguuguccaggcuggucucgaacuccugggcucaaaugauccaccccccuuacccucccaaaauacuaggauuguaggcauaagccaccaugcccugccucucauuuacuucuuacaggauuuccaagauaaaauugugagcucuggagccaguuaccacugcuaacagcuguguggcuguguggccuuggucaacuuacuuauuuuuucuauguaggguugccacuuuuaucaaaugaaaauauaggacacacuguauuuuuuuauuuuauuuauuauuauuauuauuauuuaagacagggucucauucucacccaggcuggaaugcaguggcacaaucauagcucacugcagccuugaacuccugggcucaaguuauccuccugccuuaaccuccuaaguagcuaggacuacaggcaucggccaccaugccaggcuaauuuuuauuauuauguuuuguugagauggggucuauguuguccaagcuggucucuaacuccugaccucaaguaaucuucccaccucagccucccaaaacacugggauuauaggcaugagccaccacaaccaucccaaaucuuguauuuuaucuagcuacagcauuucuaugacuguuuccucaucacuuaaauuaggguuagaacagugucuacaucauuaugugucuuaguccaagcugccauaaaaaauugucauagauuggguggcuuaaacaacaaauauuuauuucucacaguucuggaggauggcagucugagaucagggugccagcaugauuggguucuguugaaggacuucuuccacauugcagacuuuguacuucuuuucuccuugugugacagaaggagugugaauuagcucuuuguucucuucucacaagggaacuaacugcagugugagggccccacccucaugaccugaucaccucucaaaggcccuaccuccagauaccaucacaauagggauuagauuuggccaugugaauuuuaggggaacaugaaaauccaguccauaacaugaggauuguuuaggggauuuaaauaugucauacauauaaaguuuuggagcacgggcuggcacauaagaaaaacccaacuagagauuuuccauagaggucauacucugauguuucaugaccuuuuucugcucucauuugaaacuugaauucauuucacggaacguaaguacagagauugcaguggaaacaauaaacagaaaagcaugcuauguuugggcccguuuauacaaaacagacugauauauauauauauauauauuuuuuuuuucaguguagggagcaugugcaacaguguuaugaacugggaugcaaacuaauuauuaucuacuuagaugagcuggucaagaugauauuguuaauuugcugacauugcuuugaaaugaacgugccaggacauagugcaguauauucuguggcaacaacagaaacucauguuaacaaacaguggcguuguccuuguaaaguauuguuacaaauuaauacgacuuucuucccaucaaaauuauaagcucucuauggguuguguguguguguguguguguguguguguguguguguguuugagauggggucucacucugucacccaggcuggagugcaguggugugaucauggcucaccacagccccaacuucccaggcucaggugauccuccagccucagccuuccaaguggcuggcacuacagguacaugccaccaugcccagcuaauuuuuguaucuuuuuccuuuuuuuuuuuuuuucuagagacagagucuugcuaaguugcccaggcuagucuugaacuccugggcucaaguaauccuccugccucgaccucccaaagugcuaggauuacaggugugagccaaugcacccaaccuuaauuuuuguauuuuugguagagaugagguuucagcauauugcccaggcuuaucucaaacuucugggcucagccucccaaagugcugggauuacaugcaugagccacuguguuuggcucauaauguguuuuuuaaaaaguaaauuauaggccaggcaugguggcucaugccuauaauccuagcacuuugggaggcugaggcgguuggaucaccugaggucaggaguucgagaccagccugguuaacauggugaaacgccgucucuacuaaaaauacaaaaauuagccagggguaguggcacacaccuguaaucucagcuacucaggaggcugaaaagggagaaucgccugaacccaggaggcggagguugcagugagccgagauuaugccacugcacuccagccugggugacagagagagacuccaucucaaaaacaaacaaacaaacaaacaaaacaguaaauuauuaggugggcaugacaugaauagugaauuuaugaaagggaauaaauuguguuugaaugaagaggaaucuguaaguaagucuuaaggaagcauaccagagacaaaagagagacauuugcaaauuauagagaaauaaugaagggcaagauucugaauugcagcuguauugaugggaaaggcagugagagaauggugagggugaugcaaaugagcuacaucuugacucggccaccagagggacucuauuugggaauaggugagaaaaugucuacugaaucugacacuuccuucccaacugacaaguauauaaauggagguuaugguaaauaauacggauuuuuuuuuuuaaguagaaagccuuaaaaauuugauuuucugaugagugacuuaaauagauuaguuuauggcuaaauuaaugucaaagggcuauuaggaaguauagguaauuccuacagaguugguuagguaauauuauuacugccauuaucauuauuacugccuaaauauuuggguaaugaaaucaaagucaaauguucugggagaagcugaggaauggcuuugacccuccacguuccuauuuaguggagccuauucugggaaggcugccuucgcuugcugcaaaaucaagacaaguucaggagcugcaggaugauucagcauggggucccaaacuccagucauuugcuaguuuuugucauaucuaccuauaacguuugcuauuauuuauccaauauuguguagaaaaaaauugcuugugcuuuuaaagcuuuuuaaaaacuaucuuuuggagaaauuuaaaauauaaagaaaaguuacaaaaaugaugcagaauuuuuguagaccuuucaccuaguuuccugcauuguuggcauuuuacugcauugaccuuacuaucauucucucucuacacacacacacacacacacacaacuguauauuuuuucucauucgagaguaaguugcagauaugaugccccauuuccccuuaauacuucaguguauauuucauaaaagacaagauuacuuuucuucaugaccaaagugaaaccaucaaaaucagaaaauucacauugauacaauacuacccucuaauccccagauuuuguucaaauuucaccaauuauccaauaacauucuuuaguagguccaacauucaagucaggauuaucauuuacuugucguguauuuuuuccuucuaucuggaagcguucaucuuuccuuggcucauauaaccuuaacacuuaaugaaaacuacaggccaguuauuuuguagacugccucucaguuuggaaucauccgauguugcuucaugauuuauacauuuuugucaugacuauaucugaagcaaugcuggaucuucugggagaauccuaucaugaagugcaggaugucaauuuaucccauuacuugucaucuuaacucuggucacuugauaaaggagguagcugucagaucgauucacuguaaugucaauuaagaaaaauuuuauacuuauugaggaggagugaugucagcaagaugguggacuaggaggcaccagugcuuaucuccccaacaaaaacaaugaacaaacagcuacuugccaaugaaaauaguuaugggagagcucuggaguacaauaaaggaacuauaguaacccaguggagcaugaaaacugaggaugaccacauagaaaaguguaggaagcauuuuaaccuaugcuaccccucccucagucugguauagguagguaccaagagcgaucccuuggcaugaccucucccugugggggaaaaagggagcgggaggaccucagugguccucaucacugccaaggaacacuaacagcuuucuccccauggucuucagugauguugagcccguguaaugaagcuuccuggagucuacaaagauguuccugccuugaggaaggagcugcuauuauguuuccacaggaguaagaaccaccacuguguccugcccuccuucagggccaaagccacuaccuccuucccacaaucacgugcaugcuccagagccuagcucuguggcuacugugcauguuccaugccucagacaccagcacagucacugcagugaguguauuuacaugccagaccuguugcaaagagggauuuucuugggcaugacauucccccagugagauaaaagaagaccacugggccccaguagccuuuaacaccaaggaccccaacaacccucaucacaucaacagcccucugcaaccuuggccacuaaggaccacuauagaauccaacaauguuuuucagcacuugcuccccuccaucccucccccuucuaguaguucccagugucuguuguucccaucuuuauguccacuuguacucaauguuuagcucccacuaauaagugagaacacacagaauuuuguuuucuguuucugcauuaaauugcuuagcuaccucuacuuuuaacauauuuuaggcauuaggacuugcuuagccuuuaauacacaggaauauuaacuaaaaugcacauauaaaacaauugguuagacaaucugaacuaauuuagcuuauggguacagaacccuucucucugcaugguucccucucccccugcccagcaccacccagugaauagucagcaucaaaacauccaguuucacaauuccuuucccaaauucaaccacuccugugagauaacaaaaaaauauuuaaacgguguuacuguagcccucuacuuuuagcauacguugugcacuuuuaaacaucuagaaagacuagauuuuucaaauagugccuaaguuuuccacuacauacacaguaacguugaauaaaugguacacauguaauaaaggcucuaauuugaaaguguuauuuauuuauuuauagacagagucucacucuguugccuaggcuggaguacaguggugugaucuuagcucacugcaaccucugccuccuggguucaagugauucuccugccucagccucccgaguagcugggacuacagggaugcaccaccacguccggcuaauuuuugucugaccucagcagacagagcuccauggaaacuacaccaccaugcccuuccugaaggcagaacuauugcuaccuuccccgcccugccagaguaggaucgcuacacuccacccagccaacacccucacacccaccugcagguguaggucuuuccccacugaagccagucuuaagucuggaagaagugacuguuuccacaagugcauagacaccaacaccaacauauggcuauaagaaacaaacaaacaaaaaaucaaggaaacauaaaaccaccaaaaggacacaauaauuuuucaauaacugacccuaaagcaaugaaaaucuacaaauugccugacagggaaaucaaaauaauuguuuuaaggaagcuuagugagcuacaagagaacacaaguagacaacccaauuaaaucaggaaaacaaugcacaaacauaaugggaaguucaacaaagagauaaaauaaucuuaaaaccucagaaauucuggggcugaagagugcaaugaaugaaaugagaaauucaguaaacagcuucaacaguagacuugaucaagcauaagaaaaaaaaaucgguaaacuugaagacaggccauuuaauacuauuuagucagaggauaaaaaaaugaaaaaagugaaaaaagacuacaggauuuauaggacaccauuaagugaaccaaugcacauauuauaagaguucuagaaggagaagagagaaagggguagaaagcucauuuaaauaaauaauggcugaaaacuuuccacagauuguuggagggaaauggacauccagauuucugaaucucaaagauccccaaauaggaucaaccacggaagacuacaagugcuccuuaacaauggauguccugauaaacccauuguaaguugaacauauuguaaguugaaaauauauuuaggccaggcaugguggcucacaccuguaauccuagcacuuugggaggccaaggcaggcagaucaccugaaguugggaguucgagaccagccuggcuaacauggugaaauccuuucucuacuaaaaauacaaaauuaccuaggcaugguggcacaugccuguaaucccagcuacucaggaggcugaggcaggagaauugcuugaacccgggaggcagagguugcagugggcugagaucaugccauugcacuccagcuuuggugacagagugagacucugucucaaaaaaaaaaaaaaaaggaaauauauuuaauacccaauaaagccaucaggaagucaaaaaauuguaaguugaaccaucauaaguccagaugcuccucaauuugugauggaguuaaguccagauaaacccaucauaaagucaaaaaaucuuaagucaaaacaccauguugggaaucuucugcacaccaagacacauuuuauucaaguugucgaaaguuaaggacaaauaaagaauuuucaaagcagcaagagaaaagugauuugucauuuuuaagagaauuucuguaagaauauuaguggauuucuuggcagaaacuucgcagacuaggagacaguuggaugauauguucuaaauauugaacaaaacacaacuuuuaaucaggaguacuaugccaggcaaaauuauccuuuaaaauugauggagagauaguuuuucucaaacaaacaaaaaugaggaguucauuaccacuagaccuaacuuacuuaucauuuacuugucaugucuuuuuguuucuucuaucugaaacaaacaaugcuucagagacuucuucaaauugaaauaaaauuauccuaaacagcaacacacacacauaagcauaugaaagcauaaaucacacagggaaagguaaauauauagaugcagacagauucauguaacacuguaaagaugguauguaaauuacuuuuaaccccaauguaaaaguuaauagagaaaaugucgcuaauggauauaugauauaaaaagaagcauucuuugucuacaagaauacaaagugcuugugugggggaguaaaaugguaguguuuuuuuauacauuugaacuuaaaauagaagguuaaaaacuguaagauauuuuacacaagccuuuaucuaauagcaaagaaaaaaaccuguaacagauacacaagagaugaaaaaucaaagcauauuacuacaaaaaucaucaaacaacaaagacagcgagaaaacaagaguuaaaacaaugcaagacaaauagaaaauaauuaacaaaauggcaaugguaaauccucauuaauaauuacuuaaauguaaauggauuaaucucaccaaucaaaagguguagaggcugggugugguggcuaaugccuguaaucccaacaaucugggaggcccaggugggaagauugcuugagcccaggaguuugagaccagucugggcucaaacuaugucuuuaacauagggaaaccccauaucuacaaaaaaauuuuaaaaauuagccaggugugguugugcaugucugcaguccuagcuacuaggaaggcugaggugggagaaucgcuugaggcugggagguugaggcugcagugagccaagcuagcaacugaacucuagucugggugacagucugagugaccuuguuucaaaaacaaaacaacaaaaaacccacaaaagguauagagugacugaauguauaaaaaacaagaucaagucauaugcugucuauaauagauacacuuuauuuauuguuuccagguuuuuaaaaauucccauauuaaaaaaauuuuuuuuuuuugagguggcagucuugcucuguugcccaggcuggaguguaguggcaugaucauaggucacuggaaccucaaccucgugggcucaaguugucuuccugccucugccuucugaguaguucgggcuacaggcauguaccacugugcccaacuauuacaauuuuuaauuuuuuuguagagauggggucucacucuguuucucagguauguuuuaaacucuggcuucaggugauccuucugccucauccucauaaaguguugggauuacaggagugagcuaccacaccuggccuaacuuuuauuuuuaaaaaguuaauacaugcauuauaggaaagugaaaaacacaagaagcaaagaacaaaguuguccacaaucacaagcagcuuacaguuugcuguguccuucuagguccuguguguguuuagacacaacauccaguuuuauuggauugagagcauacaguauguauguaucaugcuuuuucacacaucaugaauauuuaccaauuuaaaauuccaaagugauaugaauauuuugauaacuaaaaauacaugacaccagcucaaucuguuagaaaaaaguauaaucccaccucuuuugggacaaaaauuucauagaagacaaaaauggcaacgcuccucuagauaaagguauuggcagaauuccaauuaaaauacugcauuuccuuaauguucaauuuaaacugaaacauaaagcaacagaguacaccaaguauagugucuaagauaauucauuaucagaucuauaccauucaaauguuagcaaggagguauauuuccauugaauuacucaauuuacucuugcaguucagccaaagagaugcacauacgucaguuggcuacagucaaaauguaaauaugaacacaucugcauacaucucucccuucacacuuccuucugcuccucugcugccuaccuaacaaguccugauauacacugcucagggauagguuaacaauucuguauccaagcuucauuuuuuguaucaauuauaagaagauauuuaugaauuggcuaauucacuggcucuaccuugguuuuuuuuuuuuugagauggaguuuugcucuuguugcccaggcuggagugcaauggcaggaccuuggcucacuacaaccucugccuccaggguucaagcgauucuccugcuucagccucccaaguagcugggauuacaggcaugugccaccacgcccagcuaauuuuauauuuuuaguagagacaguguuucaccauguuggucaggcuugucucgaacuaccgacuucaggugaucugcccaccucggccucccaaagugcugggauuacaggcgugagccaccgcgccuggccacuagcucuacuuuuuaucauacauuguuugcucaggguguuccuauuuaaaagauacuuucaggccgggcuggucuugaacuccugaccucaggugauccaccugccuuggccuuccaaagugcuaggauuacaggcaugagcccuguacccagccugaaaguaucuuuuaaauaggaacauucuagccuagaaccuuuuuccuuccuacuucugucaacccaauggacagauauaagcaucuauaguacuuagcagggauuuucacaaacaaaagaacagucuuuucuaugaauuuuaacacaaaacagacucaauguauuaguuuacuaacccuacuuuugucauaugcuggcgaccucuuuaacaucuagaaggacuagauguuuuaaaucaggacuugcuuguccuuuauguaugguauaaacauagccaaguaaaagacaaugcauggacauaagggacaguagccaauugugccucaccauacacacacugguaucaaacccuuuggaauuccuucuccuccuuucucccugaaccagcaugaauauaguaauguguacugcucagagaaguggugugaucauucaauuuccaaaagacaauauuucauaugaauuuuacaaaaggauauuuacaaaguguguucuuuauuaccacuacguuuaauauacuuugugcacuucuaaacaccuggacagacuagauguuucauauaaggacuuaaguucgucuacuauauacacaguaguauugaauaagcuacacauguaacaacgguuauaucugaaaguaucaucuauauuguucuggucuagaauccuccauuucuuccaguuccucuccaccgccaaucugauggauauaaguacaugugucacuuggacgugauguuaucauuuuacuucuaaaaguccuuuugagaagacagcuuuucugugaauuuuaauacaaaguguacaaaaugaauagauacacuuuagaauuaaagacacauguagguugacaguaaagggauagaaaaggauauuuuaugcaaauaguaaccaaaagaaaccagagggggcuauacuuauaucagacaaaauagacuuuaggucuaaaacugucuguagacacaaggaagaucauuuuauagugauaaaaaggucaguucuacaggaaaauauaacaauauaacaaucauauacacacucaacaucagagcaccugaauauauaaagcaaauauugacagaucugaggacaggaauugacagcaauacauuaauaguaggggacuuugauaccucacuuaacaauaagugauagaacauccagacagaaaaucaauaaagaaacacugacuugaacaacacuauggaaaagauggaccuaaccaccauaugcagaacuucuuauccaacagcagaaguaugcacauuuuucucaggcacacacaaaacauucucugggauagaucacauauuaggccacaaaaugagucuuaacaaauuuaagacguucaaaauaauucuaaguaccuuuuucaaccacaaugaaauguaacuacuaaccuauaacagcaagaaaacaggaaaauucacaaauauguggaaacaaaacacacuccagaacaaccauuggcucaaagaagguaucaaaagggaauuuaaaaagugucuuagcgaggcgcaguggcucacgccuguaaucucggcacuuugggaagcaggugggcagaucacuugaggucaggaccuccaaacuagccuggcuaacguggucuggaguucaagaucauccuggccaacauggugaaaccccaucucuacuaaaaauacaaaaaauuagcugggcaugguggcaugcaccugugaucccagcuacuugggaggcugaggcaggagaaucacuugaacccgggaggcagagguugcagugagcugagauuaugccacugcacuccagccugagcaacagagugagacuccaucucaaaaaaaaaaaauaaucucagcauugaauuucccugcuccuuuaucaaagauaauucgacuauauuuauguguguuucuuucugggcucucuguuuucuucccuugaucuguuugucuugacaaccauagcuuuauaguaaaucuugaagucaggaaguaucugacuuguucuacuccuucaauuucacguugccuauucugggucuuuuggcuuuucauauaaacuuuagauuucauuuguugauauccacaaacaauuugcuggcauuuugauugggauuuugauugugucgaauguauagauccaguugggaagaacugacaucuugacaauauugucuuccaauccaugaacuugggaauauuucuucauuuauuuagcucuucuuugauuuuguucaucaaaaaaauuguagguuuccuuacauagaucuuggauguguuuguuagacuuauaccuaaagauuucauuucgugggugcucauguaaauuguauuguguuuuuaauuauaaaucccacuuauucauuguugcuauacaggaaagcaauggacuuuuguauauuaaccuuguaucuugcaacuuugcuacaauugcuuaucaguuccaguuuuuuuguugauuguuuuagaccuucuacauagaugauuacaccaucugcucaacaaauaucaaaaauauuagcauuuugguguauaucuuucuagagucuuuuaaaaauaaauuagacaccuuuauauuuauuguguguauauacacauaauuguauguaacauaaauguuacauaauugggauucagugagaaagcuucuaguuucuuaucugagaugcuagacuuuuauucucacaacaagaaaaauccugcagaggccgggcgugguggcucacgccuguaaucccagcacuuugggaggccgagacggguggaucacgaggucaguaaaucgagaccauccuggcucacacggugaaaccucgucucuacuaaaaauucaaaaaaaauuagccgggcgugguggcgggcaccuguagucccagcuacucaggaggcugaggcaggcgaauggcgugaacccgagaggcggagcuugcagugagccgagaucgcgccacugcacucccagccugggcgacugagggagacucagucucaaaaaaaaaaaaaaaaaaaaaaaaaaaaaagaaaagaaaaauccugcagaaacugaaaaucaacaacucuuuaucagucagaugauugaggucacaaggcaagacacuucaccugcaauuggugagacaagcccauacacagaaucaaagcuuacuagaggccaggagcgguggcucaugccuguaaugccagcacuuugggaggucgaaguggguggauugcuugagccaaggaguuggaggccagccugggcaauguggcgaaauccugucucuacuaaaaaugcaaaaauuagccgggugugguggcacacaccuguaaucccagcuacucggguggcugaggcaagaaaacugcuugaacccaggagguggagguugcagugagccaagauugugccacugcacuccagccugguugacagagagagacccugauugaaaaaaaaaaaauugcuuacuggagcagaagcccacugcagcagcaagaugcagauuccuuuuacucaguacauuguauccacccuucaacaaaaaauuacacggcaaauugaaagacaaaaaacaauuugaggagacagaacaagcaucauaaccagacccagauauuguagagauuuuggauugcugacaggaauuuaaaauaacuauuuaacguguuaaggccucuaauggacaaaagugaaaaacaugcaagaacagaugcauaauauaagcagagagauggggacuuuaauaaagaaucaggacuagccaggagaccagagauguagcaccuggagcagcauggcccagccuuguggagugcaucugagcgggaaggccugcaagcaggcggaggucuucaggcaaaaucuuuuccaggaggcugaggaauuccccuacagauucuugccacagaaagucauauaucugaaucagcucuugcaaaaggaguccuucaauguggcugaucugaccucccucugagugccacugaaauccccaucccagacccucuauccaaggaugaugaguuggaaacagauaagcaggaggagaaagaagucucccuggcaugagaagguccuuuuccuguuccccuggauaagacagaagucuggacucucaaagagaaaugcauucuggugaucacauggauccagcaucugauccccaagauugaggauggacauuauuuugggauaucacuccgggagaaggugcuggagaggauaaaggcagucaagaccaaagugguuccagacaaccacguccaaguacuucucagaacauggagaugcuguggccaaggccuccaaggaaauucauguaauggauuauuaccaggccuuggugcacaggcaagaugaggcaccuauggggagaucggggacaccgugcuugaacugagggcuuucuaugcugagcuuuaucauaauuucagaagcaaccuggagaaaauuguuaacccaaagggugaagagaagccgucuauauacugagcccagggcuagaagagaaauaaaugacuuauacuuuguguggauuaaaagacaauaaucaaggccuuuuccucucagaaguccccucucucacaguagacagagagcuguuuuccuauuuuuuuaccuauuaaaccuccacuccuaaacuccuaacaguaauaauaauaguaauaauaauaauaauaauauucaggccaugugugguggcuuaugucuguaaucccagcacuuugggagucugaggcaggaacauuguuugaacucaggaauccaagaccagccuaagcacuauagugagaccuccucucuuaaaaaaaaaaagucaccagacaugguagugcaugccuguggucccagcuacuugggaggcugaggcaggagaaucacuugagccugguggucaaggcugcagugagcugugauugcgccacugcauuccagccugggugacagagugagaccucaucucaaaaacaaaaccaaaccaaauaaaaaauaggccgggcgcaguggcucacgccuauaaucccagcacuuugggaagcugaggcgggcagaucauuugagaucaggaguuugagaccagccugaccaacauggggaagccccgucccuacuaaaaauacaaaaauuagcuagggaugguggcaggugccuguaaucccaguuacucgggaggcugaggcaagagaaucacuugaacccaggaggcggaggcugcagugagcugagaucaugccacugcacuccagcccaggugacagagggaagacugucucaaaaaaauuaaguuaauaauaauaauaauaauaauaauaaucaaaaggauaugcuagaaauaaagaaaacacuauacuagaaaugaagaaugccuuuuauuugauugaucaagaggcaggacccagccaaagaaagaaucagcgagcuugaagaaaugucaguagaaacuuccaaaauggaaaugaagagagagaaaacaaugaaaaugacggaacagaauauccaagaaauacgagaaaauuaccaaagauuuaauauauguauaaaggugauaucagagggagcagaaagacagaaagggacaggggacauacuggaagccauaaugacugcgaauuucucaaaauuaaugauagcauaccacagguacaggaagcucagagaacaccaagcaggaucaguacuacaaaaaucuaucccugggcauaucacauucaagcugcagaaaaucaaagacagaaagaaaaccuugaaagaagucagaaguaaaaagcacuuuauauauagaggagcaaggauaguguuauaccggauuucucuugagacccauacaagcaagaagagagugaagugaaagauuucgugcugaaagaacaaaaacaccaauguagaauuuuguauccagcaagauuguccuuuaaaacugaaugauaaauaaagacuuucucagacaaauaaauguugagagaauuugucacuggugacauugcaagaaauguuaaaaaaaaaaucuucagagagaaggaaaaugacauaaaaagagaguuggaucuacuuaaagaaaggaagaguguuagagagaaauaaaucaagguaaaauaaaguaaauaaaguauuuuuaagauucuuaauugacccaacagauaccuguuuguccaaaauaacaauagaaacaacaauaauguauuagguaguuauagcuuauggguaaauuaaauaaggaaaaguaacauuacaagggaugggagcauugggaauacucugcuguaagguaugugcaucaccugcgaugaagugguauaguguaauuugaacauggacuuguuguaaguguauacugcaaacucaagggcaaugaccagaaaaagcuaaaaagggacauaauugauuuuuugagaggugagaaaauggaguuacauaaaguaaucaauuaaaaugacagaaggcagaaaaagaaugaaagacaagaaagaaacgaagaacaaggacaaaaauauaaaauaguaacaagcauagaagauauuaauccaacuaucaauaaucacuuaaaucuuaaugguaaauacaccaguuuagagauagagauugucagagugaauuaaagcaaaauagauguaacuauaugcuguguacaagaaacccacccuaaauauaaaaauacagauagauuaaaaggauggagaaagauauguuaugucuuuuagucaggguucuccagaaaugcagacugaugggagauagauagacugauagaugacaaguggcuuauuagaggaauuagcucacucuguuaugaaggcugagaauucccaugauagacugucugcaagcuggagaaccagggaagcugguagcuggcucagugcaagucugaaggccucagaugcaaggaugccuaugguauaacucucaggcugaaccaaaggccugagagcugguggggagagggggucugguguaagucccagagcgcaagagcuggagaacucagaguucugacacccaagggcaggagaaaauggauaucuugccucuggaagugagagaguuuacccuuccucugccuuccauccaggcccccagucaguuggauggugcccacucacauuacaucuggaucuuccccacuuuguccacugacucacacacuaaucucccccagauacaccuucauagacauaccugggacaacccaauuauucuaaucaaaagccaaacccuuugagcagaagagggauggucucagugccuacugacgcgcugagaauaauugauccuuuaccagcuaucugaguaucuuuuaauccagucaaguugacagccccaaucuacuaucacaccaugcuaacagaaaucaaaggaaaguuagaauagguauauuaauuuaugacaaaguagacuucagagcuaggaaaauuaucagggauaaagaggggcacaacguaaugauaaagaagucaauucuccaagaagauauaacaaucuuuacuguauaugugccuaacaacagagcaucaaaauacaugaggcaaaaacugauagaauuucaaggagauauaaacaaaucugccaguauaguuauagacuucaacaccccucugucaguaacugacagauccagcagacagaaaaucaguaaggacauaacagaacuaacaccaucaacuaaauggaucuaauugaaauuuauauuauacaucacccagcaacaguagaauucacauucuucucaagcuuacaugggacauggaacauucaccauuccaggccauaaaacacacccuuaacacauuuaaaagaauaaaaaucauacaaaguaagcucucagaccacaaugaacuuaaacuagaaaucaguaacaggaagauagcuggaaaauccccaaauauuuuaagaauauacuuuuauuguauuuuauuuuuagaaaugaggucuugcucuaucucucaggcuggaguguaguggcauaaucauagcuuauggcauccuugaacuccugggcucaagcaauuuuccugccucagucuccugaguagcugggaccacagaggcaugcuaccaugccuggcuaauuuuuaaauuuuuuauagagacgcggucugacuauguugccaaugcuggucuuaaacacuuaggcucaagcaauccuccugucucagccucccaaaacauugggauuacaggugugagccacagcacacagccuaaacaauauauguuugaauagcacaugggccaaggaagacaucucaaaagaaauuuuaaaaauauuuuuuaacuaugagaagaugaaaauacaacuuaucaaaauuuguggaccgcagcaaaaacagugcuuaaugagagauuuauaccauuaaacgcauauauuagaaaagaagaaauaucuaauaucaauaaucuaaacuuccacuuuaggagacuagacaaagaagagcaaauuaaauucaaaguaaacagaagaaaagaaauaauaauaauuagagcagaaaucaauggcauugaaaacaggaaaucaaaagagaaaauaaaaccaaaagcugauucuuugaaaagaucaguacaauugaugucucaguccauuuacuguugcuauaaaugaguaccugagacuggguaauuuauaaagaaaggaaaguuauuuccuacaggucuggaggcugggaaguccaaaguccaugugcuauuucuggugcgggccuucuggccggugggucuucucugcagaguucugaggaggugcagggcaucacaugugagagugcuuacaagagacugccaaacuggcuuucauaacagacccgcucuugugauaaguagcccacucccucaauaacccauuaauugguuaaucugugaaugaauuaauccauucaugagugcagagcccucaugacccagucaccuuccaaagauucuaccucucaacacugcugcacugcggaugaaguuucaugugagaagggacaaacauucaaaccauagcauuugauauaacucuagcuaggcuaagaaaagaagagagaagacacaaguuacuaauaucagaaaugaaagacaggccaucacugcugaucccauggacaugaaaaggguaauaaaggaagauuaugaacaacucuauguccacaaauuugauaauguaaaugauauuggccaauucuuugaaauucacaaucuaccuaaacucacacaagaagaaauagauaaucggaauagaccuauugcuauuaaagaaauacaauagaaaauaaccuuccaaaaccgaaagcaccaggcccagauucauucacuggugaauucaaccaaauaauuuuuuaaacuuuuauuuuagguucagggguacauguccagguuuguuauauagguaaacuuaugucgugggggguuuguuguacagauuauuucaucacccagguacuaagccuaguacccaauacuuauuuuuuucugauccucucccuccucccacccuccauccuuaaguaggccacagugucugugguuccccucuuuguguccauguguuuucaucacuuagcucccacuuauaagugggaauaugcaauauuugguuuucuguuccucuguuaguuugcugaggaugaugucuuccagcuucaucuauguucuugcaaaggacaugaucucguucuuuuuuaugacugcaugguauuccaugguauauauacaccacauugucuuuauccaauguacaguggucauuuagguugauuccaggucuuugcuauuuugaauagugcugcaacgaauauacacaugcaugugucuuuaugguagaacaauuuauauuccuuuggguauauacccaguagugggauugcugggucgaaugguaguucuauuuuuaguucuuugaggaaugaccacacuacuuuccacaguaauuaaacuaauuuauacucccaccaacagugcacaaguguuccauuuucucugcaaccucaucaguaccuguuauuuuugggcuuuuuuuuuuuuuuuuuugagacggagucucacucugccacccaugcuggagugcaguggcacgaucucugcaaccucugcuuuccggguucaagcaauucucugccucagccucugaguagcugggguuacacaugccccccaccacacccagcuaauuuuuguauuuuuaguagggaugggguuucaccaucuuggccaggcuggucuugaacuccugaccucgugauccacccgccuuggccucccaaagugcuaggauuacaggcaugagcuaccgugccuggccauuuuuuggcuuuuuaauaauagccauucugacugaugugagaugguaucucauugugguuuuaauuugcauuucucuagugaucagagauacugagcuuuuuuucacaugcuuuuuggcugccuguaugucuucuuuugaaaagugucuguucauguccuuugcccaguuuuuaaugguuuuuuuuuuuguaaauuuguuuaaguucuuuauagaugcuguguauuagacuuuugccagaugcguaguuugcaaauauuuuuucccauucuguaaguugucuguuuacucuguugauaguuucuuuugcucugcagaaacucuuaaguuuaauuccaucccauaugucaauuuuugcuuuuguuguguuugcuuuuggcaucuucgucaugaaaucuuugcccguuccuauguccagaaugguguuguauagguuguauuccaggguuuuauaguuuuggguuuuacauuuaagccuuuuauccaucuugaucuaccaaauaauuaaggaguaaaucauaccaauucucuauaaucuuuuccagaaaacagaagcaguggggauaccuccuaauucauucuaugaggccaaaauuacccuaauaccaaaaccagacaaaggcauuauaagaaaagaaauccauagaccaguaucucuaaugaauauaaaugucaaaauccucaaaaauauuaacaaauaaaaugcaacaauguauacaaagaguuucuacauuagaaccagugggauuuacuccagguuuacaagagugguucaacauucaaaaucaauuaguacaaucacaucagcacgcuaaagaagaaaaaaagaucacaugauuauaccaauagaugcaguaaaacuaucgacaaaauucaacaucuauuagugauagauagaaagcuaaguauauagggaaacuuucucaacuugauaaagaagaucugcaaaaauggcuaacaucauauuuauggugagaaaccauaaacuuuccugcuaacaauaggaaaaggccaaugauuucccuucucagcacuuguauuuaacauugcacugaaauccuagguaauacaagaagcaagaaaagaaaaaaaagguauauagauuaggaaggaagaaauaaaacuuuguuugcauaugacaucacugccuaugaaauaaaucccaaagaaucaacuacaauaaaaacuccuggaacuaguaaaugauuauaucaagauuguaggauaugagguuauuguacaaaagccaauugguuuucuauauaccagcaaugaacaauuagaauuuacauuaaaaacauacuauuguuuauguuaacaccaaaaaaauuagauauaaaucuaacagaauauguauaagaucuguaugaggaaaucuacaauucccuaugcacaaaaucaaagaagaucuaaauauauggaaaggcuuggugcaguggcucaugccuguaauccuagaggccgaggcagguggauagcuugagucaaggaguuugagaccagccugggcaacauggggaaaccucaucucuacaaaaaaauacaaaaaauuagcuugguuggggggcgugcaccuguagucccagcuacaagggaggaugaguuggaaagauugcuugagccugggagacagagguugcagugagccaugauugucagccugggugacagugaaaaaaaaauuauauauauacuuguauauguaguacuuguauagguaguuauauauauuagcauauauacacauauacuauauauacauauacauguauuauauauuauauauaguauauauaguauauauaaauauauaguauauauuauauauauaaauauauauauaaguauauauauaguuuauaguauauauaaauuauguauauacuauauauaguauauacuauauaaauuauauauaguauauauauacuauauauauuauauauacuauauauaguauauacuauauauaguauauacuauauauaguauauacuauauauauuauauauacuauauauauacuauauauaguauauauaguauuuauauaauauauauaguauauauauacuauaguauauauaguauuuauauaauauauauaguauauauauaguauauauauacuauauauauaguauauauauaguauauauauauaguauauauauauaguauauauauauaguauauacacacauacaugcacacacauuuuuauauguaauugucuauguaauaaaucccgaagaaucaacaacauuaaaaucuccuggaacuauuaaaugauuauaucaagauuguaggauauaagguuauuauacaaaagucagcugcuuuuguauauaccagcaaugaacaauuagaauuuauauuaaaaacauacuauuguguacaaaaaauacuuaguuauaaaucuaacaauauguauauauguacagaaagauuuuuuguguucauagauagauggauugucaugaucuucccgguuugauccacacauuagauacaaucaaaaugccagcaaguuguuaguagacaucaacaaacugaaucuaaaguuuauauggagaagcaaaggaguucagaaugggcaacaugaaauugaaggagaaaaacaaauuagauaccaucugacuucaaaacuuacuauaaggcuacaguugccaagacagugugguagauaaacagaucaagggaagagagcagagagcccagaaggggacccacacagauauaguugacauauccuugauaaaggaacaaggacaauucaguguugaaaauacagccuuuucaacaaaugaugcuggaacaacuggccaaccccaugcaaaaacauaaaucuagacacagaccucacaucuuucaggaaaauuaacucagaauacaucauagaccuaaauggaaaauggaaaucuauaaaacuccuagaauauaacauagaagaugacuuuuuagauacaacaccaaaagcaugguccaugaaaaaaauaauugauaagcuggacuucaaaaguaaaaaacuucugcucugugaaagacacagucaagagaaugaaaagauaagccagagacugggaggaaaaaaauugcaaaagacacacauaugguaaagaacuguuauccaaaauguacaaagaacucuuaaaacccaacaacaagaaaacaaacacccaauagaaaagugggccaaagaucuuaagagacaccucaccaaagaagauguacucacggcaaauaagcaugugaaaagguucucugugucauaugucaucagggaauugcaaaguaaaacaacaauuagaacaggcaugguggcuuaugccuguaaucccagaacuuugggagccgagcuagguggaucauuugaggccaggaguuugagaccagccuggccaacauggcaaaacccugucucuacuaaaaauacaaaaaaaaaaaaaaaaaaagccaggcauugugguacaugccuauaaucccagcuacucaggagccugaggcaugugaaucauuugaaccuggaaaguggagguuguagugagccaagaucacaccacugcacuccagccugggugacaaagaagacuuuuucuaaaacaaacaaacaaacaaacaaacccagcaacaaugagauaccacuacacaccuguuaggauggccaacauucauccuggauuuucauguguaguggcaucucauuucauccucaccagcaauggagaguuccugucgcucuacauccuaacaccaaaugcuugugaggauguggagcaacaggaacucucauucauugcuggugaggaugcaaaaugguacagccacuuuggaagacaguuuggcaguacauuacaaaacuaaauauuaucuuaccauaugauccugcaaucauacuccuugguauuuauucaaaggagaugaaaacuuauuucuaacaaaaaucucuacagaaauguuuauagcagcuuuauucaugauugcaagaacuagaaaucuaccaagauguccaugaguaggugaauggauaaacaaccugugguacauucagacacuggaauauuacuaggugauaaaaagaaaugagcuacaagccauuaaaagaaaugaaggaaccuuaaguauuuauugcugauugaaagaagccuaucugaaaaggcuacauaaugugauuccaacucuaugacauucuggcaaaggagucacuaaaaagaucaguguuuaccaugggcuuggggaaggggugaguggaagagagcaauaguagguagagcacaggggauuuuuaggacagugaaacucuucuacaagauacuguggugguggauacaucuuauuaccuuuuuaaaaccauggaauauacaaacucccaagagugagcccuaauguaaacuguggacuucagugaauaauaauguaacuauauuggcucaucacuuguaacauauguaucacacuaaugcaagauguuaauauauuaguaauaggagaaacaguguuugccuugugguggagggagaaagggauauaugggaaucuuguuacuuucugcucuuuuucuguaaaccuaaacugcucuaaaaaauaaagucuauuaauuuaaaaagaugggauccuaauguauaaacucuguuguaucuugcucuuuguauuuaauacuauguugcacacauuaaaaaauuaauaguuauaugguuagauaaaacaugaauuuaaacaauucuccauuguuuuuacuauuuuuaaaacuauuuauuuauuuauuuauuuuuugagacggagucucgcucugucucccagacuggagugcaguggcgccaucucagcucgcugcaaccucugccucccggguucaagaaauucucuggccucagccucuugaguaacugggacuacaagcgcacgccaccacgccuggcuaauuuuuuguauuuuaguagaguugggguuucaccguguugcccaggcuggucucgaacuccugagcucaggcaacccacucgccuccgccucccaaagugcuaggauuacaggugugagccaccacguccggccuaaacuauuucuaguagugcuaugaagaacauucauaaacaugaauauuugcccauuauuuccuuacaauaaauuuauagaaaagaaacuucuguaucaagaauuaugcacauuaaaaauuuuaaucauauuuccuuccacaaagauuguaccaauuuacauucuugcgaaagaaaugagagagcccauugcuucacacuuugguuaauacuuaguacaguauuuucaaucuuuucagccuccaucuauuuaacaucuaaaauauaagaucucaauuuuuaaaaauuguccuuuaguaaaguuaaacauauuuucuuguauuuauugagcauuuaauuucuuuuuuuaugaguggcugguucaugugcuuuucuuaguucuuuaaguaauuuggaauguucaucuuuaugauucauaaacaauuaaggauauuaacucguagguuucaaauauuuguuucuuaauuuaucgucuacuuuuaaauguuauguauauuaagacauuuaaauuuucuauaucaucagcucuauugaucuuuuccuugaugguuucuugcuuugaagucaugcuucucaagguucccucuaacuaccccaagaucuuuuauacucuggcuugcauuaaauucacaaguuucaguaggaagucaggguugcagggaggagcccccugugaugucucaguaaucccacugcucauuccuaaacucaucaaccacaccuggagaccacguucccaucucauuaugcugagcugaaacauugcacaaaaguccuuccuccacuuuccuuugccucacaucccagcucugccauggcuaguccaugggagauaaucuguuaaaagaaauaaugcagauaugcuaagcagaguugguuuagcagaagacaggguguaauaauuaaucaggagcagacgcgaccauucccgacggccuuggcagcucacucugccugaaccuggguggcaggggcugcauguuuagaacuuucacaaaacaggguauauuuccauucuccaggucaggccuuccauggauuauuuacagaaugaggaauaagacaagccuuagaauacuuuuagacagagcccaaucaaaggauuuauuuucacuuuauucucuauuuaagauaacauuuagcuuuuauuacaaugauugcagcccucugcuggugggaugcaccuaucugcaggucugggaaggucuggaccuccauuuacucgauguugaaggcagacauaaaugaguuuguccacagcucacagcucacagcucacagccaggcucugugggcugcaccccaugagaaauucuaggugaaggauuugagggcuuccucucucccaagcagaaauaaugggucuuggugauacccaauaucucacuugaaccagguucaucucuaugcuuuaauagaagcauuaaaacaguaagcagccaucauuuuugggcagagggagauauccuacugguauuuuccaaucacuaacauccucugucuuugcaauauguauaauuuuauccuuuuaguaaaggugcauguggacauuaguaugaucuauguaaguauaaucaccagcaguuacaaagugcugguuccacccauuuuccaaccagaaaggaaagaaacaucauuaaucauaugaugaguguuugucaggccuccaagucuaaagaagaauuuaaauugagcuaggggaagggaaguuguaagagagcagcuguccacaguuauuaaugguaccuuacacuacacaguugcugccacauccauuaucucacccucuaccugccgucagcagccuugaaagaagcagggggagggaugggaggggggugaguaugagaaaugcaagacucuacuaggguuggucauugggcauuucugaguugaugcccaucggaugugggagugguuauauccaguugccucucagcagccucagacaaccacuccugcuuucuugaaguacucuccauucuugguguccaauacaugcuacucugccucucucuggccacuccugagucuucuuugcagaccacccuuucuuuaguugaaucagagguaucaggacugacccucuccucuccaucuuuaccuccuccucagcuggugucguagaauuauuugacuuaauuaccauccaugaguggauguuccuaaauucacaucuuaagccccaacuucucacuugagugccuuauuauuuccacuuggauaucuuaaaggcaucucaaauuaccauggccccaauggaaaccaucccccuaaccgaguggaaauccugaucagcucccccauaaucccacacccccacuucaccccgcuacucacuuggucuuucuuacauccauuaauacagcaguccccaacuuuuuuggcaccauggaccaguuucauagaagaccauucuuccauggaaagagggacuggggcaugguuuugggaugaaacugucccaccucagaucaucagggccuucgucagauucucguaaagagcaugcaaccuauaucccucccaugugcaguucacaguaggguucgagcuccuaugaagaucuacuggcuggcugaucugacaggagguggagcucaggcgguaaugcuggcucacuugcugcucaccuccuacugugaggcccaguuccuaauaggccauggacggguacuggucugcagcccagggguuggggaccccugcguuaauauaccaccauucaacuuugaaucaauuuccaaaucuagaguucacacuugauauuauaguuuuauuuacauaccaccauucaccuugauucaaucccccaaucuagaguucacacuugauaguuuucuccuacuuacuccacauccaaucuauuagugacuuuuauuggcagcagaaacaagaguggauaagaggaaggacacacacuggucagacugcagggcuugauuccuggcucugccacgugugaguuuuggguccuggggaaaguuccuuaaucucacuuuguuuccacucuaccucacagaguuguugugaggauuaaauguauuaugaggcuuaaccagaguuaauacuugcaaagcacugagaacaaugccuggcccaguaauugcugcaaaagugguagcuguuauuauugccuccaacauaaaugacacaucuguccauuuaucucaagugcccuugcccugguccuagccacaauccacucucaccuucuuacugguugccucuguuugacccuugcaccaccacacuacagcuggaauaauauauaaaaaguauuggucagauuuuguuguucccgauuagaaugcuuaaaugguuucguuuuaaagacagaauaaaauccgaaucuguuuccauggcccacaguccuguagauguggucccugccugcugcuuuaacuucgguuguacaaagcagauguuacuguguaacaaauagccccaaaauauaguggcaaagaccaacaacacucuuacugugcucauggauccuguggaucagggauuugaacacaguagagcagggauauguugucucugcuccacgaugucuagggccguaucugggaaaacuugaauggcuuugggugacuugaacaaccgggguggaguccuccagaaucuuucucacucauacgucugucaccuuggcaccauggcaggaaggcugggcuuggggggacucugcuggaauuccuauauuggucucuacauggcuucagcuucuuuacagcaugguggcguuaggguagcuggauuucccacaccugugucugaacucagaccaugcuuucugugaccuguccuuggaaggcaucucuucugucauacucuacuuguuaaagcagccagaagcccacccgaauucaaagggagggcauguagaccccaccuuucauuaggaggaugccaaagaauuuguggcacuguuuuuaaagggccacgcucaugucuaucacucucucuugcucacaguucuccagucacacuagacuccuuucuguucccaaaacauuccaccucauccuaaucucagucuucccauguuuuuguuuucucuuacauaaacucucuucucccagauggcuuccuccuucucaucuuuguccaaagacuaagucuucccuuuuaauuaacacauugagucagaaacuuugcugcaaaaauugaauugaagccccaauaucuuuuuccagacaugaaguccugaacuuagcucccagacaccacguucugcuacuuccuccagaggcuaagucuagaacucugcugccugaggcuaaguccagaauuuucccuccagaggcaaagucagauuuuugcucuugggacuaaaucucuaccuaaaugucagcuccccuuccuagaccuuccuagaccacucugucuaaagugccuuuccaccucucuauccucugcuuauuuccuugauggcacugacugcaaucugaaguuauccuuuguauuuguuucuuuccccauuaauuaaauggcuacccccuuguagaagguaacuuccaugagggcagagguguuguagguuuuuuuacuaucauaucccuuggcacauagaaggcacuuaauguaaccuugcuggaugagugaaugaaugaaugaaugaaugaaugaaguguggaaagagucaggaauaaagcuuuggaaguuagaaacguuuaguuaguuguugaaaccaugacagagaaagaggcuuaggagacaaccuaagggaucauugauauuuaagacuggguaagaggaacucaaugaauguuuagaaagaagagucauaaaagcgugaaaagagccagaaaaaaaggcaucacagaagcgagggaggggaauuuggaagaaaaaagguagaggcaauaauguuaaguaucacaaugagcucaguuaaaauaaagaucacaaagugcgcauuagcuuccaauuagcaugcuguuugcccaagcuuuucuaauggagucaggcgaagaggccaacuguaguggguugagaagcaaaugggaguggaaguugaggaaguggaggccaggaguguacgcuacccauuccugaagcuuaaccauguaggaacagcaaggcagggcaaucguggugaggagcacagggccagggagaugggaacggcuggaggaguuuuccaagcucaagggacugagagguggagaggaagacuuugagauuugggagcaggccggggugggaaacagcauggauuugggaauaauccuugaaugggcugacgucuuccugugagaccuagggaaggagaaaagaggggugugugugaugcucugcuacaaauccuuauuccauuugugauuccucauucagcacugggcucuccagccagacugagcucaugagaacacgauugaggaugacccaggaagcauggcaaagguggugacagcugcugagaggugugagaggguggccagaucaaggaccagugggaagucuucaggggaagcucuucuggagugaucugucccaguuucuuuuuaaaagaauuuuuuuuuuaaaaaauuucaauagcuuuugggauacaagugguuuuugguuacauagaugaauuguauaguggugaagucugagauuuuagugcacccaucacccaaggaguguacauuguaccuaauguguaguuuuuuuuuaugccuagccccauucccacccuccuucuucugagucuccaaaguccauuauaucacucuguaugccuuuguguauucauagcuuagcucccucuuauaagugagaacauacaguguuuaguuuuccacucuuguguuacuucacuuagaauaauggcuuccagcuccacccgaauuacugcaaaagauauuauaucauucuuuaucauucuguuuuauggcugaguaguauuccaagguguauauguaccacauuuucuucauccacucauuggucagugggcacuuaggcugguuccauauuugugcaacugugacuugugcugcaauaaacauaggagugcaggugucuuuuugauaucaugacuucuuuuugucccaaucuuuaaugcaguaugaguguucuguggcugcucccacagaagugguuagggaauagugaauuuuagggcugccccaggauugggagguugcaggguaagaguagcagaaugaugcugcuggugagaguaguccaggaaauggaccaugggggcccagcugugaaugaagagguugacucaucacaucuugaugaugugguuaggggaugagggcucagauagcccuuggagugaauggcuaaagauaagggcaggccaaggucaugggucagcaaagugaaggaacugaggguauguguguauuucacacaaauuuuaaauucaaacaggauuaaguuaggaguugugguagaaagaauacugcugcuaugauaaauagacuccacuauguauaaugacucgagcacaaaaggaguuuauuuguauaucacauaauaguucaagguggguguuucuguugagugggcagagaaagguacaggguccccgcuccaugcaauuaacuggaaagucaaacugcuggugguucuaacaucuucaacacacagcucccaagguugucugggcaaucaucaucccgucagcuuggagaaaaagccuggaggaggaagagggaauugucuauguccuaggccuugaagagaugcacugcguuggcuagaacucugucacaucucacugccgaugagggugggaaauguaguccaguuguguguccuagaagaagaggagagccuggauuucaugaagagcuaguggccucugcuacaucucagugccagauagacauggaaggacccagcugauuauguccugaauaaaugugcagaagugucuuggagacagagaugaggguacacagaagggcagggcuucugcaagcugcugagaaagugauggucuggaaaugaccuugcagggugggcagauggaguacagagaagucagacagaucuuagaggaggacccgggguaugaacaggcucugguugaugacucuuggaaggggccugggcucagauacaaaaaaaucacgggaucccccucccuaaaggggcccugcaggagaaaggagggaauuggaaaccugagggaauuaucccguugcuuacugugaaaugcugaguaaaugcucaaagaguaaauaccuaauacuaacucuuggacuauagggcuuuguggcaugcauguccucuuuggacuugauuacaaacugaacagagugugguugacaaagcgguggggcucauaggacugaagggcaggaaggacacugacaacagccuuaaggcaaaccucucacaggcuugacaggagggaaaggaguagaugaugagaagaaagagaauggaaaagaagacacccacaguccuucuagaaacuuuaacuaaauggacgaggccuaagacaggaccugguuguaaauuucaugcuuuggaagguuauuuuagacucaagucccagugagucuauguuagacucaagucccaguguuugggcuguauuuuauaauggggacauuuguguaauggguuuauucaucuauccauugugcacccgccuacccacccaucuauccauccauucacccaucaucugucuauccaucuaccugagcauccauccugccaucauacaucuauuccauccacucuuccacccauucacuuuuccauccauccacccgucaucugucuauccaucuauucauccaucauccauuauucauccacccacccauccaucuauccaccuacccacucagccauccauccauccauuuguccacccacacauccauccauccauccauccacccauccacuuauccauccauccauacaaacauacauacauacaucugcccauccauccauccauccauccauccacccauccauccacacaucaucugucuguccaucuacccaagaauccauccauccaucauccaucuauccauccaccacccauucauuuauccaccuacccauccauccauccacccaccacacauccauccaccuauucauccauccauaugaacauacauacauacaucugcccauccauccauccaucugcccacccaacuauccauucauccauccaccccacccaucuacuauccauccauccauccauccuuucagaauuuguuugccuauuacaggcaaggccuuacggugggugaugaggagagagaaaguauagucucugucuucaagaugcuuacugucuaagagaaggagacacuguauaaggaaauaguccaggagacuguuuuggcacucugccaagagucuguacagcccccagugggggcauaagagaaggaguggucagcuggaccugagggcucaggaaugguugcacagaggagugauggugugagggguccaagagggccugggcaugcugggagaggcaggcaugugagcacaaguguggagcugcaaacagcccggcacgcacagggaaugcgaagauggugcccccggugagguaguggccuuagauggggagaagaagagaugaagggcaucaauucccacuuagucucuccaggcuccaguguuauuuucuuccaucagugcccugucccuuuaaaguggucuuuuuacuauccuaccuccauuucuaauucucugaagaaacagagagaacuccugagccccgagggacauaugcaggcacucauuccuccacugguuuggcagugcccacaggaguuacacacugcccacagauguagaauuuaguuuaaagcccacaaaugagacugaugguuacuaacagcacaacugcauucggcuguuuauucuuucaaugauuuccuuaucugcuugauaggaagauaggaagaauucugucugguuccucaagacaguggaagugcccagaagcuggagggagaccagucguuggguugaugacacuguggggguggagagcccccagcccaagccuagguagaggggcacaguuugccuggagcugguaaagcauugguaaagcaucacgugccauucaccugugaccucucuuucuacagcguuguacuacaagagggggacuguguauggggaacuuguaaacaucuccugaucccccuuggucuccugagagcuggcacacaaggucaguaauaaauucucacuccuugaaaacaaacagggugggggaguaaggagggcagaaagaggaccaauuuauuuacaggaaaggucagaauuuuguuaaaucuuuacaauauccaaauggacuacuuucaagcauucacagacuaagcuaauaaauugccccaaaguguccucuagggaaccgaaauggacaaauggccaagaaccauggcguguuuuuggaugagugagcaguuuucaguacauugaucauggcggauucuuuuaagagaugaaaacuccugaaauguuauuuacacuuucagaguucauaguuaccccuuuuccuuggccguuuucagaaucgacacagauucugaaucaaggagggcccaguugagggagaucugcgguauuuucuggcuguggugaguacaagccugaagugcgggauugaaaagaggaacccggcugcaguuaucaugauuggaccuccaggcacagcugagcuuugugaaugugaggcuugaugcuucccaaggacagaucccaguagaaaaggaaucugcucgcucugccuuggaucauuagaaccuaggccaugagaccucauccagucaggugaauccucaccaucuggucuuuuaaaagccuggggugaagucuaggcgugagggcccccaacuguaaucccacugcuuugggaggccgagacaggaggauugcuugagcccaagaguuccagaccagcuugggcaacauagcaagacccugucuacacaaaagauaaaaagacuuagccaggcauggugaugcaugccuguagucccaguuaugugggaggcugaggcagaucgcuugagccuaggaguuugaggcugcagugagcuaugcucaugccacggcacucuagccugggugacagggcaagacccuaucuccaaaaaaaaaacaaaaacaaaaacaaaaaaaaaccaaagaaaaacccaaagccugggaugaaucaggauuagagaauggcaggugcauaucugggaggcaacagguggaagaugaagccucggucaccugggcugaagaacagguaucuuuagaaagguucuccuguucauuugucauuuaacucuuguuuguugaguguugugcggucacuguaagguggaguggaggacuaggugguuuaggggcuuugcaauugagaaguagagacagacuggaaauacucaaguaaacaaaugcacaaaaauacuuccaaauuauaauuguugcuauuaaagagauagugcugagacaaggaagaguaggaguacaugggcuggcaucaggagggaggucauggagggccucccugaagcagggaugcaugggcaagaaggagagaugggagaagagagaacagcagccacaaagggccauugcagggaaaggaaggacaucagugugcuauggcaugagagagcuuggggacguaacacaggaugaagcuggaaaggaauagaaggguaagaucagucgggcgcgguggcucacaccuguaaucugagcacuuuaggaggaucaguugaggccaggaguuugagaccaacauggguaacauagugagacucuugucucuacuaaaaauaaaaguaaaaaauuuaaaaaagaagggcaagaucacacgcagcagacuugauaaacgguuugcauuuuauuuaugcaagcagccuggcuuggugucugaaauucuacuaaccagggucuucucuuuuuagcagaggaguagcacacugagcauuuaucauucauuuaaaccuuuauguucgucugucauguuuccuaugaggggagggccagagccacugagugaaacugaguuacacuggguuaugaggaaagaaagagauggagaauugauuucgggagaaggggaaacaucuaaggaauguggacuggggacaguggaaggaguaaagaaagacagccgaucaccugugccuaccucuugcacaaggugggucccaguuucuacuaaacaaguaccuuaccauuaaaagaacuagccuuggccaggcgcgggggcucaugccuguaaucccaacacugggaggcugaggugggcagaucacgaggucaggaguucgagaccagccuggccaacauagugaaaccccaucucuacuaaaaauacaaaaauuagccagguguggugggcaccuguaaucccagcuacuugagaggcugaggcaugagaaucacuugaacccaggaggcagagguugcagugaguugagaucacgccacugcacuccagucuggacaacagagugagacucagucuuagaaaaggaaaaaaaaaaaaaaaaaaaaaaagaacuagccccuugggcuuuggggucacacagacccaaauuagaaucugggccuggaacaagagguuucuuugugcuuuucucuccucgucuauaaaaugaggaucugaagauuuacccaguaggauuuuggagaagauuaaagcagauguauuuaaagcacucagugcuaugcuuagagcaugguaggugcucaauacauguuaauuuccuccucacugacaacauaacaguauuuuagaagauuguacuguuuccagaaggcagacaaguggaaugagagggauaauauuuaccacucuuucauaauguucccccuggacaaagagcagaccagugaugcccuguggugaguggaccccucacuagguagggagugagcccuuccuccuaguccauguuuuccuccuucuauaaauagaggguggagugggcuggaucugucgcuaaguguccagaaguagacuaguuuaaaaaccuuccuggaccuuaccuccggauauucuguucaggaugucugagcuggggcccagggugauucugauggaggggaguacuugggcacaccaacggaaacaagugaucuccaaggcccugcccuggcuuggagaccagcacgcaggggaccacgugcacacucuuuguucgccaccagagggcaggccugaggcacgauggcugagcuaggugcccuuuguccccaucagggauagaaagaccccagggaacaucuguagccacccagagaaugaggugcagggugggcauugcaggaguucuucaggaggugugugcgcuaacuggggauaagagaaagcccgagucgacuagauucugugaagugcaugcuuccucugugcccucuuguccagcaggauuuggacagaugagcuucuugucuuccugcagggaggauguguccucagaauccuagcagagcccccaugcuggccggcagucuguacaguucuagccaaagcagcgucuguuucggagggccagucacugcugacccucauuugucaccacugucacugcugcuaaaaggaugcagccacaggggaaggcagugggcagguuccgauccaaucugcagucucugacccuucagagcuacacacacaaagaaaacgaucgucauugccugauuccaucugcagugaagaaggcaucacuuccagcucaaguguccuagucaaugcccuuuguuuuggcaaagaaggauuccaguaccuucucuuuacugccgcauucauuucaaccuucucugcaggcuguguuagaggccacagcccuuggcauccaauugcagcacucugggcauuggggauuuucuuugccaccucugggcucuguuuugucagcaguuucugcucuggaguuccccuacucugugaaauucugaacauugcacuaacgcagagacccagggcgccacagaagcagaaauggcuacucuagcuccccaaaggggaacaugaaaccaagagcagcagugggcuagucagggagggaacacguuccgggcagaugcugaggaacugagagcagcacagccgcccgaggcacuggaguuaugucugcaucuccccagccccacuucccugcaguuuggaugaugcaaacaugugcaaagggcuggcugggugccuccacucauaccucccucccugcauucaguccugcuugagcccccagccuugucaggcccucuguaaggauaaggaaugaguaagacuuuuuuguuuguuuuugagaaggaaucucgcccuuucacccaagcuggagugcagugacgcaaucucggcucacugcaaccuccguuucccagguucaagugauuuuccagccucagccuccugaguagcugggauuacaggcguccccuaccacgcccagcuaguuuuuguauuuuuaguagagaugggguuucuccauguuggccaggauggucucgaacuccugaucucaggugauccgcccacuucagccucccagguguugggauuacaggcaugagcuacugcgccuggucaggaaugaguaagacuuuugaaagaguuuuucuucccugugagcucaaaccuugaauggaagaaaaaucacacucaccuaguuauggugucggugaggauuguauuguguaggugguuuacugcgaugaaugggaucacacagggauguacgaagaauaaugggaggauggaguaaaggacaguuucagaaauugagaaaaaauuacuagagacaccuuguaugacuucgaccuucauuuuaggauugggugcugucuccguguucuaccaggcuugcugauacacagcaguuuuguuaguggaggcggagcuuaaaaucuaggcagcuacagccccgcagagaauaauaagcuguuaauaauaacauuaggucuuccuggaguuucaggggcuuggagaaggggaggcugccaagaaggaaggcccggcaaagugauauuccugacugggugugguggcucacgccuguaaucccagaacuuugggaggccgaggcaggcagauccugaggucaggaguuugagaccagccuggccaauauggugaaacccccaucucuacuaauaauacaaaaaguaccugggcguggccgggcgcgguggcucacgccuguaaucccagcacuuuggggggcugagguggguggaucacgaggucaggagaucgagaccauccuggcaaacacggugaaacccugucucuacuaaaaaauacaaaaaauuagcugggcguggugguaggcaccuguagucccagcuacucagaggcugaggcaggagaauggcaugaacccagaaggcggagcuugcagugagccgagauugcgccacugcacuacagccuggggcaacagagcaagacugucucaaaaaaaaaaaaaaaaaaaaauuaccugggcgugguggugggcaccuguaaucccagcuacucgggaggcugaggcaggagaaucacuugaaccugggaggcagagguugcagugagcaaagaucaugcaacugcacuccagccugggcgacagagugagacuccaccucaaaaaaaaaaaaaaaaaaaaagugauaguccuaagggaaaggcuugcuugcauuggggauuuuuuuuuuuuuuugacauuaaaacucaccuugguggaagaaccuuuguccucgucauagcaaugauggcacuuauuuaugcacaaaauguuaagggcaccugccagagacaaggcagugugcugguagcugggagaagagggggcuuuuugcuucuaggagucaaggccugauggaagaaaugugcaagucauuauagagugaugguguuauagcagagcugaacacaggaaggagugcuuaaggcuguggggguaggauggggaaaacuucauagacaugguaacauuucaguuguuucagagggaaggaggggaaaagaacggcuuagggcaagauguagauuagggagggcacacuguuuucaggggcagugagaaguuugcucugacacugugugcgugcacccauugagcauggggacagaguagguguccagggaggggaguugaagcugcggaaaagacagggaucagacucugauacagcaccugguuaaaaugcauucuucccacucauggaucugcucaggcagauccucccuuccugcacaccaugcagaaugcccgggauguuaccauuucacuaaaccauugucuaauuuaguuacugcaucuggcucuuuuauggugcugggagaaaaguaugggaaaguggagguuugggaaggggcugugauugcggaacaggcaauuuuacauugcuuucucauguuuggcaugaauuuaauguuuaaaaauucagaaaagucaugccugacaaaggguacgaauauuagauucacaaauaauaauucauaauuuuacaggaaauuuucauugaguguuuuucuacagaaaguauaagaaacauuuauuuauuuauuuagacaaggucucacucugucacccaagcuggagugcaguggcacgaucauggcuuauuacagccucagccucccagccucaacugaucuuucugccucagccccaaccuuccccugcccccaguagcugggaccacaggugcccaccaccacacucagcuaauuuauuuuguuuguuuuuguuuuuuugagauggaguuucgcucuuguugcccaggcugaagugcaguggcgcuaucuuggcucacugcaaccuccgccucccggauucaagugauucuccugccucagccucccgaauggcugggauuaccggccccagccaccaugcccgucugauuuuugcauuuuuagugcagacgggguuucaccauguuggccagccuagucucuaauauuuguauuuuuuguagagacgggguuucuccauguugcugaggcuggucuccaacucuugggcucaacugaucugccugccuuggcaucccaaagugcgggauuacaggugugagccacugugcccagccucucauuuauuuuuacaaggaucucugaaguaaaagugugaggccuguuuaccugugguuuuuuguuuuuuuuuucaccuucaucagugcaaagcagguggaagauucuccucggcccuuuuuuacuuuuccucauugcgcugaaugguaaauaugguaagaaaugcagguugcagacaguucucuuccucggucaauuuaaaccauuuguuugguaucuuuuaugugccaaauacucucuuaggcucuagucagaacagacaaaucaguuuauaccuuacauuuuuggauauuuacgaguggaaacgucaguuauuauggacuaagaaccucauagcaauggcuauacaauugaagccaaugagacagacacaagcucuuggaagcuuuuauuacaaaacaaacgauucuaugguaaacugguaaauaacaagauauauuuaaacccauuacgcucaaacaacagggacggggguagggaauacaacaagaauacaaacaauauaauuauagguuacuuuguuuuaaauuaauuugagucucuuuauuuacucccuugccaaguaguuuuuuugugagcuaauaggacacuccucuccacugcccuguccuccgcaaagcugggacugacuguugguuuuucacaaguagagagaggccaaguagaaaggcguauuuuaagcuuucucagacucgugacuuuaaccauuaccgguugacagcaauacuugccgacaucaucucaccuugcuugcggcauaucagauugcuggagggggaagugcuucacuuucucuuucagaugcacagcuaaauugaacuuggaugaauuaaccaucggugaaacuuugugcgugcccuacggcuacuuucugggacuucagauuuuuagagauauaggagugaaaaggagaauuuuacaccuucucugagucuggaaggacagacauuccccuaaaguggcuaagguggugaagggcagaaagauuggaagucaggcccacagcagcucgaauuauuccguauuuaucuagcuaagcuuugcugagcaggugugagccaauuacauacucuuucuucccccaccccccagcccaugauuacguagggauucuauguauccuucgaccucaagcagagaagcccgagcgcuacgagggcugguccagauguuuuaguuauuguaccugccagggcaaccucccacggggguuggccucgguagauuccugaggaucaacuggaucagcguuuuucuuucccacggacccugaaguuagagcaucccagcauggcuuggacaggcaaagcuaaggggucccaggccugcucaauugcuaggaccacgaaggggccuugagugccguuugaagugacaaggcucugccugggcagucaggacacucuugauuuuaacuccgauucaguagguuuuccccaagacucaguuucccuuuccugugggauauaaacucuuccuuucuugcuccuccacagcucaucuccuccucuccgccccacggugcggugugggucccauccacuggcacuguaaacccucaggaccccggggcgcugggaucgcagcagcugcccccgacagcgcugcaggcaccagcgaaaugcgcugcgcccccacgcaccccucagggagccgaggugggcgugacuguaaagcgggcgcacagagcgcagaucgcgccacaucggccucggcgggcugcggcugcuccccauuccuccgcccuacuaaguuccucgcggccggaaggcacaaaaggauguuucagggcgggguuucccauaccccgcagccuuccccggaugccuccuucccggcucggaguuggaaggguuuccucagggcucucauuuccugcagcccggcgccuccacgcgggccagaucccgucucugcagccuccccccggcccgcgcccauuccccgcccccaggagccgggcccggacgcucccgggaagcagccgcccucuccggggccgggcguggccgggcccuccccgccggguucccgcccgccgccguuccaguccucagccgcgccagggcgggggccaggcgaguucagcgccagcaacggcgggggaggagggcccgggagcccucccgggcugcgcggcgccggccggcggugcagucgcgcgcucgccgccagcgaagccauuggcucggcgcagucaccccacgcggggcugccgcggcggccuccgcggauuggcgcgcaggcgggcagggaccggggcgcgcgcaggcgagugcgugcggccccgaagccccgccgucucggggugccgccccuccccccggccgcgacgaccaccccuccauuguccccgcguggcccaggccgcgccuggggccgccgccaaacccgguccccaccgccccggcccgaagaaagcgcgcgaaaggcgcgcucccagcgcgggcgcucgcgccgccugccgcccccggccguucacugccgcauuucgcgcucucgcgccgcgccccgccccaccggccuaaauuugcauaucccaggaucgcggccaaucgcugcucgucucucucgaagcggauggcuuuugccugagaggaaagggaguggcuggcggcgcaugcgccacgguggccgacuugaaccgaggcuuuuauugcuguaguuuauuuccacccccuucccuccuguuucucucucuccuucucucucucucucucucucucucuuuuuuuuccgcccuagcuggggcuguguuggaggagaggaagaaagagagacagaggauugcauucauccguuacguucuugaaauuuccuaauagcaagaccagcgaagcgguugcacccuuuucaaucuugcaaaggaaaaaaacaaaacaaaacaaaaaaaacccaaguccccuucccggcaguuuuugccuuaaagcugcccucuugaaauuaauuuuuucccaggagagagaugucuuaucaggggaagaaaaauauuccacgcaucacggugaguuugguacuugggaaaucugcggucggccagccaccuuuuguagcacagaaggucuaaggaauuuuuaaaaaggaggggaaaggagagggaccgaacuuuuuuuuuccuuucuguugcuaacggaggcgauggugauggugguggugguugugggagaugcagugauccaggauuagaagucgcaucguuugcaaggcauuaaacaggagcgcgagugcacgaagguagccuuagguaacgcgccagacccggucuaucuuuuauugucagugagagaugcugcagcgucggcccgcggggugcaagcaaauggaugccagauugaauaugcaugccuggagcucggauauuguucucugggcugcgugcugcgaggcuggacuccuccagcagcgauggggagauggggacuuggauccuccccgggucuuccgcccccacccaaaaagggcuuucuggagccuucuccggguccuuggaaaaaggagcggguuugagcccuaaggcguaaugacagcagagggaugcugaaaagggcaggguguaccggaaugguguggaaacgggaaggaaaaacagggacgaggugaugagcagaggaggaaggcggggggcaaggcgggggcuucuuguuggccaggaaccgguuuugggugccccccccccgguuuucucgcccuguaguucggggcuggggcccuggcggggauucgggcucuuuuucacgucucuuuuccgccccuucugccgcucaggaggcguccguguuggugcauacaaagcggacugcagggugggcgcggggaccgcggcgagcggccgggcgcuaauggcgcugcgcgacgcgggagcagauggcccggccccggccagacaaugaucgcggcggccggagggcucggcgcagugcuggggccuggacuuguugguuugcaaaccacggggaaaacgucugugccgugaauuagcgaugccucagagaucagcaccagucuugcucccaccucuccccugcucccucccucuccccaucuuuuccuggaaaaauucguucguccuauucuuuccauccccagugaaaucccagggaggggggaacaccagggaaauucauuguuauauaaggaugugcaauugcaaccggccagcugauucccggguagaaccuaggacugaggcagagaucgaaagagccuuuuaaagcagucaggauguguuuuuagggcuggauauaaggacgcucuuugguucugguuuucccuuuagccaugggcaccccggcuuccucuccgugcacaagggcacacccauccgcgggagagagaaggggagcaaaugcauaggggagggggcgugugcucggaggauuuucuaggaugaucugaagaagggcgcuagcuucuucuugaaggcaaaagacccaagaucccaaagggccgggcacggggcacccacccuuguguguucacugugcaggaggaaggaguggugacucuggggagggaggauggaaagcagauuugcagcaagccucaaauaauuugcugucuucgugaaugaacaaggcagcuucauuuugacaguguggggagaaaaaaaaauuaaaagcaaacgaucaacaagacuuuuuuuuuuuuuuuuuuuuuuaaagagcgcccccccccccacacccuuuaaaaaaucugguugcauuaucauaggaccuauagcaugguauuccucccucccucaccacuggcagccucuuauguaagagccuucuggaaggcacuagagugaacgggggugugguguuucacuuuuuuucauggcaucauguuggcucgggauauucgcggugauggcuggggcagguaccacagugacuguggaggcaggaggugaagggggaggccucuccuugccuuccaggugauauuuauuccauggaagcuuagagaucugggagagaaguggaggucauuguagacagaggacaagugcacugauuugagugaccugggcaaguggccuaaccucucugagccucaguuuccuuaugugucaugggaauagaaccuggccucaucuaccucacagauuucuuucgaggcucugaugucaugaugugcacggcuuuguaaaggucuuuacacuuaccuuauacaggugcaggaauuauuguuggcuauucuccuuugacuuuccaaagucuacgugaggaucagggacccugcaguguacaaaauuaaaaugaucuuauugguuuucaguauguuagagagacaauaaauacuuucugaaccaagguguguguauuuauguguaaaauuaucuuuuuuccuugcucucuaguagcuuaucucuuuuuuaaagauuuucuaugauuuccuuuucuugguagcugcuaaagagagguagcacuugcugagaauauuguuuuguaacugaauuuugaguuaacuauugccaaaagaaugucauucuuugaaauguguugcauauuaaaagggcaauguaugguucagcuugccagguuuaagcccauucuguauaauacaggugcauauuuacugaacacucgaugccagcauuccuuccaucagcagcauuugcaauaacgaugagucauaauguagcauuucugucacauucucagacuuuaucugcugcuuguccuuuauuuuuuagcauaaauaucaccgguuaaaauauaagugcaucagcaaucuguagugcauugcaucuuagaauuugcuaucucagauacuuauucgugggaguuuaccuuuuucuuaacagccuaguuaaaauggcaucaauggcguauuuuuuguagucuuuuugcuauacuugcugugauuuaccucaaagauaaaugcaaauauaaaggacauauugaauggaaaccuugcuaugguugaacccaguguauuugugugguauaucccgugacagcagacuuuuuggucaauugugcuugcuugacacagucuuuccaagacauggcuuuccuauauguaggugguuuuuuuuguuguuguuuguuuguuuuuaaauugagguuuagccaaaagccauuuuaaaaaguacuaucuucuuuuuuuuuuuuugaguuggagucuugcuguguaacccaggcuggggugcagugacgugaucucgguucacuacaaccuccgccugcugcuucaagcaauucuccugccucagccucccgaguagcugggauuacaggcgcccaccaccaugcccagcccauuuuuuguauuuuuuauagagaugggguuucaccauguuggccaggcuggucucaaacuccugaccucaggugauccgcccaucuuggccucccaaagugcugggauuacaggcaugagccaccgugcccggcccuaucuucuuuauaugaaauaauuuucacugcuuuuuuuuuuucuuuggaguccaaggucuaauugaaagagaugguucguuuaucuaggauaagcugucccuguguguucugacucaucaggugaugaauagguugccacauacaggcuuaccuuugucacugaaccuuuccaaaaugggcuuauuuugaacaucacuuuugaacagugaaaauguauccuuagcucacauaucuuagcaccuguuucucauaggucaguuacgcguugugaccuuacugccucuuuguuucagagcgaucgucuucugaucaaaggagguaaaauuguuaaugaugaccagucguucuaugcagacauauacauggaagauggguugaucaaguaaguguaacucaugauauacagauguauuugaacacuuuccagacuucccaaguauuagauaccauucgcauccaaaguaucaaacuucaggaacaucagagagugaccaacuuaguaucuguuuuaaacugguuuugauuggugguaauuagugaauuugaaaacucaaauuuagggaauucaaagcaacaauuaauguacacccguugcauuagguauuauguaauuuacuauuuuuaacugaggugauaugauaucuuucuguugccagcucaaauacuugguuugugauauguugaauauauuaaaguuuugccuagaaugucauuguuuggguuggauugcccaaaggacgcaaacgugaaagacagucuccucuauugagacagcacaucugcuuucuucaucaagaauccaaguuggaggggccaaagaaagauaccaaguuaauuacuaaguaauacagacaaauuacugccuaaauccugagggaauuuuagguuuuauucuaaguggcaacuagugcaaauaagacugcccuuguguuuauuguguuaauguuacaaaggagaagcaacagggcaguuccugaguuuggguauuuuuggacgccagaggguuaaggaagcugaguucaucccaguaucugccugcccuuucuacugggguagcucccggggcucuggagaaauagcacaucuguuugaagacaaacacugcagccagugacagcuuuuaaauaagcagcauucaucaagggauagcuguaaaccgguccagaggaguggaaaacuggaguggcugugacuguugccugggagcucacacccagauuuaugaaccuaaaauagauuuuaacauuuccacguuuaauguuuucuccauguguguuugcugugacagucucagcuccaggcucucaaaugccaugacuuugauguuccauuuucccccaauuauaagauggcacgaucuggucugguagaaugacacuggcccagaagugugcaggccugugugcuguuuuuacucaucacugauuuguucuagaacuuuaucaacuucuccuagauuaauauuccuuuuaaaaaauugguagaaagauauaaaaauauuuuuuaaaaguuggaaaugaaucaugucucccaacauaaugaauauucauuuuucugccuuuuaaaauuauauuucagcuguuagcuuuuucauuaucugaauaacuaaacacacgcuuccaaaauuuuaaaucauugcaaucauaguguucacuuuuuuuuuuuuuuugcuuugauuuguucuaccucacccuuccaccccuauuuuccuucuggugaaaaggauaugauaaaaauaaauguuuggaaaguacggccaggucuggagaaaauugcuauaggauaauuagcucaauugcaagugcuguaaagaaaguuuaaugacaguucuuagaaauaucuuggggccuuguuaucauuugaucuuaggggguuucuugggaacaaaacgucuuugaguggggccucuggugccuuauuuaacuuuugcuuucuaguauacucugcauugccucuugcugggggguaggaguauauaguguuuuauuaugaaucguaacaaugaucugaaaagcccacggcacagagcggaggauaguuuauagguuagugaaaguagcugucagaucccauuugaguccacauuucauuuacaacccuuaucaccaacccuguuuauuuaggcaaauaggagaaaaucugauugugccaggaggagugaagaccaucgaggcccacucccggauggugauccccggaggaauugacguccacacucguuuccagaugccugaucagggaaugacgucugcugaugauuucuuccaaggaaccaaggcggcccuggcugggggaaccacuaugaucaguaagaagcuuaaaaaucaucauuguagugcuuaggaagugugagaguuugcaaauaagucuauuguuugauucucuccuucuaaaacuugcuguccugagccacaguucaaucuaccaaauaagggggugaggauguguuaaccauuugucuuauuuauuuaugcucauuuucugucaaauuuuaaguucucccauugaacuagagaauaugguucuaaggaguuugguaagaugaaugacuucuugcuuucucuccauguggacuuuugucuuccuugacccuagaaugugauuugguuuugaaaacacggcauuugaagucaucuucaaugccaccaacuuuaagccauugagcauaaguauuugauugagauuuucagaaaaauuccuaagagugcuucuuuuuagaaugaggaugggcugcaacaaaugaaaugcugaagcaggaacuccuguuccucugauaugaaaaucaaauggagacgauacucucuaggcugaguuuaacauaaaaggaauugggcagcccugucuggagggggacccacagguaauugucuuuuagauaugaaaauugcugacacccacagcugggugccccuuacguauugcuccaagggcuuugugcuuuuuuuuuuuuuuuuuuuuuuugagacagaguuucucucuuguugcccaggcuggagugcaauggugcaaucugggcucacugcaaccucugccuccccgguucaagugauucuccuggcucagccacccgaguagccgggacuacaggcaugcacccccacgcuuggcuaauuuuguauuuuuaguagagacgggggucuuccauguuagucaggcuggucucgaacuccccaccucaggugaucugccugccucggccucccaaagugcugggauuacaggcaugagccaccgugccuggccgcuuugugcuuuuuguuuaacuaaaucugaacuguauucacagcacugugacacagcacacauaauauuaagaguuugcuugugaacugcuagauuccagcaugcccacugauuguccuuuugaaaaaugucauuuuguuuuugaggaggugggcaagcugcauaguggcccgucagauacauauuuuaaaaaacagauugcauccaagagugacagucaacguggagucugucauauaugaaaagauagcaguucaguucagaagagggucuaaguagaaagaacuuagcuguuucugcuauagaaaaaccuuucuuacugguuauuuuuccgagugguggucuuuuugcuuguggcuuuggggucuaucuggaagcuucuuuucuaucuugccugagcuagaggaauguugcccugccauccccuccuagucugaguugccccgcauuuuaaaucacaacucauccucuggcguucucucuguccuggcccucagggucugaagcaucaggaacagcucucuccuguuucagcuuucuuggcaccacugagaaaagccuccaaguguaagccuugcgacuugugucuugcuguacauguugcccuuuaaccuagugggugccauuuuccagggaugucggggggagauuucaugcacaccuagggagagcagagccugcaccuugucauuugcuggggaaucacuggcaccugugggcguuucugccucuccuccagggcggacuguggagaaacacuugaacuuggagaagcuuagacuauucgggugucagccgggaaggccaagucagggugaucaucugccucaguuuggaguucacagggagacccugcaggccccuggauuggucacagacagucaauaagccauuaaaaacaauauuucucuggcugggcaccaugguucaugccuguaauuccagcacuuugggagccugagguggguggaucacuugaggucaggaauuugagacuagccuggccaauauggcgaaucuacuacaaauacaaaaauuagcuaggcaugguggcaugcuccuggagucccagcuacuugggaggcugaggcaggagaaucuuugaaccugggaggcggagguugcagggagcugagauugcaccacugcacucuauccugagcaauagagugagacuccgucucaaaaaaaaacaaacaaaaaaauucucgagugaauggucagugucaucuaucauuggagagggaaaugcccccagccaggaguuaggagucuggagugcuggcccccuucugacacugacuugccgugugaccuugagucacuacccuacucuguguucuagcugugugucuccagugagggauuugugcuacaugacccuggaaguccuuuccagcccccuacauuuggccauucacugaaacucauucacugaaacucagagagauuuugccucucaucaaguacauguugcucagcagauacagaaagucccuguuuucucucacacuugcuggaaagaaucccucagcccaccaucuccuguccugcauuccugggucugccucuucccuccacacgcucgccccgugcuuaggcccccacucuuguucuuguuuuugacucuuuccugccuucccuuccccaccacaggagcaucaccuucuugccaccaccccgaauuucucuuucgucuucccccucagaggcuguggccuuuuuuccauucauccagauggguuccuucuguuuagggacgagggacaucccccucugagugcagcaccuggcccagggagcucagaagagucagcagauggccuuaugggcaggugguccggaaaggggagugaggagucugaccgccugcucugcuuccuuggccagaaugcuauggcauuugcacggaggcugugugaugcgaucuggcuauagaguggggcauccaaugagcgaaccucaaggaauaaaagucaucagagggggcaguguaugguuagcauugugacccccaaaugccauugcuuuuauagccugagaaaaguacuaacuacuuuugcaaauaaccaccuauguuuacugaccucuguagaauuucuacuagccugccuuuccccgggggagggaaugguaauaauacaggugaggaacugaggaauuuuuauccuuuuucuguuugcugaccagacguucugcauugcuuuaagugagugaguggcugggauuugcuuuacagagaaggaggccuugcaaagagaaauagcuuaaugccacuucauuggcaccuaagaccugcuacuuucuuugacuuaauauauugaguccagaaagaaaugccuggggcacuuugaaaacuucacaggcccacugcugcuugcugaaauaaaaaauugaagugaauugguacaaaaaucucccucuuccucccaacuccccgccaccccgccccugggcacuccacccuccuggcuuucuggccuucuccagaccaugucaccaugucaccugcccucacggguaaauccucgccugccucccugcuggcucugcguuucccaggucacaggcccuggagacuccuuucugucugaaauggcgccgcauguagaggaaaacacagccaaauauucucgguuuaaaaaaggagauggcaugucagcagcagaagauaauauuauugccauuaaacagagccugcuauugagaaucacacaaugagaucuuuaugaggcggacucaguguggagcagggggaacgcccuuugcccuuuccacccaguggugggugggcagagacugcagacauacccugcaggcggcauccagaccggcugagggguugcgggggcggccgcauugcugcuuggggaaaacccuacggacuucccagggccuucauggucauuugaguucaggaucucagaguuucuaggaagcagcugggaacaguuaccucuauuuuauagaggggaagacugaggccggaaggacagacacgacuugccaacacuuacccugugcgucggugcagguggccagguguggaacauacaccuguagcucuggccucaccgcuugcccuggggccaccuuugcucucagccucaguggccucaucugcaaaauggggcaaguuuugacaaagguggacugugguggcaucacaacagcaucugcccaguagugagcacucccaugugguagcuauugucauuccauccuugcuggguacugacacccucccaucucuuguacacugagcucuacucucccccgcauggccggagaaacaggcugagcugccguagggcuugaccugaguauucacugagagcaggcgcugucuaggcguggcuggcggacugugugcuuuguguguugcuucugggggcggcaucuugaaacauuacacuuccugggucccaccuuaccugguuaaaguagcaaaucugcugguggggucugugacucuguauucgaaucuggugcuuggggagcuuuuugaaagcaugacuuucaggggugcaugccggaucugcacacucuggaucuccagggcuugggaaccacugcucugaaugucauuucugcucaccugaacuccaggcucucucuagaggaggugcacccucaggcacaacauacccagcaggcuuccuggucccuggguagcaccgcacagcagagauggggacuggacucuagcagggaggaggaggggaggugcugcugccgcagggcuggaaggggcccucccuccugaguaccagccuugucacuucuccccuggcuguggcucccuggaugugcaucaggcaccuccauccaacuguccccaguuggacucccugucugcuccuugcugcuuuuccggugcccaguccuggagagggcucgcuggagguugugcuggcgguaucugcagagucauccuagcaucuucauguccucgugcugccuugaguugcuuucaucucuguguuaccucuugcacucauucccuuacccacacagauuugacuuuugucaccucuuccuggauuuuggcccuguccucugaggagucuuacugucugucccccaccuccugccucucgccaggcuguuuuucuggugcagcuuucauugugccgccuucuuccucugaagccuucagugacucccucuugcucagagaaucagcccaagugucagaacccuccacgacgcggccuauuccugcugccccagcccagacuugcauugucaucucagccagggaugcccucccuuucuuucccugcuucuagaagcuucaucacccuugguggcccagccugggugcuucccauucacugaucuccugugaucuguggcugcuguguggccucuucgcaaacguugggcuuuuaucccacagcccagguggcauucagccuugcgugugguucaaucaaggccccucugucucuuacauuuuccuauuuccugccgccugggcagccucacuccucagaggcacucuguuaaugcccaugggugaaugaaugagugagugaaugaaugaaugacugaauacacugacgauacuugauauccugcuuccucugagugaugccaagagacuuagugucacaaggagggaggaggguuuagguauccgacguggacuguguucacccugauggaagcugucgcuugcucagcaguggcucccucugcagccccagcucccugagucccuguggucagaucuggucauggugggggaggguggcagaaagaggaagccgagagcccaggcauggccugugguuguggaugggacagcucccucugucugggcuguucuucagaagagggugggaacagcagcucucucauugguccucuugcgagaaagccugcucuccaaguacagagggucacaacauggagaaaucacauggucccagcaccacaguggacccagcagucauucccccagugccuugggcuugucccggcucuuccuacugagccuccccauggaggcaggagggcugggaggaaggugagguggcuuccugaagggacguggcuccugaaugucacugcgguacauccacggcuugucauuuguucauccauguggcauguggguugcucccuccuuauggcgaguacacacgugugaacgcaugcacacacuguaauauggaugugucuguaauugauacuuugauuauucccuuugcagcacucauuugacucggguuagaaaguguuuacaaaaacgcccgaccacaucagacccaaguuucaaaguccaggaccaaaguuguugccacaaaaucugccuguggccuggcgauuagaaagccacguuauccaaugggccauuggugugggcugguucucugugcuccuccccuuguccccucagucuccacaugguugaggucacacauuucuccuaaggacacgggugcccucugcaagcagaugccgggagccuggguccacucaggugucacugcgugaaucucggccuugaacggcuggacuggaagaauccauccacccucaggugucacugcgugaaucucggccuugaacggcuggacuggaagaauccauccacccucaggugucacugcgugaaucucggccuugaacggcuggacuggaagaauccauccacccucaggugucacugcgugaaucucggccuugaacggcuggacuggaagaauccauccacccucaggugucacugcgugaaucucggccuugaacggcuggacuggaagaauccauccacccccuuggcauaguuugggccgaucuaaugccuggcacugagcagagcggagggaucuccuaaugccuggugcgguacaggggaaggauggcggagcauccucagagacagcacagcucuucccaaagguccagcacgcacacuuuaccgaaugcuuuucuugugaagggagucauuggguugggcuagccagguaggcuggguaggccuguggggguuaggaacuucuaggcccuuccagaagcaagggcauccccaagugggugucuagacucuguuucguggacauuguggcaguuaucauacugucccaggguuucuugcccccaccuggcccugggagcuggcaguuacagugcuggaaaugagccugacucacugggguggugaucuuccaccccuucaggugcccucaucccaguuccuacucugccuauggguguuuuacauggagagucacagcacuggggguuucccagagccuagacucugacuugcccuaaagcugggucacacagacuauugggaacuuccugucgauccugcuggccugauugacagcuggaaccgggaguggagguggggcccaugggaaugcuaggcuccagcaaguucugccugaccuuuggaugugagggucaggcauucaguggucgggucucaggguuccuuauugcuagaugaaagcuuccacgacacacaugugucuaagugugcccuuguccuauguccuggcugagugaguugggcagagacuucugaggacagcgaucguggccucuccauuuuccuaaggccccugcaugccuggagcuggcugugggggcagccagagaagcugcccaaugagucugaugggagccagacccguuacuccuucuacucaugauagcuuuagcauuguugucccggggcaacccuuucucaugugaaaccuugcguggaacccccuccaccugagauaugagacugaugaaugcagaacugcucugguuggaaugguggguggcaggugggcugugggggaguccagauccucuccgcuuucucuuugucauccccccauggcagccccucugccucuggagaaucccagagcuuggggaagcacaggauggaaaccaacccauccuggcacugccucccccucugcccaccuccccugcaaagcuugcaaugcgauugguccugguguagccuccguguugaguuguaggggaaaggguguuuaguaagcaggcauauacccacggagucgcuuaagaaaacaccuaaccacacuguaaguuuuuaguaguuucguuuaauaucccucucucuguucaagacaggaaccaggguagagcaccuguuucauuuucccugccuagguuuggguugguuuucuuagcuuuuuaugacagcccauaauaggugagcauucugcccuuuuuaaaaaaauuaauggugcagagaguuuuauuuauuuauuuuuuagaaacggugucucacucuaucacccaggcuguagugcaguguugcgaucauagcucacugcggcuuugaacuucuagguugaaacaauccucuugucccaguaguugggacuguaggugugcaccacuacacccggcuaauuuuuuacuuguuaguagagauggggucuugcuauguugcccaggcuggucaugaacucuuggccuccguugauccuccugccuuggccucccaaagugcugggauuacaggcgugagccacugugccuguuugguacauuaguuuuuuuuuuuuuguuuuuuuuuuuuuauuaagacggaguuuugcucuuguugcccaggcuagagugcaauggcgcagucuuggcucacugcaaccuccaccucccagguacaagccauucuccugucucagccucucaaguagcuuggauuacaggcaugcaccaacaugcccagcuaauuuuuuuuguauuuaguagagaugggguuucaccauguuagucaggcuggucacgaacuccugaccucaggugauccacccgccucggccucccaaagugcugggauuacaggcaugucccacugugcccggccgguacauuaguuuuaaagggaagauugacuguggguggccaagggauuuguguuuucugacuuaaccauccauggcucugaccccaagucacccauuaagggcuguuucucccuuuuuuuuuccucuuccuccccaagcugaccuuucucucuucuuaagaagugauuacugauuucuuuagguuuugaggguucugucuuugacucuccgugauuguugggugaagccauuugcuuaaauuccuugcuuuuagagcgucuuaacugccaugguaaugauaaaggggagugacagugaguagaaauuagaguucuuucugguuaacccauuugggagguagcuuucuuugaauaugacuaaguguucccccuaaugacagagaggauguugcuggggguugggucgcgguggcugaggcugcuguccaguuaagagaauuuugcaaugaacuagggcagugguuuaaaaaccuugacugcacauuagaauccccuggggaguuguaacaaaaugcagagaccagaccuucugacuuaauuguucuaggugggccuggcauuggucguuuugaaagccucaaggugauagcugggauuaagaaucauggaucccagugcuuguucugauaguuggacuucuguugaaaccgaaugaaugucugccaagauuuuccgaaacccagagcugcccucugcucccugcuuuguccuguccucuucacgaagggagugggaucacacuguugcuaucuggccaggguggagucuacagccagaugcuccccagaagcuuaaccauggaggggcugagcuaauugucaccagaaagagccuccuccuucaguugcuguccuugguguucgggaagguuuuacuuggcuaauucccuaaaagggcacugguuaggacuuggaguaaguggugaugagcaagagcagggcuggcuggugggacagggugggugccgggggcagaggggaacuggaauguggacugcuguccccagccuguggccaccugcugugcugguuucccugagaaaacccuacugucuuuagguugaaucuguaguguuuaugaccuaaucacucucuaaugauaggucaggacuggaaucuuuccuuguggggagccugugagacaaaaaucaaaagggccugauaauaacauagaaucauggacucuuaaggcagccauucaccuccuucccagccccgcucccacagcugggcacgguuuauuggaccaggcuucagaggaugggauuguaaguaacucaacaggacaggaugggagcgcuccaagaaucagaucuaaguuuaacuucccuuucuagugcuuucugucugagcgugaucauccuaauguguuucuagauggcuauuuccacauguguaaaguggagacaaucaauucuuaugucuuacgacuauggaaaaagugaguuuuuuugugccauacuauuugaaaguaaucauugugacaccuuuggaacaagugugaaaagaucucccucucucucucucucacaccugucuguauccaucuuuaucuuuuuaucaucuaucucuaucuaucuauuaauauauauuuaucuaucuagcaugaccugggauaggugaauucuauagccagguggccuccagaagcuuacgaaaugaucgucuaccaaaucuaccaucuaucuauuucccuaccuaccuaucauuuaucuaaucuaucuauauauugauauauaucuaucuggucuauaucuaucuugauaugacaucugucuguaccuauggucuaucaucucuauuuaauccaucgucucuauaucuauugauuaucacuuaucuguuuuacuuauccuaaucuaucauuaaucuaucaucuuucuaaucuaucuguauauaucuauuguuuaucuaaucuaucaauugaccauucaucuguucaucuuucauauaccaaagaugcaguugcaugccaccugauuccagauggguuaucucacuucacugucacuuagugagaucaggaagaagucucaaggauuguuucaacuucaagccuauguacaugaguuugcguuuugaacauagcaggaaaaacaacgauguauaagaagcuuucuuauuggcugggcauggugacuuaugccuguaaucccagcacuuugggagauugaggugggaggaucacuugaaggcgccaggaguucaagaccagccugggcagcaaagugaagccuugucucuaccaaaaucaaucaaucaaucaaucaaucaauaacuaaaaauaaaaauaaaaaauuagcugggcguggugacacauaccuguaguccuagcugcuugggaggcugagguaggaggauugcuugagccccagaguuugagggugcagugagcuaugauugugccacugcacuucagucugggagacagugagaccccaucuuaaaaaaaaagguauaauguagcuuauagggcuuauaauccuguaagaagacuucuuaugcaagaaaauaaaaauuuuacuuuucgcuauuuuuuuuuuccuccuccaaauaaucucuggagaauuuggagccugauuuucuugacaacacaucuggcccugcagauguaaagcaguguucccagaaaacagcccgucaaaucaauaacucuugcuaucuuugaauuuucagccuuuuuuggcauucaaaugaggccaacuuuauaaguggccauugcugugcuguugaauucaagccccuccguuuuucaugguggauuccuugcauugucugcuagggggguugcauuccucgcugaaccagaccucugcccucuuccccgcugccuugcaguuugcugagcuuccaggcagggcugcagggucgugcugcuggaaguauuggugacaaauucuuccccaguggguguuucggcuaaggaagcauuuagucauguagggccuaccaugcccagcagugcagcgugggagaggccuggcagagggcagagcucucuucucuccagccggguguggcugguggcuccuuccucuuuuguagugucaaaccaagggauaguauggacccagcagaacugaaagcaaagggaggacccauuauuagccaguucuggcagaggcgagcagcuucuuuguguggacaggcauaucucaugccuuuuugcuucagcugggaguuuguuuuuuuuuuaauuacuguuauuuauuuauuuaguaccuuagcucauuagcugcagaaaucacaggggaugaaaaagcagguaggauggguccauccuuaaagcaaggagagaguugaaugaggaaacugucccugaggccuugacagauauuuuggagcuaacucugagcccagugagggaggaccuaaucuuuuggaggaagugcaacuuuagcuucagaguuuuaaauggaaacugggcagaaagccacagcuugggcacagcauugguggcguguuguugugucacuuugcacaguuagauggggcuucagcccucuuuguaggaugaacguuuagguucuuguccaaacgaauacacuucuauauccuacuaaaaaugauugcaggacagcagugcaaaccagggcuguccuaggcaaacccaggcaucugucacucuaaaggacacaaggacacguguugaguccucuuguccuccagugagcucgggaaggggaugacccuagcaguugcucucuggaccucuccacagaccugccgggagucauggguaggaguugugugauucuguccuuuucacaagagaugguuagaagaaagugaggaguuuggagggagcagauaauugauaucauuuaucgggaaucugugggacgcaagcccugcauacaccauuucuaauccuuccaucaaccccgaagauagauaggcuuauccuccuguuauaaaugaaguaaugagcaguccagagaagugaaaugacuugccugaagccacagagccugcaagugcgagggcugggauuccaauccaagcucugggccaauggcccuugcauauccuagaaugcgagaggaacguuuguuuuguagcaguuagacagccugcucaugaaagcugcuuugugcccagccuugugacaggugcuuuacaacaaucccagacacagcacccaccuugaguuugcccucagguacagggcuccuauccauccuggaagaacagaaagauuuugguguucaaguuuuauccugcccuuccauccaccuguuauuuaaaaguacuuuuucuguaauauauaggcagaaaaugaucagauaucauacgucuccuacuaagugggaggcugcacccagcauggaagaugcucaccaagacggugguauauugggugucucuucucuccuacagaagcccuggguugaugcccuagaucuccccuugcaucccagagggggauuuggagagcaaucaagaggaguaacugaugccaugcauucaucaacugaacuuaauccuucuucugggaggcccgggagccuucuuccaugcggggccagauugagcugauuucugucacguaggcugcuccgagguugccuugcccuugccuggcacucaucuuuugcauuucucugaaucgcuuuggcgugggcuuuuaugagguucauuaggcucagcaccucccaugucugcuugggaaacaccacgggcagauggcauuuuucuuuucuuuucuuuuuuuuuggauacagagucucccuccguugccuaggcuggaaugcaguggcuugaucucagcucacugcaagcuccgccucccagguucacgccauucuccugccucagccucccaaguagcugggacuacaggcgcccgccaccacgcccaacuaauauuuuguauuuuuaguagagaugggguuucacuguuuuagccaggauggucucgaucuccugaccuugugauccacccgccucggccucccaaagugcugggauuacaggcaagagccaccgcaccuggccucuuuuuuuuuuuuuuuuuuuugaggggcagagacaaggaggaagaucagacaauuucucagaguuggaauuguguucuggguauuguuuuucuccuuuauggagauaauccagggagaaacaugaaguguaauggaaagaauuugaggcccaaccuucuugaugaugcaucuucauggagcugggagaccuucgugccagggucgacucugcugcuuauuagcucaggcucggugccccacggcuugguccugguuuucugaaucgucagaugcaccuggaucagcaugucuugcauaauaggguugcuuugaggauccagggaggugguggcuauggcagggcuuggacaaauuacauguaugggggaguagccccuucaccccaguuuugcuccugaccguugaagcuuuuuauauugacccguggcuacugugguauucgaagggcuaaauuuguuuugugacuuuugccuucagcagccaucgcauuacaucaucuaccuuuucuuguguucuucugucgucgagaaucaauuaaaauggucagcauugcuaugaaaugguuuauuuuuuuguggauguuuuagagcuccuccucuccaucuccugaauuucuuuucuugcuaagccuauucagcucuguuuuuuagagaguucuuuucccuccugcucuaugaaaacguauuuuccauguuaaaaaaggaagauccauguugcuguacuuaaugcuucauguuuuagaauguuagugccagcagaaagcaccaggagacacccgaugugcccccaccuuggugagcaccuuuccccccaggcacagucccugcuuacgggagauuugaggcauuugaucauuuuuucccguuagcuuacagcacaaaguacuuugaaauaaagauuggcucgcagggcagguugaagcuucaacaccaaaaucucucuguuccuuguggguggaugggagccugacaccugauuacaagcuccaggugaagagcagguuugagacuuacaccuuguuuauugcaaucuuucuuucauuuugcaggcggugggggugggggaaugaaagcccagaaagggauguggcacucgggcaggacgggggcugcuucugugccuuuuccccacugugcguauucuuagcugcgcaagugucgugcaugugcguuuggcucacacccagcgggagugcccuucuugugaaggaagcucguucucuaccgaaaagcucacuuuucagagaagagcuggagaaggccuguuguccaucuuaguccugaaauaugaguuuucauuccauggcaaguccuuuuaaugaaagauggacuggagaagcugaugcauagaaaagaaauagguucuuuuauguagagggggaaaguguccacucugcgguauuuccuggguccuguggcuuguaggcauuugaacuguuuugucuugguucugagagagucagaugauucagaagcuguguucugcugaacauuccugccuucuugacagaaauccccuauuuuuguggucccccuggcagguaaagguggccccuacugacuuguaggauuucuguccaugauugugucugaaaugucauuuuuucugguuguuuucccucuucauguauuagcuuggcucuuucuucuccucuuugucuuuaagguaauuugcaaaggucacacuauucuugcuucuucuuagaaaugucauaagggauuuucaaagaaagaaaauuucugaguaagaguaucucccuccccuccccuccccucccuccacuccucuccccucuuuuccccuucccacuuccuccuuuccuuucuuucucucgcucucucucuuucucauuuauguuagcuuacaugaguauacugacucuaaaaauuuuugauucuacuacugcacuccagcauggguaauagagcaagacccugucucaaaaaaauaaauaaauaaaaauaaaaaaucuuaaaaaaauuuagauaugauuuguauacccucagauucacucucugaaaguguauaacucagugcuuuuuaguauauucacagaauuguggaagcaucacuaccaucuaauaucagaacauucuuaccaccccaaaaagaaacccuaccaauuaucagcugcuccccauuccccaccucuccccuugcaccccuagcccauggcaaccacuacauuucuauagcguugccuguucuggacauuucauauaaauggaauaauacaauauguggccuuuuauagcuggcuucuuucccuuagcauaauguuuucaagguuuauccaaguuguaauauguaucaauacuucaugacuuuuuauggucgaauaauauuacauuuaugaguagaccacauuuuguuugcccauucaucgauggauggcauuuggguuguguccacuguuuuggcuauugugcaugaauaauguacauuugugggcaagcauuugcgugggcguguguuuucuguucucuuggguauauaccgaggaguggaauuguggggucauguggucauucuauguuuaauuuuuuuuuuggccauguuacuggcaaauauauuuaacuuucugagcaacagucagacuguuucccaaagugguugugcuauuuuacacucccaccagcagugugggagggccccgguuucuucgcauccuugccaacacuugcuauugucugucguuuugauuauagccaugcgaguggguguuaggugcugugucauuguggcuuuaauuuuaggcuuuauuuugaggcccguguacucauucacugaccccuagucacauuuaucuugaccugugaugugagaacuugguuuggguguguuuucccuacucugcacuggcucaucugguguggcaagugcaaagauguuugcagagaugagaaugaguaccugcaaccagggguccccagaaaggcagcccucuuagcucuccccacugaggacccuugagcccucccucuagggcucaccauuuguggcuggcuggaauggcuaccuccauucccuugagccuggcaccgcuccucgagauuugcucugaucucaccgcauggcugagaguaaauccuguuuugcucccuuuugugagccuucuucuuucugcuuccugauggggugggcagauaggugguuccaugcuggggagggaacuuggcagaggcccuguuagccucuuccuccagugucacccuucugacagcacacagccugcgggguccaggcacucucagccaugauauggaccaucuccagggccaguccauuccugccgcugauggagauucccuccugaucuccagagggcagaggaaucagaauaguuuccuucuacauuuguaguuugcaggaaccauugcucacagcugcucccuccuuggaugcuauacccucacucuguaagauagggugggaaaugucgccuacuuuacccaugagagcaucgcagaagggagaggcugagggacuuacccaacuaguaugaggcugaaugaggacucagaugauggucaucuggcuccggggccagcacuuaauccugcuggguauguuccugggcccucucuuuuuuuguuuuuguuuuuguuuuuuuuuguuuugagacagagucucgcucugucccccaggcuggagugcgguggcgccaucucagcucacugcaagcuccgccuccuggguucacgccauucuccugccucagccucccaaguagcugggacuacaggugcccgccaacaugcccggcuaauuuuuuguauuuuuaguagagaugggguuucaccguuuuagccaggauggucuccaucuccugaccuugugauccgcccgucuuggccucccaaagugcugggauuauaggcgugagccacagcgccugggcccucucuuauaggaacuucaggugcuaauguugcaggauuuaggaggacgagagagaccuuggguugaaacaggagaauuuuuacugaguguacucaggcccagcugacuuacguuuaaaagacugggccuggaacaaagacaguacuugacauuuauauauauuuuauaaaagggggugggcuagcuugaaauaagcucauaguggugcgaaagcagggauauugaggcaggacaaagacaggauuguauaugacuguugccaagcaaccuagauguuuguuauuuagguuugccugggcaaaggcuuauuuuauaaccuuuauuauggugcccaggcagcuguaguuuaggcuuauuuaggcuuuuuaugacuuuuguuguauuuuuuagauaaaacagaauacuugaaguuacuaguuauagagaacaggaauuuauaaauuuuauaaaacaaaggaaauuuuuuuuuuuuuuuuuuuuuauguugagggagugcugcgagaguuuuuaggagcguauuagauaauauuauuaagacuuuuuugggucugggccaugccuuugcugccuuugggacaaguuagcuuaauacaggaaaacuuauuuuuuuuuaauuuuauauaaaaauucuccuguuucaacccgagaucucucucguccuccuaaaucccgcaacacuaagugugguucccuuaagugcacuggauucaaggugacuuuguccuugcuuuuggauguuuuggauguaacagcgaugagauggccccucccagagcugagaauggagaguauuaugcuagacaccugaggcugcagugaugugggcugauggaggggugucaaggagaaagcauguggucaccuucauggcaccaucacagccuuugguuuguuuaaacaaagugaauuaguguugugguuucugcugcuaagaaaacccuguucguuuauucauucaccuauucauuccuucauccguucauuuauucauuuauucauccauucauccauucagcugacauuuauuggccaucuggcaggugcugaucugggcauuagaaguacagauaagguccucuuugcaaaaaacuucuugucuauugggaagaccuacaaagaaaagaugaaaaugaaaugugaagauugcuguacuaagguuccaguggaacagagaagagaaaucuuuaaaaucugccugggagagccaagagaggcuucagccaauagguccuaugugagcugacccuugaaagccggcucaaauuuuacccugggguggauuucacccauggggugggcaggagaagggaguguccacccaagagagagaugugugcagaagaauuugguagaugagucugguguauuuuagaauuuagacuccggauuugaccauaggauguuugaguucuaucuucauggcuugcuagcugggcaagugacuuuucauuucucggagccacaguuuucuuucuucuuuauuuauuuguuuuuauuuuuauuauuuuuuuugagacagggucucgcucuaucucccaggcuggagugcaguggcccgaucuuggcucacuacaaccuccaccucccggguucaagcgauucuccugccucagccuucugaguagcugagacuacagguguccaccaccacacccggcuaauuuuuguauuuuuaguagagacgggguuucaccauauuggccaggcuggucucgaacuccugaccuugugaucugccugccuuggccucccagagugcugggauuacaggcgugagccaccgcgcccggcucuuucuucuuuauuuuauagugguagcauacauaacacaaauuuuaccacucgaacuauuauuaagugggcaguucaguggcauuguguauucgcauuguuguacagucaucaccgugguccacuuccagaacuuuaucaucaucccuaacugaucaucaucccuaaacuguugccauuaaacacuaacuccccauucccaccuuucucuagccccugguggccccuauucuauuauaguuguuucuauggauuugacuguucuaggaaccucauguaaauauauaugcuuaugacauugcagaauggccccaaguucaccuaugugauagccugugucagaauuuccuuuuuuuuauggauaauauuucaucguauauauagaccauauucuguuuauccauucauccauugauugauagauacaugggcugcuuccaccuuuuggcuauuguaaauaaugcugcuaugaacaugagugugcaaauaucuauucaagucccugccuucaacucuugggugugugcccguaaauggaauugccgcaucauacgguaauucugcaccacaguuuucugauuugucauauaauuucaggguuacugugcagcuuaaauuugauugaagguacaaaguacugagcauugccuggcacauaaucaguauuaagucccauccugaagggccccuucuagccucuccugaaaagugaacccuuuaaagcaaaaggacuuuuaacuauuuggaugaaaaaauaccucuucaaauguaguuuaugguucuuaaauggagguccuuuuuggcacuuuuguggaguuugggugaggagucagauggccacauuugcauagugaggugugauuggguccuggaaugucaugccagggagcaggugaaagccaaugaguauucugccagguccaaaggcccaguggccaguuuccaucuggaugggccuggaaggcuuccuggaggaggggguaguggccccagcuggggaaagaggagguaaaggaaugggugagaaccugccugccucaucuugagagaggcugaggaagcacagagcugggaagguagccacuggucuccauggccacuaugcuuugaacauaccuuugcugcagggccgaugaaaaguuggacguuagcuaucuucaucucaaccuacucccugucaagucuugcuuuuuuuuuuuuugagacaagagucuugcucugucacguaggcuggagugcauuggugcuaucucggcucacugcaaccuccaccucuccuccuccgggguucaagugauucuccugccucagccucccaaguagcugggauugcaggcacaugccaccacaccuggcuaauuuuugcauuuuuuuuuaguagagacgggguuucaccauguuggccaggcuggucuccugaccucaaguuauucacccaccucggccucccaaagugcugggauuacaggcuugagccacugugccuggccacgucuugcauuuaccaugggaaauuguuagcguggucaucauuuggucugcuuuaguagagaguaucuuuuauguuucucaaaggcguuauguucugcauuguaaaugugcggaaaucagucacccagucaccugaacuuccauuuaacaucaggucccuggccaugggacuugggcaggagcaccagggcuggcccaucaaguaccucaauauauugcucccugaugagggaggggccagaauacauguuaucacuacuguuuaacaugguuccggauauguuagccaguguaauaagauacgaaaaauaagaaguaauaauaauggggagaaaauauaagauuauuacuauuuuuuuuuauugcccaggcuggagugcaguggugugaacucggcucacugcaaccuccagcucccggguucaagugauucucuugccucagccucucaaguagaguagccaggauuacaugcacccacuaccacacccagcuaauuuuuauauuuuuaguagagaugggauuucaccauguuggccaggcuggucuugaaauccugaccucaagugccugccucagccucccuaagugauuauuacuauuuuuagaugguuuacuuuagccauucaaaggaauuaaaugaagaaauauuugaucuaagaagaaaguuuaugaagaugacugacuuaaaaauaauguauuaaaaauuaauagcuucccuguaugucauaaauaaccaaucagaaaacauaauuuaaaaaauccauacacaauagcaacauaaaauauaaaauuacuaggaauuauaagaauacauucuuauauauggaauccaagaagagucuuaaauaaauuaaaagaaaugcuauguuagugaacagaaaaacccaauacuguaaagaaguguauacuuuagauuaauuuuaaaauugaaaaccucaaaaggugguugaguuuuuguuuuguuuuccauuugaccaaaugauucuuaaguacaggugaaagauuaaacaggugauaagaaccaaaaaauauucaaaaaggucauaaugaauaaggcugggagaccacuacuggcuagauauuaaaacaaacuguaaaaauauaauaauuaaagcugugugguacuagcuccagaagagacagcuauauaagcagguuaaaguagaaaaucugcaaaugugacuaacuguaucuagguauuuaguauauaaaaaaggcuacauuucacacucaugguaaaauuguaaaauauucauaguauuauauuagaaguuaacuauuuugaaaaccaaaguaaacaucuuaccuuaguucguauaccaaaauauaucccagauggauuaaagaauuacauuuaaacaguaaagucagaagagaccagaagaaaauacagaugaaaagccauauaauuuagauauuucagcaaaggcagaaaucagaaaagauggagaugcuugacuacauaguaauuaaaaacauuacuaacaguuuaauaauaaaaggauaacgaaguaggacauucgacuugcaauauaugauaaaggguugaugcauuuaaaauaugaaauuuuaacauuuuaauaaaaaaagcaugcuuuaauagaaaagguaaaugguaugagcaagguauucacaaaaaggaaauaauuccaccauugaacuauaaaaaauauucaacugaaugaguaauaaaagaaauacaaauugaaguuucacugagcuaaguuuuuaucuacuaaacuuucaaauauuaaaagggguuaaguaagcugaaaaaaaugaaacuauguuggaggauucacuuuuaucuguuuuauuuaauuucuuuuauauaaauaauacuucaggcaaauaugauaaacuuaauaaaugucaauucugaggggggaagaauaaaggaguuaaauaaguagaaguuguaauacccaguguuggcuagguugugguuaaaugaacacucaaacugcggauagguauuuacauuggcauggcccuuucuggaggguaauaagacagacaguaucuaacaagagcuguaaaaauguguaaacaaaaaaauucauacgccuugaccuagaguaaucuauauguaaacauuuagcucuaaggauguucauuguagcauuauuuauaaugaggaaaacaggaaaugagcugaaugaugaaaauuggugacugguauaguaaauuaaggccaucccuagaaaauaguaguauauagucauuaaaauuuauuuugggggccggguggugccucacgccuguuaucccagcacuuugggaggcugaggugggugaauugccugacaucaggaguucgagaccagccuggccaauauggugaaaccccaucucuacuaaaaauacaaaaauuaaccgggcaugguugcacgccuguaguuccagcuacuugggaggcugaggcaggagaaucacuugaaccugagagguggagguuacagugagcugagauugcgccacugcacuguagccugggcaacagagugagacucugucucaaaaaaaaaaaaaaaaucauuguggggcugggcgugauggcucacaccuguuaucccagcacuuugggaggcugagauggaaggauugcuugagcccagaaauucaagaccagccugggaagcguagggagacccugucucuacaaaaaauuugaaaauuaccuggacaugguuuugugugccuguagucccagcuacuuaggaggcugaggugggaggauugcuugagccuggcagguugaggcugcagugagcuaugauccugccacgaacuucacaaagcaagacccugugucaaaaagaaaaaaaaaaaucggcugggugugguggcuaaugccuguaauccccacacuuugggaggcugaggugggcggaucacaaggucaggagaucgagaccauccuggcuaacacggugaaacccugucccuacuaaaaacaaaaaauuagccgggcauaguggcacgcaccuguaguccuagcuacucaagaggcugaggcaggagaaucgcuugaaccugggaggcggagguugcagugagccuagaucacgccacugcacuccaaccugggugacagagcaagacuccaucucaaaaaaaaaaaaaaaaaaauuguggaaaauauuuauuaauaugaccauguucacaguauauugauggaaauaagcagaccaugauuucauuaugucugauuugauacuuuuuuaaaaaacagcuuuuugaaacauaaaaacauuaugaugcuacuuuuguaaaaaguguauauguguauaauaaguagauaggaaaaagauugucuagacauacaucaacauaguaauagugacuuuuuuuggaugauuggaugagucauggaagauuuuauuuuuuuucuccauucuuucugguguuccaggguuuuggcauugaaguacuuuuguacuuagaggaguuuuauaaaaaacaaaaguucccuuugagggauacuuugcaucuggacuguuaucucuuacccacaucauucuugaggacgaagagaaaauaccugugaggaaguauuuacauuuguuacgguggugcugggcugaguuuguguggacccuggacucccagcuguccacacaguuauaaagaguaauuaaaagcucccugaacaacaggucccuuaucagccuuaaaccuuauuguucagauacauuggcuuuuauucauagucuuacuaaucaacuggggacaaaaaagacccauugaaccauuagcccucagcccgagaugagaagcgcaugaugguacaauggccgugguucagacucagauguuaugcuauguuuugaauucaguccagguuccuaggaggaaaacacccaucaaauuauguuggcuuuagagcgaucucagucaacagaugacaucaccgacuuuuccuucccugcuggucuuuauuuggaggggaugcaagaauugugcaaccuuggaauaaacagaauagagacccgacuccucacucauuguguuucugaguuuaguuucaauccaacagcggaucuguuuuuuuacuccauguaaugggacuguugcugcagcuuuuguacaaggguggaguggguguccauuugcugacgagcacccuguguacacgcuaguuuuuauuugaacgaggugcucuugucuuuauuauguauugucugcccauaaaugaugucuugaaauagaggggugagcaucaccucauuuauuucaacccauauuuguacagaaggauuuuuguaaucaaaucaugggguuuguguguagaacucaguaagaaguaaucaugacccuguccguucauuugcucuuuguucuuuccuguuauuaacaauggcuuuggggcuuuuggggcgcauuuaguucugcacguuguguauguaaguagauguucuucugugggggcugcaaguccuuaaguuauaguuggauucccuucccagcaaggaaccaacaggaaggaaaacgaagucaaacccagucuuugcacguggaagcuuguggcgugacuguuauuuuuuugugauguucuguacagcccuguaaucucuuauuuuuggcaagccaacucugaaucuguggucccguagccccaggcaaccaaaagcugagacaaacagaggaagugucguuauucacauguuucucuggccaccucaucgggcuggacgcugccggcugccacccgucgcugagcuggagcuccccagagugcagccuggccaggcagggacuguugacccuggccccuguaggaagcaccucuggcuugucccccagcccccagggucccugccacucauuacuucucugcacucuuucuguaauuuguucaucgccuggaauuuauuucuggcagacuuuguggucaaaacugggaagugucuguuuccuuaaaacagccuuuccucaaacccaggaagugaaguagggagcuauccuuccucaccuccucccugucacaugcacaugggcauacacacacguacacacucacccaugugcacacacacaggcacacacaugagaaagggacggggaaagcuaggguguccaccccagccugggcuccugguaucccuaaggguuuuggaagaagaguuucaguuuuucaaagccugcuggagauguaacugucgugauguuucgugggaucugcaagagccuguagcgucagguuucuuuccuuuugauugggaugacaugaagucuguuaaugcgggaucguuuguguuaucugcucugauaggugguuuuacuugcauuugauuuuugauagaaugagagaugaauugauuuguuccugauacauucuguugggauacaguccauuugauaggaagguuguuuacaucacaguguccuguauuugggggcugcccugggaugugaaaagucuguuuaugucuguugacagagggucucuaugcuucuuccuuuucuagcauuuacucuuauguuacaauuagugccugcuugcugugugaacaggacagauuugucuuguuuguuugggucguaugcaguuucaugcagaagacuuagcuagaugagugacucaaaguuccaugccuggggcccuccacccuccuucccucaaucacgccuuuauccagucccuucccacgcccuguuccucauuggaauccucuguccuagccuauccccccugcucuccccuggcauagaagggugcaucucgucuccccacaacagcacuggaaggugcuagaacacuuggagaaaacuaguucuguaccagggauuauguucagcagguuuaucuccucaaggcaccccuaaaguauguuuuuacuauuuaacacacgauuuuguaggcccuacuguuguuagcuguucguagauacuauuucagaacaaugcugugaguagauacuauuauuagguccauuucacagauaagaaaccugaggcccugacaggguaaggaguccuaagguucuguagcuagccaugguagagcugggguguaaacucaggcuuucugacuccaaaguucauauuuuuaaucccuauacagugaaguaggcacuguugccauuucuauuuugcagauggggaaacugaggcacugaggaguuaaguacuuugcccaggguccuagaacuagucagugguagagccaggauucuacccagacaggugagcucuggagccaaagcccugagcaucuguaguagauuccuuguggcuuucuguccuguccuuguuccgagaaaguucccaggggacaguuacggaaucacugggugcuugcuguucucacacgcacaguuucuacuggcucucuagcauuucuuucauuagugagagaauguuucagcccagcuuuucagaugguggaguugaggcccccuugucugagcuggguauuugagagccagcaggcuugagggccugugaggucucuggaggacacgguggugguggggccaggagaagucacuucuugggacuuuggaaagccuagaggaauuccagaaaugaaacaccacacacuuacuggaagccaaguucguguuucucccacugguggaagggauaugaggugcuguaaacguggccuuuuuucagaugcagaaugccugucuaauuacaggaaacagagaugucgccccacacugagccaaggauuucaacaucucuuggagaaauucugcauggaccugaaguuugaagcuuugcauuguaaccaaguuggcucuccuugccuuccccccaggccacgauuucgucauccugcuuuacggauggcauuuccuauuaagugucugucugugaacauaaacauggagcugagacaaagcacagcuucucccuggacccggaaagagggacucaggcgccuggggcuggggccuggcuccagaccugcugcugcugccuggccugguucggggaugccuagccuaacaaggcagccugggcugggaaucgcuuaggccucagguugaugaagcugggagaaggguugagagggcaccagaccuaagaugguggccagagccauuuaaucaugugguuguaaaauugucaguaacuucuuuguauggcuaguugaucugaucucucauguaggacucagucccccaguuggaucuuggaagguagacauuuauuugaaacagacagccugguagagugaaaagagcuuuguguuuuacccccucagauaguaagcaaagaaaauggaaaaagcagcgcugucuggggugacauccugaugcauugcuggugacagagugaagaggugacacauuuggaacauaauguggccaucuguaugaagaaccauaguucauccagucaucccaacccuaggacucuccagagaaaaccguuuaaaauagggggaaaguuauuugcaugaauauguucauaagaacauuauguauaauagaggaaauuuggaagaaaccuauagguucuuccacagggaaauuguuaaggaaaugaugguagauucuccgcaagaauggcucccauuaaaaauugaauuaguaagacucuaagauaaugugguauuaagaaaaaaacuccaugauuaaaaaugagcaugggccaggugugguggcucacgccuguaaucccagcacuuugggaggccgaggcggguggaucacuugagcucauuaucugaugcccugaauuggcuuuuucucaugcacauuagguuaaggucaguaguuacucacuuaaguuacccauugcauguguuuccagugacagaaaaggauuuagggauggaucguugaggugacugcuaugcauagaaaugccuagaaggaggcggugguuuaagcuguagaaggaggcaggugccaagugcucccaguuugggguuugagcucccacauucugucugcacagcagcaggcaagucccguggccuccaggcucugcaucugugauguaagaucguaaaccuguccugccuaccuuguuugagcaucagaugagauaagguacgugauaacacuuugugaaucacuuaaaaacacuaugucuaugugagguugauauuauugcuauucaauaaaugcaaacguguaggaaauuauaaaaugauucaacuguuccauuccuguuuuugaaacuuucugaagagagguggauauguuucccugagguggggagcuaggguugugccuguguucauccaggaaaaugggaugaaaagcccaagauacaucugcgacaucaucuucagaaugugaaauuacaguggguuuggaaucugggccuucucucugccugcucccugccucuccuucccuacccacagucuccagcucugacuccuggccucccaggguccucucccagcagccuggaaggaagggacauccucauuccagggcccaggccaugaggaaggaagcagugggcagggaugcaggcugcaggugugggcagcuccaggugcccacucuaggcuucaggaugaguggcucccuuccugcagugggugcccauccuggcagguacagucaccagagaggcccgccugcuucagcugcauaccaugggguuuuuccugagacuaaagaggguccugcuccuuauauccauugaccagugagugaugaggaagacugaaugcugacggacgggaggaaggaagucaggagaaagggagaagggcuggccaggaaggaggagagaggaaaugacagaggagagggagagaucaggagccccaugccugccagccagggaaggcccugcuguugcacucuucagaaccccaacuugggacauuuugaauagauguuaggagugugaguggaaucuaaugagugggacagaccucccaagugagcauugaauaugagggcggguggggcaugguagcucaugccuauaaccccagcacuuugggaggccaagguaggaggaucauuugagcccaggaguuugagaccugccugggcaacaugggagacacuuucucuacaaaaaauuaaaaauuaacugggcaugguggcacgugccuguggucccagcuacucgggagguugaggugggaggaucgcuugaguccuggaaaucaaggcugcggucagccagauugcaccacagcauuccggcuugggugacagaaccagacccugucucaaaaaaauaaauaaaagauaaaaaauaaagaaaaugaggguggaggaagaagagccagcggaagauucuucugagacaugggaaguaaauuugcaagauugcugucugggagcuggacagacaggaagggaacagaacugggauguggcagggacagguuccaggcacuggcaggaugggggccagugugcagugggccaagagggaaugggagcgagaagguggggcgucagcaacauucagcucccuccauagcucgaugagaagagagggguggggacaggcgguagcuggaggguccuucaggaucauuuuauccguaucccuuucguaucuuuuagugaguuuuuguuuucccuaacuggauuguuggcauuuuaagggcacaguuuguaucuucuaccucuuuguuuccuccaaaguuggccgaucaccagaucacuuaaaggagguuguuuguuuuauaagcguuuuaccagaucuuggcuuaacacuucccccagaguuagucauaaucauucuagcagggcuucuagaugcugaacaaugaccgauggugccacuugauuuauaugaagauacugguuuaguuuuaaaagcaaacuuacauugaacaaaguguaggaaagagaaaggagagggcuacucaagugccugaagguccgagcagugaagaacauguuuccauaugccugccacccuuaggcuaaggacacgguuuuccuaucuguuuauugaauugggucacuugcuuuaguuauaauauaugaagggauaagacugaauuucacuucucaauuaacuagcccucuugcucucuuuugaucacacguucuggggucagauuccagcucugccagucaguggcugcacuggccaaggccacgugguugaccaccauccagaguucugccaagagccuuaccugccagaggcacgggagguguggcuguugcgcagcuucuguggcccaggcccucugccuggcacauuuuaaguaaugugagcggauuacuuaaucuuacugucuguucagcugaaaacuagggccaacccuggcucagagcucagggggccguugcgaggauuaaaugagagaauccauggaagauguuuagagucguaccagacacauaggaagugcugaauaaaucagaaugguuuuuacuaugacucucaccuuucaauguuugugacuuaaacuuauguuacaguuagucauuucacuggcgugugcuaaccaaagguggccuggccccuccgcauccauuaggagggcuugaguuuaaaauccaggcccugugagucugcagggaggaccgacgggagagcuggguacuccugggacuucaguguccaguggaugcugggguucucagguugguauauugagucacauaguuccaugacucccuuggaggaagaggcuaaaguugucuagaggcaggugugauguuuggucuguccugugugcacugagcaccuucuguauaccagucccccugcuugcuucuuccagacagaagaaaacacagauggcaauuggucauauuugaacagugccucuuauagcuuacaaauaccaucuuauugaacacucaugaaaaaugcugggauguauguuauuuuuacuguuucaaagaugaaaaaacucaggcacagacauucuaaauaguuccagcucuuaggaaaaugcuucuuuagcauugcgggagaaacaguauauuuguacaaggcaaguaguucacccuguaaggcagcacgugcuuuggaggcaccuaaauacuacacaguguuuuaugcaugggcguuuuucuuacaaaggaacauagcuuuaucuuccuggggguguuuaucaaaccacaucuauguagcagaugcucuucaagcauuucccauauucccucguuuacaacacccuggaacccugaguuaauuauuagucccauuucauggcugaggaaucugaagcucugagaguuugaacuucuugucuaaagucacauggugaggaagugguagaacugaccuggaccccagguaucuggcucuggucuuuccaauagugccucuucaguggguaucccuuaaauucucaggggcaggugcuuucuccuccuuuuaugcccuuuuuuucagagcaaaaccacguuauccuaacugccaagcacaacccacaaaggcucuuaucucuccuucaaaaaaagccauucccugccugguugaugaggucaccuggcauuuugcagggcauuuugcaggguagaugccagcucgggaaagccacauagauaagccaguggauggcuuguguuacugccucccugaugguuugcuuuuaauucaagucgauucauuuaucugagaugaaaaagggagaggcugauucacacacauugaaaagcagggaauggugcuggagaaugaggccgugacuauuuggaauaagauccuggagaugggcagugcugauagaguaaauauccagggagcaggggaaggugugugcacugacaacaggaguuuuagcaucugccccuccuugcuucaaggggcuggcggguacccgaggcggggucggagggcugagugauggcucccauccucccucuucccuccugcuccacggguguaaccuugaggugggauuggagggcuuggugaccucucuccucccucaugcuccauggguauaaccccaaggugggaucacaggcugagugaaggcuccucauccucccuccucccuucuauuccacguguguaaucccaagaugggaucagagggcaggguggaggguuacacauccucuccccucccuccugcuccacgugcguaacccccagcugacuuacagacugugguaccugcucaacugcuucaauuccagaacuggaacugcagggaagcuguuucugacaucccugguuuuaauuacaaagggccccuugagaccuugucagaaauacugccagccuagcccuuuaaaaacucaugauauuggguucucuaucagugucgcucccuggcuguaauauuguacuauaauuaggcaagauguuuccuuugggggaaacggggugaaggguaugaagguucucucugugucauuucuuaaaacuccaugugagucuauagugaguuuuaaaaagaaaaaguuccagccugggcagcauagcgagaccuauugucucuacacauaauaauaauaauaaaauuagacagugugguggcgcacgccugugguccuagcuauuugggaggaugaggugggaggauugcuugagcccaggagaucaggacugcagugagcugugauugcacuacugcacuccagccugggugccagagcgagacgccuucucaacaaaagaaaaaggauaaaagaaaaaaaaauuaaaaguagggucauuuaaauauggcaaacuccaaacgggucuucucuuugaaguuuuagggagcagcuuauuuacuuugugucucacacuuugcuaauauccaaaaugcagaacauuagggaaccgcuugaggcaggaggggaaggaagcacugauucucgcugcagcauggaugaaccuugacgacaugaugccaagugaaagcagacagacgcacaagacuacaucuuuuaugauuccauugauaggaaauguccugaauaaacaaaucuauggagacgggaaguagauugaugguggccaggguuugggaguagcagggguaggagggaauggggagugacuguaaguggguaccagguuucuuuuuugagucauguucuaaaauuagauuauugcaaugguuguaaagcucugugagugaacuaaaagccaccggguuauacccuuuaaaugagugauugcauagcaugugaauuauaccucaauaaaacuguuaaaaaaaacaguaggguccuuugauaguuuuaauagaagucauaauaagaggaauaguccuuuuucagagacugcuuguaacuugcaaauucaggccacuguccuggggcauguuccuggcucucauaaaccagauucacaggcccaccacgcagaccaugaggguguuuccagucacucaucuugagggaaggaacacccagugugugccaggcauuuugccaggugcuuuuaccuacgcuuuauuauguaaacuuuuugcagcccugcaugguaugugguuuuacgccuuuuuuuuuuuucuuaauagacagucuuuaucuguugcccaagcugaagugcaguggugcagucauagcucacugcauccccaaacuccugggcucaagugaucuuccccacuuagccucccgaguagcugcgacuacaggcacauaacaccaugcccggguaauguuuuuuuuuuuuuuuuuuguagaguuggggucucacuauguuacccaggcuggucuugaacuccuggccugaagcaaucugcccaccucagccucccaaagugcugagauuacaggugugagucacugaacccagcucaugccuaucuuuuuauagaugaguaaauggagguuccuggcugggugcgguggcucaugccuguaaucccagcacuuugggaggccgagguugggaggaacaucugaggucaggaauucgagaucagccuggccaacauggugaaaccccaucucuaccaaaaaaaaaaaaaaaaaaaaaauacaaaaauuagccgggcaugauggcgcgcgccugugaucccagcuacucaggacgcugaggcaggagaauugcucgaacccaggaggcggagguugcagugagcugagaucgcgccacugcacuccagccugggcaacaagagugaaacgccaucucaaaagaaaaaaaagaaaagaaaaaagaaauggagguuccaaaaggcuaaaccacaguaagggaguacugcagcaaaaacuagaauuugggggcuccuugacccccaagccuauucucuuuucacugcugguauagucggguugccaaggcugcccucuuggaggggccgauagcucagggaggucaccagaggaaaggccugugagcucugugcaagucauuuucaggcuuguguccucaguggggacucuacucccuccggaagugaguaugacauucugcccuauucccuuggagcagcucuucccaggagagcuucaguggaaagaaaacugugggaaaacauuuggaggcauuucauggacacguuucugaguguuaugagcucuugaaggaagcauguuuauuuccccaaagugcucagcuguguccggguccugaguuuuucaaggguuuauaacccccggagcugaauuuggauaugcaaggaagccaugggauugcagccagggaacaugcuauuuuuuguaagugaugaugcuguuguguaguaaacaggccccucgugguaaauggagagcagugaauggagguggagggagaaguuuugggaaaagauuugcacucaguuaaugaugcucaagguaguucaaggcagacucaguagcucccggguugcuuaguagaaaugcagauuacugggucccagucuggaccugcagcgucagaaacucugggguaaggucugggaaccuguguuuuauuuuuauguuauuuuuuugagacagggucuugcuguguugcccaggcuggucuugaacuccugggcucuaguguuccucuugcuucagccuuccaaagugcugggauuauaggcaugcgccacugcaccuggccagaaccuguguuuuaaggaacacuggagaucauuacugugcacccugaagucugaggagucuagcaccagaugaucugacgacacaucauugggauguggagucaugguuccagucaccagccugaaguuguccuugucugucacccuccccacuuugucuaagggugaguggaacagacagaaaguagacuagugguugccaggggcugggaguagcaggcuaggagggaauggggagugacugcagguggguacagccuuucuuuuuuggugauguucuaaaucuagauuguggugaugguuguaaggcuuuagauggcuugcuugagccuugcaaugggaaugagugccuuggccuaaggagaagggaagaaaaucuuguggaggaaaugagcuuuuauuuuuuuccuuuuuuuuugaggcagucucuugcucugucacccaagcuggagugcaguggugcaaucucagcucacugcaaccuccgccuccuggguucaagugauucuccugccucagccuccugaguagcugggauuacaggcaccugccaccacacccaguuaauuuuguauuuuuaguagagacgagguuucaucauguugcccaggcuggucucgaacuccuggccucaagugaucuuuugccaccagauauuaaaauguaucaaaaagcugcucuauuuaguacugauugagaugaauggagcaaaauagcccaggaacagaaccugguauugucucucuguaaaguaugagugaauuuaaaacauuauuagauauguuaucuaguaauaauaaugauaaaguauuuuuuaaagucaucaugaaucaauagaaggaaaggauuauucaguaacuaugagcaugugggucuuagugucaccaguacuuauccuucuucuuaggagggauuuguuuuuuuaaucuuaaaggaaauagauauguuaaaccuaucaggcuuccuuauuuacauuggcuagagagccuaacucuaaauuuagccaauguauaagacuaaaugucaaguauuuaucuauacaaacacacacauauguacacacuugcauccacaucuacauacacauauuuuacauacacauauacacauauaaauacacacguacauacauacacauacauacaugccucuuuccugauuuuauuuuaccauuauuuuucuuccgcuuuaucuugcauuacucuuucugguuuaucacauuuucuuguauuuuauguaucucuauaaaccacuuuaaaacuuuuugggggaagaaaguggacuauagauaaagaaauagaauaagguauaauauauagaaaaaaggcaguaaaaauacacccaaauuugaauagguugauuuuggggugguggugguaaugggauuauuaacuuucccuaaaauuuucuguauuuuugaaauuuucuacucaaagaaucauaucaucagaaaaaaauuauuauuucugcucauucccuuugcuggccagugaaaggaaugcauuuccauaagugagggucuggcagagcaguguugaggggaggggucuuugccgcagcaaaagcugguccgguucccaggagagccccuccuuugcugcuugaccugauugcaaguggaaugugagagccagaaggaaauauuccaucacuuauuuagagcauucauuuggcucuucccugaucuaggcguucaguaccugcucagagggaguuuacauucuagucaggggucagagaguaaaugagugaaauggauucagaaacgaugccacccugggauggugacauauagccccagugagaaggaugaggagaugcccaagucaagagcgaggggaauggguuuccagagagagagagggcugcuugugcacaggcuuggaguugcccagggguugggcaggucaaagugaagaauggccgggguggccauugugggugagcaggucagggauaaagaguaccuuggagagaucaacuaggaccggaucugacuggccaagagaaagaguuugaauuggacucuaaggaugguagacagcuacuaaaggauuuaauaaggggaauggcaguguuugaugaaagguuuaagauccuucuagcugcuucugaagggugauuuguagaaggacaagagaugaagccaggggaguggguagggagauucugcccaaacugauugcuacacagugauauuuuuaugcuuuucuuuuuuuucuuucuuucuuucuuuccuuccuuccuuccuuccuuccuuccuuccuuccuuccuuccuuccuuccuuccuuccuuccuucccucucucucucuuucuuucuuucuuucuuuuauuuuuguuuuggguguugaugaggggacauacaacuuaagaagaaaaauuggaauuauuuugucaacuuuucuacaucagcauuuuacugauggaauaagcuugcauuugaacuggacaucauuuuuguuuuuauuagauaacauuaucuguauuacagauaccagauauguguguacccauuuauuuacuaaucacuaauacuuacaaaaaaguaaauuuugucaaaagaaaauucagcuuagauggccauauuguauguguguguguguguguguguguguauauguguguguguguguguguguauauauauauuuuuuuuuuucuugagacaaggccuugcucuguugcccuggcuggagugcagcggcacaaucuuggcucacugcaacuucugccucccgggcucaagcaauucuccugccucagccucccaaguagcugggacuacaggcaugugucaccauggccagcuaauuuuuguauuuuuaguagauacaggguuucaccauguuggccaggcuggucucaaacucuugauucaugugaucugucugccuuggccucccaaagugcaacggcuauauuucugacauauacaaauccaagcccaguugaucagaauuuagcaguaucugcaagauuugaaccauuucagaaaucugagcucucuagcauuacauggacugauguuuucuuagcucagaacugcuuaccuguguguagaaaaucuaauauuuaggaagaauaauucauugcuuuaaguguucaguccugguuuuuauuucuauuguugcacaaguuugauuugaccuuggacaaaucauuucaguuuguauuuuagugcuugugugcagaagauggguaguaauaguccugguaauccuccugccaucauguuaacugggugagagcucuucaagaccuaggagagauaauagcaggugcaaagucccuguggugggaggcagcagguagauauuuuaggagcugaaaaacggucuguguagcuggagagcaggguacaagggagaggugguccagggucauguuauagagguaggccagggccacacugguugggguuuugcaaaccuuacuggggacuugaaucuuuaucugaagagcagggggaagucauuggaggauuuaaaucagggaaugacauaagauugauggauaugcuaucuccuuuaauccucauaacaaauguaugugcuagguaauauccccguuuuaaagcagcacagaaauuagggcaguggagauuaaggaguuuaccccaggacaccaugcaggugaaugauggagccaggaaaccaacucgggucagcuugcauccaaaguccucagucuuccagaucagcguaccuccauaguaauauaacaaugacugcaguuuuaaaacacuuugaacucuuaagaugaaagauuucccuuaaauuacaaagugguauuaugcugcagaaaugugagcgguaaugagagagcagguaaugcccgggaacuuuugaaaggcccgguccguguggcucugcuccagcaccuucaaguucccugccgucuggcggggggcgucucauaagcugcuuucaacacaaagaaggguuuggcugcuccccggccauuugacacugccauuguccauaaggacucguuguccgugaaaugcacccaaagcuugagcuuucagggguuuugggaaaucagaucugggcagugcaugugugguuucgcuggagacaucauccaaugccaaguuucugcuuucugcuuucucccucuuggauaaucagcuggguuacauggauucuuagaagcugguuguagagaucaccaucucgauuuugaacccaagaagccuuauucaggguucaagugggaaaauaccugcuggcccacggcccuugaggcucuuggugaugaugacauaugucuguuucuuucuaguugaccacguuguuccugagccugggacaagccugcucgcugccuuugaccaguggagggaaugggccgacagcaaguccugcugugacuacucucugcauguggacaucagugaguggcauaagggcauccaggaggagauggaagcgcuugugaaggaucacgguagguugcacugagucaaugcccucugcagauguuuccgcuucaguccaucaacuggcacagcccugggaagaaagugauaaugcuuccagaucccauuugugccucaugcccaugccugccccugggaaggagagagggcuuugggccgcagcuuaugcuguuuggagguggccuuacccagugcaguaacaugagccuucauugaugauaagagaagaugaggcuuacugcugggaccuguucuuaggugacagcugcucacagcuuauugguuugugagcaccgugcucucuagccaggguggggaguugaggcugcugagagagagauuuacccucaaaagauaacaaauacauaucucagugaggauuugacagucucaggagaguguugggcagccccuuccuacaaaccuggauggaucuaggauagauuugagggcuaugagacacuucaaaacugagugacaaccugagagggcuuuuccuuucccuagaauuauuuuggagaacaaauuuccagggauugggaagauucacagagaggcaggaggaaucuuuaccaccucaaggugccucugggacucuugucaacaagaaccucggggguuugcggggaagagccaggccacaucaucuuccugggucucgcugggcuuggcuagagaccagauuaacuucacuggaucuuaguguucagggaaacaccuauugcuuuaggguucuggggacuuccaggcuuagaaacaccaugugcugugagugacauggcaagagggaaaucucuagguacuagaaugauagaaaaugccccggaaugaaaagcaagagucuuggguuuauuucucugaucuuccacagacuaacugugugacccuggguaauuugcugaaauuuuaugggucucaguuuuuuaaacauuucucauauaugagggucuuggacuagauguccucuaagauucuuuccagcacaaagcuuccacauaaaagaaaauagguaaacuuugacuuuucucacuuuugaucaugcggagacuccaagugguuuaacuguggauacuuagacugaaucugcuccaaaccaggcaggaggguuaccaugguaacuguugccuggcaacgggagaagggccaggauguccagaggcauuuaacucaggcagcucccagcaccccccagguggcuugaauuaaacuccaaggcugcgagguugucaggacaauuguuuaaaauugugaugaauguugggcagggauguuuggucuggugccuagggaggcaagaacuccaagacgccaggaugagaauugcgacaucugcuuguugaacuaauggaccuuuucuuacuuaaaaaaucauuugcuuaaaaaucagcauggaaggcagucugucugccaaagaaaagacauuuaucacaguucuucauaggcagaaacuucuaauucauuuucuuguuacagucgcaacagacuuguuugguagaggcagcuuaaaaaauuaacugugguaaaauaaauauaacauucaaguuaccaucuuaaccauuuuuaagugugugugcaguucauuguuuuaaaauacacucauaauguuguugcaaccaucaccacccuccauccacaggucucuuuaucuugcaaaacuaaaacgcuacacucacucauuaaacacuaacucuccacuguccuucaccccagucccuggcaacugcuguuguacuuucugucugugaaauugacuucuagggaccucauacaaguggaaucauauaguauuuguccuuuugcaacuggcuuauuucauuuaccaugauguccuuaagguuucuccauguuguagcaugugucagggugucuuuccuuuuuaaaggcugaauaauauuccauuguauggauagaccacauuugguuuauucauuuaucaguuaauggaggcuugauuuuugcuuccaccuuuuggcuauugugaauaauucugcuaugaacauggaugugcaaacacuggcaacuuuuaauuuugauauacuuguaaacuuacaggaagauuauaagaauacuaaaaagcauccuugugccucuuccucccacauucacagguuauuuauaugguacucugcuuccuuuaccauucugugucuccauuucucuccucucucuuucucuguacugaaacacacacacacacacacacacacacacacacacacacacguacacacacagacaguauuaucacuuucuuaucccuuauuugguuauuugguuuaucuauuaaaaguccacuucucuauuuuguccgcacuagggguaaauuccuuccucguguacauggcuuucaaagaucgcuuccagcuaacggauugccagguaagaaagucggcuuuucggaagaggcacccugacauuugguaccuucaggcuguggccguuugggaaagcagucuccgauguaugcauguuuccuagcuuccugggaaguggcugguggaugcaguuacugauguaacugagccuuggaagagaguaugaacgcagugcccuggcccccagcacugccacuccgccgcccuggaucugaggcucugccccgcacggcgugugugggagcggcacucagaaccuccuuagcaaaccuggugcagagccaggugucacccaagagcuucucacucccgguccacguccugcuaaguuguacugccucuguuaauuucugaggggucuuucuccaucaaauguggccaguaacauugcccucaucauaucaaaaaaagucaggcuaauagaaucgccuagguguccuguuucucaucccagaaaugccucugguggggagaugauugucuuugugaacaggaagauggaagucccugucucugaucccacccuugucucucucucagauuuaugaaguacugagugugauccgggauauuggcgccauagcccaaguccacgcagaaaauggcgacaucauugcagagguacagggcuuucuuuuucgucauuucuucaucaccuggagggugagaggcaggcucaagaaagggaagcugcaucuguagcuuaacaccaagguggaaaagcagagggaccugguguucccuugcuggagcucugcucagucucacccauggcaugaaugccagugacacacgugccucuccgugugugccacagaacaucuaagucaguuacuauugcagagagaggccauuucucucggugcuguaacgcagcugccuugggugggguacgggaacccucacgucacacacaggcauuuuacaccguggcugaggguugcaaaugcaccagucgucagcaucccagggaacagcugaauggguuuugggaggcuguaauugauccauccugcucaggcgggacugggaacagggcagugaacccuucucuucaugaggucuugggaugagggcagaacgaucggcagugguaauuuuccaucuugcccggauaacugcaugcccgggccucugccaucagagcugugcaaaauccacucucccucacagccugacuuucucuaaacauugcaggagcagcagaggauccuggaucugggcaucacgggccccgagggacaugugcugagccgaccugaggaggugaauguucaccaagcggaaugcgugaaucagugucccuugggcacugugcagagccucagggaaccugcuuccugccuguugagaagggggcuucucugaugcugacuguggucuuucugagaagcugugggucacgugugugucugucugucuacgcaggcaaagugaaguguuagauugcuccugaggguaaggugguguggacuguuucgccagaagauucuucuuucugucuguaauucuucaagcccuugcuuguauagacacaaacaguucuucauuggcauccugcaauguagauuuuagugguucacaacuuauggucuccaauaucuuaccaaaauucaccaaaacguaguuggaaggauggaaaagcucuucuaaaugccuagaaggcguguggggaauuguuuuuccaagguaacccugcacaggauaucacaugauaugcagaguuugguagacagaaucuuuuaaaauuauggagggaagauucagagcaggggccugugcuggcucaaagguggagacucaccgucuuggugaggugugugaguucgaagggagggugcacacgucuuagguaauggagaaccuguguucaucaguuagaauuuguggcugugaaauacuuuucagaaguugguuccuuaaugacaggcuggaugucaggcucuaggggcccugacuagggagcagccugcagcuucgagugaagcgugcaaucagggaaucuccagggaaccaccaggauuuccccuucaugggaggaaguggcagaaaagggacuggcgccgagcagugggggaagaucaccaagggccugaguggaggcugacagugaggaggcuccagaagccugggagggaggagcuuggcaagagcucccugcagggcuguggccacugagucacugagugucagcaccgugccaccacccugaguuugggauguggucauguucauaccagugugggaggggagccggucccugugauaaggaaguggauucaggagggcuuggaagcaaaggcaccaucuguguacugccucgggugcaggagggggugguugggauccuuucagacuugaggggaagggaugaggcuggaagaggagaaaggagucaagacaggcagaaagacgagagugggagccacucggaaugcuuugcacacagucaggguccacgcuuuguucuauccuucuugcugcaugcauaugcacacauagacacacauguacacacagacauaggcacacgcagacagguaggcacacaacagacauagacacacaugcauacacauaguaacacacacagacacauagacacacagacagcuagacacagccauagacaccuacacacacacacauacacauagacacacagacacauacagacacagacacagacauacacagacacauacacaugcagaggcagauacacagaacugcaugcuccaagacacuuucaguagcauuugaggcccugaggacauuuuccucuccccagaugacagaauggaagccgugacauuuucaggauugcacguuccugcuucaggccagggaugcaggcccuuuuguagcuaucaaccuucucaugcgugcuaaaggcugaaaggguggccuggcacaggcccgaggaugagggaggcaggcaagccccugugucagcugagggaagccccaugcugagaccguggcugguggacagugauugcaggggacagcuugcaggcgagagcaggcuaagaucagccgaccauaaacaugccugaggcugauuuuauuuuauuuuauuuuauuuuuuuuccuuuuucuggagaacggggucucacuauauugcccaggcaggucucgaacuccugggcucaagcuauccucccaccucuuagccucccugagagcugggauuacaggcgugagccaccgcgcccggccgaggcugauuuuaugcacauuugugugcacacagauccacgugcacaagcacacacacgugcacacacucacguucacacacauauacauacacacacguccauaggcacagacaugcacguguacacacacagacacauuuuagcauacgcacaugugcacaggcacagacacgcacauauguguuguacccacguauuuucacauacacauauacacauguacaagcacagacacgcauagguguacacacacauuuucacacacacaugcacauaugcgcuugcacacaccuaugcaggcaccaucccccuuugcagacaccgcaaggguucguuucugugguuucacuucucccucugggccggcuucugugacugcccucgccagauuccccaggauccaccugucgggugguuuaaaccauggcagcauaagccaugguugcucucagcccugaccucccuggaauugggcuuuguucccagggcuuuguucccagggcuuuguuccgcccugaaacagucuugggauugggccuuggaaaugcacagaguccgggagagguggagggcugacacaguucucacgugagcccuguucaaagcugccuucauuuagugcucacgugugcuggacacuguguuccuggcccacauuucaguuuuguaacuguccugugcaggagguacaacaucuccuucccacaacuccagggaugccauucaugcaggcugcauggcuguauucagggagcaccauuuacauucuacugcccaugaguggugguaccagagcugugcugcagugggcuccuugguuaucucucuuuagaugaggacacuccagaagcaugaaguuaagugacugcccaguuaucaaagcagagagcuagaaagugcaggguccugccugcuaccccaaccccucccgcaguguacacauacucagcuuaaagccacaccuggaccugggcuuuauuagaaaguuuccuccugcuuuccucccguuuggugacugggagccagucccucugccugccauguaccagcuguacaaggaggugagaagauguccucugagaaaagcaaaugccacuucugcaaaugcuacaugaggcuccugcugagacccucacucuucaaguuuuagagccuucugaggggcuugcauuccuucuuucuccugcuuucugcagagaaguacacaaacacagaaagaaagggcccuggcuuugcugaagaggaaaaugcucucagagaguuguuauucugguugcuuguauucauccauuuucauacuacuguaaagaaauacgugagacuggguaauuuauaaagaaaagagauuuaauugacuuacaguucugcauggcuggggaggccucaggaaacuuauaaucaugguggaaggugaaggggaagcagguuccgucuuauguggcggcaagagagcgagugagcagaaggcaaacugccacuuuuaaaccaucagaucucgugagaacucacucauuaucacaagaucugcaugggggaaaccuuccccauaauccagucaccuccuacaggucccuccuucaacauguguggauuacaauuugagaugagauuuggguggggacacagagccaaaccaugucauugcuauuucaaccagagaaauugaaaccauuuuuacgugauuaggcccagcagcuguugcccugagaacuucagaauccccagcaacugauuauggagucuccuugagggcuggcagauccagggaugcaccaguaugggaugcaguuuuucagcugauuuagaggccccucuuguaugccaggcccugaguccuuuuagccauaugacagcccagugaggcgaggaggggggaugcaggggguuugaaaggcuuggauaguggcagagcgugauuagaacucaagcccacaggcaccugccggcugacgucuccucucauggugaguuugucaagagggaucuguuguguguuaaacccugugugggugauaaagagaacaaguauggaacaauuuugugugaauuuuagcuucccagucuacuuggggaggugcugcugauggaaugaaacacaucccaguguaacuucucuguaguuuggugaccuauccaucacuagcaugaugguucucuuggauuugaacuuuccaaaacauguuccuaacccacuaggccuuucuucccaacccaccaugugagaccacccaguaggauuuucccucguuuuccacccagaggauuggaaaggacacuagggagugcagacaucuggaacugaaccaucuguggcugagaggaguggcgacugagccugcgugacaauccgggcagugccuggcauuguggggaugcaaaacagauaagaaagugauccuuucugaagggacuguggacaaggcgaggagaaagagguagacagaaagugaguguagagauagaauuugacaguggcucugagcuguaagacugaugucugggaagagaguggggacuuggagaugaggauaaugaagaacccuucacagggacgggcacuuuccagcaggccuuguagaaugacagauguccugacacugcucugugucccuggacaggucauuucccuuucugaguuaccucaucauuaaaaucagaagauaggcguaguggcuuguaccugucaucccagcacuuugggaggccgaggugggaagauugcuugagcccaggaguucaagaccaaccugggcaacauggcgaaaccccguguugggacaauaaauggaguagucaccuguaucucugggaggugcugaggguucuaguggaguccaucucacacuucacacccaugcaagacgucccuguccccgccuggugcugccgggccacaggcaucucugcuguaaguggagagagagggcuucuccuucagcugucuuaggaaugaaaaacauuuggguguuuaauaugcuuuuucaagagcccuuugcuuggauuguggauuucuagacaucccuuuucacauaguugaugccugaaaggccaaaugugaaugaaguugucucagcucugcuaaauuagauuaccaguuaaugcaauuacagaauuuaaucuuuuggccaagcucugguggagacaagguaaccaauucaguuauaggggcucaguuauuucuugugaaaaauaacaguguucuguggagcagccuagacugaaauaccaugaacauaaaaugaaaucauuuauaugcuuagcaaacauuuuugagcaccugcuguguaucagacaggacauugggagcuauugggggcagggcauggaagauacuaagcagugaguaagccccagucccuccccuccaagaguucaagccagagcccuuuugcugggauggagagggagccagugauguucugagaucugccuuccacaauuucaccugcuccuucccuugcugauuggugauuccucuguaggauagaacuugauccagggagucuugccugaucagauauuccacagucaucaugugggauuugaaauaucauucaucugaacauccgauguauuuauuuauuuaugagaugaagucucucgcugucacccagucuggagugcaguggcgccaucucagcucacugcaaccuccgccuccuggguuccagcgauucuccugccucagccuccugaguaguuggaauuacaggcaugcgccaccaugccuggcuaauuuuuuuuuuuuuuaauuuuuaauagagacagaguuucaccauguuggucaggcuggucucgaacuccugaccucaggugauccacacuccucagccucccaaagugcugggauuacaggugugagccaccacacugacuggaacauccgauuuaaagcgccagauuauuuacucaagcaguucuucaaucuugugcugaaggucguaccaggcuguggcuggccaugucugugcuucacacacagggggccauugguguagacaaacggggcccacuccguuccuagagcccugugaggcugcauuguuucgugggugaugcugacuucauucaugagcauuuaaugggagcccagcacaaacuccacaucacugaauaucuugacucaagacccugggagcagaaugaauauauggaauugagagcaaucagugucuguguguggcgguucucaaacguuaguaagugugaaaaucacccacauugcugggucccgcccucagaguuucuagccugugaguuucuaguccagggcagagccagaaaaucugcauuucuuacagacucugggccagugcugaugucacaggcuugcugccugcaccuggagaagggucagaagggaguuuucuuuucuuuuucuuuugagacuuagucucacuuuguugcccagguuggaguaugguggugcaaucucagcuuacugccaccucugccugcuggguucaagugauucuccugccuuauacucccaaguagcugggauuacagucaccugcugccaugcccagcuuuuuuuuuuuuuuuuuuuuuaauuguauuuguaguagauacggaguuucaccauguuggccaggcuggucuugaacuccugaucucagguaauccaccugccucagccucccaaagugcugggauuacaggcaugagccacuguguccagccacaggagggaauuaguucaaccaaaccaauguugagagacacaaggcaagucauacuccuuugaauuguccccugggguaggaccuuggagaccagcagccucgccuucaucuuagccucucucugggguggaggauaaagguagcggcucguggggugggcugagccacauucucaugcucugcugcuguuuugcaggucgaggccgaagccgugaaucgugccaucaccaucgccaaccagaccaacugcccgcuguauaucaccaaggugaugagcaaaagcucugcugaggucaucgcccaggcacggaagaagggugagugcuguggccggacuggcugauggcagguggggagguuuggaggggaggggggcuccucacuagggagggcuccuuuuccagacccucaugccaagugggccacuugcaccauguucuggcauuaaccuaauuacagccgggcaaggcaggagcuccaguuuccuccucugcuccacugcugcggccuuguuaguaucuauuuaaagccaugugcacgccaaggcggggugggcaggcacaugucccccagcccccgugcaagagcuggacuuacuuugaugugguugaaauaaacuaggcacauacacagauuacgucaguuuccauccgccccagaauccuuggucacaucaugcaccuccccuccaaggcugggagugauuucugccgggguauguaaggcagcuuugugggguguggggaugcauuuugccccagacacuaucacauccagauguuuuggugcuugauaaacucucuugaugcauucugaacuggggcugggucucugguauuacuaggguguccacuguaacuaacugaugaagugcagcuuccagugcuuccucuagaggacgccccaugaggcaccucaugcauuuugaaugcagcugagcccuguugucacccaccgcugacaacaugaauuucgauaaucacacugcaucuuuuaugcuugggaguucucuccucguacagaaagccugagggcaugucguucauuuugaugguggaucuuaggcugaucugaaaugaacauuauaaaaggguccccuucuuucuuccuuccuuucucccuuuuauguucccuccuccccuuugccuguugggaucucuccaucucugugucuccacuucucuucccuucuuuccugauuucuguuucauuuuaucuuucauuugacucuuucucagucccucugucauucucucucugugucuuucuuucccuguuaggaagggagccauuugaccucuauggcuugguuucuacuucccugcaucaugcaauccacauggaucaaggugggcugugggauuuuuuucacuggcgggugacuugcugcaagcccuggaacaaauugcucaaugaugacugagucaucuugucccagagaugaugacuuccagacggacccagcgacuccuggcccugguucuuuggagugcuccuggggccucuguccuuaggcuacacaucaaaugguugcugccuuucugucuucuccuggcaccuugaaggaauugccuuuuagaaauaagaaagcauucaccuaaaauaauguaaccuacucagaaugagcuuugaguuguuuucuaggagauauuguggaugacgauggaaucgguggccuugggccacccagacacgcauuugcaagaaggcagcgcauuugugggaaucagccucuguacagaaggccggccacagcacugcugcccccacguaguguggggaugguuggcauagugucugaaagggggaaagaaugagacggcuuauuuucuguauuuuacuacugcgcuguaccuagaugaugaugauacgugaguuaggcuaacauuucaacguaauuuuggauagagaccuugucuaaaguuuacuucauauucaaaccuguccaaaugagaagacggagggguccuacaugucccagacuuuaguugggggagguggagucgugggccagcccugccgcaggccuccuccucucugucccucaggguucuucucagguggaguugcggagcuggaguguguuguugcggugcccaguuuggaccuauuaccccaacucagugccugguagcccccguuguuguuuuuuuuaauuuauuuuauuuuauuuuugagauggagucucacucugucgcccaggcaggcgugcaguggugccaucucagcucacugcagucuccgccuccuggacucaagcgauucucccgccucagccuccuuaguugcugggauuacaggcgcccccccaucacacccaucuaauuuuuauauuuuuaguagagacgggguuucaccauguugaccaggcuggucuggaacuccugaccucaggugaucugcccgccucggucucccaaaauacugggauuacaggcaugagccacugcaccuggccaccccuauugucuuuauaaccuugacacacugugugucuuauggggugagcaguaggaggggacuuuagucuguucccuuccagagccuucugagugugaguccaaaugugcccacaccaugguucccaggauggcauuugcauucaaacuguuacccauuaaucugugaaagccugagcuuuagacaaaccugagcugccagaaaggaauuuccagugcauucaggugcuaaugagcaggaaugagaaguccuagcuaacuuccuaggcucuuaggcucuuucccaucuugcuggaacuuccuagcaacuuugggaggcagcccuggcaggaauuuuuauauuuuguuuuacuuugcagcugaguaaacugaagcucagagcucauguauaguggaauuggggcuugacugucaggcaucuaacuugaggccacaaauauccguguaaauguuugacugacuuaccuucaugcuuugagauuauuuuaauacggugaugcuugugaccugugucuguuggggcuuaguuccuuaagaauccugauugaaacaguggccugacacccagcagagauauggguaauguacacacaaggauucccaaaugaccaagaaggaaagcucuguaagggaguauuaauuguuugccuccaggaucaguauucauucuuggaucaaaccccagcuccacuguacaccagccacgugaugcugggugcuuccucaucaucuccacauguccuuuugccaucugcaaggggaggauaguaaccaugacucaucucacagggugaugaugauguguacaugagauauugcagguaaagauggagaugagaagcgugaccaguuauugugacuacaggaugaaggggcuggucuaaccuugagcuugcgaggaaagcagaguaaagaugccugcugacccuggacaaggguuuucugcucagaauuguuuguccacuucagguggguucuucuggcccccugaggcaagugugugcacugccacagcccccuuucugaugcugcauuucuuccucugugaauggagagauucugaauucauugaaugcauuuucaugaugugauacuuuaggccugcguaccaggaaaauaaauggucccaaccacaguuagcuccucgacuugcaggggaaggaugcugaguggaaagucacauugggagguagucggggcuacaaaagggguacaagucaggagagguugagcccagaagggagucucagagaggucaggcugcguaagcagacucgaaauuuugcuauaaaugugagcuuugaaaaaugauaauccugcccugggaggaguaguaaugucuccuucucuuagugauccacaugaaccuccccagccaagaccugcugguccagaaucuaagacaagagaaguucggggaagugaggauaugaggugaaacgaaugagaacuguuuucacgugccugcuugagccagcacgacugcauccugccuucccugagagacacgcugagagacacgcugcuuccaucagccgcucuguggcuguucagcaggauggcguguucagccggggaguggugugucaucaacccaauuuggcagcugaggcaaugaacacagagccaggaccagacgaccugggggcauuuuuacucuugaaaagaacuuagacauugaucaacuuaauaggcucauuucauggaagaaguagaaaugcagaaauugaaaaucuugcccugguucauguagccugugggaauuagaaaccaugauuccaggcuccuggccaccucucuuuccauggagggccccuuguggggauuucuucucuagaaugggcucccucugaccacauuuuguccaugugugaaauccagcaugacugcugaugccuuccaugugugagugguggccgugggcagugccugaugaccucaucugauggacauucuuuuccguccuccuccucaccccucucccauaacccgggugcagaaacauucaggacauuaaacccugggaaccucaauuugagauaagaccucuuauguccugugggucaauaggagugacucaaacguuaugagaagcacauggucgcagggccugugaggaccaccucagcuuggggaugaguccuuaguuaagcuuaugcuugauguugcaaucuugaacagaaaagggggaugagagaggagagaggacaguagagaaagggggaagauuuauuuuaaagaauuauauuuaaggaaucaacucacacgauuguggggauggcaagucugaaaucugcagaucaggccacagacuggagaaccaaggaagagcugauguuggcaucggaguccaaaggcagaauuccuucccaaucuaugcccucacuuuuaacggcagauggucugcaagguugggaauucaauuugcauuguaauucagccacugccaggaugagauccuacuucugguuuucagccaucucagcucugcaucuaugggacauaagggcagacauagaaacuuuugauucauucauguggugcuugagcugggaauuugaaucccugaauucauucuucuuuuuucccccacuuugucuaguacaauuaggagcaaccaaccacucucguuauacuuguuaauuuuacaaaaauguuuaagguaucugcuacacacccaccuagaaccuugccucuuagaagccuuugggaguauuuaauaauauuuucugugucucuauugucccaucaugcccuguacucuccucuuuuuacuacuggacguagaaucauuagugccuuucaacccaaucagaucugagaacgaauuucagaaaccucagaacccauucagaaaacucauuuuuaagaugauguucuucuagaaccacucuugcuacgaaaaccugacagcacaguccccaggcuguuuguuagggucuggcauaaauucuuggaaaggcaaaggagaauggugagagcguguguaacugucugucugucuguccaucccaguugguuuucacugugcuuugguggcugcauauggagcuacagauacugauuucccacaguucccacuuuggauuuguucuccugcuucucguccaugggaaaugacugccagagcugggagcuaucaagcauauuuaaaccgcagccuuccauuuauucuucaugaaugcacacgggccccagacugguuguaaauaagcaccagcucccauccccugcaguucuuggccuuauagagagccugccagaggcuggcuuggucacauccuucaguuuagacuuuaccuggagaagaaaaucacaaaggucuaacgggcacccagauagcaucagcaguguauuuagagaagugcagaagggccaauuaagcccauuucgugguuuauuauuauuagugguaauuauuucuggcaugcaguucaagggugucuguggccuggcugagcuccggaagugcauccacagcacccuccugugaauguuuauagacccaggaggggagcccuggguugggagcuccagaccacuggggaugggaggcagagacucuauguauagaucauacucuuguggagguagaggccuggaacaugauggcuaaacuccugucgcugauucugggcuaagaaagaaagaaaauccaaaagacagcaaggaccucugaaucccugagggaaguugaacagagcaaaguagaaaugaaccacaggauggcuccaucccuccccuggcauccacugccccugccccugaaugucccuaucuuugcuuagcuguggcccagaaguccacucagccuuugucuaaagaggcagguucugcucagcaguggcguugagagcucagaccccauuuuggguuuucuagaggcagaaggccaaguucauucucuugaagugagguagauauuccugugcacagagagaaggggaauccagcuccucauagagcagcuccccaccccaagcugaguuguguuucgcagggagagauaagccuguggucagcagcauucauccccaugguauucaggccacuuuccaagaaccagccccuccuuguacuuaaguuucuagaggcagggccgaggagcaggcacagggagaggaugagcgucggcaaguuacaggaaacucaggaaaauguuuauguguguccagggauuuucagagacuauccagccauucuuuaucuccaagugccucugcucucaugaacuucuucauguggacaaaagcaggaagccuuuagggccacgcaucucuuguuuuccugugacuuacacagcccucaccuuugugcuuagauggacuguggccagcgggaccuccaggccuggcugggucaggagaguuuugcuuaaccagaucuguuugauccuugaaccaaaagcggggagccagagagauccuuugagaacugaugacugcugcuggguccugcccagccauuugcauuuuauaaaggucuuuggcagcggccaaggccuucucauuaugugguguuuuuccacuucgggaugaaccggagugguuugugcagccaccugauagcucuuugcaccagcuucugcaugggagacuuugagcaggccaggagccaaggggacccuccuaggccuuccgagcaccuagcacuggcccuuuucuuccuuggggcuuccuucuggaggagguuucccuggguuuggaguccucccuccugcugggggugggggcgugguugcugguggccuggagugagcugccugcuguggccuccagcacuccccagcugaacagcgaguccuuugugaaauuccugaggcaggagggggcagcugugcagagccagcucucagaguggccgacagggaggguguugugguguaucaucaagugauaaggccuucggaaaggcuguggagaggaaggaaaacacauuccugacugugguguguuugcccuugagggcccuguguuuggggaaguagagaagcuuggcugcauuguuguggggugggaguuagcccugugcuggggggagcuagugagagaugaauucagcugaccugggaucaaauuccagcuuggaugccuuuaauuaauaacauauuagaccauuuaaucaauuuaacacacguuuuuggagugccuacuaugugcaggcagguaaaugaucuucaaggugucuccaucagguggaaagucaaaaauucagaacugggcaaugacuggaggggaggaugggauucucaggugaagggugugagacccgaguuguguuuuggacgauguuaaaggaggagaucagcuuccaguagugaagagcaucugaugcuuuggugaggaggauuuucuuuuaaguccuugaaugcagaagggcuccuuuggaagauuuuaugcaagagaaugccauggaaagauuauauuauaguggaucacucuggaagugucaugcggaaugaauggagagguaggaagcgggguugggagagcaaacguaaaucuaagguccaauugggaggcucuguuggaaugagcuggcgagagaugaugagggccugauuuaaggaacgauuguauugaaggcacuaagguauuggcauucagcgaauguacaugagucucaacuuucugguuuacaucugaauggacagagaagaggacaugaucugagcaucagggaguugauguuugucuuggacauugcauuaauauaguuaggcuaggcuuccagaaacucugaaaucccaguggcauaauguccaguuuguuucucucucacagagucagcugugaagaugguggcuguaacggacagcuucuuccaggcagugacucagggauccaggcugucucuugaggauaucugggggguuauguauuugcccugaaauacuucgcccuggugaugucaugugugauuuccucccgcagaccuuuagucagagcuagacacugugaagggcuaggaauugugaaaagauugugugaaugaacaggaagguuaaauuugaggugccauaggccaugcauaaagaacaguccagauggcaccugggaccggaugccuggacaccauccgagcaggagauuaauggaauugaaaaucagcaacguaggagacagaagccuucaggaugucugggauccuauagggaggguguguuguuugaagagcaggggcugaagguggaaucuuggggagcucaugacaggcuggcagagguacugaauuucuccaagucucaguuuccucaucugcgagaugagccugauauuuccuauaaagggauagugagugcacugggugcugcugggcaggcaguggcuccucauaggggugguucccuucccccugcauuguguuggacugaaccuuguguguucuguuugucaggaacugugguguauggcgagcccaucacugccagcuugggaacggacggcucccauuacuggagcaagaacugggccaaggcugcugccuuugucaccuccccacccuugagcccugauccaaccacuccagacuuucucaacuccuugcuguccuggugaguccuggcgacuuguucacacuucacauucugucuuucuucagaccagacugaccuguuaggcgaaaacaacaugguggccaagagcagccauaaaacugggagacccuuguucaccaaacuagguuggcuacaugaguacagggaauugucauucuagcaccauuuugggaggggauucuggauaaaaaccugggccauguugaaagucaagccaagaagggagaggaggcgucaaaaggacuccacuuggguuggugugaugccauucaugagacagcccaccaaauagguguaggcgcacagcaucuugacgaagcugcagcaccacguuaugcauuuucuuugcaguggagaccuccaggucacgggcagugcccauugcacguuuaacacugcccagaaggcuguaggaaaggacaacuucacccugauuccggagggcaccaauggcacugaggagcggauguccgucaucugggacaaggcugugguaaggagcgauggccucacuccuugguggcucucagccuuccuuguccuccucaucugggggccauggggcucauggaggccuugaaaugacagacaguggaggacauccuagaagccaguacuuauaugacaauauuucugaggguuggaaaucuaagaccucuucuaauaggucauuucuuccuaaauauuacauauauauuucuuuuuaaaacaauuuuuaaauuuuuuucagacaaggucuugcucugucaccaggcuggagugcagugguacaaucauagcucacuguagccucaaacuccugggcucaggugauccucccaucucagucuccugaguagcuaggaccacaggcucagaccaccaugccuggcuaauuuuuuuuuuauuuuuuguggagaugggggucucacuauguugcccaggcuggucucgaguucccggguuuaagcaaugccucggccucccaaagugcugggauuacaggugugagccaccacgccuggcuuaccuguauauuucuuaucauuaucaucaauggaacaguaaagacugaaaaccuacacagcuuuagaugugacucugggucagucaggaacaaacuuccuuagcaaccaggugacuuacucaguuaauccucgucuacucuuggaaaugggcucaauuuccuuaaaagugucuuuuagggcucucuggacuuagcaugucuucuacugccagcuuccaguaggccugcuaugaacauacacugaccuuuagaggaucuuugggcuuuuucauuuuaauguuuuaaaauauauuaacagaauagguuuucuguuuuuuagugaauuguuuagauuauaugaagaauauauccuuauuuccagaagaauaaggaaguaaauaaaagucacuguguuucagauauaaccacaauuaacauuuuggcaaaugucuuuccauuuuuugcuacuacacaggcacacacauguauaugugacaugcgugaguguguaaauaauauuggcaucauacagcugggcccacucccagguucaugccuauaaucccagcauuuugggaggccgaggugggugaauuauuugagcccaggaguucaagaccagucuggcaacauggcaaaacccugucucuacuaaaaauacaaaaauuagugaggcaugguggcaggugccuguagucccagcuacucggugugggggaggcaggaggaucaccugagccuugggagguugaggcugcagugagccaugacugggccacugaacuccagacugggggacacagugagacccuguuucaaaaaauaauaauaauaauaauauuggcaucauacauacuauuuuguagucuuuuuuaaaaaaaauuuuaucauggaaauaucuccaccugcuuaaauauacuugaaaaaguugauuuauaauaacagacucuuccaugugagugcuaaacugggacucauuuauuuauuuauuuauuugagauggagucucacucuggagugcaguggugcgaucucagcucacugcaaccuccgucucccggguucaagcgauucuccugccucagcccccugaguagcugagauuacaggcgugugccaccacacccagcugauuuuuguauuuuuaguagagacaggguuucaccauauuggccaggcuggucucaaacuccugaccucaggugauccaccugccuugaccucccaaagugcuggcauuacagaugugagccaccaugccuggccaggacucacuuauaauucuuuuuuuuuggcugggggagacaguuucacucuuuccccccaggcuggagugcaauggcgugaucuuggcucacugcaacguccgccucccggguucacgcaauucucuugcuucagccuccugaguagcugggauuacaggugccugccaccaugcccggcuaauuuugguauuuuuaguagagacgggguuuugccauguuggccaagcuggucucaaacuccugaccucaggugauccacccaccucagccucccaaagugcugggauuacaggugugagccaccacgcccagccacauuuaugucuuugguugaacauuuauguuguuucugguuuuuuuuuuuuuuuaacuugaaugacauuuuuauaauagacacauucuugauuauguuuguaggagaaauuucuacaaguggcauugcugggucaaaggaugcauauauuuuuaacauuuuugguacauauugucaaaguuccuuccagaaaguuuguacugcuuuauacgccaccaccaauauaugucauuccccagugucuucuaccaccugggugucaucagcaaagauccauuguuugcugauuugauaggugaauuuugugucuuauuguuuuacauuuaauuuauucaauuacugauuagagugaaaauuuuuuccuaugcuuaguggccauuuguacuuuuuucucccucuuaauaccagcuuauuuccuuugaccaguuuuuuacuggauuuagaguggguuugggaggggaagcacuugaggaaaugugauuggcaccuaaaaccagauguggggcggagacuucuagguuggcuagacuagaagaugacaucuggccaggcaugguggcucaugccugaaaucccagcacuuugggagagcgaggugggaggguugcuugagcccaggacuucgagcccagcugggcaacauagugagaucugucucuuaaaaaaaaauuagccugguaugguggugcaugccugucuucccagcuacucaagaggcugaaagaggaggauugcuugagccugagaggccgaggcugcagugagcugugaucacucuacugcacucuagccucaaugacagcaagacccugucucaaaaaaaagauuaaaaaaaaaaaggaagccuagaucuguggcuguauuuuguugaaaaggacagccaauugggccaaaugauauuuccuaaagagggauugccaccccugcaaauuaaacgaauuuuuuuuuguuuugaaauaauuauagauuaagaagcaguugcaaagauaguacagagagaggucccggguacccuucacccaguuucccucaugguuacaucuuauauaaauguagaacaauaucaaaaccaggacacugacagugucacaauguguggguauagcucuaggcuguguggccaccuguggagucaugugaccaucaccacaaucaagaugcaggucuaguccagcauuucagagaccaaccucuugcugcuccuccccuccacccucccuaacccuggaagaacccaucuagccccucaucuguucuccaucucuaccauuuuguuauuuggagaauguuauagaaauggagucauacagugugugaccuuugagacgguuuguguuucacuuggcacaacgcucuugacauccaucuaagcugucguguguaucaauaguuuguuauugaaaaguaacuuuuuaacucguuucugcugugugccuccugugcacaccuaugcugucucccucaggucacugggaagauggaugagaaccaguuuguggcugugaccagcaccaaugcagccaaagucuucaaccuuuacccccggaaaggccgcauugcugugggauccgaugccgaccuggucaucugggaccccgacagcguuaaaaccaucucugccaagacacacaacagcguaagaccuguuaacugugcagaccccauccaaacgaauuacagucacagagacacagacggagggagagccccaggguuucuaaaaagaacuugcugugaugggaaugcgcucgacugaggauguuaugauuugcaauuugcugggaaaagaauaguuauuucauuuucuuuagugaggucaauaagauuguuacucucauaaucauuuuggaauaccacagccucucuaucuauagaccuuuagagccucuaaagugaugucaggaugugcaaagcuuccagaagucaggcaccgcuccauuuucauagguuggcacagcacuucucauggcaguacuuggugcaagggaccucaaugaagcagugagauguccucuccugagaugcccacuggggacuuugauccucuuaagccauuguuuucucaggccaguauccaugcagaaaacuggaugacagccauucuuauuaucuuaaaggaauugauugacugacuucucccuaacagaaguaccccccagccauuugauuguuguuuuaggaucugccgcuuuggguaucucuucccucugggucugggcuuuagagcuuagagauguccucucuuguuaacaggacccagggcaagucuguuaaugucuuacgcuccucagcugagagugagggguucagacgaggucuccaaguguccugugauucugugaggucagcagacauuaagcagaguuguuagacacugccgauuccucacaagcaacaugguauaggcagaaaaacugaaggaauaugcccagagggagagcuuuggaaaagaaaugggccucgggcagaagaguuucgugucaggaacucauuugaaucuugaagacagcucaggccagcaagcacugacaccucccccacacaccacgacagcuuagggcagguuucuggcauuucuccgggacaacccugggacuuugcccugucccaguccucucucauuugcacacacagagguguuugggcugcaaugggcucaggcucagcucuggcuucugccaccugugaggaccagggugguggguguuucucagaagacuguucaagucuguguuuaaagcugucuuucucccucucccaccaccacucacuggcucagccuggcagcgcagccuuaugaucgcgccccuuacagcccagaucaugacuucuuggguguccugacuggcuauuuuauggucagggauccuagggcccugccccaugaaccucccuauucaugugccuguaacuucacauucucauugacucuuucauuugaccuucucaauaaagggacugguauuauuaucccaauuugggaaaauaaauaaacggaggcuuagagagcuuaagugaccagucuaauguuacauagcgauuuugcgguugagccagaauuagaacccaaaauuguucaggacucuucccugccagacugcauaugcagccucuuggucaggcuuagacggggaaaaugcuuccccucucuugcaagguugcuucccccagaggugcuauaaauggcuggcugggcucguuauuuaagacacaaaugaccuagcuggggaacuugcauuuggaguucuuaaccuagaagacgagacagugggaaggagagaagauuugggaagacagauucugcccuccagacauuuucaccccaaccuacccugcuuuuaccuccaggugaccuauggaagaaauguugacuuucaaagcggugcuuuuccauccccaccuguuuuaaagagccagcacuaagcaugugccuguucguucaucuucugggaaaaugcaaccaggagacuuucccugcauaguacaguguuuccuaccaugaggcuaauuagcuuuaguucagagcaucuagcuaacuauuaucgacagcccuguugcuaagccuuugcuuggauuuuccaggcaucuggcccgaugaguaauuuuagggagccuguguggauguagguuaaaaaugucuaugcauggugagugaggaagccucccugcaucaugguuugauggagaguaggcucugaguaucugggaauugugaucugacccuuggacuugucaauguuaagucacugagagucauggggcugguucuuccaucuuuuaaaaaugauagauggccccagaggucuucuaggugcucauuuauaagcaacaagacucaacgcaugcauugugugagaucuuggaugcugcagggcuggcaaguguuagcaaagugcaauaaagagccagacagugaaugagugaagauuuucuaaaugccuacugugagccaaauagugagcuagaugcuuuuguucauuuuauuucauuugauucucacaugaguccugcaaagggggaccuacuuaccccucacagaugaggagguggaggcucaggggugugagggaugcauccaaagucacauagcuggugaauggcauaccuggggugugaacccagggcagaugucuccauggccgaggcugcgcccauacucuacccaguagggcacaagaggagguugucagggcauaaacuguuagcuguggagugauguggaagagauggcucuugauccaggccuuaaaggaugacucacacccuuucaaagguuguuucugagaugaccagggaugaggcuuuuuguauugucaucuucacauacaccucgggagggugcagaugaagaaacugaagcugagacaggauuaaagcaaucuccccagagucacacaacuucuggauuuuaccguaucugagaugccaucgauuuuaagauauuccauuagguuauguaccacgaugaaagaaaacaugcccaagacgaggagucucauaggagacugggccaccaagggccagcgugugcuuauuauggcaucucuggggagaccaucugcugugcagacagggguggcagaaaaucucgcaggccucgaccuuggcauugguugccaagagggaaaaaugucucccccaagaauuggaacuggaagugggugcuuguccagccuuguggucugaaugcaugccgccugugugguccagaacaaugucaagcugagaauuuacuguaaaaugcccucagugggguugucccccaacccaguggcacaaacaaacccauaucccccuagaagaacuuggauuuagucuaggcuggcaguacccgcguggcuccggcugcuauaagacacauucugacuucagggaugagugucuuagaauugaugaaagacaauuuuaagucuugggucucaguaauccaagugcagaguccucuucccucccugcuggcgccucucugcuaugguuccuuugguagcuucugcaugacugcuuugagacucagagcaauguacugacagcccucgugguuguuuucacccaacauuguaugcggggcauugugcauuuacaugccugaugugagcugcugagcuggccgaauccguguuaccagccgcugcacuaagcagaaaugucaucuugaacugcagggugcuagcacagcucucuguucagaggccagcucccugagugcugauaaccuggucugaacuuucccagaagcccagggugcuuuuuaugguuggagcaaccuauuaauccucuaguccagacucagccacagccauugguccccgugaaccaaacaggcaggaagaagcgggaggcauuugggaucugggaaguagcacuggguuagcagaagcugcaggauggaaugacuccugugcaaugacuccuguguucuguugcuucauuaccaaccacaaacucacauccauauggagaccccaccuauuuuccaagagggcacacagauaugucucuguuuuacccggaaaaacuugaaaccagaaggauagcuacauagcuacauuguucuggaaauuaacuagcccucaaucauuuuaucggaggcaugucucuucagugaccacaauccuuucauuuagggacuucaguuuaaccacaccgcaaacagacuagaaaaccaggcuagccagugggaaaaccuacuuguggauggcucauuucaagauuaaauuuagaacuuggucagagaaggccuuuggaauucaaccggaauggagcuggagauggugggaacacagucucuguuaauaggaagaaucauuuucuuuauauuuguguagcauuuacaaacaugcacccuuuucacacaauuauucuguuuaauuauuuuucuuucuaauguggagagguagaaaaaguuauuucauauucuagacagggaaauggagacacagcaaguaagugccugcuggggugcccaguugggacaggaucccugucucugagucucucuuuugucucugugggguuggggcagugggugcugccggguggauugaguccagccagaguggccuguucuagaguuuacuuugccuucuucucagucucucgaguacaacaucuuugaaggcauggagugccgcggcuccccacugguggucaucagccaggggaagauuguccuggaggacggcacccugcaugucaccgaaggcucuggacgcuacauuccccggaagcccuucccugauuuuguuuacaagcguaucaaggcaaggagcagggugaguaguuuuguucugaugaauuuuuuguuaaaucacgaauuaaguucaaggccacaaacauuuauuaagcaccuugagacagaauauuaagaugaauuuaguggauuccagggauaagagggagccugaauuuuuuauuccuggcauuuaaaauacuggagaaggagucagucguguccacagagagcccuagcaaagugagaucaugguauaugcuaugauaaggaguguggaguaaggacccagaggagggagccacugcuguaguuggggagagugucauggggagaggacauuuugaguugggcuuugaagguuaaguaggaguuugucaagucaaagaagggagaugagggaauuugauaagaguaucaugagcauagaaaauguacaguguauucagggcaugugaagcaggaaagagauggagcuauaagggaauuaaaaggagagaaugcaauuggaaagaaaguuuggggccagaucuugaacaugauaccagauccgccucacagcaugcuuaggggauucuuacaggguuuaaaguugaagugucuugggggaaaaauuguaagguguguuaguuuuuguagaguuaaccaguuacuggaccuuguggggaguuuuggccuggcauggugggagcuggccccacacaacaccuguccaccugucuguaaggagagcccuccaucccuagaucucacaggcccauccucccuccaggaggguuucuagagagguauccucuguggcuguggccugagcuggggggacucuuguguuuugcagcuggcugagcugagagggguuccucguggccuguaugacggaccugugugugaagugucugugacgcccaagacagucacuccagccuccucggccaagacgucuccugccaagcagcaggccccaccuguccggaaccugcaccagucuggauucaguuugucugguaggguuggggcuuggggagggcacaguucugcagggccagcucgcuggugcuggcgaggcuacaguugcauuuggaaaggacacagaaauagaagugaaugauauucccuuucucuccaacgugagaaauacaguggacucagaucucuggagauguauuuucuuuuucuuuuuuuugaggcagggucucgcucuguuacccagacuggagugcaauggcacgaccuuggcucacugcaaccuccaccuccugguucaagugauucucaugucucagccucccaaguagcugggauuacaggcaugcaccaccauaccuggcuaauuuuuguauuuuuaguagagacggaguaucaccauguuggccaggcugauagaacuccugacuucaggugaucugcccgccucggccucccaaagugcugggauuacaggugugagccaccgggcccagccuagcuuggccuggagauguauuuucauaguuaaugacugguuggguuucagaaucuugagaucaguuugugucacacaaugcccauacuguguuuuaccuaauauauuaagaagacauuuguucaauuuauuagguccaucauaagaaaggacacugugguauuucaggacuucucuucucuccuacaguauauuguaguuuagcuuguggaguuuggaguuucaacagccuaacuucagggcucagcucuggcugugcuucagucuccucaccuguauaauggcaauaauaguaguugcucccccgugagguuguugugaggguuaaauggguuaauauauauguacagugcuuagaauggggccauuugagaacuguuaguuguauuugcuuggguaauuugugugauauccccuuggugagaggaaaggguucagauuuuuaaguuuccuugcuugaaacuucuuucccaucuuucauuugucccaugacuagaacauuccacucuuccagcucccugggccacagauuccuauggcguauuaaagaaauuguuaaaccagagagaauuuuuuuucuuggugguuguauggguuuuuagaaaguaaccuaugucccauauauggauuaccaguuuucaaaacauuuaaaaauaaggaacuuuacuuuguuguaaguaaaacguguauaaucaugucuguguuuucugaucucucaaagcuguuccaauauaaggugccaucguuccuccuacuugugauuauauguguaggauuaggggauuagaaugccagaagagggcuauguccucagaaaagccacagccaauuugacuaaucagaacaggggacaggacagagucuaagauguagugauauuuuguauauaguuuuacuuucuccaguaauagauccaacaaccuuuauacagugucugauucuuugguuaccuuaggcucaucuccuuuuuaaaaaguuuauuuuuauuuuuagagauauaauaguaucucacugugucacccaguacccaggcuagagugcaguggugcaaucacagcucacugcagccucgaccuccugggcucaagugauccucccagcucagccuccccaguagcugguacuacaggcuugcaccaucacgccuggcuaauuuuuuaauuuuuuuuuuuuguagagauaggcucucacuguguugcccagacuguucucaaacuccuggacucaagcaaucuucucaccucagccucuccaagugcuguuaguaggauuccaggcaugagccaccaugccugcucuccaccucccuucuguagucuaaacuucagugagguuuuaagagaagaacaaagaaugugaggccgggcaggguggcucacaccucuuaucccagcacuuugggaggcagagguaggaggauugcuugagcccaggaguuugagaccagcgucagcaacauagcgaaaccccucuuuacaaaaaauuuaaaaauuagcuagguaugggggccuguggcuguggucccagcuucuugagggggccgagugggaggauggcuuaagcccaggagauugaggcuguggugagcuaugauggugccauagcacuuuggucuggaaaacagagcaagacgcugucuccaaaaaaaaagaaugcgacuagcacuuuuccuccugagcugugagauuucaccuucaagcaggaucuugugugacuguccuggccccucacccgcuccucucuucuccucucccuccaggugcucagauugaugacaacauuccccgccgcaccacccagcguaucguggcgccccccgguggccgugccaacaucaccagccugggcuagagcuccugggcugugccguccacuggggacuggggaugggacaccugaggacauucugagacuucuuucuuccuuccuuuuuuuuuuuuuguuuuuuuuuuuaagagccugugauaguuacuguggagcagccaguucauggggucccccuuggggccccacaccccgucucucaccaagaguuacugauuuugcucauccacuucccuacacaucuauggguaucacacccaagacuacccaccaagcucauacagggaaccacacccaacacuuagacaugcgaacaagcagcccccagcgagggucuccuucgccuucaaccuccuagugucuguuagcaucuuccuuuucauggggggagggaagauaaagugaauugcccagagcugccuuuuucuuuucuuuuuaaaaauuuuaagaaguuuucuuuguggggcuggggaggggccggggucagggagagucuuuuuuuuuuuuuuuuuuaaauacuaaauuggaacauuuaauuccauauuaauacaagggguuugaacuggacauccuaaugaugcaauuacgucaucacccagcugauuccgggugguuggcaaacucaucgugucuguccugagaggcuccacaaugcccacccgcaucgccauucuguagucuucagggucagcuguugauaaaggggcaggcuugcguuauuggccuagauuuugcugcagauuaaauccuuugaggauucucuucucuuuuaccauuuuucugcgugcucucacucucucuuucucucucuagcuuuuuaauucaugaauauuuucgugucugucucucucucucucuguguuuccuccagcccuugucucggagacgguguuuuccucccuugccccauuaucuuuucaccucccaggucuaccauuucaugguggucguuggguccgccuaaaggauuugagcguuugccauugcaagcauagugcugugucauccugguccauguaggacuggugcuaaccaccugccaucaugaggaugugugcuagagugugggacccuggccaagugcaggaaugggccaugccgucucacccacaguaucacacguggaaccgcagacagggcccagaagcuuuagagguaugaggcugcagaaccggagagauuuuccucugugcagugcucucuggcuaaagucacggucaaaccuaaacaccgagccucauuaacccaagugaaccaaccaaagucaccaguucagaagugcuaagcuaauaggagucugacccgagggccugcugcuuccugguuaaguaucuuuugagauucuagaacacaugggagcuuuuuauuuucggggaaaaaccguauuuuuuucuuguccaauuauuucuaaagacacacuacauagaaagaggcccuauaaacucaaaaagucauugggaaacuuaaagucuauucuacuuugcaagaggagaaauguguuuuaugaacgauagaucacaucagaacuccuguggggaggaaaccuuauaaauuaaacacauggcccccuuagagaccacaggugaugucugucuccauccuucccucuccuuuucugucaccuuucccccuagcuggcuccuuuggaccuaccccuguccuugcugacuuguguugcauuguauuccaaacguguuuacagguucucuuaagcaauguuguauuugcaggcuuuucugaauaccaaaucugcuuuuuguaaagcguaaaaacaucacaaaguaggucauuccaucaccacccuugucucucuacacauuuugccuuuggggaucugguugggguuuuggguuuuuuguuguuguuguuuauuuguuauuuuaaagguaaauugcacuuuuaaaaaaauaauugguugacuuaauauauuugcuuuuuuucucaccugcacuuagaggaaauuugaacaaguuggaaaaaaacaauuuuuguuucaauucuaagaaacacuugcagcucuaguauucacuugagucuuccuguuuuuccuguaccgggucaugguaauuuuugguuguuuugguuguuuucuuaaaaaacaaguuaaaaccugacgauuucugcaggcuguguaagcauguuuaccuguuggcuugcuuugugugucuguuaaaugaaugucauauguaaaugcuaaaauaaaucgacagugucucagaacugaauaacugcagugacuugaugcucuaaaacaguguaggauuuaagaauagaugguuuuuaauccuggaaauugugauugugacccaugaguggaggaacuuucaguucuaaagcugauaaaguguguagccagaagaguacuuuuuuuuuuguaaccacugucuugauggcaaaauaauuaugguaaaaaacaagucucguguuuauuauuccuuaagaacucuguguuauauuaccauggaacgccuaauaaagcaaaaugugguuguuucagg
